United States Patent 7,745,391 (HUMAN THROMBOSPONDIN POLYPEPTIDE) - sequence listing, part 42

SEQ ID NO: 102161 - DNA, 371 bp, Homo sapiens
gggggatggggtgctggagtcagagagtagttgctgggctggagatttcagaagtcatgacattctgggtgcagctttactgctctaagaaggaatgggagtgttggcattggaagggaagactgagcacattcagagtgatttgaaatatggcatggtcaggagggcagtaggtgtgagcagtagagggaggggcttgtgtctctaggggaatgaaagtaacatgctgtggtgttggggagactggcctgggagcagcatggaggaactttagggttggtacaggatgaggctggggcatgattagcctccttttcagagggcctcaggaaaaggcagtgtgcacagaaagccaggctacttgttggagg

SEQ ID NO: 102162 - DNA, 415 bp, Homo sapiens
ccaacactttgggaggttgagacgagtggatcatttgagctcaggagttcaagacgggcctgggcaacatggtgaaacactgtctctccaaaaatacaaaaattagctgggtgtggtgatgaatgcctgtagtcccagctacttgggaggctgaggtgggaggatgacttgggccggagaggcagaggttgcagtgaggcaagattgtgccattgcactccagcctgagttatagagccagaccttgtcttaaataaataaacagacttcttaaacttagcatccttctaaagaataatttatcaaaatacagatttgttgttttaaagtatacattaacatgcataattattaaaattactatgtccttttaactacctaaaaacatctttaataccagtgacacatactctta

SEQ ID NO: 102163 - DNA, 540 bp, Homo sapiens
aaattatcttttatatctccaacattgagtctctttatatgtaatattccttattttattatagtattaccttttctaaaacagccatttattgttatcttttatttcagcacttcatagtgtttgatcactttggctaaaatttttttttttgttttttacaaattttattgatcttttcaaataactagcttttggcttcattgagtcttctctttttgttcattttaaattttattgatttgtactctttattattcctttccttgtatctaatatatattaatttgctattcttttccccatttcttaggattaaagtctgaatgatttattttagaccttttttctttttctaatttaagcatttaaagcaacagaattccctgtaagctctgcttttgtagtattcaagataatttttcttgctgttttgggtgttgtgattttttattgaatcatctgaggaccagtatagactgaagtaaataatatttatgggccgagtttgtcagctcacgcctgtaatcccagcacttt

SEQ ID NO: 102164 - DNA, 577 bp, Homo sapiens
ccatttcagagcacacactccctggcagggcgcctctgcctgtgtctcctgcccagcagccgccagcagggaatagttgctggtgtctgagcacaaagagagctttgattacctagagaggaaaaaggctgtcagccagatgcagccaggcccaggggtagatacaggagttgctaaggaaggggccgagccaggagaggccaggcagatccacaaagcccaaggggatgcaggctgggtgtggtttctgagggaacctaccaaatagcaggtagatggaatcagaggactcttgtgtcctgaaagaacctccttaaaaacaactaaaacgaagaacttctggggctgttcacacattgttcaagtcaccccaagatcgttctggcacgctgagctgaacaccaccatctttgttcattctctctctaatgggcaaagcaggatcatcgagttgaaaagttgtaaataatgaggatatttatcccgctatttattttttcaataactgtgacctcctgcactgtgaatgctctgtgacatgagattcttagtttaataaaactgtcattaaatttga

SEQ ID NO: 102165 - DNA, 185 bp, Homo sapiens
gcagatcaaatagaaatatgattcatgcttcacaatttgtgtagccaatatcatagatatttggtagttctattatgtatctgacaggtacatatatttttttcctctaagagattgttctgtgtgaatagatagaaactacttaaatacagtaaagtctatttattacagaccaagagcaaaca

SEQ ID NO: 102166 - DNA, 697 bp, Homo sapiens
gccttattgaaggcattggaccgtcgctcaccccagggccccccaccatctgtccagcctgtaggcacaactggccatttgtaaagtcacttcagccaagttttcatttgggagctacccaagggcacccatgagctcctatcaagaagtgatcaacgtgaccccttttcacagattgaaaggtgtaatcacactgctgcttggataactgggtactttgatcttagatttgatcttaaaatcactttgggactgggatcccttgctgattgacaaacagactttctgggaccttgatggagtggggaacaagcagtagagtgggactgggggagacccaggccccgggctgagcactgtgaggcctggatgtgaagactcagcccagcgaagctcattcccttacccccggccagtgctgctgcttcagtggaagagatgaagccaaaggacagaatgaaaatccctaccttcagagactctagcccagcccaacaccatctcttcctacctctcagccttctccctccccagggccacttgttgaagtctgagcactttatgtaaatttctaggtgtgagccgtgatcacattttctatttatttccaagtcttctcattgtatggaacatagtactacttatacttacagtagtaagttatacttgtgagcccacagagtggcagacagcatgg

SEQ ID NO: 102167 - DNA, 185 bp, Homo sapiens
tgactccagggataggatttcagctgttccctcttacagatgaggaagtaaaggctccaagagggtgctggccttgctgagtgccgggatggaccatgatcctctggcagtctgggcctgtcttctgcagacccctctgcagcagccttgacattgcgctgtgcgcttctgtcaaaccctctgca

SEQ ID NO: 102168 - DNA, 679 bp, Homo sapiens
catcagtgttgcgggaagtcagggaccctgaacggagggacctgctgaaaccacggcagaagaacataaattgtgaagatttcatggacatttgttagttccccaaattaatacttttataatttcttatgcctgtctttactgcagtctctgaacataaattgtgaagatttcatgaacatttatcacttccccaatcaatactcttataatttcctatgcctgtctttactttaatcttttaattccgtcatctccgtaagctgaggatgtatatcgcctcaggaccctgtgatgattgcgttatctgcacaaattgtttgtaaaacatgtgtgtttgaacaatatgaaatctgagcaccttgaaaagaacaggataacagtgattttcagggaataagggagataaccataaagtctgactgcctgtggggcctggcagaacagagtcatatttctcttctttcagaaagcgaataggagaaatgtcgctgaattcttttctcagcaaggaataaccctgggaaaacgaatgcattcccaggggtaggtctctaaaatggctgctctgggagtgtctgtcttatgcagttgtagacatgggatgaaatatgccctggcctcctgcagcacccccaggcttgctaggattaggaaattccagcctggttgtctgctc

SEQ ID NO: 102169 - DNA, 435 bp, Homo sapiens
tatttccccattttacagccaagaaaattaagatagtgtcaaattctcattatgtaccaggccactgtgctatataaactttacatgcatcaccttatttaattctcataatagccttacgagggaggcactgaggcttagagggatgaggagatctgcccaagctagtgagagaaggagctggggtgaacacttacacttttcaccctagatcttaatcgttgtctaacaccgtctccttccactttgtgatacctagccataatccaactgctcagagatgggcagtgcagtgaatgctcttataccctgcccagatatcctttctgagggaccccttacagccatgagagaaggatgctacgggctatatatgcccttctctggggaccagcccctgcccagaaatgcctgcgaagctaagccctccatctc

SEQ ID NO: 102170 - DNA, 714 bp, Homo sapiens
gcataaatggtctctattctccaattagtcatttttaataatacccagagttgctttcagagtgttgattcttagagcctgatgccaaaaaacagggatggtggtaatgggggacaggaacggggtcagggtgggggcggtaaggaggctgaattccttcagtgtggggttttcctgcagggcctccctgctgcaacccccttggaagctggcagctctccaccacctttcaagctgtccagaaactccaggcgctgtggccccaggtgtatttggtaaatgaccatctagtggtaaaaagaattcttgtggtaaaatgattacttaaaggatccatgtgaaaaagagtttgtaggtccaggcatagtggatcacatctgtaatcccaacactttgagaggccaaggcaagaggatcacttgagctggggagtttgagaccagcctgggcaacacagcgagacccctatctctagaatttttttttttaattatttggggatggtggagtgcacctgtagttctgctactcaggaggtcaaggaaggaggatcacttgaggccaggagttcaagaccagcctgggcaacatagtgagaccccatccctactaaaaatacaaaaattatctaggcgtggtggcatgtgcctgtagtccaagctactcaggaggatcgcttgagcccaggagtttgaggctacagtaagtgatgat

SEQ ID NO: 102171 - DNA, 399 bp, Homo sapiens
gctccaaactttatgagtgaggtggaggaggtataataggcaagggattgtaagagggagtagccaggaaggtaggaagcaaaccagaagggtggtggtgaggaaggcaagagaaggttctgtttcacagagagggaggaggtcacaatttcagatgtggaagggtcaacgaagataaggatgaaaaatgttcatcatttagctctcacatagaggggaacaatacatactggggcgtttcagagagtgaagggtggaaggagggggaagatgaggaaaaacaactaatgggtactaaagttaatacctgattgatgaaatcgtctgtacaacaaacccccatgatacaagcttacctatgtggcaaacctgcacttgtacccctgaacttaaaagtta

SEQ ID NO: 102172 - DNA, 179 bp, Homo sapiens
taagagggcactgggtgtctggaacaggggcagaaaacgttggggcccccatacttctagtcacttagattctccctctagacctacgttttcttgtcagcaagatcaggataaaagtattattgcctgtccatggggtgattgtaggtaacagagagtaatgaaatgatatcaccaat

SEQ ID NO: 102173 - DNA, 186 bp, Homo sapiens
tttttgtttttaacgcatttcacatgaattagtttttttctcttcaaaaattaaaaatttcacatttcccacgtgatttttcttagtgtttcagtatgtcatttgtcatctaaacaaattttctgttacttgaaagtttactgtaacttctttttaaaagctacattggcaacacatttcaaaaaa

SEQ ID NO: 102174 - DNA, 827 bp, Homo sapiens
agtagaaataagttctagtgttcagtagtgtagtaggatgactgtagttaacaatttattgtatatttcaaaatagctaagagggaagatttgaaattttcccagcacaaagaaataatacatgtttgaggtggtggatactctaaacactctgatttgatcataacacattgtatccatgtatcaaaatatcacatgtaccccataaatatgtacaattatgtattaataaaaaagattaaggatgcaatataaaaaatggattatggtgaagagagatttgagacagggaggcctcattactaaggaagattatgcagtaatccaggtgagattagggggtgaattaatgcattggtaggatatttcatgaggttgggtatgtgccttattcattctacgtagcaggagtccatgatgtatttatttggattaactgatagcatggagggggcaaagatcaatatatgttatattttataacatatctgagatacatttaattgaagctggtgcatatatattctttctactcattgtgaagtttctagaaataataatctacttttgcttactgacttcacttccttgcttgtttctgtcttgaaagtcagccaattgatggctgggtgcagtggctcacacctgcaatcctagtacattgggaggtcaggagggcggatcccttgagtttaggagtttgagaccagcctgggcaacatggcgaaaccctgtctgtaccaaaattacaaaaattagctggacacggtggtgtgcacctgtggtccggctacttgggaggctgaggtgggaggactgcttgaacc

SEQ ID NO: 102175 - DNA, 743 bp, Homo sapiens
agacgcataactgtgcattgttctttgggattttgagagccttcatctcaatttcaactttaaagcagcttaatctttaaggaacatatctctgatctgggtaatttgtagaacttaatttgagggtcattacatgtgaggatagcaggagttgaagatgccaaggacctgaagggctactggagggacaggtgaagtgatttgaagatgtagcattttgaatctctttctggcccatcctctgcttcacaccagaatcattgtgacctgtagacctgcaaaacaaaggaccaaaggttagcatgcagaagtgaaagtgtcaataataaccaaaccactccatcaagttaggtctggggaaaagcagcagcaaaaatgagttcttacttctgggcacaaaatgaaagtaacagacctgatttactctgcgggcagccagctgactaccttgttgaagagaaacatttcacaacgcttgtatgcttcattgttgttttgggagggcttttgaagatgtgtttaaagaattgtgaagtcattgttttgacgattctttctctatcaggattcgtgataggacacatggcctacaattctgttgaggtgcaccaaattgtctaccctcttctaagaacatcaagtttttcactttattcttacttttcacctttaattatatttatggttgctttggatgtagaattttatacactcaagaaaatgttttggcaggtaagaacaca

SEQ ID NO: 102176 - DNA, 785 bp, Homo sapiens
gtatagaaacacaacattcttaattttattcaccaataatcaggacctacagaaccacacagcacagatggatcgatttctgcctccatgaattttaaattgccttttgcaacattcctctggctcagatgagctagtgttccacaatatgctggctcgtgaaatccaagcaactgtgccttcctctacacttcttcactcagcctcagccttaaattgcacactgcctataaaaatgtacttaaaagaaaaatgaagttactctaaaatgccatatgcaacaaaacagcttattcttgtagatggggctgccactggtggggtgcacctgcatttgttttgctcttacagcatgcccagagcccagcagccctccagcatcacaccgaaggaagcagcccaggaaaagaagggaatgtgttcacgtgacgtgactttaaggattgatttaaatggtgacatggttacgctttgcgtccccacccatatcgcatcctgaattataatccccataattcccatgtgtcaagggagagaccaggtggaggtgactggattatgggggcggtttcccccatgctgttctcgtgatagtgagttctcaagagagctgatggttttataaatatttggtaggttctcctgcattcattctccttcctgccaccttgagaagaaggtgccttgcttccccttcaaccatgattgtaagtttcctgagacctccccagccacagtgaactgtgagtcaattaaacctctttcctctataaattaccaagtcc

SEQ ID NO: 102177 - DNA, 390 bp, Homo sapiens
ttttttcagaaccactgactgcctacagacacagaaaccaaattgtctgggcttgaattcagtgccacgacttgggaaagtcattgaattatgcgtgtgtcttgatttccccattgtacaatggtaataatagtaatcctactgttgggactgatgagagggattcagtttatatgagtatacttagaacagtgacttctaatgtacttagatcagtgacttccacaaaatatgctgtaattagtgttatatattatttttacttgttgttgttattcatgtctctttcattctaggcccattccagagccatcattcttgaatacttttcttggcattcctagaacaactgcactattgcacatgttcctcttagtttctcccatcatg

SEQ ID NO: 102178 - DNA, 345 bp, Homo sapiens
gaaaatgaggacgaggcgggaactagagcccaagggccccaagccaaccgccccttctgccgtgggcccaaacagcaacggcagccaacacccagcaactgtgaccttcagtcctgtgacgtccaggtggagacgcgatgacctctaccctggcgctatctccaccactgtccaaagagcctctccagagtcaagacccagaggcacactctctggcagcttcacaatgagcttcttctggtcaggtcgacagagacatctttgacgcaatctctgatgcttccagcaatcctcaaccttgtctgccctgccctaccccaactgtgtccacatccctgccgccac

SEQ ID NO: 102179 - DNA, 649 bp, Homo sapiens
tgtaaggcttgacagaaggtcaagacctttaggaaatgcataacttcccttggctgatctagagacagatgtattttaacctgcatggaaaactcctcactgcacttaagaccagagcctggcagtattgagggcatgaaactggttttccagatgtctctcagtgcctggctgcatcagaacacgtgcggatcttttgaaaagcatggactcgagtcctttccttggagattcaggttcagtccatttgggtgagacctgggaatccactgtctgaaagcttcccaggtgatgctgtgtggctgtgttggggttttgttttgtagttgacttctctctctccatacctgcacgcatatatacacgcatgcccttatatgtgaggagagtatttttgaaggtcatacaaggccctagcaacagtggtttcctctgggcagtggaatggggtgggtggcttgaagtgcttttcactctgtatccttttctgctgttttaagtcttttaccaggttggaatcttttaagggggaaaaatgatattagcctatactagttttccaggatgtgaatgaagagaagggggaaatagtgatagagcacgatatctgttatttagataacagatagagaaatatctacttgtgtgg

SEQ ID NO: 102180 - DNA, 567 bp, Homo sapiens
ctgttgccggccacgtgttcacactgagcgcctgaaagcgcacccagccatatcagtgtgtgccgtatacccggagggcacacagcgtttctaaggctgggttcaaaagaaatgaatgtaaaggacctcgtcagtaccttttagcattgattacattgtggaaatgacaatattttgcatatattggattagataaaatactattaaaataaatggcactggtttctttcttacatttttcaatgtggctagtagcaaattgaaaattcccggccaggcaaagtggctcacacctgtaattctagcactttgggaggccgaggtcagtggatcacttcatctcaggagtttgagaccagcctgggcaacatggtaaaaccccattatctaccaaaaaaaaaaaaattagtcgggcatggtggtgtgtacctgtagtcccggctacttcggtggctgaggtggtaggattgcttgagcacaggcggtggaggttgcagtgagctgagattgcaccagtgccctccagcctggcagcgtgggtgacagagtgagacctgtctaagaaaa

SEQ ID NO: 102181 - DNA, 363 bp, Homo sapiens
tttatgcagcctacagatttattgtgtaagtaccaaaattgctaattcacatcagttgctttgttagaaattgacatctctgaggccaggtgcagtggctcatgcagtcccagaactttgggaggccaagacaggaagagtgcttgagcccaggagtttgagaccagcctgggcaatgtggtgaaactcccatctccacaaaaaattaaaaaaaaattagctggatgtggtgacatacatctgtggtctcagctatttgggaggctgagatgggaggatcacctgagcccaggaggctgagactgcaatgagccgtggtcatgccactgcactccagcctgggtgacagcaagattctgtctc

SEQ ID NO: 102182 - DNA, 591 bp, Homo sapiens
tatactgttgtgcggcggagaattttgacgtgaataagtatctcggaagatggtacgaaattgagaagatcccaacaacctttgagaatggacgctgcatccaggccaactactcactaatggaaaacggaaagatcaaagtgttaaaccaggagttgagagctgatggaactgtgaatcaaatcgaaggtgaagccaccccagttaacctcacagagcctgccaagctggaagttaagttttcctggtttatgccatcggcaccgtactggatcctggccaccgactatgagaactatgccctcgtgtattcctgtacctgcatcatccaactttttcacgtggattttgcttggatcttggcaagaaaccctaatctccctccagaaacagtggactctctaaaaaatatcctgacttctaataacattgatgtcaagaaaatgacggtcacagaccaggtgaactgccccaagctctcgtaaccaggttctacagggaggctgcacccactccatgttacttctgcttcgctttcccctaccccacccccacccctatccgctatccaatggggatcctctaggtcac

SEQ ID NO: 102183 - DNA, 333 bp, Homo sapiens
  misc_feature (46)..(46): n is a, c, g, or t
  misc_feature (67)..(67): n is a, c, g, or t
  misc_feature (136)..(140): n is a, c, g, or t
  misc_feature (153)..(154): n is a, c, g, or t
ctttcagttttaattttattagtgacaaggtaaataggtacatganaatcttcacagatatctacgnacgtatttaaataaaacaagagtcgagttctaagaatgcagtttcaggggtgactagtacatattattnnnnnatttactgtatannttttccaagtttatccgcgccataaagacaaaccaatcaaccacgacaaaggaagttgacctaaacatgtaaccatgccctaccctgttaccttgctagctgcaaaataaaggagatggcgggcctgaagtacgaaattcgtgtaaatacgtgatgtactggattagaatgaaattaga

SEQ ID NO: 102184 - DNA, 1086 bp, Homo sapiens
aaaaccatagggctagggaagcgaggctgggtgtcgatctcaaatcggctgattctgcatctggaaactgccttcatcttgaaagaaaagctccaggtcccttctccagccacccagccccaagatggtgatgctgctgctgctgctttccgcactggctggcctcttcggtgcggcagagggacaagcatttcatcttgggaagtgccccaatcctccggtgcaggagaattttgacgtgaataagtatctcggaagatggtacgaaattgagaagatcccaacaacctttgagaatggacgctgcatccaggccaactactcactaatggaaaacggaaagatcaaagtgttaaaccaggagttgagagctgatggaactgtgaatcaaatcgaaggtgaagccaccccagttaacctcacagagcctgccaagctggaagttaagttttcctggtttatgccatcggcaccgtactggatcctggccaccgactatgagaactatgccctcgtgtattcctgtacctgcatcatccaactttttcacgtggattttgcttggatcttggcaagaaaccctaatctccctccagaaacagtggactctctaaaaaatatcctgacttctaataacattgatgtcaagaaaatgacggtcacagaccaggtgaactgccccaagctctcgtaaccaggttctacagggaggctgcacccactccatgttacttctgcttcgctttcccctaccccaccccccgccataaagacaaaccaatcaaccacgacaaaggaagttgacctaaacatgtaaccatgccctaccctgttaccttgctagctgcaaaataaacttgttgctgacctgctgtgctcgcagtagattccaaaaaaaaaaaatcaaccttatttaaaatcataaccagcactatctctcaacttgaatatcacttcgactttacctatttggcttcctcattgcccttccgtccttaactcacattttgaagggtggtccccttctgcaatatacctattttggggggggtccccgccccctatcccctctttttaaatctctaa

SEQ ID NO: 102185 - DNA, 1201 bp, Homo sapiens
gagcatgggcttaggtacaggctgggtgatctcaaatcggctgattctgcatctggaaactgccttcatcttgaaagaaaagatggagtttttgctctgttgcccaagctagagtgcaatggtgtgatcttggcttactgcaacctctgcctcccatgttcaagcaattatcctgcatcagcctcccgagtagctgtgattacagctccaggtcccttctccagccacccagccccaagatggtgatgctgctgctgctgctttccgcactggctggcctcttcggtgcggcagagggacaagcatttcatcttgggaagtgccccaatcctccggtgcaggagaattttgacgtgaataagtatctcggaagatggtacgaaattgagaagatcccaacaacctttgagaatggacgctgcatccaggccaactactcactaatggaaaacggaaagatcaaagtgttaaaccaggagttgagagctgatggaactgtgaatcaaatcgaaggtgaagccaccccagttaacctcacagagcctgccaagctggaagttaagttttcctggtttatgccatcggcaccgtactggatcctggccaccgactatgagaactatgccctcgtgtattcctgtacctgcatcatccaactttttcacgtggattttgcttggatcttggcaagaaaccctaatctccctccagaaacagtggactctctaaaaaatatcctgacttctaataacattgatgtcaagaaaatgacggtcacagaccaggtgaactgccccaagctctcgtaaccaggttctacagggaggctgcacccactccatgttacttctgcttcgctttcccctaccccaccccccgccataaagacaaaccaatcaaccacgacaaaggaagttgacctaaacatgtaaccatgccctaccctgttaccttgctagctgcaaaataaacttgttgctgacctgctgtgctcgcagtagattccaaaaaaaaaaaatcaaccttatttaaaatcataaccagcactatctctcaacttgaatatcacttcgactttacctatttggcttcctcattgcccttccgtccttaactcacattttgaagggtggtccccttctgcaatatacctattttggggggggtccccgccccctatcccctctttttaaatctctaa

SEQ ID NO: 102186 - DNA, 1056 bp, Homo sapiens
  misc_feature (1021)..(1021): n is a, c, g, or t
agctgtgaaggaaatcgggggaggaggatggacacaacatcccatctttgtgtttcgatacagactaagcttttaggccaaccctcctgactggatgggggcggcgggcgtggcatgcatgaaaagtaaacatcagagacctgaagaagcttataaaatagcttgggagaggccagtcaccaagacaggcatctcaaatcggctgattctgcatctggaaactgccttcatcttgaaagaaaagctccaggtcccttctccagccacccagccccaagatggtgatgctgctgctgctgctttccgcactggctggcctcttcggtgcggcagagggacaagcatttcatcttgggaagtgccccaatcctccggtgcaggagaattttgacgtgaataagtatctcggaagatggtacgaaattgagaagatcccaacaacctttgagaatggacgctgcatccaggccaactactcactaatggaaaacggaaagatcaaagtgttaaaccaggagttgagagctgatggaactgtgaatcaaatcgaaggtgaagccaccccagttaacctcacagagcctgccaagctggaagttaagttttcctggtttatgccatcggcaccgtactggatcctggccaccgactatgagaactatgccctcgtgtattcctgtacctgcatcatccaactttttcacgtggattttgcttggatcttggcaagaaaccctaatctccctccagaaacagtggactctctaaaaaatatcctgacttctaataacattgatgtcaagaaaatgacggtcacagaccaggtgaactgccccaagctctcgtaaccaggttctacagggaggctgcacccactccatgttacttctgcttcgctttcccctaccccaccccccgccataaagacaaaccaatcaaccacgacaaaggaagttgacctaaacatgtaaccatgccctaccctgttaccttgctagctgcaaaataaaacagcaggtcngcaacaagtttattttgcagctagcaaggtcgacc

SEQ ID NO: 102187 - DNA, 1068 bp, Homo sapiens
agctgtgaaggaaatcgggggaggaggatggacacaacatcccatctttgtgtttcgatacagactaagcttttaggccaaccctcctgactggatgggggcggcgggcgtggcatgcatgaaaagtaaacatcagagacctgaagaagcttataaaatagcttgggagaggccagtcaccaagacaggcatctcaaatcggctgattctgcatctggaaactgccttcatcttgaaagaaaagctccaggtcccttctccagccacccagccccaagatggtgatgctgctgctgctgctttccgcactggctggcctcttcggtgcggcagagggacaagcatttcatcttgggaagtgccccaatcctccggtgcaggagaattttgacgtgaataagtatctcggaagatggtacgaaattgagaagatcccaacaacctttgagaatggacgctgcatccaggccaactactcactaatggaaaacggaaagatcaaagtgttaaaccaggagttgagagctgatggaactgtgaatcaaatcgaaggtgaagccaccccagttaacctcacagagcctgccaagctggaagttaagttttcctggtttatgccatcggcaccgtactggatcctggccaccgactatgagaactatgccctcgtgtattcctgtacctgcatcatccaactttttcacgtggattttgcttggatcttggcaagaaaccctaatctccctccagaaacagtggactctctaaaaaatatcctgacttctaataacattgatgtcaagaaaatgacggtcacagaccaggtgaactgccccaagctctcgtaaccaggttctacagggaggctgcacccactccatgttacttctgcttcgctttcccctaccccaccccccgccataaagacaaaccaatcaaccacgacaaaggaagttgacctaaacatgtaaccatgccctaccctgttaccttgctagctgcaaaataaaaccgatgcggccgaaacacatgaacgacagaactacaacctgcgcgcaatactcaacg

SEQ ID NO: 102188 - DNA, 1068 bp, Homo sapiens
agctgtgaaggaaatcgggggaggaggatggacacaacatcccatctttgtgtttcgatacagactaagcttttaggccaaccctcctgactggatgggggcggcgggcgtggcatgcatgaaaagtaaacatcagagacctgaagaagcttataaaatagcttgggagaggccagtcaccaagacaggcatctcaaatcggctgattctgcatctggaaactgccttcatcttgaaagaaaagctccaggtcccttctccagccacccagccccaagatggtgatgctgctgctgctgctttccgcactggctggcctcttcggtgcggcagagggacaagcatttcatcttgggaagtgccccaatcctccggtgcaggagaattttgacgtgaataagtatctcggaagatggtacgaaattgagaagatcccaacaacctttgagaatggacgctgcatccaggccaactactcactaatggaaaacggaaagatcaaagtgttaaaccaggagttgagagctgatggaactgtgaatcaaatcgaaggtgaagccaccccagttaacctcacagagcctgccaagctggaagttaagttttcctggtttatgccatcggcaccgtactggatcctggccaccgactatgagaactatgccctcgtgtattcctgtacctgcatcatccaactttttcacgtggattttgcttggatcttggcaagaaaccctaatctccctccagaaacagtggactctctaaaaaatatcctgacttctaataacattgatgtcaagaaaatgacggtcacagaccaggtgaactgccccaagctctcgtaaccaggttctacagggaggctgcacccactccatgttacttctgcttcgctttcccctaccccaccccccgccataaagacaaaccaatcaaccacgacaaaggaagttgacctaaacatgtaaccatgccctaccctgttaccttgctagctgcaaaataaattccgatgcggccggaggcgaaggaataaaataaataattaacattaataacagacct

SEQ ID NO: 102189 - DNA, 1049 bp, Homo sapiens
agctgtgaaggaaatcgggggaggaggatggacacaacatcccatctttgtgtttcgatacagactaagcttttaggccaaccctcctgactggatgggggcggcgggcgtggcatgcatgaaaagtaaacatcagagacctgaagaagcttataaaatagcttgggagaggccagtcaccaagacaggcatctcaaatcggctgattctgcatctggaaactgccttcatcttgaaagaaaagctccaggtcccttctccagccacccagccccaagatggtgatgctgctgctgctgctttccgcactggctggcctcttcggtgcggcagagggacaagcatttcatcttgggaagtgccccaatcctccggtgcaggagaattttgacgtgaataagtatctcggaagatggtacgaaattgagaagatcccaacaacctttgagaatggacgctgcatccaggccaactactcactaatggaaaacggaaagatcaaagtgttaaaccaggagttgagagctgatggaactgtgaatcaaatcgaaggtgaagccaccccagttaacctcacagagcctgccaagctggaagttaagttttcctggtttatgccatcggcaccgtactggatcctggccaccgactatgagaactatgccctcgtgtattcctgtacctgcatcatccaactttttcacgtggattttgcttggatcttggcaagaaaccctaatctccctccagaaacagtggactctctaaaaaatatcctgacttctaataacattgatgtcaagaaaatgacggtcacagaccaggtgaactgccccaagctctcgtaaccaggttctacagggaggctgcacccactccatgttacttctgcttcgctttcccctaccccaccccccgccataaagacaaaccaatcaaccacgacaaaggaagttgacctaaacatgtaaccatgccctaccctgttaccttgctagctgcaaaataaagtcaacattctaaaacgcaccgtgcgaactaataatttc

SEQ ID NO: 102190 - DNA, 1030 bp, Homo sapiens
gagcatgggcttaggtacaggctgggtgatctcaaatcggctgattctgcatctggaaactgccttcatcttgaaagaaaaggctgctgctttccgcactggctggcctcttcggtgcggcagagggacaagcatttcatcttgggaagtgccccaatcctccggtgcaggagaattttgacgtgaataagtatctcggaagatggtacgaaattgagaagatcccaacaacctttgagaatggacgctgcatccaggccaactactcactaatggaaaacggaaagatcaaagtgttaaaccaggagttgagagctgatggaactgtgaatcaaatcgaaggtgaagccaccccagttaacctcacagagcctgccaagctggaagttaagttttcctggtttatgccatcggcaccgtactggatcctggccaccgactatgagaactatgccctcgtgtattcctgtacctgcatcatccaactttttcacgtggattttgcttggatcttggcaagaaaccctaatctccctccagaaacagtggactctctaaaaaatatcctgacttctaataacattgatgtcaagaaaatgacggtcacagaccaggtgaactgccccaagctctcgtaaccaggttctacagggaggctgcacccactccatgttacttctgcttcgctttcccctaccccaccccccgccataaagacaaaccaatcaaccacgacaaaggaagttgacctaaacatgtaaccatgccctaccctgttaccttgctagctgcaaaataaacttgttgctgacctgctgtgctcgcagtagattccaaaaaaaaaaaatcaaccttatttaaaatcataaccagcactatctctcaacttgaatatcacttcgactttacctatttggcttcctcattgcccttccgtccttaactcacattttgaagggtggtccccttctgcaatatacctattttggggggggtccccgccccctatcccctctttttaaatctctaa

SEQ ID NO: 102191 - DNA, 877 bp, Homo sapiens
tatactgttgtgcggcggagaattttgacgtgaataagtatctcggaagatggtacgaaattgagaagatcccaacaacctttgagaatggacgctgcatccaggccaactactcactaatggaaaacggaaagatcaaagtgttaaaccaggagttgagagctgatggaactgtgaatcaaatcgaaggtgaagccaccccagttaacctcacagagcctgccaagctggaagttaagttttcctggtttatgccatcggcaccgtactggatcctggccaccgactatgagaactatgccctcgtgtattcctgtacctgcatcatccaactttttcacgtggattttgcttggatcttggcaagaaaccctaatctccctccagaaacagtggactctctaaaaaatatcctgacttctaataacattgatgtcaagaaaatgacggtcacagaccaggtgaactgccccaagctctcgtaaccaggttctacagggaggctgcacccactccatgttacttctgcttcgctttcccctaccccaccccccgccataaagacaaaccaatcaaccacgacaaaggaagttgacctaaacatgtaaccatgccctaccctgttaccttgctagctgcaaaataaacttgttgctgacctgctgtgctcgcagtagattccaaaaaaaaaaaatcaaccttatttaaaatcataaccagcactatctctcaacttgaatatcacttcgactttacctatttggcttcctcattgcccttccgtccttaactcacattttgaagggtggtccccttctgcaatatacctattttggggggggtccccgccccctatcccctctttttaaatctctaa

SEQ ID NO: 102192 - DNA, 1007 bp, Homo sapiens
agctgtgaaggaaatcgggggaggaggatggacacaacatcccatctttgtgtttcgatacagactaagcttttaggccaaccctcctgactggatgggggcggcgggcgtggcatgcatgaaaagtaaacatcagagacctgaagaagcttataaaatagcttgggagaggccagtcaccaagacaggcatctcaaatcggctgattctgcatctggaaactgccttcatcttgaaagaaaagctccaggtcccttctccagccacccagccccaagatggtgatgctgctgctgctgctttccgcactggctggcctcttcggtgcggcagagggacaagcatttcatcttgggaagtgccccaatcctccggtgcaggagaattttgacgtgaataagtatctcggaagatggtacgaaattgagaagatcccaacaacctttgagaatggacgctgcatccaggccaactactcactaatggaaaacggaaagatcaaagtgttaaaccaggagttgagagctgatggaactgtgaatcaaatcgaaggtgaagccaccccagttaacctcacagagcctgccaagctggaagttaagttttcctggtttatgccatcggcaccgtactggatcctggccaccgactatgagaactatgccctcgtgtattcctgtacctgcatcatccaactttttcacgtggattttgcttggatcttggcaagaaaccctaatctccctccagaaacagtggactctctaaaaaatatcctgacttctaataacattgatgtcaagaaaatgacggtcacagaccaggtgaactgccccaagctctcgtaaccaggttctacagggaggctgcacccactccatgttacttctgcttcgctttcccctaccccacccccagcagcaagcagcccccaacaagtcatcttaggaattcctcattcctgcagatgggaaggagacaaccaccgcgcagcgttgcagcctgca

SEQ ID NO: 102193 - DNA, 1183 bp, Homo sapiens
agctgtgaaggaaatcgggggaggaggatggacacaacatcccatctttgtgtttcgatacagactaagcttttaggccaaccctcctgactggatgggggcggcgggcgtggcatgcatgaaaagtaaacatcagagacctgaagaagcttataaaatagcttgggagaggccagtcaccaagacaggcatctcaaatcggctgattctgcatctggaaactgccttcatcttgaaagaaaagctccaggtcccttctccagccacccagccccaagatggtgatgctgctgctgctgctttccgcactggctggcctcttcggtgcggcagagggacaagcatttcatcttgggaagtgccccaatcctccggtgcaggagaattttgacgtgaataagtatctcggaagatggtacgaaattgagaagatcccaacaacctttgagaatggacgctgcatccaggccaactactcactaatggaaatcgaaggtgaagccaccccagttaacctcacagagcctgccaagctggaagttaagttttcctggtttatgccatcggcaccgtactggatcctggccaccgactatgagaactatgccctcgtgtattcctgtacctgcatcatccaactttttcacgtggattttgcttggatcttggcaagaaaccctaatctccctccagaaacagtggactctctaaaaaatatcctgacttctaataacattgatgtcaagaaaatgacggtcacagaccaggtgaactgccccaagctctcgtaaccaggttctacagggaggctgcacccactccatgttacttctgcttcgctttcccctaccccaccccccgccataaagacaaaccaatcaaccacgacaaaggaagttgacctaaacatgtaaccatgccctaccctgttaccttgctagctgcaaaataaacttgttgctgacctgctgtgctcgcagtagattccaaaaaaaaaaaatcaaccttatttaaaatcataaccagcactatctctcaacttgaatatcacttcgactttacctatttggcttcctcattgcccttccgtccttaactcacattttgaagggtggtccccttctgcaatatacctattttggggggggtccccgccccctatcccctctttttaaatctctaa

SEQ ID NO: 102194 - DNA, 667 bp, Homo sapiens
gcttaaggtgactgactctcttatttaccaccgctacagttatgccatcggcaccgtactggatcctggccaccgactatgagaactatgccctcgtgtattcctgtacctgcatcatccaactttttcacgtggattttgcttggatcttggcaagaaaccctaatctccctccagaaacagtggactctctaaaaaatatcctgacttctaataacattgatgtcaagaaaatgacggtcacagaccaggtgaactgccccaagctctcgtaaccaggttctacagggaggctgcacccactccatgttacttctgcttcgctttcccctaccccaccccccgccataaagacaaaccaatcaaccacgacaaaggaagttgacctaaacatgtaaccatgccctaccctgttaccttgctagctgcaaaataaacttgttgctgacctgctgtgctcgcagtagattccaaaaaaaaaaaatcaaccttatttaaaatcataaccagcactatctctcaacttgaatatcacttcgactttacctatttggcttcctcattgcccttccgtccttaactcacattttgaagggtggtccccttctgcaatatacctattttggggggggtccccgccccctatcccctctttttaaatctctaa

SEQ ID NO: 102195 - DNA, 668 bp, Homo sapiens
  misc_feature (1)..(1): n is a, c, g, or t
ncattgctggaacgactctcttaattttccaccgctacacttatgccatcggcaccgtactggatcctggccaccgactatgagaactatgccctcgtgtattcctgtacctgcatcatccaactttttcacgtggattttgcttggatcttggcaagaaaccctaatctccctccagaaacagtggactctctaaaaaatatcctgacttctaataacattgatgtcaagaaaatgacggtcacagaccaggtgaactgccccaagctctcgtaaccaggttctacagggaggctgcacccactccatgttacttctgcttcgctttcccctaccccaccccccgccataaagacaaaccaatcaaccacgacaaaggaagttgacctaaacatgtaaccatgccctaccctgttaccttgctagctgcaaaataaacttgttgctgacctgctgtgctcgcagtagattccaaaaaaaaaaaatcaaccttatttaaaatcataaccagcactatctctcaacttgaatatcacttcgactttacctatttggcttcctcattgcccttccgtccttaactcacattttgaagggtggtccccttctgcaatatacctattttggggggggtccccgccccctatcccctctttttaaatctctaa

SEQ ID NO: 102196 - DNA, 705 bp, Homo sapiens
atgatctctgccaagctatgtagccctggagcacgatatatgatctgctgccaagctggaagttaagttttcctggtttatgccatcggcaccgtactggatcctggccaccgactatgagaactatgccctcgtgtattcctgtacctgcatcatccaactttttcacgtggattttgcttggatcttggcaagaaaccctaatctccctccagaaacagtggactctctaaaaaatatcctgacttctaataacattgatgtcaagaaaatgacggtcacagaccaggtgaactgccccaagctctcgtaaccaggttctacagggaggctgcacccactccatgttacttctgcttcgctttcccctaccccaccccccgccataaagacaaaccaatcaaccacgacaaaggaagttgacctaaacatgtaaccatgccctaccctgttaccttgctagctgcaaaataaacttgttgctgacctgctgtgctcgcagtagattccaaaaaaaaaaaatcaaccttatttaaaatcataaccagcactatctctcaacttgaatatcacttcgactttacctatttggcttcctcattgcccttccgtccttaactcacattttgaagggtggtccccttctgcaatatacctattttggggggggtccccgccccctatcccctctttttaaatctctaa

SEQ ID NO: 102197 - DNA, 1207 bp, Homo sapiens
agctgtgaaggaaatcgggggaggaggatggacacaacatcccatctttgtgtttcgatacagactaagcttttaggccaaccctcctgactggatgggggcggcgggcgtggcatgcatgaaaagtaaacatcagagacctgaagaagcttataaaatagcttgggagaggccagtcaccaagacaggcatctcaaatcggctgattctgcatctggaaactgccttcatcttgaaagaaaagctccaggtcccttctccagccacccagccccaagatggtgatgctgctgctgctgctttccgcactggctggcctcttcggtgcggcagagggacaagcatttcatcttgggaagtgccccaatcctccggtgcaggagaattttgacgtgaataagtatctcggaagatggtacgaaattgagaagatcccaacaacctttgagaatggacgctgcatccaggccaactactcactaatggaaaacggaaagatcaaagtgttaaaccaggagttgagagctgatggaactgtgaatcaaatcgaaggtgaagccaccccagttaacctcacagagcctgccaagctggaagttaagttttcctggtttatgccatcggcaccgtactggatcctggccaccgactatgagaactatgccctcgtgtattcctgtacctgcatcatccaactttttcacgtggattttgcttggatcttggcaagaaaccctaatctccctccagaaacagtggactctctaaaaaatatcctgacttctaataacattgatgtcaagaaaatgacggtcacagaccaggtgaagaggctgcacccactccatgttacttctgcttcgctttcccctaccccaccccccgccataaagacaaaccaatcaaccacgacaaaggaagttgacctaaacatgtaaccatgccctaccctgttaccttgctagctgcaaaataaacttgttgctgacctgctgtgctcgcagtagattccaaaaaaaaaaaatcaaccttatttaaaatcataaccagcactatctctcaacttgaatatcacttcgactttacctatttggcttcctcattgcccttccgtccttaactcacattttgaagggtggtccccttctgcaatatacctattttggggggggtccccgccccctatcccctctttttaaatctctaa

SEQ ID NO: 102198 - DNA, 1184 bp, Homo sapiens
agctgtgaaggaaatcgggggaggaggatggacacaacatcccatctttgtgtttcgatacagactaagcttttaggccaaccctcctgactggatgggggcggcgggcgtggcatgcatgaaaagtaaacatcagagacctgaagaagcttataaaatagcttgggagaggccagtcaccaagacaggcatctcaaatcggctgattctgcatctggaaactgccttcatcttgaaagaaaagctccaggtcccttctccagccacccagccccaagatggtgatgctgctgctgctgctttccgcactggctggcctcttcggtgcggcagagggacaagcatttcatcttgggaagtgccccaatcctccggtgcaggagaattttgacgtgaataagtatctcggaagatggtacgaaattgagaagatcccaacaacctttgagaatggacgctgcatccaggccaactactcactaatggaaaacggaaagatcaaagtgttaaaccaggagttgagagctgatggaactgtgaatcaaatcgaaggtgaagccaccccagttaacctcacagagcctgccaagctggaagttaagttttcctggtttatgccatcggcaccgtactggatcctggccaccgactatgagaactatgccctcgtgtattcctgtacctgcatcatccaactttttcacgtggattttgcttggatcttggcaagaaaccctaatctccctccagaaacagtggactctctaaaaaatatcctgacttctaataacattgatgtcaagaaagaggctgcacccactccatgttacttctgcttcgctttcccctaccccaccccccgccataaagacaaaccaatcaaccacgacaaaggaagttgacctaaacatgtaaccatgccctaccctgttaccttgctagctgcaaaataaacttgttgctgacctgctgtgctcgcagtagattccaaaaaaaaaaaatcaaccttatttaaaatcataaccagcactatctctcaacttgaatatcacttcgactttacctatttggcttcctcattgcccttccgtccttaactcacattttgaagggtggtccccttctgcaatatacctattttggggggggtccccgccccctatcccctctttttaaatctctaa

SEQ ID NO: 102199 - DNA, 495 bp, Homo sapiens
  misc_feature (46)..(46): n is a, c, g, or t
  misc_feature (67)..(67): n is a, c, g, or t
  misc_feature (136)..(140): n is a, c, g, or t
  misc_feature (153)..(154): n is a, c, g, or t
ctttcagttttaattttattagtgacaaggtaaataggtacatganaatcttcacagatatctacgnacgtatttaaataaaacaagagtcgagttctaagaatgcagtttcaggggtgactagtacatattattnnnnnatttactgtatannttttccaagtttatccgcgccataaagacaaaccaatcaaccacgacaaaggaagttgacctaaacatgtaaccatgccctaccctgttaccttgctagctgcaaaataaacttgttgctgacctgctgtgctcgcagtagattccaaaaaaaaaaaatcaaccttatttaaaatcataaccagcactatctctcaacttgaatatcacttcgactttacctatttggcttcctcattgcccttccgtccttaactcacattttgaagggtggtccccttctgcaatatacctattttggggggggtccccgccccctatcccctctttttaaatctctaa

SEQ ID NO: 102200 - DNA, 325 bp, Homo sapiens
gtaagtatccacttttcccaggaggattcagggacaggaaatatgcaaactgaaggctagcgccccggcttggagaattcctgagacacctgagtgtcatctataatcactcagcacataattatctgtcaaacacttactacatgtcacgcactagggttgccatgatgagccggacagagctggccttggtacttatggagctcacatcccagtgtggatactgacacgtgaccccgcaatttactataactagctagcgtttcaacaggtgaaacacaagtaggtgcacaccgggtgtgggctgcagaagacacaacccagt

SEQ ID NO: 102201 - DNA, 1078 bp, Homo sapiens
gagcatgggcttaggtacaggctgggtgatctcaaatcggctgattctgcatctggaaactgccttcatcttgaaagaaaagctccaggtcccttctccagccacccagccccaagatggtgatgctgctgctgctgctttccgcactggctggcctcttcggtgcggcagagggacaagcatttcatcttgggaagtgccccaatcctccggtgcaggagaattttgacgtgaataagtatctcggaagatggtacgaaattgagaagatcccaacaacctttgagaatggacgctgcatccaggccaactactcactaatggaaaacggaaagatcaaagtgttaaaccaggagttgagagctgatggaactgtgaatcaaatcgaaggtgaagccaccccagttaacctcacagagcctgccaagctggaagttaagttttcctggtttatgccatcggcaccgtactggatcctggccaccgactatgagaactatgccctcgtgtattcctgtacctgcatcatccaactttttcacgtggattttgcttggatcttggcaagaaaccctaatctccctccagaaacagtggactctctaaaaaatatcctgacttctaataacattgatgtcaagaaaatgacggtcacagaccaggtgaactgccccaagctctcgtaaccaggttctacagggaggctgcacccactccatgttacttctgcttcgctttcccctaccccaccccccgccataaagacaaaccaatcaaccacgacaaaggaagttgacctaaacatgtaaccatgccctaccctgttaccttgctagctgcaaaataaacttgttgctgacctgctgtgctcgcagtagattccaaaaaaaaaaaatcaaccttatttaaaatcataaccagcactatctctcaacttgaatatcacttcgactttacctatttggcttcctcattgcccttccgtccttaactcacattttgaagggtggtccccttctgcaatatacctattttggggggggtccccgccccctatcccctctttttaaatctctaa

SEQ ID NO: 102202 - DNA, 928 bp, Homo sapiens
cgtctagagatccgggcgtgccgtgggagaggacagcattatcttgggagtgcccaatctctggtgcaggagaatttgacgtgaataagtatctcggaagatggtacgaaattgagaagatcccaacaacctttgagaatggacgctgcatccaggccaactactcactaatggaaaacggaaagatcaaagtgttaaaccaggagttgagagctgatggaactgtgaatcaaatcgaaggtgaagccaccccagttaacctcacagagcctgccaagctggaagttaagttttcctggtttatgccatcggcaccgtactggatcctggccaccgactatgagaactatgccctcgtgtattcctgtacctgcatcatccaactttttcacgtggattttgcttggatcttggcaagaaaccctaatctccctccagaaacagtggactctctaaaaaatatcctgacttctaataacattgatgtcaagaaaatgacggtcacagaccaggtgaactgccccaagctctcgtaaccaggttctacagggaggctgcacccactccatgttacttctgcttcgctttcccctaccccaccccccgccataaagacaaaccaatcaaccacgacaaaggaagttgacctaaacatgtaaccatgccctaccctgttaccttgctagctgcaaaataaacttgttgctgacctgctgtgctcgcagtagattccaaaaaaaaaaaatcaaccttatttaaaatcataaccagcactatctctcaacttgaatatcacttcgactttacctatttggcttcctcattgcccttccgtccttaactcacattttgaagggtggtccccttctgcaatatacctattttggggggggtccccgccccctatcccctctttttaaatctctaa

SEQ ID NO: 102203 - DNA, 1130 bp, Homo sapiens
agctgtgaaggaaatcgggggaggaggatggacacaacatcccatctttgtgtttcgatacagactaagcttttaggccaaccctcctgactggatgggggcggcgggcgtggcatgcatgaaaagtaaacatcagagacctgaagaagcttataaaatagcttgggagaggccagtcaccaagacaggcatctcaaatcggctgattctgcatctggaaactgccttcatcttgaaagaaaagctccaggtcctctcagcaccagccagaggatgtgcgcgtgttcgactgctgctctctgcggcgaggacagcttcatctgggagtccatctccggcagaaatgacgtaatatttcgaaatgtcgaatgagaagatccaaaactgaaaggagctgatcaggcaatatcatatgaaagaagatcaagtgtaacagagtggagctgtaatgtgataatcaagtgaagcaccagtactccgagctgccagtggagtagtcctgttatgccatcggcaccgtactggatcctggccaccgactatgagaactatgccctcgtgtattcctgtacctgcatcatccaactttttcacgtggattttgcttggatcttggcaagaaaccctaatctccctccagaaacagtggactctctaaaaaatatcctgacttctaataacattgatgtcaagaaaatgacggtcacagaccaggtgaactgccccaagctctcgtaaccaggttctacagggaggctgcacccactccatgttacttctgcttcgctttcccctaccccaccccccgccataaagacaaaccaatcaaccacgacaaaggaagttgacctaaacatgtaaccatgccctaccctgttaccttgctagctgcaaaataaacttgttgctgacctgctgtgctcgcagtagattccaaaaaaaaaaaatcaaccttatttaaaatcataaccagcactatctctcaacttgaatatcacttcgactttacctatttggcttcctcattgcccttccgtccttaactcacattttgaagggtggtccccttctgcaatatacctattttggggggggtccccgccccctatcccctctttttaaatctctaa

SEQ ID NO: 102204 - DNA, 852 bp, Homo sapiens
agctgtgaaggaaatcgggggaggaggatggacacaacatcccatctttgtgtttcgatacagactaagcttttaggccaaccctcctgactggatgggggcggcgggcgtggcatgcatgaaaagtaaacatcagagacctgaagaagcttataaaatagcttgggagaggccagtcaccaagacaggcatctcaaatcggctgattctgcatctggaaactgccttcatcttgaaagaaaagctccaggtcccttctccagccacccagccccaagatggtgatgctgctgctgctgctttccgcactggctggcctcttcggtgcggcagagggacaagcatttcatcttgggaagtgccccaatcctccggtgcaggagaattttgacgtgaataagtatctcggaagatggtacgaaattgagaagatcccaacaacctttgagaatggacgctgcatccaggccaactactcactaatggaaaacggaaagatcaaagtgttaaaccaggagttgagagctgatggaactgtgaatcaaatcgaaggtgaagccaccccagttaacctcacagagcctgccaagctggaagttaagttttcctggtttatgccatcggcaccgtactggatcctggccaccgactatgagaactatgccctcgtgtattcctgtacctgcatcatccaactttttcacgtggattttgcttggatcttggcaagaaaccctaatctccctccagaaacagtggactctctaaaaaatatcctgacttctaataacattgatgtcaagaaacgccgtcacgagatggtacacgagctcgattcactgccgtcgtcac

SEQ ID NO: 102205 - DNA, 1240 bp, Homo sapiens
agctgtgaaggaaatcgggggaggaggatggacacaacatcccatctttgtgtttcgatacagactaagcttttaggccaaccctcctgactggatgggggcggcgggcgtggcatgcatgaaaagtaaacatcagagacctgaagaagcttataaaatagcttgggagaggccagtcaccaagacaggcatctcaaatcggctgattctgcatctggaaactgccttcatcttgaaagaaaagctccaggtcccttctccagccacccagccccaagatggtgatgctgctgctgctgctttccgcactggctggcctcttcggtgcggcagagggacaagcatttcatcttgggaagtgccccaatcctccggtgcaggagaattttgacgtgaataagtatctcggaagatggtacgaaattgagaagatcccaacaacctttgagaatggacgctgcatccaggccaactactcactaatggaaaacggaaagatcaaagtgttaaaccaggagttgagagctgatggaactgtgaatcaaatcgaaggtgaagccaccccagttaacctcacagagcctgccaagctggaagttaagttttcctggtttatgccatcggcaccgtactggatcctggccaccgactatgagaactatgccctcgtgtattcctgtacctgcatcatccaactttttcacgtggattttgcttggatcttggcaagaaaccctaatctccctccagaaacagtggactctctaaaaaatatcctgacttctaataacattgatgtcaagaaaatgacggtcacagaccaggtgaactgccccaagctctcgtaaccaggttctacagggaggctgcacccactccatgttacttctgcttcgctttcccctaccccaccccccgccataaagacaaaccaatcaaccacgacaaaggaagttgacctaaacatgtaaccatgccctaccctgttaccttgctagctgcaaaataaacttgttgctgacctgctgtgctcgcagtagattccaaaaaaaaaaaatcaaccttatttaaaatcataaccagcactatctctcaacttgaatatcacttcgactttacctatttggcttcctcattgcccttccgtccttaactcacattttgaagggtggtccccttctgcaatatacctattttggggggggtccccgccccctatcccctctttttaaatctctaa

SEQ ID NO: 102206 - DNA, 154 bp, Homo sapiens
gtgtgtatttcacctgagaccacttgctcagagccatagtttacatctgaagccaggacgctggagcacttggcactccagacagctggttcagggggctcccgctggttgagtggacttgggcaggttacaaggcctctgtgccgcagttccc

SEQ ID NO: 102207 - DNA, 351 bp, Homo sapiens
tgtcagtcacccaaggcctattcagaatctgttcctgtttgaaatttaatgctctatctccctgaactcgaggccactcaacagtgaagctggaactccacatgatcaaaaggtggaatgcatagaagaaaagggaaatgagtcacatgacgtgtctttcaaacctgacttctctggcggtccttcagggctgggaagaatgaatgctcaattttgcaaggctttgggtgtcctcactaacagtgaaaacattctatatatttatatgggacttcagaaatgcaaaacgagagacaagaaacaaagacttgtttacttatagattttttcccctaaatttaatcggcccaa

SEQ ID NO: 102208 - DNA, 297 bp, Homo sapiens
atactcttccccctgcacaaatctccccccaccccacaaaatgcttaaaaggtagcttgactctttgtttggggcccggtcctttggatgttaatctgattgggtcggtgcgcctaaataattaaataattcctcctcaaccccatcggtctctctgattccttaattatcccgcagcaatacatgaagcaaaaactcacagaattgaagggtgaaacagtcaattcaccagtaacggttgggccaggcatggtgactcacgcttgtaatcccagcactttgggaggccgaggtggg

SEQ ID NO: 102209 - DNA, 423 bp, Homo sapiens
ttaaggcacacgatatgtgaatacttactcttcacaattttttagtacagattttgctgttgtttattatttctggccacattaacttctattttcttaattccaactgtacttatagttatttctatggtttaacatttaactattcacttttatatgttattatcatctctcaagggagattgttcatccttgaggaaaggactgtgtcttttatttttatatatccccttcagtgtctaatatttgtaaaaactaatcatttctgagcttcatacttataaattcaactgcttggtttcttaaacaaatcacaaatgcaacaaatctaaatccgaatcatctttttgccctaaatttactccttctgttttgttctttgggaagttcccatgtggtaacctggagctacccttgaccact

SEQ ID NO: 102210 - DNA, 359 bp, Homo sapiens
tgttcttctcgcgttcattctccttcctgccaccttgtgaagatgatgccttgcttcccctttgccttccatcatgcttgccttgctctgtcacctaggctgtagtgccgtggcacaaacttggctcactgcaactttggctttctgggctcaagcgatcctctcacttcaacctcccaagtagctgggactacaggcaccacttctgaaaaacgctgacttcgttatcttcctcaaaagaatggaaacttatttacatgattgttgctgaccaggcatcgataagaagaaatggggagcaaatattttgtatagacaccagaatggctaataaaggtgacatcacgctgagttgcaag

SEQ ID NO: 102211 - DNA, 392 bp, Homo sapiens
tttttttcctttgagatgggggtcttgctctgttgcccaggctggactgcagcagtgcaatctcagctcactgcaacctttgcctcctgggttcaagcaattttcctgtctcagcctcctgagtatctgggattacaggcatgcgccaccatgtccggctaatgtttctatttttagtagagatggggtttcgtcatgttggccagtctggtctcgaactcctgacctcaggtgatctgcctgccttggcttccctaagtgctggaattacaggcgtgagcaattgcgcccggcctctctgttataaattagtgttcataaattaatatttttaaatacatgcacagatttaaaaaattcattcagtacaggggtaataggatagaaaagca

SEQ ID NO: 102212 - DNA, 407 bp, Homo sapiens
gcaattgagggatagaatggttaacaaattcttccaggtcgcatggccagaagtatggcagagtcattatcaaagcccccaagttagtgcctgagtctgcaccctgggccgaaattttccagcttctgtgatacagaattttatgccagaaactcttacattactaaatttttcattctttcttttaatataaatatacataaaaatgaggaaaacttccataggtgtgttctaatactgtgagcaaattaaaactcaattgaatactattttcacaaatacatgtatgcttatctcactttaggatgaaccaattctaaaagtcctacttaagaaatagttatgaccaggcatggtggctcatgcctgtaatcccagcactttgggaggccgaggcaggcagatcg

SEQ ID NO: 102213 - DNA, 271 bp, Homo sapiens
taccacatggcttaacacccttctgctcacacatggttaaacacgtgtttgaactgatgttttaacacccgtctcgcacatctttatgccctttgttcacatatgctggaacacatgctttgccaccctttgtgcactcattgttgaacacaggcagagtattgtctagagtctgactttccagaggttcgttggtgagtagcattccatctaagattggtgcctaataaagtcacagctccttctgccagatgatgtccacacttgtgtt

SEQ ID NO: 102214 - DNA, 300 bp, Homo sapiens
ccttttccccagtggagctgaccttgctgttattggcacacaccgtagcttctgtggcctttggctgctgttccccctctggacccttgccctgtgttccactgtctttagccaaaccccctctaggggctttgggagaagtctctgaggtgtcaattcctgatggagattcatggacagggcacgtcctgtctcttgtcttcaccctagctctgcttgagggcagccatctctcttgagtgtctggtttcccggacacatgtcttctccctgcatctctggtctttgaggaaacaggac

SEQ ID NO: 102215 - DNA, 270 bp, Homo sapiens
taaaaggaggcccgaagatgtcagggggattcaaggtggcaaaacacattggttgtattttttttttaaagctttattgaaatataattcacataccatacaattaagccatttacagtgaacaattcaatggttcttagtatattcacaaatacgtgcaaccacagtcaatgttagaatattttcatcatttcgaaaagaaactctaaccctttggctatcactccttggcttccccactgccacatgtgccccatacttagcctcaaa

SEQ ID NO: 102216 - DNA, 827 bp, Homo sapiens
gctttgagctgcggccagaaccccctgcccatctacctcaccatcaatgtcaaggatgatgtaagcaaccaggacttcagagagtggttcgagttctccccctacgaggtgggcctgcagaagtatggggccttcatcccctccgagctcttcggctccgagttcttcatggggcggctggtgaagaggatcccggagtctcgaatctgctacatgctaggcctgtggagcagcatcttctccctgaacctgctggatgcctggaacctgtcacacacctcggaggagtttttccacaggtggacaagggagaaagtgcaggacatcgaagacgagccgatcctgcctgaaatccccaaatgtgatgctaacatcctggagaccacggtagtgatcccagggtcatggctgtccaattctttccgagaaatccttacccatcggtccttcgtgtctgagtttcacaacttcctgtctgggctgcagctgcacaccaactacctccagaatggccagttctctaggtggaaaggtaaccctacctggctactccttgaggcctgcctccatatggaggaggaagatgtggatgtcaaggctgccatggataaagaataagaaaacttctctggctatgttcactgggccaggcacctctctccccatggtgttttccacatttggtggtgtcgtcttgaacactgtatgtgtctggcagcagggagtggtgtgggtacttaactcactgcatctgtacagtcattctatacagaatctgtacaacagtcctagcaggtagaagttggccccatgttacagatggggaa

SEQ ID NO: 102217 - DNA, 344 bp, Homo sapiens
ataggtaagcctgctgggccctggcctatggggtctgttcaggaagaagaggggtcttctctctaaacctgtgagatctcttctagactcttttatagattgtttttatattgtatgtttgatcattttgtcctcccctaaccccctttgggcactatctcagactttaaatattctaaataattttggcagtatgtgaaaaatgaattttatgtcactaagcgattcatggaaatatttttttagtacctacatgtacagatttcttaaccaattatgtatatttgagttcctaagaatagaagtaactttttaatgaccttcaggtacacatatttgtatta

SEQ ID NO: 102218 - DNA, 472 bp, Homo sapiens
gtcctttttataaaagcctccaaccttctcttttttctttggacatactaaaggccagccagtctgtgggtatgtgctgaatccaatctttgcttcccaaataaaatgttttaaatttagagattagtctttatattttatctgacttcaacacagctatgggctgatctgtagaactcaatatagaaatctactgtcctggtcaagactggtagaaatactctctttacaaatcatatctgtgttaattttgaatctgcaagtgagtaaaataggaatttgctctctcatctcttggaaatttgatccaaatctatagacattgtggtcggagaacagtgaatgcatgaagagaatggtcccataaagttgagatcgaggagccattttttgccgtgagctttctaacgagtaagaaaaacttgtctttagagagagactgaagagtagagcagacagtacagaggtgagg

SEQ ID NO: 102219 - DNA, 566 bp, Homo sapiens
aatagtctgttcatttcagactttgtcttttggtatcaagttggttaatatatgattttgaaaatgtaaatatgcatacctgcaacaaagtgcatcagagttgaaagaagaaagaagcaggttgtgtttgcctaaaagctgcaaaaccagcttttagtctacactctgcatgtgtggcttaggggtcagccagagctgagagcagacagaagttggaaatcctccctcggactctttcccttcctgcattccctttctcttcccagcagccatggtggccctggattcagctttcccttccacaggccagagagattgtgattttttttccaccaatgccctgccaccctgcaggctgctctcactacacttgggtgtaagtgaaaagctgtccctataacttccctcctctgagcacggaccaccccactcctgggtctgcctgctcttctcactctcatatgtcttcaagaagctgcttgtattacgtccaaagcttacaattggtatgtccaggaggctcagtctggtaggatcttactctgtccttaccagcagcagaagta

SEQ ID NO: 102220 - DNA, 344 bp, Homo sapiens
gctatttcttcttgcagaacccacaaatgagtcccatatttgggcctctgcaatcagttggctgcagctcccaggcgggctgacacacactgcaacctcacatctgcaggactctcgccccttctctcttttttaaagggcctttgtcctttgttccccagcctcacaggcaagacagaagagcctttgcttctgtacttcttaaaagctttagaaagggacttcattctgcacacttcggggaggaccaggacccatgactgcatgggaagtaaaacacaagtagcacacggcatacttctcctagatgctctctgcgtcttccagcacctcaacatccaatt

SEQ ID NO: 102221 - DNA, 425 bp, Homo sapiens
tgtgcatctagttttcaggtgaagatgagttgaccgaagtgcatgtggctgatccagctgttgcaccctccatccagtataacttttgtgccgttgcctttggtgcaaccccttgacatgaaaccacagttcttccaataagcagagtgaatgtgaacacatgttggcagaactgtgccatttacaaaggaagtggtgagatattactgaggaaaagctagacaatgctgcaccagcaatctgatcccgctcattctttctccaaaatgtagtttccaactctgcaggagtagtggctgtgaaatacatgggaaagagtttgaaaagtatgtatcccacatttcacagcactttccaggattttacatttcagtatagacaaaagtaagtgtataatgcttgtaaataaaatttacaaaccaaac

SEQ ID NO: 102222 - DNA, 663 bp, Homo sapiens
ttcctgtaactaacattctatttagagtgcctaatgtgccaggcactaggccaaggactttgcatgcatatcaaagtctgtttaatcataagtaagaataaagtcatatttaacatttccaacaaccttgaataggcaagaaaactgcagaaagagagatatacccaaggttagcatagctagtactgatagcacatctagtactgggacccaagtctcacttgttaagacaacacatggtgtttactactattacaaattacttcccagtgtatccctactttcagattaggggagcaggatggctcaagatcattacacagaaaactctacaaaataatatacatacatggatgggggaacacttcctcttcacatcccattctttgtatccttccaaaagcttttctgtgcgtgcttgggaaaacatacaggcatcttttttagaggagaagccagttttctaaaagtgaaatcagattatatgtactctgctgctttctttctgtgtatcgtatgcctcattcttcctcagtacatacagatttagatttccttttgttgcatgtcagtgtactgtttagttgtatggctctaccatgtggtataactaagatccttattgatgggtaaggtgttaatttctggccaatgtaatggttt

SEQ ID NO: 102223 - DNA, 684 bp, Homo sapiens
cagctaagaaaattaacaatactatcatcccttggtatccatggaggattagttccaggacctcctgtggataccaaaatacacgaatgctcaagtcctgtatataaagtgccatagtatttccatatctttctctatgccttatttacatttttttcttttattttcttaattgatataaacaagtacacttttatagggtgcatagtgatgttttgatacatataatgtatagtgatgagatcagggtaattagcatatttatctggaacatttatcatttctttttgttgggaacattcaatattctctttctagctatttgaaatgatgtaatacagtcatcctaaaatgctatagaccactagaacttagcccacttatctagctgtaattttatatcctttaacaaatctctgtctacccacttcctcctaccctttctacccctgctgtatgctttaaatcatctctaggccaggcgcagcagctcacgcctgtaatcccaggactttgggaggccaaggcaggcagattgcttgagctcaggagttcaagaccagtgtaggcaacatggtgaaacctcgtctctacaaaaaatacaaaaattagccaggtgtggtggtgtgtacctgtagtcccagctacccaggaggctgaggtaggaggatcacttgagcccca

SEQ ID NO: 102224 - DNA, 689 bp, Homo sapiens
gaggaaggcagtggggccaaggagatacgaagaacctgggggaaggacagggctgggcaaggatgcagtgagggtggcagggctggaggaaaggaggtggcaaggctggtgaaggaagagatggatgcagagtgagggagcacacacacatttaagatgatacactttcccatttcagcttggacaccagccctgaagcagggaaaagacagatgtactaattgtcatggatggcaaactgtgcccccaaacttgtaccaagcctcaaagccttggtttaatactcctgaaggagtaatagacccaatgtgacattttgcatgcaggaaccccttaacagctacctccatattatgcgtgcttcatgaatggagacacctacgttatatgaagttctctattgggctgtaaacttcctgagacaggccttctgggaaattactctctacatcccaggactgcaatgtccagtgcagacccgtgcatttagatgtttccaaaatagcagttgtttccgcggcattatgttctgctggcctagaggtcttagttccagagggaggaatgctgccaccaagagacacaacaatgattccattaaactggaagttaagattgccacctggccactttgggctcttcttacttttaagccaacttgctaagaagggagttacagtgtttgaccc

SEQ ID NO: 102225 - DNA, 145 bp, Homo sapiens
agacataaaccctacctttacggaagttaccacattccacttggggagatgacacctattgtaggataaggaataaaatggttagtaacataaggaaaatgaattttaaaaccataggcattcacatgcaaaaacaaaacaacca

SEQ ID NO: 102226 - DNA, 306 bp, Homo sapiens
tggcacctaggaaaataaatgtctgtattgaacacattgtagttgctcaacaaatatttgttgaaattagaattaaaagggatctcaggatatcaccctattcatttgactgattctggagaagtaacaatattttcactttgtttttcatataactgaggttcagggatattatatgacttgcccgggatagagcatctattaggtttaagatactttcttctgcaaggttgtgacaaaaccttttggatttcacgggtatattgctattcatgatccttaactagcaatactaagagttcttgc

SEQ ID NO: 102227 - DNA, 317 bp, Homo sapiens
gcgtcgactttttttattgctagcaaagaaaaaggcctcgcacaaagaatagcagtttgtggggtgtcctccaaagagggaaaggggaatttgtctcctctgtcataccagtgacccctgaaagctggcacatgtctgtcctgtgagccctggcactctcctggcatggcaagcccatactgctcaggaagtagcagtatgaactgaaagaaggagctccaagttacaatgcaggacacaccacaaactgctattctttgtgcgaggcctttttctttgctagcaataagttttcccattttctattattcacaaca

SEQ ID NO: 102228 - DNA, 337 bp, Homo sapiens
tgagagccacttccacagctcaataaatctctgcattcaccatctttcaggttcatgtgacctgattcttcctggatgctagacaagaacccggttaccagagggcatggagtgaaaggatgtcaccctagccctccactcaactggttaacacttagctgtccatagacagaaaatgctaaaaagcattgtttgtaacacttgccttctggggcttcagaggtcatgtgcaacccctggatgctgccacaggctggtacaaggtatgtttctgctgtcgcccgaaggcattcgccccagctcctccacctgctcaactgtatgctcacccttccac

SEQ ID NO: 102229 - DNA, 339 bp, Homo sapiens
ttttttttttgaccaggctggtctcgaactcctgacctcaggtgattcacctgcctcagcctcccaaagtgctgggattacaggcatgagccaccacaccaggccagactccagttttcactgccacctaccatggtgccagctacaagcccagcttcaggctggtggggctggggcacctgactgcaagcattctattccttgttgaggaaatgagacaggtgcacaggaagcagttagtaaacagaatcctagtggagctggaggtgttttagagataatttgtgagcaaaaaaatagtctagattctagaataagccaaccccaaagttggcgtgg

SEQ ID NO: 102230 - DNA, 333 bp, Homo sapiens
tagaagaatcaccctagggcaagggctctcaacctcagcactattgacattgtgggctggaaaattcttgttgtagtgggggtgtcctgtgcattgtaggatgtttagcagcatctctgacctctgactactaggtgctagtagcaagtcctcttgttcccccatcacacccccccgcaactccccaccctcctcctttcccagctgtgacttccaaaaatgtcttcagacgttgccaaatgtcccctggggtgcaaaatcacaccccactgagaaccactagtctagggataatgtggaagatgaattggagggcaaggagattaattacat

SEQ ID NO: 102231 - DNA, 306 bp, Homo sapiens
tggtcaggttggtcatgaactcctgacctcaggtgatccacccacctcagcctcccaaagtgctgggattataggcgggagccaccacgcctgaccaataaatccctttttatcctacacaaaaaagcaactggagtgcaaatgagaaaaatggggttatcacaaagttacccttagaaccactattttacctatgtagataagtaagtactttgagggcaaggacttggtgtcactgttttaactgcagtgcccagaacagtgtttgatcctcaataaaatatgtgttgactacctgttaataat

SEQ ID NO: 102232 - DNA, 601 bp, Homo sapiens
tgccagtattttattgaggatttttgcatcgatgttcatcagggtctaaaattctctttttttgttgtgtctctgccaggttttggtatcaggatgataccctaactcattttatgaggccagcatcatcctgataccaaagcctgaattcatctattttctaatcaacgtaggaagacttcacggaggtggaaagtgagtcctctctggtaggaaaggtagggatttaaaaatccaggagcttttgaatgaaagagaagtggctgggacaggaagggatctgcaggcatctagcacagttttagaaagagcgtgggagcctactaacaattacaaccgcttggagtgggctggagtgatctgacttaatgttttatagtgatgttaagtcatatgtatcacatagtttctgaagtttgatagcaatagggatccttttcatatgttatgtaattaaatttacccccgggggaaagtataactttttcagcagtctattttaagtctcttctttatagtcttaatcatatgaattgttctatacaggattgtggcatggaagagacacttttaatcaaatgttaaccatatttcttactgt

SEQ ID NO: 102233 - DNA, 603 bp, Homo sapiens
gcagggtggagcacaactttgatctcaaaggaattcatctcaaacagtgaaaccagaatcccaagaaagatgtgggagggattttccgagaaaacctccccacgttccgaagacagagacctgtcacacagggccaaggaaaaatcatggagctgggagcaggaggcctggaaatgcaattataaccttttgcctcccctgcacctgaggcttgctacaggccaagtccatctagctatgtgcatagacactccagagtggaactctcacccaccaggaggttgcctcgggagataacagtccatcgacgatccaaaggatgtccgtgacgaaactctctcccacctggagagttttcagctgctttacaacctagtcctgcccatgaaggtgccagcagtcaccagttttaccaccgcctggtagataaagcaccaagttagcgcacagaccccccaaacctgctcgcttcctccctgtgtgccgttcatgttaggcccccttcaaaaagcacttgccttctgctccaaaagtcaagccttaaggcaggaagcctgtacttcttcccctaagctagcttgggaataaaaagtgactttcttt

SEQ ID NO: 102234 - DNA, 121 bp, Homo sapiens
gtgaggaaactgaagtccaggaacaggttcggagccagctccccgctttccagagttgaggagaggaggaaggagagaggggggaatcgcaggagagggagagaagccggcgggattcgag

SEQ ID NO: 102235 - DNA, 1130 bp, Homo sapiens
  misc_feature (1072)..(1072): n is a, c, g, or t
  misc_feature (1077)..(1078): n is a, c, g, or t
cccggcattccgtgctccttggttccggcgttggagctctttggggcccagctttgcggacccgggagctcgggacgcaggcggggcttgtgctccgcgggggcagggcgtagggtgggcctcctacctcccctgatctcgcggtttgttccgtttcattggagcttcccggaccgtgtgctcgacggtgccctaggtgccgtggggccacacgcgagtctgataagcaccctcccccggaatcatgcggtgctgtgaggcctagcgaagatgaagatagaatgcaagtttacagaagcacttgcagaactcatcagaagccaccccgcttatcagcagatctcaagagagcgttcggtggaggccctgggtctgcacagctcacctccctgggaactgctcgcccgagcgtcggagccggcgctggccccctgcagccggaaggttgcagccgcaggagccccggaggcccaggacacagggctcttgctcttgcagaatccacaggtctttcttgaggaaatctgtagacagaactttgtgctgcgtttttatctagggaaggaacagaagagtgtcgtctcctagaaatctagcactggagaaacgaggaaaattcttccagcgatggtctcccactcagagctgaggaagcttttctactcagcagatgctgtgtgttttgatgttgacagcacggtcatcagagaagaaggaatcgatgagctagccaaaatctgtggcgttgaggacgcggtgtcagaaatgacacggcgagccatgggcggggcagtgcctttcaaagctgctctcacagagcgcttagccctcatccagccctccagggagcaggtgcagagactcatagcagagcaacccccacacctgacccccggcataagggagctggtaagtcgcctacaggagcgaaatgttcaggttttcctaatatctggtggctttaggagtattgtagagcatgttgcttcaaagctcaatatcccagcaaccaatgtatttgccaataggctgaaattctactttaacggatatgcggtttgtgagagcgccnagtgnntggggaaggcagggtaactagaaacttcaacaccgtggggggccaaaaggcc

SEQ ID NO: 102236 - DNA, 1005 bp, Homo sapiens
cccggcattccgtgctccttggttccggcgttggagctctttggggcccagctttgcggacccgggagctcgggacgcaggcggggcttgtgctccgcgggggcagggcgtagggtgggcctcctacctcccctgatctcgcggtttgttccgtttcattggagcttcccggaccgtgtgctcgacggtgccctaggtgccgtggggccacacgcgagtctgataagcaccctcccccggaatcatgcggtgctgtgaggcctagcgaagatgaagatagaatgcaaggtagaaagtgctggatacctttagaaagctgcaggactggtgcgatgggagttgagacgtaagaacctgcccgtccgtagggctctggatgctgctgaggcccgaggcccctatggcagatttgaaaattcacccttgtagagtcattcctgcctttgagcggactcccttttaagtttacagaagcacttgcagaactcatcagaagccaccccgcttatcagcagatctcaagagagcgttcggtggaggccctgggtctgcacagctcacctccctgggaactgctcgcccgagcgtcggagccggcgctggccccctgcagccggaaggttgcagccgcaggagccccggaggcccaggacacagggctcttgctcttgcagaatccacaggtctttcttgaggaaatctgtagacagaactttgtgctgcgtttttatctagggaaggaacagaagagtgtcgtctcctagaaatctagcactggagaaacgtactccagcctgggtgacagtgagaccccgtctcttaaaaaaaaaaaaaaaaaaaggattttcgaaattcacttaaggtaaaagaattaaaaacaggtttttactaattcacaagggccagcattttcccctaaatgaattaaatattaataactcctaacagcctatataaaccatttcttttttataaatgacttggaaatactcgaaagccaggttt

SEQ ID NO: 102237 - DNA, 378 bp, Homo sapiens
  misc_feature (9)..(9): n is a, c, g, or t
  misc_feature (158)..(158): n is a, c, g, or t
atgatgaanaatttttaaatacctggattccagtgatttccaaaaaggcccgtaacttttaagccatagcctactccccgggcaaaattcctccctacagagacaatattaattacaatacccacattgtgtatatattttgaaaagaggctgattancaggcttgggccaccgcgcccagccaatgtcctagagagttttgtgatctgaattctttatgtatatttgtagctatatttcatacaaagtgctttaagtgtggagagtcaattaaacacctttactcttagaaatacggattcggcagccttcagtgaatattggtttctctttggtatgtcaataaaagtttatccgtatgtcagaacggatttgtgg

SEQ ID NO: 102238 - DNA, 414 bp, Homo sapiens
catgcgtggggggcacaggctccctggctggcgtcagctaaagtggctgttgggtgtccgcaggcttctgcctggccgccgccgcctataagctaccaggaggagctttacgacttcccgtcctgcgggaagtggcgggcacgatcgcaaggtagcgcagaagcttctcaatggccagcgccagctgcagccccggcggcgcactcgcctcacctgagcctgggaggaaaattcttccagcgatggtctcccactcagagctgaggaagcttttctactcagcagatgctgtgtgttttgatgttgacagcacggtcatcagagaagaaggaatcgactgggaggcggatattgcagtgagccgagatcacaccactgcactccagcctgggcaacagagtgagacactgtctc

SEQ ID NO: 102239 - DNA, 2765 bp, Homo sapiens
cccggcattccgtgctccttggttccggcgttggagctctttggggcccagctttgcggacccgggagctcgggacgcaggcggggcttgtgctccgcgggggcagggcgtagggtgggcctcctacctcccctgatctcgcggtttgttccgtttcattggagcttcccggaccgtgtgctcgacggtgccctaggtgccgtggggccacacgcgagtctgataagcaccctcccccggaatcatgcggtgctgtgaggcctagcgaagatgaagatagaatgcaagtttacagaagcacttgcagaactcatcagaagccaccccgcttatcagcagatctcaagagagcgttcggtggaggccctgggtctgcacagctcacctccctgggaactgctcgcccgagcgtcggagccggcgctggccccctgcagccggaaggttgcagccgcaggagccccggaggcccaggacacagggctcttgctcttgcagaatccacaggtctttcttgaggaaatctgtagacagaactttgtgctgcgtttttatctagggaaggaacagaagagtgtcgtctcctagaaatctagcactggagaaacgaggaaaattcttccagcgatggtctcccactcagagctgaggaagcttttctactcagcagatgctgtgtgttttgatgttgacagcacggtcatcagagaagaaggaatcgatgagctagccaaaatctgtggcgttgaggacgcggtgtcagaaatgacacggcgagccatgggcggggcagtgcctttcaaagctgctctcacagagcgcttagccctcatccagccctccagggagcaggtgcagagactcatagcagagcaacccccacacctgacccccggcataagggagctggtaagtcgcctacaggagcgaaatgttcaggttttcctaatatctggtggctttaggagtattgtagagcatgttgcttcaaagctcaatatcccagcaaccaatgtatttgccaataggctgaaattctactttaacggtgaatatgcaggttttgatgagacgcagccaacagctgaatctggtggaaaaggaaaagtgattaaacttttaaaggaaaaatttcattttaagaaaataatcatgattggagatggtgccacagatatggaagcctgtcctcctgctgatgctttcattggatttggaggaaatgtgatcaggcaacaagtcaaggataacgccaaatggtatatcactgattttgtagagctgctgggagaactggaagaataacatccattgtcgtacagctccaaacaacttcagatgaatttttacaagttatacagattgatactgtttgcttacagttgcctattacaacttgctatagaaagttggtacaaatgatctgtactttaaactacagttaggaatcctagaagattgctttttttttttttttaactgtagttccagtattatatgatgactattgatttcctggagaggttttttttttttttgagacagaatcttgctctgttgcccaggctggagtgcagtggcgcggtctcggctcactgcaagctctgcctcccaggttcacgccattctcctgcctcagcctcccgagtagctgggactacaggcgcccgccaccacatccggctaattttttgtatttttagtagagacggggtttgaccgtgttagccaggatggtcttgatctcctgaccttgtgatccgcctgcctcagcctcccaaagtgctgggattacaggcttgggccaccgcgcccagccaatgtcctagagagttttgtgatctgaattctttatgtatatttgtagctatatttcatacaaagtgctttaagtgtggagagtcaattaaacacctttactcttagaaatacggattcggcagccttcagtgaatattggtttctctttggtatgtcaataaaagtttatccgtatgtcagaacggatttgtggaattttcagttctgcctcttgcatattggaatacccaatatttcaggtaccgtgttgaagcataaatagcccccaggcaagaaacaggcttaagactctactttgcttagtgctgggtacaatgtcctcaccccatgagcccactcccacttcctgaagccctgggacctggaaagtcctttttttttacttcttgggattgtcatatatgaaatgttacaaaagttttttgtttttgttttcctccaatataacaatagagtcttaaacaaaagtactgattaaaaatggatatttgggctcaggcctgtaatctcagcactgtgggaggacaagttaagaggatcacttgaggacaggaattcgagaccagcctggacaacagagcaagaccctgtctctgcaaaaaataaaaacattagctggatgtggcggcacgcacctgtagtcccagctacttggtgggctgagatgggaggatcccttgaactcagtagttcaaggctgcagtgagctgtgactctgccattgtactccagcctgggtgacagtgagaccccgtctcttaaaaaaaaaaaaaaaaaaaggattttcgaaattcacttaaggtaaaagaattaaaaacaggtttttactaattcacaagggccagcattttcccctaaatgaattaaatattaataactcctaacagcctatataaaccatttcttttttataaatgacttggaaatactcgaaagccaggttt

SEQ ID NO: 102240 - DNA, 2512 bp, Homo sapiens
cggctttgcagagcagacagatctggtgtctccagtttacagaagcacttgcagaactcatcagaagccaccccgcttatcagcagatctcaagagagcgttcggtggaggccctgggtctgcacagctcacctccctgggaactgctcgcccgagcgtcggagccggcgctggccccctgcagccggaaggttgcagccgcaggagccccggaggcccaggacacagggctcttgctcttgcagaatccacaggtctttcttgaggaaatctgtagacagaactttgtgctgcgtttttatctagggaaggaacagaagagtgtcgtctcctagaaatctagcactggagaaacgaggaaaattcttccagcgatggtctcccactcagagctgaggaagcttttctactcagcagatgctgtgtgttttgatgttgacagcacggtcatcagagaagaaggaatcgatgagctagccaaaatctgtggcgttgaggacgcggtgtcagaaatgacacggcgagccatgggcggggcagtgcctttcaaagctgctctcacagagcgcttagccctcatccagccctccagggagcaggtgcagagactcatagcagagcaacccccacacctgacccccggcataagggagctggtaagtcgcctacaggagcgaaatgttcaggttttcctaatatctggtggctttaggagtattgtagagcatgttgcttcaaagctcaatatcccagcaaccaatgtatttgccaataggctgaaattctactttaacggtgaatatgcaggttttgatgagacgcagccaacagctgaatctggtggaaaaggaaaagtgattaaacttttaaaggaaaaatttcattttaagaaaataatcatgattggagatggtgccacagatatggaagcctgtcctcctgctgatgctttcattggatttggaggaaatgtgatcaggcaacaagtcaaggataacgccaaatggtatatcactgattttgtagagctgctgggagaactggaagaataacatccattgtcgtacagctccaaacaacttcagatgaatttttacaagttatacagattgatactgtttgcttacagttgcctattacaacttgctatagaaagttggtacaaatgatctgtactttaaactacagttaggaatcctagaagattgctttttttttttttttaactgtagttccagtattatatgatgactattgatttcctggagaggttttttttttttttgagacagaatcttgctctgttgcccaggctggagtgcagtggcgcggtctcggctcactgcaagctctgcctcccaggttcacgccattctcctgcctcagcctcccgagtagctgggactacaggcgcccgccaccacatccggctaattttttgtatttttagtagagacggggtttgaccgtgttagccaggatggtcttgatctcctgaccttgtgatccgcctgcctcagcctcccaaagtgctgggattacaggcttgggccaccgcgcccagccaatgtcctagagagttttgtgatctgaattctttatgtatatttgtagctatatttcatacaaagtgctttaagtgtggagagtcaattaaacacctttactcttagaaatacggattcggcagccttcagtgaatattggtttctctttggtatgtcaataaaagtttatccgtatgtcagaacggatttgtggaattttcagttctgcctcttgcatattggaatacccaatatttcaggtaccgtgttgaagcataaatagcccccaggcaagaaacaggcttaagactctactttgcttagtgctgggtacaatgtcctcaccccatgagcccactcccacttcctgaagccctgggacctggaaagtcctttttttttacttcttgggattgtcatatatgaaatgttacaaaagttttttgtttttgttttcctccaatataacaatagagtcttaaacaaaagtactgattaaaaatggatatttgggctcaggcctgtaatctcagcactgtgggaggacaagttaagaggatcacttgaggacaggaattcgagaccagcctggacaacagagcaagaccctgtctctgcaaaaaataaaaacattagctggatgtggcggcacgcacctgtagtcccagctacttggtgggctgagatgggaggatcccttgaactcagtagttcaaggctgcagtgagctgtgactctgccattgtactccagcctgggtgacagtgagaccccgtctcttaaaaaaaaaaaaaaaaaaaggattttcgaaattcacttaaggtaaaagaattaaaaacaggtttttactaattcacaagggccagcattttcccctaaatgaattaaatattaataactcctaacagcctatataaaccatttcttttttataaatgacttggaaatactcgaaagccaggttt

SEQ ID NO: 102241 - DNA, 2663 bp, Homo sapiens
cggacgcgtgggtcgacccacgcgtccgctttagaaagctgcaggactggtgcgatgggagttgagacgtaagaacctgcccgtccgtagggctctggatgctgctgaggcccgaggcccctatggcagatttgaaaattcacccttgtagagtcattcctgcctttgagcggactcccttttaagtttacagaagcacttgcagaactcatcagaagccaccccgcttatcagcagatctcaagagagcgttcggtggaggccctgggtctgcacagctcacctccctgggaactgctcgcccgagcgtcggagccggcgctggccccctgcagccggaaggttgcagccgcaggagccccggaggcccaggacacagggctcttgctcttgcagaatccacaggtctttcttgaggaaatctgtagacagaactttgtgctgcgtttttatctagggaaggaacagaagagtgtcgtctcctagaaatctagcactggagaaacgaggaaaattcttccagcgatggtctcccactcagagctgaggaagcttttctactcagcagatgctgtgtgttttgatgttgacagcacggtcatcagagaagaaggaatcgatgagctagccaaaatctgtggcgttgaggacgcggtgtcagaaatgacacggcgagccatgggcggggcagtgcctttcaaagctgctctcacagagcgcttagccctcatccagccctccagggagcaggtgcagagactcatagcagagcaacccccacacctgacccccggcataagggagctggtaagtcgcctacaggagcgaaatgttcaggttttcctaatatctggtggctttaggagtattgtagagcatgttgcttcaaagctcaatatcccagcaaccaatgtatttgccaataggctgaaattctactttaacggtgaatatgcaggttttgatgagacgcagccaacagctgaatctggtggaaaaggaaaagtgattaaacttttaaaggaaaaatttcattttaagaaaataatcatgattggagatggtgccacagatatggaagcctgtcctcctgctgatgctttcattggatttggaggaaatgtgatcaggcaacaagtcaaggataacgccaaatggtatatcactgattttgtagagctgctgggagaactggaagaataacatccattgtcgtacagctccaaacaacttcagatgaatttttacaagttatacagattgatactgtttgcttacagttgcctattacaacttgctatagaaagttggtacaaatgatctgtactttaaactacagttaggaatcctagaagattgctttttttttttttttaactgtagttccagtattatatgatgactattgatttcctggagaggttttttttttttttgagacagaatcttgctctgttgcccaggctggagtgcagtggcgcggtctcggctcactgcaagctctgcctcccaggttcacgccattctcctgcctcagcctcccgagtagctgggactacaggcgcccgccaccacatccggctaattttttgtatttttagtagagacggggtttgaccgtgttagccaggatggtcttgatctcctgaccttgtgatccgcctgcctcagcctcccaaagtgctgggattacaggcttgggccaccgcgcccagccaatgtcctagagagttttgtgatctgaattctttatgtatatttgtagctatatttcatacaaagtgctttaagtgtggagagtcaattaaacacctttactcttagaaatacggattcggcagccttcagtgaatattggtttctctttggtatgtcaataaaagtttatccgtatgtcagaacggatttgtggaattttcagttctgcctcttgcatattggaatacccaatatttcaggtaccgtgttgaagcataaatagcccccaggcaagaaacaggcttaagactctactttgcttagtgctgggtacaatgtcctcaccccatgagcccactcccacttcctgaagccctgggacctggaaagtcctttttttttacttcttgggattgtcatatatgaaatgttacaaaagttttttgtttttgttttcctccaatataacaatagagtcttaaacaaaagtactgattaaaaatggatatttgggctcaggcctgtaatctcagcactgtgggaggacaagttaagaggatcacttgaggacaggaattcgagaccagcctggacaacagagcaagaccctgtctctgcaaaaaataaaaacattagctggatgtggcggcacgcacctgtagtcccagctacttggtgggctgagatgggaggatcccttgaactcagtagttcaaggctgcagtgagctgtgactctgccattgtactccagcctgggtgacagtgagaccccgtctcttaaaaaaaaaaaaaaaaaaaggattttcgaaattcacttaaggtaaaagaattaaaaacaggtttttactaattcacaagggccagcattttcccctaaatgaattaaatattaataactcctaacagcctatataaaccatttcttttttataaatgacttggaaatactcgaaagccaggttt

SEQ ID NO: 102242 - DNA, 3006 bp, Homo sapiens
cccggcattccgtgctccttggttccggcgttggagctctttggggcccagctttgcggacccgggagctcgggacgcaggcggggcttgtgctccgcgggggcagggcgtagggtgggcctcctacctcccctgatctcgcggtttgttccgtttcattggagcttcccggaccgtgtgctcgacggtgccctaggtgccgtggggccacacgcgagtctgataagcaccctcccccggaatcatgcggtgctgtgaggcctagcgaagatgaagatagaatgcaaggtagaaagtgctggatacctttagaaagctgcaggactggtgcgatgggagttgagacgtaagaacctgcccgtccgtagggctctggatgctgctgaggcccgaggcccctatggcagatttgaaaattcacccttgtagagtcattcctgcctttgagcggactcccttttaagagatctcaagagagcgttcggtggaggccctgggtctgcacagctcacctccctgggaactgctcgcccgagcgtcggagccggcgctggccccctgcagccggaaggttgcagccgcaggagccccggaggcccaggacacaggacagagtctcgttctgtcgcccaggctggagtgcagtggtgtgatctcggctcacttcaacctccgcctacagggttcaagggattctcctgcctcagcctcctgagtatctgggctcttgctcttgcagaatccacaggtctttcttgaggaaatctgtagacagaactttgtgctgcgtttttatctagggaaggaacagaagagtgtcgtctcctagaaatctagcactggagaaacgaggaaaattcttccagcgatggtctcccactcagagctgaggaagcttttctactcagcagatgctgtgtgttttgatgttgacagcacggtcatcagagaagaaggaatcgatgagctagccaaaatctgtggcgttgaggacgcggtgtcagaaatgacacggcgagccatgggcggggcagtgcctttcaaagctgctctcacagagcgcttagccctcatccagccctccagggagcaggtgcagagactcatagcagagcaacccccacacctgacccccggcataagggagctggtaagtcgcctacaggagcgaaatgttcaggttttcctaatatctggtggctttaggagtattgtagagcatgttgcttcaaagctcaatatcccagcaaccaatgtatttgccaataggctgaaattctactttaacggtgaatatgcaggttttgatgagacgcagccaacagctgaatctggtggaaaaggaaaagtgattaaacttttaaaggaaaaatttcattttaagaaaataatcatgattggagatggtgccacagatatggaagcctgtcctcctgctgatgctttcattggatttggaggaaatgtgatcaggcaacaagtcaaggataacgccaaatggtatatcactgattttgtagagctgctgggagaactggaagaataacatccattgtcgtacagctccaaacaacttcagatgaatttttacaagttatacagattgatactgtttgcttacagttgcctattacaacttgctatagaaagttggtacaaatgatctgtactttaaactacagttaggaatcctagaagattgctttttttttttttttaactgtagttccagtattatatgatgactattgatttcctggagaggttttttttttttttgagacagaatcttgctctgttgcccaggctggagtgcagtggcgcggtctcggctcactgcaagctctgcctcccaggttcacgccattctcctgcctcagcctcccgagtagctgggactacaggcgcccgccaccacatccggctaattttttgtatttttagtagagacggggtttgaccgtgttagccaggatggtcttgatctcctgaccttgtgatccgcctgcctcagcctcccaaagtgctgggattacaggcttgggccaccgcgcccagccaatgtcctagagagttttgtgatctgaattctttatgtatatttgtagctatatttcatacaaagtgctttaagtgtggagagtcaattaaacacctttactcttagaaatacggattcggcagccttcagtgaatattggtttctctttggtatgtcaataaaagtttatccgtatgtcagaacggatttgtggaattttcagttctgcctcttgcatattggaatacccaatatttcaggtaccgtgttgaagcataaatagcccccaggcaagaaacaggcttaagactctactttgcttagtgctgggtacaatgtcctcaccccatgagcccactcccacttcctgaagccctgggacctggaaagtcctttttttttacttcttgggattgtcatatatgaaatgttacaaaagttttttgtttttgttttcctccaatataacaatagagtcttaaacaaaagtactgattaaaaatggatatttgggctcaggcctgtaatctcagcactgtgggaggacaagttaagaggatcacttgaggacaggaattcgagaccagcctggacaacagagcaagaccctgtctctgcaaaaaataaaaacattagctggatgtggcggcacgcacctgtagtcccagctacttggtgggctgagatgggaggatcccttgaactcagtagttcaaggctgcagtgagctgtgactctgccattgtactccagcctgggtgacagtgagaccccgtctcttaaaaaaaaaaaaaaaaaaaggattttcgaaattcacttaaggtaaaagaattaaaaacaggtttttactaattcacaagggccagcattttcccctaaatgaattaaatattaataactcctaacagcctatataaaccatttcttttttataaatgacttggaaatactcgaaagccaggttt

SEQ ID NO: 102243 - DNA, 2870 bp, Homo sapiens
cccggcattccgtgctccttggttccggcgttggagctctttggggcccagctttgcggacccgggagctcgggacgcaggcggggcttgtgctccgcgggggcagggcgtagggtgggcctcctacctcccctgatctcgcggtttgttccgtttcattggagcttcccggaccgtgtgctcgacggtgccctaggtgccgtggggccacacgcgagtctgataagcaccctcccccggaatcatgcggtgctgtgaggcctagcgaagatgaagatagaatgcaaggtagaaagtgctggatacctttagaaagctgcaggactggtgcgatgggagttgagacgtaagaacctgcccgtccgtagggctctggatgctgctgaggcccgaggcccctatggcagatttgaaaattcacccttgtagagtcattcctgcctttgagcggactcccttttaagtttacagaagcacttgcagaactcatcagaagccaccccgcttatcagcagatctcaagagagcgttcggtggaggccctgggtctgcacagctcacctccctgggaactgctcgcccgagcgtcggagccggcgctggccccctgcagccggaaggttgcagccgcaggagccccggaggcccaggacacaggatctagggaaggaacagaagagtgtcgtctcctagaaatctagcactggagaaacgaggaaaattcttccagcgatggtctcccactcagagctgaggaagcttttctactcagcagatgctgtgtgttttgatgttgacagcacggtcatcagagaagaaggaatcgatgagctagccaaaatctgtggcgttgaggacgcggtgtcagaaatgacacggcgagccatgggcggggcagtgcctttcaaagctgctctcacagagcgcttagccctcatccagccctccagggagcaggtgcagagactcatagcagagcaacccccacacctgacccccggcataagggagctggtaagtcgcctacaggagcgaaatgttcaggttttcctaatatctggtggctttaggagtattgtagagcatgttgcttcaaagctcaatatcccagcaaccaatgtatttgccaataggctgaaattctactttaacggtgaatatgcaggttttgatgagacgcagccaacagctgaatctggtggaaaaggaaaagtgattaaacttttaaaggaaaaatttcattttaagaaaataatcatgattggagatggtgccacagatatggaagcctgtcctcctgctgatgctttcattggatttggaggaaatgtgatcaggcaacaagtcaaggataacgccaaatggtatatcactgattttgtagagctgctgggagaactggaagaataacatccattgtcgtacagctccaaacaacttcagatgaatttttacaagttatacagattgatactgtttgcttacagttgcctattacaacttgctatagaaagttggtacaaatgatctgtactttaaactacagttaggaatcctagaagattgctttttttttttttttaactgtagttccagtattatatgatgactattgatttcctggagaggttttttttttttttgagacagaatcttgctctgttgcccaggctggagtgcagtggcgcggtctcggctcactgcaagctctgcctcccaggttcacgccattctcctgcctcagcctcccgagtagctgggactacaggcgcccgccaccacatccggctaattttttgtatttttagtagagacggggtttgaccgtgttagccaggatggtcttgatctcctgaccttgtgatccgcctgcctcagcctcccaaagtgctgggattacaggcttgggccaccgcgcccagccaatgtcctagagagttttgtgatctgaattctttatgtatatttgtagctatatttcatacaaagtgctttaagtgtggagagtcaattaaacacctttactcttagaaatacggattcggcagccttcagtgaatattggtttctctttggtatgtcaataaaagtttatccgtatgtcagaacggatttgtggaattttcagttctgcctcttgcatattggaatacccaatatttcaggtaccgtgttgaagcataaatagcccccaggcaagaaacaggcttaagactctactttgcttagtgctgggtacaatgtcctcaccccatgagcccactcccacttcctgaagccctgggacctggaaagtcctttttttttacttcttgggattgtcatatatgaaatgttacaaaagttttttgtttttgttttcctccaatataacaatagagtcttaaacaaaagtactgattaaaaatggatatttgggctcaggcctgtaatctcagcactgtgggaggacaagttaagaggatcacttgaggacaggaattcgagaccagcctggacaacagagcaagaccctgtctctgcaaaaaataaaaacattagctggatgtggcggcacgcacctgtagtcccagctacttggtgggctgagatgggaggatcccttgaactcagtagttcaaggctgcagtgagctgtgactctgccattgtactccagcctgggtgacagtgagaccccgtctcttaaaaaaaaaaaaaaaaaaaggattttcgaaattcacttaaggtaaaagaattaaaaacaggtttttactaattcacaagggccagcattttcccctaaatgaattaaatattaataactcctaacagcctatataaaccatttcttttttataaatgacttggaaatactcgaaagccaggttt

SEQ ID NO: 102244 - DNA, 2071 bp, Homo sapiens
cggacgcgtgggtcgacccacgcgtccgtgagctagccaaaatctgtggcgttgaggacgcggtgtcagaaatgacacggcgagccatgggcggggcagtgcctttcaaagctgctctcacagagcgcttagccctcatccagccctccagggagcaggtgcagagactcatagcagagcaacccccacacctgacccccggcataagggagctggtaagtcgcctacaggagcgaaatgttcaggttttcctaatatctggtggctttaggagtattgtagagcatgttgcttcaaagctcaatatcccagcaaccaatgtatttgccaataggctgaaattctactttaacggtgaatatgcaggttttgatgagacgcagccaacagctgaatctggtggaaaaggaaaagtgattaaacttttaaaggaaaaatttcattttaagaaaataatcatgattggagatggtgccacagatatggaagcctgtcctcctgctgatgctttcattggatttggaggaaatgtgatcaggcaacaagtcaaggataacgccaaatggtatatcactgattttgtagagctgctgggagaactggaagaataacatccattgtcgtacagctccaaacaacttcagatgaatttttacaagttatacagattgatactgtttgcttacagttgcctattacaacttgctatagaaagttggtacaaatgatctgtactttaaactacagttaggaatcctagaagattgctttttttttttttttaactgtagttccagtattatatgatgactattgatttcctggagaggttttttttttttttgagacagaatcttgctctgttgcccaggctggagtgcagtggcgcggtctcggctcactgcaagctctgcctcccaggttcacgccattctcctgcctcagcctcccgagtagctgggactacaggcgcccgccaccacatccggctaattttttgtatttttagtagagacggggtttgaccgtgttagccaggatggtcttgatctcctgaccttgtgatccgcctgcctcagcctcccaaagtgctgggattacaggcttgggccaccgcgcccagccaatgtcctagagagttttgtgatctgaattctttatgtatatttgtagctatatttcatacaaagtgctttaagtgtggagagtcaattaaacacctttactcttagaaatacggattcggcagccttcagtgaatattggtttctctttggtatgtcaataaaagtttatccgtatgtcagaacggatttgtggaattttcagttctgcctcttgcatattggaatacccaatatttcaggtaccgtgttgaagcataaatagcccccaggcaagaaacaggcttaagactctactttgcttagtgctgggtacaatgtcctcaccccatgagcccactcccacttcctgaagccctgggacctggaaagtcctttttttttacttcttgggattgtcatatatgaaatgttacaaaagttttttgtttttgttttcctccaatataacaatagagtcttaaacaaaagtactgattaaaaatggatatttgggctcaggcctgtaatctcagcactgtgggaggacaagttaagaggatcacttgaggacaggaattcgagaccagcctggacaacagagcaagaccctgtctctgcaaaaaataaaaacattagctggatgtggcggcacgcacctgtagtcccagctacttggtgggctgagatgggaggatcccttgaactcagtagttcaaggctgcagtgagctgtgactctgccattgtactccagcctgggtgacagtgagaccccgtctcttaaaaaaaaaaaaaaaaaaaggattttcgaaattcacttaaggtaaaagaattaaaaacaggtttttactaattcacaagggccagcattttcccctaaatgaattaaatattaataactcctaacagcctatataaaccatttcttttttataaatgacttggaaatactcgaaagccaggttt

SEQ ID NO: 102245 - DNA, 2751 bp, Homo sapiens
cccggcattccgtgctccttggttccggcgttggagctctttggggcccagctttgcggacccgggagctcgggacgcaggcggggcttgtgctccgcgggggcagggcgtagggtgggcctcctacctcccctgatctcgcggtttgttccgtttcattggagcttcccggaccgtgtgctcgacggtgccctaggtgccgtggggccacacgcgagtctgataagcaccctcccccggaatcatgcggtgctgtgaggcctagcgaagatgaagatagaatgcaaggtagaaagtgctggatacctttagaaagctgcaggactggtgcgatgggagttgagacgtaagaacctgcccgtccgtagggctctggatgctgctgaggcccgaggcccctatggcagatttgaaaattcacccttgtagagtcattcctgcctttgagcggactcccttttaagtttacagaagcacttgcagaactcatcagaagccaccccgcttatcagcagatctcaagagagcgttcggtggaggccctgggtctgcacagctcacctccctgggaactgctcgcccgagcgtcggagccggcgctggccccctgcagccggaaggttgcagccgcaggagccccggaggcccaggacacagggctcttgctcttgcagaatccacaggtctttcttgaggaaatctgtagacagaactttgtgctgcgtttttgaggaaaattcttccagcgatggtctcccactcagagctgaggaagcttttctactcagcagatgctgtgtgttttgatgttgacagcacggtcatcagagaagaaggaatcgatgagctagccaaaatctgtggcgttgaggacgcggtgtcagaaatggagctggtaagtcgcctacaggagcgaaatgttcaggttttcctaatatctggtggctttaggagtattgtagagcatgttgcttcaaagctcaatatcccagcaaccaatgtatttgccaataggctgaaattctactttaacggtgaatatgcaggttttgatgagacgcagccaacagctgaatctggtggaaaaggaaaagtgattaaacttttaaaggaaaaatttcattttaagaaaataatcatgattggagatggtgccacagatatggaagcctgtcctcctgctgatgctttcattggatttggaggaaatgtgatcaggcaacaagtcaaggataacgccaaatggtatatcactgattttgtagagctgctgggagaactggaagaataacatccattgtcgtacagctccaaacaacttcagatgaatttttacaagttatacagattgatactgtttgcttacagttgcctattacaacttgctatagaaagttggtacaaatgatctgtactttaaactacagttaggaatcctagaagattgctttttttttttttttaactgtagttccagtattatatgatgactattgatttcctggagaggttttttttttttttgagacagaatcttgctctgttgcccaggctggagtgcagtggcgcggtctcggctcactgcaagctctgcctcccaggttcacgccattctcctgcctcagcctcccgagtagctgggactacaggcgcccgccaccacatccggctaattttttgtatttttagtagagacggggtttgaccgtgttagccaggatggtcttgatctcctgaccttgtgatccgcctgcctcagcctcccaaagtgctgggattacaggcttgggccaccgcgcccagccaatgtcctagagagttttgtgatctgaattctttatgtatatttgtagctatatttcatacaaagtgctttaagtgtggagagtcaattaaacacctttactcttagaaatacggattcggcagccttcagtgaatattggtttctctttggtatgtcaataaaagtttatccgtatgtcagaacggatttgtggaattttcagttctgcctcttgcatattggaatacccaatatttcaggtaccgtgttgaagcataaatagcccccaggcaagaaacaggcttaagactctactttgcttagtgctgggtacaatgtcctcaccccatgagcccactcccacttcctgaagccctgggacctggaaagtcctttttttttacttcttgggattgtcatatatgaaatgttacaaaagttttttgtttttgttttcctccaatataacaatagagtcttaaacaaaagtactgattaaaaatggatatttgggctcaggcctgtaatctcagcactgtgggaggacaagttaagaggatcacttgaggacaggaattcgagaccagcctggacaacagagcaagaccctgtctctgcaaaaaataaaaacattagctggatgtggcggcacgcacctgtagtcccagctacttggtgggctgagatgggaggatcccttgaactcagtagttcaaggctgcagtgagctgtgactctgccattgtactccagcctgggtgacagtgagaccccgtctcttaaaaaaaaaaaaaaaaaaaggattttcgaaattcacttaaggtaaaagaattaaaaacaggtttttactaattcacaagggccagcattttcccctaaatgaattaaatattaataactcctaacagcctatataaaccatttcttttttataaatgacttggaaatactcgaaagccaggttt

SEQ ID NO: 102246 - DNA, 1946 bp, Homo sapiens
cggctttgcagagcagacagatctggtgtctccagtttacagaagcacttgcagaactcatcagaagccaccccgcttatcagcagatctcaagagagcgttcggtggaggccctgggtctgcacagctcacctccctgggaactgctcgcccgagcgtcggagccggcgctggccccctgcagccggaaggttgcagccgcaggagccccggaggcccaggacacagggtgaatatgcaggttttgatgagacgcagccaacagctgaatctggtggaaaaggaaaagtgattaaacttttaaaggaaaaatttcattttaagaaaataatcatgattggagatggtgccacagatatggaagcctgtcctcctgctgatgctttcattggatttggaggaaatgtgatcaggcaacaagtcaaggataacgccaaatggtatatcactgattttgtagagctgctgggagaactggaagaataacatccattgtcgtacagctccaaacaacttcagatgaatttttacaagttatacagattgatactgtttgcttacagttgcctattacaacttgctatagaaagttggtacaaatgatctgtactttaaactacagttaggaatcctagaagattgctttttttttttttttaactgtagttccagtattatatgatgactattgatttcctggagaggttttttttttttttgagacagaatcttgctctgttgcccaggctggagtgcagtggcgcggtctcggctcactgcaagctctgcctcccaggttcacgccattctcctgcctcagcctcccgagtagctgggactacaggcgcccgccaccacatccggctaattttttgtatttttagtagagacggggtttgaccgtgttagccaggatggtcttgatctcctgaccttgtgatccgcctgcctcagcctcccaaagtgctgggattacaggcttgggccaccgcgcccagccaatgtcctagagagttttgtgatctgaattctttatgtatatttgtagctatatttcatacaaagtgctttaagtgtggagagtcaattaaacacctttactcttagaaatacggattcggcagccttcagtgaatattggtttctctttggtatgtcaataaaagtttatccgtatgtcagaacggatttgtggaattttcagttctgcctcttgcatattggaatacccaatatttcaggtaccgtgttgaagcataaatagcccccaggcaagaaacaggcttaagactctactttgcttagtgctgggtacaatgtcctcaccccatgagcccactcccacttcctgaagccctgggacctggaaagtcctttttttttacttcttgggattgtcatatatgaaatgttacaaaagttttttgtttttgttttcctccaatataacaatagagtcttaaacaaaagtactgattaaaaatggatatttgggctcaggcctgtaatctcagcactgtgggaggacaagttaagaggatcacttgaggacaggaattcgagaccagcctggacaacagagcaagaccctgtctctgcaaaaaataaaaacattagctggatgtggcggcacgcacctgtagtcccagctacttggtgggctgagatgggaggatcccttgaactcagtagttcaaggctgcagtgagctgtgactctgccattgtactccagcctgggtgacagtgagaccccgtctcttaaaaaaaaaaaaaaaaaaaggattttcgaaattcacttaaggtaaaagaattaaaaacaggtttttactaattcacaagggccagcattttcccctaaatgaattaaatattaataactcctaacagcctatataaaccatttcttttttataaatgacttggaaatactcgaaagccaggttt

SEQ ID NO: 102247 - DNA, 955 bp, Homo sapiens
cccggcattccgtgctccttggttccggcgttggagctctttggggcccagctttgcggacccgggagctcgggacgcaggcggggcttgtgctccgcgggggcagggcgtagggtgggcctcctacctcccctgatctcgcggtttgttccgtttcattggagcttcccggaccgtgtgctcgacggtgccctaggtgccgtggggccacacgcgagtctgataagcaccctcccccggaatcatgcggtgctgtgaggcctagcgaagatgaagatagaatgcaaggtagaaagtgctggatacctttagaaagctgcaggactggtgcgatgggagttgagacgtaagaacctgcccgtccgtagggctctggatgctgctgaggcccgaggcccctatggcagatttgaaaattcacccttgtagagtcattcctgcctttgagcggactcccttttaagagtcttaaacaaaagtactgattaaaaatggatatttgggctcaggcctgtaatctcagcactgtgggaggacaagttaagaggatcacttgaggacaggaattcgagaccagcctggacaacagagcaagaccctgtctctgcaaaaaataaaaacattagctggatgtggcggcacgcacctgtagtcccagctacttggtgggctgagatgggaggatcccttgaactcagtagttcaaggctgcagtgagctgtgactctgccattgtactccagcctgggtgacagtgagaccccgtctcttaaaaaaaaaaaaaaaaaaaggattttcgaaattcacttaaggtaaaagaattaaaaacaggtttttactaattcacaagggccagcattttcccctaaatgaattaaatattaataactcctaacagcctatataaaccatttcttttttataaatgacttggaaatactcgaaagccaggttt

SEQ ID NO: 102248 - DNA, 1629 bp, Homo sapiens
catgcgtggggggcacaggctccctggctggcgtcagctaaagtggctgttgggtgtccgcaggcttctgcctggccgccgccgcctataagctaccaggaggagctttacgacttcccgtcctgcgggaagtggcgggcacgatcgcaaggtagcgcagaagcttctcaatggccagcgccagctgcagccccggcggcgcactcgcctcacctgagcctgggaggaaaattcttccagcgatggtctcccactcagagctgaggaagcttttctactcagcagatgctgtgtgttttgatgttgacagcacggtcatcagagaagaaggaatcgatgagctagccaaaatctgtggcgttgaggacgcggtgtcagaaatgacacggcgagccatgggcggggcagtgcctttcaaagctgctctcacagagcgcttagccctcatccagccctccagggagcaggtgcagagactcatagcagagcaacccccacacctgacccccggcataagggagctggtaagtcgcctacaggagcgaaatgttcaggttttcctaatatctggtggctttaggagtattgtagagcatgttgcttcaaagctcaatatcccagcaaccaatgtatttgccaataggctgaaattctactttaacggtgaatatgcaggttttgatgagacgcagccaacagctgaatctggtggaaaaggaaaagtgattaaacttttaaaggaaaaatttcattttaagaaaataatcatgattggagatggtgccacagatatggaagcctgtcctcctgctgatgctttcattggatttggaggaaatgtgatcaggcaacaagtcaaggataacgccaaatggtatatcactgattttgtagagctgctgggagaactggaagaataacatccattgtcgtacagctccaaacaacttcagatgaatttttacaagttatacagattgatactgtttgcttacagttgcctattacaacttgctatagaaagttggtacaaatgatctgtactttaaactacagttaggaatcctagaagattgctttttttttttttttaactgtagttccagtattatatgatgactattgatttcctggagaggttttttttttttttgagacagaatcttgctctgttgcccaggctggagtgcagtggcgcggtctcggctcactgcaagctctgcctcccaggttcacgccattctcctgcctcagcctcccgagtagctgggactacaggcgcccgccaccacatccggctaattttttgtatttttagtagagacggggtttgaccgtgttagccaggatggtcttgatctcctgaccttgtgatccgcctgcctcagcctcccaaagtgctgggattacaggcttgggccaccgcgcccagccaatgtcctagagagttttgtgatctgaattctttatgtatatttgtagctatatttcatacaaagtgctttaagtgtggagagtcaattaaacacctttactcttagaaatacggattcggcagccttcagtgaatattggtttctctttggtatgtcaataaaagtttatccgtatgtcagaacggatttgtgg

SEQ ID NO: 102249 - DNA, 950 bp, Homo sapiens
catgcgtggggggcacaggctccctggctggcgtcagctaaagtggctgttgggtgtccgcaggcttctgcctggccgccgccgcctataagctaccaggaggagctttacgacttcccgtcctgcgggaagtggcgggcacgatcgcaaggtagcgcagaagcttctcaatggccagcgccagctgcagccccggcggcgcactcgcctcacctgagcctgggaggaaaattcttccagcgatggtctcccactcagagctgaggaagcttttctactcagcagatgctgtgtgttttgatgttgacagcacggtcatcagagaagaaggaatcgatctgtcaccaggctggagtgcaatggtgcaatctcggctcactgcaacctccgcctcctgggttcaagcaattctcctgcctccacctcctgagtagctgaaactacaggatgctttcattggatttggaggaaatgtgatcaggcaacaagtcaaggataacgccaaatggtatatcactgattttgtagagctgctgggagaaccggaagaataacatccattgtcatacagctccaaacaacttcagatgaatttttacaagttacacagattgatactgtttgcttacaattgcctattacaacttgctatagaaagttggtacagatgatctgcactgtcaagtaaactacagttaggaatcctcaaagattggtttgtttgtttttaactgtagttccagtattatatgatcactatcgatttcctggagagttttgtaatctgaattctttatgtatattcctagctatatttcatacaaagtgttttaagagtggagagtcaattaaacacctttactcttaggaatatagattcggcagccttcagtgaatattggtttttttccctttggtatgtcaataaaagtttatccatgtgtcagaac

SEQ ID NO: 102250 - DNA, 2941 bp, Homo sapiens
cccggcattccgtgctccttggttccggcgttggagctctttggggcccagctttgcggacccgggagctcgggacgcaggcggggcttgtgctccgcgggggcagggcgtagggtgggcctcctacctcccctgatctcgcggtttgttccgtttcattggagcttcccggaccgtgtgctcgacggtgccctaggtgccgtggggccacacgcgagtctgataagcaccctcccccggaatcatgcggtgctgtgaggcctagcgaagatgaagatagaatgcaaggtagaaagtgctggatacctttagaaagctgcaggactggtgcgatgggagttgagacgtaagaacctgcccgtccgtagggctctggatgctgctgaggcccgaggcccctatggcagatttgaaaattcacccttgtagagtcattcctgcctttgagcggactcccttttaagtttacagaagcacttgcagaactcatcagaagccaccccgcttatcagcagatctcaagagagcgttcggtggaggccctgggtctgcacagctcacctccctgggaactgctcgcccgagcgtcggagccggcgctggccccctgcagccggaaggttgcagccgcaggagccccggaggcccaggacacagggctcttgctcttgcagaatccacaggtctttcttgaggaaatctgtagacagaactttgtgctgcgtttttatctagggaaggaacagaagagtgtcgtctcctagaaatctagcactggagaaacgaggaaaattcttccagcgatggtctcccactcagagctgaggaagcttttctactcagcagatgctgtgtgttttgatgttgacagcacggtcatcagagaagaaggaatcgatgagctagccaaaatctgtggcgttgaggacgcggtgtcagaaatgacacggcgagccatgggcggggcagtgcctttcaaagctgctctcacagagcgcttagccctcatccagccctccagggagcaggtgcagagactcatagcagagcaacccccacacctgacccccggcataagggagctggtaagtcgcctacaggagcgaaatgttcaggttttcctaatatctggtggctttaggagtattgtagagcatgttgcttcaaagctcaatatcccagcaaccaatgtatttgccaataggctgaaattctactttaacggtgaatatgcaggttttgatgagacgcagccaacagctgaatctggtggaaaaggaaaagtgattaaacttttaaaggaaaaatttcattttaagaaaataatcatgattggagatggtgccacagatatggaagcctgtcctcctgctgatgctttcattggatttggaggaaatgtgatcaggcaacaagtcaaggataacgccaaatggtatatcactgattttgtagagctgctgggagaactggaagaataacatccattgtcgtacagctccaaacaacttcagatgaatttttacaagttatacagattgatactgtttgcttacagttgcctattacaacttgctatagaaagttggtacaaatgatctgtactttaaactacagttaggaatcctagaagattgctttttttttttttttaactgtagttccagtattatatgatgactattgatttcctggagaggttttttttttttttgagacagaatcttgctctgttgcccaggctggagtgcagtggcgcggtctcggctcactgcaagctctgcctcccaggttcacgccattctcctgcctcagcctcccgagtagctgggactacaggcgcccgccaccacatccggctaattttttgtatttttagtagagacggggtttgaccgtgttagccaggatggtcttgatctcctgaccttgtgatccgcctgcctcagcctcccaaagtgctgggattacaggcttgggccaccgcgcccagccaatgtcctagagagttttgtgatctgaattctttatgtatatttgtagctatatttcatacaaagtgctttaagtgtggagagtcaattaaacacctttactcttagaaatacggattcggcagccttcagtgaatattggtttctctttggtatgtcaataaaagtttatccgtatgtcagaacggatttgtggaattttcagttctgcctcttgcatattggaatacccaatatttcaggtaccgtgttgaagcataaatagcccccaggcaagaaacaggcttaagactctactttgcttagtgctgggtacaatgtcctcaccccatgagcccactcccacttcctgaagccctgggacctggaaagtcctttttttttacttcttgggattgtcatatatgaaatgttacaaaagttttttgtttttgttttcctccaatataacaatagagtcttaaacaaaagtactgattaaaaatggatatttgggctcaggcctgtaatctcagcactgtgggaggacaagttaagaggatcacttgaggacaggaattcgagaccagcctggacaacagagcaagaccctgtctctgcaaaaaataaaaacattagctggatgtggcggcacgcacctgtagtcccagctacttggtgggctgagatgggaggatcccttgaactcagtagttcaaggctgcagtgagctgtgactctgccattgtactccagcctgggtgacagtgagaccccgtctcttaaaaaaaaaaaaaaaaaaaggattttcgaaattcacttaaggtaaaagaattaaaaacaggtttttactaattcacaagggccagcattttcccctaaatgaattaaatattaataactcctaacagcctatataaaccatttcttttttataaatgacttggaaatactcgaaagccaggttt

SEQ ID NO: 102251 - DNA, 3055 bp, Homo sapiens
cccggcattccgtgctccttggttccggcgttggagctctttggggcccagctttgcggacccgggagctcgggacgcaggcggggcttgtgctccgcgggggcagggcgtagggtgggcctcctacctcccctgatctcgcggtttgttccgtttcattggagcttcccggaccgtgtgctcgacggtgccctaggtgccgtggggccacacgcgagtctgataagcaccctcccccggaatcatgcggtgctgtgaggcctagcgaagatgaagatagaatgcaaggtagaaagtgctggatacctttagaaagctgcaggactggtgcgatgggagttgagacgtaagaacctgcccgtccgtagggctctggatgctgctgaggcccgaggcccctatggcagatttgaaaattcacccttgtagagtcattcctgcctttgagcggactcccttttaagtttacagaagcacttgcagaactcatcagaagccaccccgcttatcagcagatctcaagagagcgttcggtggaggccctgggtctgcacagctcacctccctgggaactgctcgcccgagcgtcggagccggcgctggccccctgcagccggaaggttgcagccgcaggagccccggaggcccaggacacaggacagagtctcgttctgtcgcccaggctggagtgcagtggtgtgatctcggctcacttcaacctccgcctacagggttcaagggattctcctgcctcagcctcctgagtatctgggctcttgctcttgcagaatccacaggtctttcttgaggaaatctgtagacagaactttgtgctgcgtttttatctagggaaggaacagaagagtgtcgtctcctagaaatctagcactggagaaacgaggaaaattcttccagcgatggtctcccactcagagctgaggaagcttttctactcagcagatgctgtgtgttttgatgttgacagcacggtcatcagagaagaaggaatcgatgagctagccaaaatctgtggcgttgaggacgcggtgtcagaaatgacacggcgagccatgggcggggcagtgcctttcaaagctgctctcacagagcgcttagccctcatccagccctccagggagcaggtgcagagactcatagcagagcaacccccacacctgacccccggcataagggagctggtaagtcgcctacaggagcgaaatgttcaggttttcctaatatctggtggctttaggagtattgtagagcatgttgcttcaaagctcaatatcccagcaaccaatgtatttgccaataggctgaaattctactttaacggtgaatatgcaggttttgatgagacgcagccaacagctgaatctggtggaaaaggaaaagtgattaaacttttaaaggaaaaatttcattttaagaaaataatcatgattggagatggtgccacagatatggaagcctgtcctcctgctgatgctttcattggatttggaggaaatgtgatcaggcaacaagtcaaggataacgccaaatggtatatcactgattttgtagagctgctgggagaactggaagaataacatccattgtcgtacagctccaaacaacttcagatgaatttttacaagttatacagattgatactgtttgcttacagttgcctattacaacttgctatagaaagttggtacaaatgatctgtactttaaactacagttaggaatcctagaagattgctttttttttttttttaactgtagttccagtattatatgatgactattgatttcctggagaggttttttttttttttgagacagaatcttgctctgttgcccaggctggagtgcagtggcgcggtctcggctcactgcaagctctgcctcccaggttcacgccattctcctgcctcagcctcccgagtagctgggactacaggcgcccgccaccacatccggctaattttttgtatttttagtagagacggggtttgaccgtgttagccaggatggtcttgatctcctgaccttgtgatccgcctgcctcagcctcccaaagtgctgggattacaggcttgggccaccgcgcccagccaatgtcctagagagttttgtgatctgaattctttatgtatatttgtagctatatttcatacaaagtgctttaagtgtggagagtcaattaaacacctttactcttagaaatacggattcggcagccttcagtgaatattggtttctctttggtatgtcaataaaagtttatccgtatgtcagaacggatttgtggaattttcagttctgcctcttgcatattggaatacccaatatttcaggtaccgtgttgaagcataaatagcccccaggcaagaaacaggcttaagactctactttgcttagtgctgggtacaatgtcctcaccccatgagcccactcccacttcctgaagccctgggacctggaaagtcctttttttttacttcttgggattgtcatatatgaaatgttacaaaagttttttgtttttgttttcctccaatataacaatagagtcttaaacaaaagtactgattaaaaatggatatttgggctcaggcctgtaatctcagcactgtgggaggacaagttaagaggatcacttgaggacaggaattcgagaccagcctggacaacagagcaagaccctgtctctgcaaaaaataaaaacattagctggatgtggcggcacgcacctgtagtcccagctacttggtgggctgagatgggaggatcccttgaactcagtagttcaaggctgcagtgagctgtgactctgccattgtactccagcctgggtgacagtgagaccccgtctcttaaaaaaaaaaaaaaaaaaaggattttcgaaattcacttaaggtaaaagaattaaaaacaggtttttactaattcacaagggccagcattttcccctaaatgaattaaatattaataactcctaacagcctatataaaccatttcttttttataaatgacttggaaatactcgaaagccaggttt

SEQ ID NO: 102252 - DNA, 2892 bp, Homo sapiens
cccggcattccgtgctccttggttccggcgttggagctctttggggcccagctttgcggacccgggagctcgggacgcaggcggggcttgtgctccgcgggggcagggcgtagggtgggcctcctacctcccctgatctcgcggtttgttccgtttcattggagcttcccggaccgtgtgctcgacggtgccctaggtgccgtggggccacacgcgagtctgataagcaccctcccccggaatcatgcggtgctgtgaggcctagcgaagatgaagatagaatgcaaggtagaaagtgctggatacctttagaaagctgcaggactggtgcgatgggagttgagacgtaagaacctgcccgtccgtagggctctggatgctgctgaggcccgaggcccctatggcagatttgaaaattcacccttgtagagtcattcctgcctttgagcggactcccttttaagagatctcaagagagcgttcggtggaggccctgggtctgcacagctcacctccctgggaactgctcgcccgagcgtcggagccggcgctggccccctgcagccggaaggttgcagccgcaggagccccggaggcccaggacacagggctcttgctcttgcagaatccacaggtctttcttgaggaaatctgtagacagaactttgtgctgcgtttttatctagggaaggaacagaagagtgtcgtctcctagaaatctagcactggagaaacgaggaaaattcttccagcgatggtctcccactcagagctgaggaagcttttctactcagcagatgctgtgtgttttgatgttgacagcacggtcatcagagaagaaggaatcgatgagctagccaaaatctgtggcgttgaggacgcggtgtcagaaatgacacggcgagccatgggcggggcagtgcctttcaaagctgctctcacagagcgcttagccctcatccagccctccagggagcaggtgcagagactcatagcagagcaacccccacacctgacccccggcataagggagctggtaagtcgcctacaggagcgaaatgttcaggttttcctaatatctggtggctttaggagtattgtagagcatgttgcttcaaagctcaatatcccagcaaccaatgtatttgccaataggctgaaattctactttaacggtgaatatgcaggttttgatgagacgcagccaacagctgaatctggtggaaaaggaaaagtgattaaacttttaaaggaaaaatttcattttaagaaaataatcatgattggagatggtgccacagatatggaagcctgtcctcctgctgatgctttcattggatttggaggaaatgtgatcaggcaacaagtcaaggataacgccaaatggtatatcactgattttgtagagctgctgggagaactggaagaataacatccattgtcgtacagctccaaacaacttcagatgaatttttacaagttatacagattgatactgtttgcttacagttgcctattacaacttgctatagaaagttggtacaaatgatctgtactttaaactacagttaggaatcctagaagattgctttttttttttttttaactgtagttccagtattatatgatgactattgatttcctggagaggttttttttttttttgagacagaatcttgctctgttgcccaggctggagtgcagtggcgcggtctcggctcactgcaagctctgcctcccaggttcacgccattctcctgcctcagcctcccgagtagctgggactacaggcgcccgccaccacatccggctaattttttgtatttttagtagagacggggtttgaccgtgttagccaggatggtcttgatctcctgaccttgtgatccgcctgcctcagcctcccaaagtgctgggattacaggcttgggccaccgcgcccagccaatgtcctagagagttttgtgatctgaattctttatgtatatttgtagctatatttcatacaaagtgctttaagtgtggagagtcaattaaacacctttactcttagaaatacggattcggcagccttcagtgaatattggtttctctttggtatgtcaataaaagtttatccgtatgtcagaacggatttgtggaattttcagttctgcctcttgcatattggaatacccaatatttcaggtaccgtgttgaagcataaatagcccccaggcaagaaacaggcttaagactctactttgcttagtgctgggtacaatgtcctcaccccatgagcccactcccacttcctgaagccctgggacctggaaagtcctttttttttacttcttgggattgtcatatatgaaatgttacaaaagttttttgtttttgttttcctccaatataacaatagagtcttaaacaaaagtactgattaaaaatggatatttgggctcaggcctgtaatctcagcactgtgggaggacaagttaagaggatcacttgaggacaggaattcgagaccagcctggacaacagagcaagaccctgtctctgcaaaaaataaaaacattagctggatgtggcggcacgcacctgtagtcccagctacttggtgggctgagatgggaggatcccttgaactcagtagttcaaggctgcagtgagctgtgactctgccattgtactccagcctgggtgacagtgagaccccgtctcttaaaaaaaaaaaaaaaaaaaggattttcgaaattcacttaaggtaaaagaattaaaaacaggtttttactaattcacaagggccagcattttcccctaaatgaattaaatattaataactcctaacagcctatataaaccatttcttttttataaatgacttggaaatactcgaaagccaggttt

SEQ ID NO: 102253 - DNA, 2708 bp, Homo sapiens
cccggcattccgtgctccttggttccggcgttggagctctttggggcccagctttgcggacccgggagctcgggacgcaggcggggcttgtgctccgcgggggcagggcgtagggtgggcctcctacctcccctgatctcgcggtttgttccgtttcattggagcttcccggaccgtgtgctcgacggtgccctaggtgccgtggggccacacgcgagtctgataagcaccctcccccggaatcatgcggtgctgtgaggcctagcgaagatgaagatagaatgcaaggtagaaagtgctggatacctttagaaagctgcaggactggtgcgatgggagttgagacgtaagaacctgcccgtccgtagggctctggatgctgctgaggcccgaggcccctatggcagatttgaaaattcacccttgctcttgctcttgcagaatccacaggtctttcttgaggaaatctgtagacagaactttgtgctgcgtttttatctagggaaggaacagaagagtgtcgtctcctagaaatctagcactggagaaacgaggaaaattcttccagcgatggtctcccactcagagctgaggaagcttttctactcagcagatgctgtgtgttttgatgttgacagcacggtcatcagagaagaaggaatcgatgagctagccaaaatctgtggcgttgaggacgcggtgtcagaaatgacacggcgagccatgggcggggcagtgcctttcaaagctgctctcacagagcgcttagccctcatccagccctccagggagcaggtgcagagactcatagcagagcaacccccacacctgacccccggcataagggagctggtaagtcgcctacaggagcgaaatgttcaggttttcctaatatctggtggctttaggagtattgtagagcatgttgcttcaaagctcaatatcccagcaaccaatgtatttgccaataggctgaaattctactttaacggtgaatatgcaggttttgatgagacgcagccaacagctgaatctggtggaaaaggaaaagtgattaaacttttaaaggaaaaatttcattttaagaaaataatcatgattggagatggtgccacagatatggaagcctgtcctcctgctgatgctttcattggatttggaggaaatgtgatcaggcaacaagtcaaggataacgccaaatggtatatcactgattttgtagagctgctgggagaactggaagaataacatccattgtcgtacagctccaaacaacttcagatgaatttttacaagttatacagattgatactgtttgcttacagttgcctattacaacttgctatagaaagttggtacaaatgatctgtactttaaactacagttaggaatcctagaagattgctttttttttttttttaactgtagttccagtattatatgatgactattgatttcctggagaggttttttttttttttgagacagaatcttgctctgttgcccaggctggagtgcagtggcgcggtctcggctcactgcaagctctgcctcccaggttcacgccattctcctgcctcagcctcccgagtagctgggactacaggcgcccgccaccacatccggctaattttttgtatttttagtagagacggggtttgaccgtgttagccaggatggtcttgatctcctgaccttgtgatccgcctgcctcagcctcccaaagtgctgggattacaggcttgggccaccgcgcccagccaatgtcctagagagttttgtgatctgaattctttatgtatatttgtagctatatttcatacaaagtgctttaagtgtggagagtcaattaaacacctttactcttagaaatacggattcggcagccttcagtgaatattggtttctctttggtatgtcaataaaagtttatccgtatgtcagaacggatttgtggaattttcagttctgcctcttgcatattggaatacccaatatttcaggtaccgtgttgaagcataaatagcccccaggcaagaaacaggcttaagactctactttgcttagtgctgggtacaatgtcctcaccccatgagcccactcccacttcctgaagccctgggacctggaaagtcctttttttttacttcttgggattgtcatatatgaaatgttacaaaagttttttgtttttgttttcctccaatataacaatagagtcttaaacaaaagtactgattaaaaatggatatttgggctcaggcctgtaatctcagcactgtgggaggacaagttaagaggatcacttgaggacaggaattcgagaccagcctggacaacagagcaagaccctgtctctgcaaaaaataaaaacattagctggatgtggcggcacgcacctgtagtcccagctacttggtgggctgagatgggaggatcccttgaactcagtagttcaaggctgcagtgagctgtgactctgccattgtactccagcctgggtgacagtgagaccccgtctcttaaaaaaaaaaaaaaaaaaaggattttcgaaattcacttaaggtaaaagaattaaaaacaggtttttactaattcacaagggccagcattttcccctaaatgaattaaatattaataactcctaacagcctatataaaccatttcttttttataaatgacttggaaatactcgaaagccaggttt

SEQ ID NO: 102254 - DNA, 1769 bp, Homo sapiens
cccggcattccgtgctccttggttccggcgttggagctctttggggcccagctttgcggacccgggagctcgggacgcaggcggggcttgtgctccgcgggggcagggcgtagggtgggcctcctacctcccctgatctcgcggtttgttccgtttcattggagcttcccggaccgtgtgctcgacggtgccctaggtgccgtggggccacacgcgagtctgataagcaccctcccccggaatcatgcggtgctgtgaggcctagcgaagatgaagatagaatgcaagtttacagaagcacttgcagaactcatcagaagccaccccgcttatcagcagatctcaagagagcgttcggtggaggccctgggtctgcacagctcacctccctgggaactgctcgcccgagcgtcggagccggcgctggccccctgcagccggaaggttgcagccgcaggagccccggaggcccaggacacagggctcttgctcttgcagaatccacaggtctttcttgaggaaatctgtagacagaactttgtgctgcgtttttatctagggaaggaacagaagagtgtcgtctcctagaaatctagcactggagaaacgaggaaaattcttccagcgatggtctcccactcagagctgaggaagcttttctactcagcagatgctgtgtgttttgatgttgacagcacggtcatcagagaagaaggaatcgatgagctagccaaaatctgtggcgttgaggacgcggtgtcagaaatgacacggcgagccatgggcggggcagtgcctttcaaagctgctctcacagagcgcttagccctcatccagccctccagggagcaggtgcagagactcatagcagagcaacccccacacctgacccccggcataagggagctggtaagtcgcctacaggagcgaaatgttcaggttttcctaatatctggtggctttaggagtattgtagagcatgttgcttcaaagctcaatatcccagcaaccaatgtatttgccaataggctgaaattctactttaacggtgaatatgcaggttttgatgagacgcagccaacagctgaatctggtggaaaaggaaaagtgattaaacttttaaaggaaaaatttcattttaagaaaataatcatgattggagatggtgccacagatatggaagcctgtcctcctgctgatgctttcattggatttggaggaaatgtgatcaggcaacaagtcaaggataacgccaaatggtatatcactgattttgtagagctgctgggagaactggaagaataacatccattgtcgtacagctccaaacaacttcagatgaatttttacaagttatacagattgatactgtttgcttacagttgcctattacaacttgctatagaaagttggtacaaatgatctgtactttaaactacagttaggaatcctagaagattgctttttttttttttttaactgtagttccagtattatatgatgactattgatttcctggagaggttttttttttttttgagacagaatgtactccagcctgggtgacagtgagaccccgtctcttaaaaaaaaaaaaaaaaaaaggattttcgaaattcacttaaggtaaaagaattaaaaacaggtttttactaattcacaagggccagcattttcccctaaatgaattaaatattaataactcctaacagcctatataaaccatttcttttttataaatgacttggaaatactcgaaagccaggttt

SEQ ID NO: 102255 - DNA, 2377 bp, Homo sapiens
cggctttgcagagcagacagatctggtgtctccagtttacagaagcacttgcagaactcatcagaagccaccccgcttatcagcagatctcaagagagcgttcggtggaggccctgggtctgcacagctcacctccctgggaactgctcgcccgagcgtcggagccggcgctggccccctgcagccggaaggttgcagccgcaggagccccggaggcccaggacacagggctcttgctcttgcagaatccacaggtctttcttgaggaaatctgtagacagaactttgtgctgcgtttttatctagggaaggaacagaagagtgtcgtctcctagaaatctagcactggagaaacgaggaaaattcttccagcgatggtctcccactcagagctgaggaagcttttctactcagcagatgctgtgtgttttgatgttgacagcacggtcatcagagaagaaggaatcgatgagctagccaaaatctgtggcgttgaggacgcggtgtcagaaatggagctggtaagtcgcctacaggagcgaaatgttcaggttttcctaatatctggtggctttaggagtattgtagagcatgttgcttcaaagctcaatatcccagcaaccaatgtatttgccaataggctgaaattctactttaacggtgaatatgcaggttttgatgagacgcagccaacagctgaatctggtggaaaaggaaaagtgattaaacttttaaaggaaaaatttcattttaagaaaataatcatgattggagatggtgccacagatatggaagcctgtcctcctgctgatgctttcattggatttggaggaaatgtgatcaggcaacaagtcaaggataacgccaaatggtatatcactgattttgtagagctgctgggagaactggaagaataacatccattgtcgtacagctccaaacaacttcagatgaatttttacaagttatacagattgatactgtttgcttacagttgcctattacaacttgctatagaaagttggtacaaatgatctgtactttaaactacagttaggaatcctagaagattgctttttttttttttttaactgtagttccagtattatatgatgactattgatttcctggagaggttttttttttttttgagacagaatcttgctctgttgcccaggctggagtgcagtggcgcggtctcggctcactgcaagctctgcctcccaggttcacgccattctcctgcctcagcctcccgagtagctgggactacaggcgcccgccaccacatccggctaattttttgtatttttagtagagacggggtttgaccgtgttagccaggatggtcttgatctcctgaccttgtgatccgcctgcctcagcctcccaaagtgctgggattacaggcttgggccaccgcgcccagccaatgtcctagagagttttgtgatctgaattctttatgtatatttgtagctatatttcatacaaagtgctttaagtgtggagagtcaattaaacacctttactcttagaaatacggattcggcagccttcagtgaatattggtttctctttggtatgtcaataaaagtttatccgtatgtcagaacggatttgtggaattttcagttctgcctcttgcatattggaatacccaatatttcaggtaccgtgttgaagcataaatagcccccaggcaagaaacaggcttaagactctactttgcttagtgctgggtacaatgtcctcaccccatgagcccactcccacttcctgaagccctgggacctggaaagtcctttttttttacttcttgggattgtcatatatgaaatgttacaaaagttttttgtttttgttttcctccaatataacaatagagtcttaaacaaaagtactgattaaaaatggatatttgggctcaggcctgtaatctcagcactgtgggaggacaagttaagaggatcacttgaggacaggaattcgagaccagcctggacaacagagcaagaccctgtctctgcaaaaaataaaaacattagctggatgtggcggcacgcacctgtagtcccagctacttggtgggctgagatgggaggatcccttgaactcagtagttcaaggctgcagtgagctgtgactctgccattgtactccagcctgggtgacagtgagaccccgtctcttaaaaaaaaaaaaaaaaaaaggattttcgaaattcacttaaggtaaaagaattaaaaacaggtttttactaattcacaagggccagcattttcccctaaatgaattaaatattaataactcctaacagcctatataaaccatttcttttttataaatgacttggaaatactcgaaagccaggttt

SEQ ID NO: 102256 - DNA, 1905 bp, Homo sapiens
catgcgtggggggcacaggctccctggctggcgtcagctaaagtggctgttgggtgtccgcaggcttctgcctggccgccgccgcctataagctaccaggaggagctttacgacttcccgtcctgcgggaagtggcgggcacgatcgcaaggtagcgcagaagcttctcaatggccagcgccagctgcagccccggcggcgcactcgcctcacctgagcctgggaggaaaattcttccagcgatggtctcccactcagagctgaggaagcttttctactcagcagatgctgtgtgttttgatgttgacagcacggtcatcagagaagaaggaatcgagatgctttcattggatttggaggaaatgtgatcaggcaacaagtcaaggataacgccaaatggtatatcactgattttgtagagctgctgggagaactggaagaataacatccattgtcgtacagctccaaacaacttcagatgaatttttacaagttatacagattgatactgtttgcttacagttgcctattacaacttgctatagaaagttggtacaaatgatctgtactttaaactacagttaggaatcctagaagattgctttttttttttttttaactgtagttccagtattatatgatgactattgatttcctggagaggttttttttttttttgagacagaatcttgctctgttgcccaggctggagtgcagtggcgcggtctcggctcactgcaagctctgcctcccaggttcacgccattctcctgcctcagcctcccgagtagctgggactacaggcgcccgccaccacatccggctaattttttgtatttttagtagagacggggtttgaccgtgttagccaggatggtcttgatctcctgaccttgtgatccgcctgcctcagcctcccaaagtgctgggattacaggcttgggccaccgcgcccagccaatgtcctagagagttttgtgatctgaattctttatgtatatttgtagctatatttcatacaaagtgctttaagtgtggagagtcaattaaacacctttactcttagaaatacggattcggcagccttcagtgaatattggtttctctttggtatgtcaataaaagtttatccgtatgtcagaacggatttgtggaattttcagttctgcctcttgcatattggaatacccaatatttcaggtaccgtgttgaagcataaatagcccccaggcaagaaacaggcttaagactctactttgcttagtgctgggtacaatgtcctcaccccatgagcccactcccacttcctgaagccctgggacctggaaagtcctttttttttacttcttgggattgtcatatatgaaatgttacaaaagttttttgtttttgttttcctccaatataacaatagagtcttaaacaaaagtactgattaaaaatggatatttgggctcaggcctgtaatctcagcactgtgggaggacaagttaagaggatcacttgaggacaggaattcgagaccagcctggacaacagagcaagaccctgtctctgcaaaaaataaaaacattagctggatgtggcggcacgcacctgtagtcccagctacttggtgggctgagatgggaggatcccttgaactcagtagttcaaggctgcagtgagctgtgactctgccattgtactccagcctgggtgacagtgagaccccgtctcttaaaaaaaaaaaaaaaaaaaggattttcgaaattcacttaaggtaaaagaattaaaaacaggtttttactaattcacaagggccagcattttcccctaaatgaattaaatattaataactcctaacagcctatataaaccatttcttttttataaatgacttggaaatactcgaaagccaggttt

SEQ ID NO: 102257 - DNA, 668 bp, Homo sapiens
cccggcattccgtgctccttggttccggcgttggagctctttggggcccagctttgcggacccgggagctcgggacgcaggcggggcttgtgctccgcgggggcagggcgtagggtgggcctcctacctcccctgatctcgcggtttgttccgtttcattggagcttcccggaccgtgtgctcgacggtgccctaggtgccgtggggccacacgcgagtctgataagcaccctcccccggaatcatgcggtgctgtgaggcctagcgaagatgaagatagaatgcaaggtagaaagtgctggatacctttagaaagctgcaggactggtgcgatgggagttgagacgtaagaacctgcccgtccgtagggctctggatgctgctgaggcccgaggcccctatggcagatttgaaaattcacccttgtagagtcattcctgcctttgagcggactcccttttaaggtaaatttccaaagagctccacaattgtttccagtatccagtgtcccgccaaataccagggattcagtaacacgtggtattttactttatttattttctttttgtaaacatagggtctcactatgttgcccagggtggtctcaaactcctgagctcaagtgatactcctgagttcaagtgatcctcccgcctcggccttccaaa

SEQ ID NO: 102258 - DNA, 115 bp, Homo sapiens
gtgaggatgctgctgtccttggaaatggcttccgttcagccctatggagggtggacatggtccagactctgggagagcccggctcagccttgggcccctccctaggccactgctg

SEQ ID NO: 102259 - DNA, 369 bp, Homo sapiens
gttgtttttcacctttctcacgtatctcctttggtagcttaataatcaaccttttgaattctttataaaaagatatttcaaagatttcatcttggtttagatcaattgctggagagctaatgtgatcttttcagggatgttatagaaccctgttatgtcatattgccagaattgtttttctggttccttctcatttaggtagaaatatatggaatgcttcacgaatttgcatgtgagccttgcacaggggccatgctaatcttcactgtatcattccaattttagtatatgtgctgctgaagtgagcaccgtctcaattgttttgaacagaaaatctttataaagtgttccacagaatatactgccttc

SEQ ID NO: 102260 - DNA, 266 bp, Homo sapiens
ttgaagctcacattgttccaatctggccaataggagccccttttgtatggctcctgtatctttatgacatgtcctcatcattcttgaatcacttcctcacttccagatacagtaagttattcttggccaggtgcagtggttcacgcctgtaatcccagcactttggcaggccaaggcaggaggatcatttgggcctagtttgagaccaaatcatggttgcacaaactgtacccactatggacaacagagtgggatcttgtctctgt

SEQ ID NO: 102261 - DNA, 971 bp, Homo sapiens
gacgtcgggaaaggaaacagaattccgctgtttttcccgctccctcgccgcccctccgcccagcgcctcctcccactttacagcggcggggtcactagaccaggcgctcctggaaagtttccctgaaagccaggggcggcaggcacgaccggactggggctcagcatgtgcagtctgagggaagccggacctggagggaatcatgcggacagctcgggatgcagctaggagctagatcccggccctttggagagtggaacctcctggcccgcggtacttgctcgacaagtcggggaagggatgaatggggaagcaggaccccggaggcaggtgcggccactgtggacagaggctgtggggaaggtgcgtgtggacacaggccggggctcagtggcttgcaagtaggcagcttcaggtgcagaatcccgagccatctgctccctgcgcacgatttcccagcgtggctatccagggagggaggaagcagagccaggtgtgcgtggagcgggagaggaatgggagactggaggcgctgtcttcacagccggggcaagcacttccagggagtctccggcctgtatcgcactggggagccctgcaggctttttcgcgtcggtctttgggagaaaggtggctgctttggaactgcggtggccaggcacagccacagtgggatcgctcctttttttacgctcagcttttttacgctactgaatgcgatctgtgaaaggtttaaaacacaggcgtgcatggacacacacacgcacacactcgcccttgtacgcacaactttctttacctcagatctgaaaagccgtttaacccacttgcagtgttgtgccagcaggtctcagaaaagctatttaatgccccccagcgctggtttttaagtcttgccaggatgggaaggtcgagtgcctttgccttgtctttctttagtcctgaaattgttcgtcgtccttcccctggtg

SEQ ID NO: 102262 - DNA, 202 bp, Homo sapiens
aaaaaaaaaaaaaaaaaaaaaaaggagagtgggaacagaggagagctacgcctctttccatcatgaacatcatggtagcttctccaagactatgtaagagaagggaaaagatggccacacaatcctggcgtccaggactaaacaatcaagtttccacctaatacccaaaacccccagggaacagtgatatatgaagaaaaga

SEQ ID NO: 102263 - DNA, 507 bp, Homo sapiens
ggcctgccttcttaggggatgcactcagaatgtttgctgctccagcctttcctcactatctaccttgttactttctgttgatcctgaagtttggaacgtttctagactcacaatagccaaacatcacatcccagtcaaaataactctccaaaacccctccatttcccttcatcagtctcaatatccccttaacccagccagcctcaggggcctcaaacctactatctgtaaacttttacaagctcaagttctcaagcctgtcaattctccccacaacactcctatcctggctgtcaaaaaaaccagatgggtcttacttcttggtccaagatctttgagttaacaaccaggcagtggttccaatccatccagtggtccccaacccacatactctagtctcccatattcccctatctaccacacacttttctgtattggatccaaagaatgccttttttactattcccttggatctggcttcccaaagtctttctactttcacttggt

SEQ ID NO: 102264 - DNA, 116 bp, Homo sapiens
ctggctccctgatactctgaacaagtggagtgtgcaaaactacaattcccagctcttcctctcactgtgtgtccctattctgcttttcctgtggtgtctagacctttcagagtctg

SEQ ID NO: 102265 - DNA, 473 bp, Homo sapiens
cacttagagagtcgaatgggctcctgtcaggtcacctaactgttcatctgggagagtcaggagtgtgtccaaggcctcccaggatgatcttgaggtggactggaggcgcagtcataacaaccacgtaaactggcaacttgggggcagtggcagtagcagggaggtagggagaaatgtgggaagtccatgttagagttgagattttagacctcatggaatatgaagtggaaatgttcagataattgaggctgtaggattcagatacggttttgtagagtagtcgccatacggaagctctgagaatggatgagatttccaagaggtggttgcaggaagaaagtatcagaggcttggacaagtgtggcataggcaataggataggatactctgttagacaagacagaggtgactttctattacaaaactcgtccatttgtctgctcagaaaccttctactccttatttctgcagaa

SEQ ID NO: 102266 - DNA, 756 bp, Homo sapiens
ctaagataagagaccgtgcccagagccactggtcacttagcacaggtagtgggaaatggtagccagcaaatgtttaattgaatatcttatgtctcctagaccacagctgagcaaactaggccaagctcaaggtcctgaggggaatgaggagctgagctcagtcccttttggccccctttctctttccctcctcattttaagtatggaagctcacttatttcctttttgtattggccatttgtgtagggttttgtttgaaaaagggcttgaggctgggcgtggtggcccacgcctgtaatcccagtactttgggaggccaaagaaagattgcttgagcccaggagttcgagaccaacctgggcaacatagtgagaccctgtctctacaaaaaaatttttaaaattagctagacatggtagtgaatgcctgtagtctcagctgctcgagaggctaagttggaagtatcacctgagcccaggagttgaggctgcagtgagctctgattgacccagtgcacttcagcttgagcaacacagcaagaccctgtctcaaaaaaaaaaaagaagttgggcacagtggctcaggcctgtaatcccagcactttgggaagcctaggtgggcggatcacctgagatcaggagtttgagaccagcctgacctctaaaactacaaaattagccaggcgtagcccagcggctcatacctgtaatcccggcactttgggaggccgaggcgggcggatcacctgaggttggg

SEQ ID NO: 102267 - DNA, 824 bp, Homo sapiens
taaaccctatacttattaacaactcactgtttctccctttcccaaaatcctacactttctgtatctataaatgtgactattctagatacctgataataagtggtcatatactatttgtttatatgtgtgatgggcttatttcagttagtgtacggtgctccagaatcctcttgcagcatgtgtcacaatttccttcttttttttagactgaataatattccatgatatgtattgaccacattttttaaaaatccattcatccgtccataggcatttgggttacttctatcttttgactactgtgagtacttttgctttggatatatacttagtagtggaattgctggatatataataattcaatttttaatttttgaggaaccaccgtactgtttttcataactcctgcatcattttacattcccaaaagcagcccacaagagatcctatttctccacatcaaaacgttatttttttctttcttctttttctttttttatcattgccatcttaatgggtgagaggtgatatgtttttgtggttttgatttgcatttcctcagtgactaatgatgttgaacaacttttcatgttcttgttgtccattgtgtatcttatttggagaaatggctattcaagttatttgcagattttataattggatgtctgttttggttgagttgtaaaagttatttatatattctgaatactagtcctttctaagatataagatttgcaaatagtttcttccattctataggttgccttttcactttcttgatagtgtcttttgagcacaatagttttaaatgttgatgaagtcca

SEQ ID NO: 102268 - DNA, 823 bp, Homo sapiens
gaagaggtttcaccatgttgcccaggctggtcttgaactgggctcaggagatccgcccccctcagcctctcacagtgctgggattacaggcgtgaaccaccatgcccggtccatattttttaaagaaacgactccctcctcagaacgagtctcaatgcgtcaggggcattcagaacagcctggactccgcacagcgaaccccagaagcacctgctccccacgcgttaatccttgtttccaggagcagggccttgaggacaccttttcagggaaccctgttcctagagcaggaacagtcctaacctgacaatgggtgctaattttaaagcttttcaaaactcagatggaaaagcacacaggcataaatgctaactgtatgaatcagcactgtggggtggccaactcaaacccctcctggggtggaaaacgaccgtcccgggtgccccggtgcccttgccaacgtccaccctcccctgctccctggacggccgcctccaacagcatggactagtttgcctgtttcagaacattctctaagtggaatcacaccatggcgactccctcatgtctgtgtctttggtgggcattttgtgaggtttgccccgtggtgtgtaacagccgtccattttctttgctgtatagtattcccctgtgtgatctcttctgctattgatggacatgtggcttgtgtccaggttggctgttgtgtagacgccgtgtgagggatcccgcgtgtgtttctggtgtccgtgcgcctgttctgggtgtaaacccaggagtggaagtgccacagtgtgtgcatagtttcaacgttagtagaaaa

SEQ ID NO: 102269 - DNA, 218 bp, Homo sapiens
tgttagcccctttccacagcctgtctgtaatccttcgtccatttattagcactcattatgtgccagacactcttctaaatgctggagatgcagccatgtgtagacagatgaggccctatagagctcccgtagtaacagggaagccaaacaataaacacctaaggtgataaataaagagaagaggccgggcatggtggctcacacctgtaatcccagca

SEQ ID NO: 102270 - DNA, 800 bp, Homo sapiens
cccctactcacctctccaaccacactgaaccactagctttcttgtaccttcggtctcacacactactttctggaatgccctttcctatacttcttgggtaattcctgtgctttctttggtattctgcttaggcatctctttcagggaggcctgccttgacctcttacctctggcagggttaggtacctctcctaggctttctgacagtgtctagtatgtatttcttttatgttttttaaatatccaaactacagtaagaggtaataatgttgggcatttactatatgtcaaaacttaatgagcatttgctatgtgccaggcataggacagtgctaactggaaagtgtttccttatataattttcaactggttctcatctcagaattagagataattttatgtcactgcaagagtaatatttgaagatggctatctaacatctctctttcaggctaagtatcttcattgaatttgttcaaatatggatttcagacctcttgccttcctggtcactcccctccatgtgttttattttgttttctctcttaaaatatgtggttccgttttacatcaaatagaattgtcataaaggaacatagggcttctcagatggatagaagctggatatggattgtcatatttaaggtatatacctcacttacctaggtcgttagctatgaacatttttctgaacattttccagaagtcactagaattacgggaatttacttatagttagcaagtgatggagagactgacacaaaaccaagaatgccagttagtgaatttattaatataac

SEQ ID NO: 102271 - DNA, 295 bp, Homo sapiens
tgtgaatttttttttggcccaagaacagcatgaaaaaaattaggacgatacgaagggtgatatgaactgaggtacttggggaacctctgttctacacaaagcatggtttaacccgagatgttccagggctgaacctgcctctggattctctatgtggtacagtgacagccacaaaagcagctcccatctactgagctcttggccaaacataggcaagctcttaagcattgtaactgcatgacctcatttaatctccagagcactgtgagcatgggtcttttatgatccccattta

SEQ ID NO: 102272 - DNA, 703 bp, Homo sapiens
ggtatcaattcagcattccacttaacattttataaattccataggaacatgcctgttttggtagttactgacttaatttgttagtgccacaaggaaaatattttacagtattttatgccatttaggcaaaatgaataaactgttttccaagattttcttaaaagattatcaatttaaaagtatgatcaagtatgcctcaaaaactagaaacatttcaaaatgtagaacaaacgttgaaaaattgttttgccaggaaagagttcaagttcagttaaggatttgagaggcttttaaacaaggatcagtaggatagttatcatatttacttaatatatgtctgatattcagtgctggttctttttcctgtttgtgcaacaatgaagtgtgtcatgtgtgttttatagcctctatcattaatcacaccagagtctcattttaaaacattttaatgttaaaacatccccacacttatacacaggtaaaattagtttttttttttttaaagttgtaatctgtacttttttttttttgcaatttttgaaacagctacattaatccctaaaaatcccaccatactgaaaatgtatggcgtgtattttctatagtaagtaatatgaggaaaacatgattagctgtgccaaagaaattttatacattgtttacatgatgaggccacagtacttactgaggacttcatatggtt

SEQ ID NO: 102273 - DNA, 464 bp, Homo sapiens
ttgatgaaaaacttaaaagctatcccactaagatgaggaacaaggcatgctctcactactgctttcaacattgtactcgaagtcctagttagtgcagtaagacaagaaaaggaaataaagagcatagtgattgggaagaaagaaataaaactgtctttgttcacagatgacatgattgtctatgtagaatatccaaaaattgacaaaaatgctcctggaaataataagcaattttaccagggtggtaggatataaggttaatacacaaaattcagttacttttcgtgtatatcatcagtgagcaagtggtatttgaaattaaaaaaaatactatttgcattagcacccccaaaagtggaatacttgggtagtaatctaacaaaacatgcacaagatttatatgagaaaaattgtaaaactttaattaaagaaatcaaagaactaaataaatggagagagatttt

SEQ ID NO: 102274 - DNA, 645 bp, Homo sapiens
gtaatttatccattgggtcaaatagcacaggacctaattccaaaattaactccagccatagatgttttctactagtaatagtagcttcttccttagagtgaattttcttcaagaacattcatttaagtatccttttctgctttgagcccatcaaaacttgtgagttgtataaaatatgagccatagcataatattcaggaacaatttcaataaactttttcttccaaaaaaagctatgttaggtaactgttcattttttaagttaaggagatttttctctaagtagccaaaatggaataatgatcacttaactctaaggtgtttctctgagaaactgaatagcagtacctttattccagattaaacttaaaaaaaaaaaacccttttgtgtgatacctattgggcctattagatttatgtaacttccctcacttttagaaatgacagattgaccctatactttaaaattgcttataaaagtcccttaagttgccacaaaaggaggtctgagattgcattatgaatatttagaagttactttttgtttttagtatttatatatgaccttaaatgtgagtctcagccaaagcaaagaaactgcactgatttaaaggatttagaaatcactttttttttttttttttg

SEQ ID NO: 102275 - DNA, 226 bp, Homo sapiens
agatagacaggggtccagggaagagaatgggacagacaatgagaatagatcagaatttagtagatgttagaagtggcatttcagattggtaggctgaggacacagtacacagtgctgtgataattggtcatacctaaggaacaaaacatgagatccctacctcataccatatacagaggcatcaggggaaaccaaaaggagtatgtacatgaccttggggacacag

SEQ ID NO: 102276 - DNA, 363 bp, Homo sapiens
ttcctctcagcatgcagaactgagtccaccagtcaccgtccctgctggggcttacactgacctcccctcagcagctctgctagttgccttgcacagcatctgtgctcagcagatccctgttggctgatcgtttctgatggcgatttttgaatgaagcacaaggttctttaaagaacaaccttgtgctccgcttggaggcagagtcttgctgaggtgcccgtgggtctgcctcagcaattacctgtgtctctgcccaatgcctctgaggtcaggaggccggcatgcgtgaccctttgtctctgggagtccagatttcctaatgcagggctctttctaacacagaaagcaaggttgagtaaatac

SEQ ID NO: 102277 - DNA, 472 bp, Homo sapiens
tcttacatggtggcaagcaagagagcttgtgcaggggaactcccatttataaaaccatcagatctcaagagacttattaccatgagaacagtatgggggaaactgccctcatgattcaattatctccacctggctgcacccttgacacatagggattattgcaattcaaagtgaaatttgggtgggacacaggcaaacaatatcaagtctgataacccaggagtgttctttcatagtttagagtgtacagctatgttgcctggaagctgtgtgtgagtagccagggcctgtggatatgtgtgcttcactgtatgcttgggtggtcttctagctttttattggaggattcccagctatcagctttgacagatcttttctctttggccattctctttctccaggaaagtatctgccactcttctgttagggaggtataaatctagctgctggagttctgggagctggatggcag

SEQ ID NO: 102278 - DNA, 399 bp, Homo sapiens
ctaagtgctctggacttccaagaagttaactggagtggaaggcgagtcatattgtggatgcggaatggaagcttagacaagaaaaaactgtcagcagagcgcctctgctctcaccgtcacacccaaatgagccaggacgtcgctcagagcgcaaactgagatccacacagggacatcttcaaccgaatctttcttctgtctccattccggactaaggaaagaaagaaagaaatacggagcctttatagagtattcagaggctacacacatggatcttgctgaaacggagttatttaaaaacagagaaagtgtgttttcccatgagatagatgttatagtttctctctgaaacatacccaagtctatgggtgtcaataatagccatttcaaatgcctctc

SEQ ID NO: 102279 - DNA, 401 bp, Homo sapiens
cacactgacaactgtgtgaggaagagcctcgtgagatgatggaactccattgatttttcataaaagcttaataagatgatacaggtcaaaagctttgtaaagtttgctataaattgtagtgaggaattgagcaagatgtaattggataagaaaatgtaaatgaaacttgtacaagtgtggcagagttgatggagaatattgagaacaaggcccctcttgaccatctcagtggtatttttctaaacaggtgtctgacccttaagtgcaggggctttgactccagtcagccccttatcactgatgggttaatatattgttacccatcggtttttttaatgtcattaaaattcatcagatacagtttatgggtgcagatcagataggacaatcagtgtgtttgc

SEQ ID NO: 102280 - DNA, 93 bp, Homo sapiens
aaaaaaaaaaaggtaatgacttgatctgtgtcataagcggccatgctgggattaaacccatagcagcccattactcagctacatagatggact

SEQ ID NO: 102281 - DNA, 374 bp, Homo sapiens
gagagaaagaccatgatacaggtggcgatttggccgctgtcctctttggacttgaggtccacaatgatgtggtcgttggtgttggggatgaacttgaagaatgaactttaacgtgcgcggggcccacctcccccatgtggctgacggaaatgtaaccgaagtcctgggtggtgctcaggagtcctcgctgcaccgctgggggcaggaccggcgctgcagcactttccagcaggcggactaggggtgtgaggcagcctggcggtcggatttccgtggcggccctgggagcattgcagctgcacacccagttcttgtggtccacgctgcccttgtggcctgccactctcacccattccacgttctctctccactat

SEQ ID NO: 102282 - DNA, 617 bp, Homo sapiens
atctgtggctgtggccaagtgattgttgctgaacttacctgtgtcgaaaggtcagccttccagtgctaaggctgggcacaggcgctaaggcaaattggattgtgaatggaggccctgaggcatgttctgcactttgcaactggtctggcaggctccactcctccaccttctaagtctgccacaggcatgggaaacacctgggcagcgacaaaggtggttaaggcagcttcgccaagaagaggagccaagatggttaactagacgtagccaggaggaacatctcccaccaagagactgagctgtcaggaagactggtacattctgagcagatctttggagggaaggcattgagagtggatggaaggatgatgcagacactgggctgaagaggaaggaagctgggaaccctgtacaggactaccgagcaccaggacttgtttctggccccctgcaactcctgggaaagggagaactcctccagtgctctcaagtgttttacagaccactaattattaaatgtggaagctctggagcagagaacctttcaactgaaatgatgacaaacgatgctggctgaggagagtcagacctgaaaagttaggaatccctaaaatgac

SEQ ID NO: 102283 - DNA, 1453 bp, Homo sapiens
tctggaatattcaacaatgaaacctcagcacaattttccacagtgctgtaccaagattacatgtttcttccagagagggaaaggtttcttcaaacaaatgtggtacgccacacttctttgccaaacataacagcccacccataaaggacaccatgtgatgaggtataatagttttgatagctcattaaggaaactgctttttgataactggggaaggtttttccactgtgcaacaaaatgataatgctactttgctaactcctctactgacaaagatccccatgaactttctgaacattactggatggttgaaaggaaaagctgcttctttagaaaactgtgattaaaacaaattagagaataagcatctaagactaaccagagtataaacaaatgcaacacagttcaattctaaaactgcaataggacttccactttttaatctgcagtctctaactacctaccctctcttaaaaagaaataagaatattttaatttatttaaatgatagtaatgtcattttgggaagagactccatgaaaatttaccaccttaagaagttcccttacccagaaccctgtggcatgcacattttcctaaaacatcatcaaagcagtttgaatgagatctatacttaaagtttttacataaaatcccagggactgagaggattcagtcaagccacttaagaggtagagctaggttatcctcaggagttctgaatggaactcaaaactagcttctgtcctaagcatcaagttttcaatctattaaatgtatcagtgattgacacaggatgatgtaacatagcaaagtgggctacacagctattcctaatcaattacgctaacaactctggaataaaatggacatctcctaagaaaaagaattgtgagatttctaacaataataacagtgcctattcttacatagcatttaggctatgaaaaataaaactttcacatccattttatctcatttgtccaagtagtcctatgagtattttcaaaagcatatgttatcattcccattttatggcagaaagcctaggccaagaaaagctaaggaattagtcaaatgtcggaacttgaatctattcctctgctcatcagattttctgaccacagcatcatgacaaatttttataaacatcaacatcacacccctgacccctgttcaggacttccgtagatttctggctgggcatggtagctcatgtctataatcccagcactttgggaggttgaggcaggcggatcacttaaggccaggagttcaaaaccagcctggccaacatggtgaaaccctgtctctactaaaaatacaaaaattagctgggcatggtggtctgcgcctgtaatcccagctacttgggaagctgaggaacgagaattgcttgaacctgggaggcagaggttgcagtgagctgtgattgcgtcactgcactccagcc

SEQ ID NO: 102284 - DNA, 202 bp, Homo sapiens
gtgagagtgtgtgctcgctcagctaaagccagggcaggagaggtgtccagcacaggggctgtgggagtgaagccccatctgcaccttaatttctgggcttggccaaaaacaggagcatgctggggtttgtgagagaaagaaacacagtagtccccccttatctgctatttttgctttctgcactttcagatacctgaagtca

SEQ ID NO: 102285 - DNA, 306 bp, Homo sapiens
agacagagaagcatacttatttgaaggagcacagggaaaaaggaagagactaaaaacagcaaaaaatagaggctgtttattgcaatacatagcgcggaggtaaatgaagggaccctcacacacatagcccccttggaggatagagaatgaggtcttctgctaaccaagggagaataaatgaataccattctgatgtgttaaccttattccagccatggtcaaaaggtaatgaggaataaatgcttaaataactgattagaaggatgcccaagatatactaaatgtcagacgcaagtcttttatgtt

SEQ ID NO: 102286 - DNA, 743 bp, Homo sapiens
aaaaagacaagatggcctgaaaagcaccttcaccaaagacttatgtaaatgtaagccaatggtaagtttctagtgactcagcactccctctccaggtacagtgaggtaaagacccttacaaatgaagatttcttttgtagatgtaaatttcttttataaatagccaactaaatgacagaaagctgtattttggacactgattttgttgaatgggtggtctttttatgttcacttttgttagcttaaaaattactgagttcagctgggaaagcccattaagaaaaagggcaaaaaaagcataatatatgtgtggactcagcatggatagctctgataaagaagcaagcctgaagggttacccctaggttaaagacctcttctaaaaaagaagggtttgaaagaacagcccaaataaaatgtacaccttcaaccaaagagtggtataggtccagattattagtaggacttttgtccaataatttatcttggaattggaagaacatgagagtttcatagttggccaggtgccaagtccaggaatggctaagggtggcttactgtgaatcctgctcacagtgccagaaatgtcaacctaaagggaagaaaatgaggcatagttaatacagataatgtatttgggccaaggttgaggactgcagcctaggacacacttccaagtggtcttggggagtgctccagagaacagaagagaggctcatatttttagagaaaaaaaggatgaa

SEQ ID NO: 102287 - DNA, 799 bp, Homo sapiens
acacagaatgggaaaaggaagggggaggcggtgctccagctgattttatgattccagaagccttctatcttaagatgtataggatgtatcttagggtgtataagagaagcgcaagagaaacatttaggctgttttatgtttgagtagagacatgaaagttttaaataaagcagcagcacaatgagtccagcggcacatcagaaagcaaatcaccatgatcaggtcaggttcagggtggttttatgtcatgatatatgtcagtgtgctttacctattagtggaccaaaggcaaaaaatacggttttctacagagaaagacaaagcatttgatttcaatcaacattcgtttgtggtgaaacatgttgagaaaactcatcatagaagtgaaatgttttctttgataaaggctaatctcagaagacatacgtagtggagagcttttaaatgtatttttaaaaatacgaaccaatgagaagattgcctactttcaccgcttctgtttaacacagcattggcagagctgccaccaagaagaacacagcacgttgaaggcacggtggctcctgaagctgcagccctgagacctgattgtaccatggaaggtggggtggctcctgcagctgtagccctgagacctgattccaccacaagtgctgcagctggcagaggccacaggacataggcatagctggtgaaacctgcaactgagggtgtcgggggctcctgggagagcctccgtcccccctaaggagaggggctgcgtagaacctgtgtgctattgtcctttccccctttttcc

SEQ ID NO: 102288 - DNA, 659 bp, Homo sapiens
tcctgggttcaagtgatcctcctgcctcagtctccctagtagctgggactgcaggcgtgtgccaccacacctggttaatttttgcatttttagtagagacagggttttaccatgttggcctgtctggtctcttaattcctgacctcaggtgatccgcccgcctcagcctcctaaagtggtgggattacaggcgtgaaccaccgtgcccagctggaaggattaattaattcaaactggagtaaattagctgttgctgttgccttcaacctcaccagaatggattgcttatggggcttgcttctgtcgctgcttcctctttgacctctacgtcctcctccttttgttgattcagtttttcaaagtcggggttggtttgtctgactggaaaagctcaggacttacacgtaaccctgtcccagttaggagagagatgtggaaagcaaatacctggttttcagtttctttagttttagggcaaggttctgccttataaagtgaagaattctccaaacataggaaagtggattcgataaagctgggtagccccctccagtgccatatatccatgaaagaacattttgtgaatgaaagggaatggttacaggatttgtggatatctttgctgtgatttgagtcttgtttgtattttttcccccttt

SEQ ID NO: 102289 - DNA, 342 bp, Homo sapiens
tactaattcatcaatagattttctgaatcggaatagctcatttgcattgcaattaatagatgctctagaagttttgaagcaggaaggagctgagttggtactcctataaaaggtcttactgcataattgatagtgttcttacttttttttcatttggttttattttccttgattatttttcagttgtgggccacttatcacatacactcacaaactggattcacagtccatgttctgactaatcttaatcagaaactggtaaattaataaagataccgatcatatttcattccccttattgggcatctcgcaaacaaaatcttgtttttacaagggtttgtt

SEQ ID NO: 102290 - DNA, 229 bp, Homo sapiens
ctggtccttgttcttggccactgtctgcaggatcaacctctgattttacatcatgatgtaatcacctcaatccaagagcttcatctggaggaaagacgaccccaaaaaggagctcagactgctgtgtgagggctggcgcagtggtggccagtgcaggtccccgaggtggtgggtcccactcagctgctccttacagtggggactcctgatgtggagttctgcccctgtc

SEQ ID NO: 102291 - DNA, 401 bp, Homo sapiens
gctcactgcattcttgacctcctgggcttatggtatcctcccacatcggcccccctagtagctggatggcaggtgcacaccaccacgcctggccaatttgtgtgtttttttgtagatacggggctccaccatgttgtccatactagtcttgaacttctgacctcagttaatcctcctgccttggcctcccaaagggtttgagattacaggttcaagctaccatgcccgacctgttttccatgtgtccagcataggacttactccattatcagtcagaaaatatataatgcggctaggtgcagtggctcacctctgtaatcccagcactttgggaggctgaggtgggctgatcactagaggtcaggagttcgagaccagtctggccaacttggtgaaacccc

SEQ ID NO: 102292 - DNA, 304 bp, Homo sapiens
cacctcagcctccctaagtgctgggattacaggagtgagccactgtgcccagcttaactttttattttgaatcagttttgaactcacaggacagttgtgagaacggcacgaagaccccgtatgcctcctgctgcagtggcctgcttctcccggcccctcctagccctgtgcacacaggtgagcctctcaccaagaactccaccttgtcaacaccgcatcctgaccaagggtgagccccgacagcccacagccatcctggggcgtcgtggcctgtgtggggcctcgcggggccccggctgcctct

SEQ ID NO: 102293 - DNA, 358 bp, Homo sapiens
tcagagttgtaccaggtagtttggactccccagactccaaacctcaggtgagtgaagggaagccacatggttaggaaagacatgaggaagacatggacacccttctcttggttagagatgaaatgtcatttgcaggtctcctgacagaacagaacacaagggagagcagcgggttcaggtgctgggccagctctcccctgcccagctcagggcaatgactgtcagcctagtgcccaccagctgcctctcgggggaggaactgtccacaggagctgggaccagggccagcctcccctgacattgggtggaactcctcaagagtgaccattgacaaagattctcctcagagttttctaag

SEQ ID NO: 102294 - DNA, 255 bp, Homo sapiens
tgagtgcctccctggctaatgctcccagatggccacttgcccggagcagaggacggtttggttaggcaagggggtggcggtggcattgccatcacgggatgtctcacgctttctcctctagacgtcttaatttccagaaccccttgcttatgtgcagccctcttcctgctgccacggcattttgcacagcgtgcatcaatccagaaataggctgagataggagcttagtttcctattgcacaccatgctgggtga

SEQ ID NO: 102295 - DNA, 284 bp, Homo sapiens
gaaatttctaagcagcaatgcattcaagagatgacttgggtgctgttaaaagcattcagttttaaatgggaaacacagcacaaaagtttggaaaatttgcagactgatggtgcaagagaaaagaaaaaaaacattttctgaggagaaattcaagctggctgcagacatttgcataagtaacgaggagccaaatgttaatccccaacacaatggggaaaatgtctccagggcatgtcagacctttgcgacaacccctctcaacacaggcctggaagtctaggaag

SEQ ID NO: 102296 - DNA, 443 bp, Homo sapiens
ttaagtggggctatgaatatccccatgtgacagatgagaatgtgaggcccaaggcacagaaccaggggtgccccagcatgccagttgtgcacctgtggcttttcccttggccactttgcagcaccggcacgagagaggcccacagggtgagcctccacaccaccagccaccctttgtccctcagaaagggctggcagagcctgcaggtgagggtgggtgtggggaggggtgggcaatcgtctgcccttcatttctgtcatgttgtggctgtcactggggagaaaatgccaaaaagcttcctggaagaagcagcttccaggaggcttcaccatatccttgtcctgccaagtggccacgaatggattagaagattcccactgggtgagaaggctcagaagccaccacagaggatggcggaggtgggagaggcctcgcaccgcggg

SEQ ID NO: 102297 - DNA, 284 bp, Homo sapiens
cgatggccttaatacagctcgtcaagaactgctgaatctactttcttatagagacaatttcatatcgtgacaagaacatgggtttggaaatcagacaggacattctcctgagtttcctcatctgcaaaatgcagaaccatatgtaatatacatggtccaagtaaacttcttaaagtcttaataagagcatcttgagacactgtttacagaggatggcatatttattcctggttttcttggtcctttcccctcccctcccctcctatcttctcttctctctctct

SEQ ID NO: 102298 - DNA, 286 bp, Homo sapiens
ccgccttggcctcccaaagtgctgggactacaggcatgagccactgtgcttggccttcctaggagtctttgtgagggccaggtgggatcaaatgtttaaaagagtaccaggcccacagtaaatgtttgctgcttgtttgtgggagtattccaagacttttaatacttccctggcccattcagcacattcccctcagtaaagactcatgctcactgtttagcactgttcaccatcagaacatttcctcatgattttcctaaggcaagtttttcaggaatatggcaaa

SEQ ID NO: 102299 - DNA, 124 bp, Homo sapiens
gatctaaaatttattgtggtgatgtttgcataacagtgcaaatatactgaaaaccactgaattttacactttaaatcagtggcttctgtggtatgttatcaatatttctcaataaaacttcaaa

SEQ ID NO: 102300 - DNA, 481 bp, Homo sapiens
gacacctttttactgatatacccacagttctctatggtgtgcattttccctagctgcaatgaacaacagattcaacttgtttaattatagatgtgtttccattggtctttggctgtagggcattaataatattatgtactattagtgcgttaataacattaataatgccctatagccaaaagtacttttaccagtgctagagatccaccaggctttctgctaaaggtcactctaacattacggacacaagtcagttgtttgtcttttaatgcttttgccagctgaaatagtttatctcagagttttctatgaggatctgagatttaactctgctctaggtgttgagagcaacaagctcatagtgccagttgtcttgtggttaaatgtcaaaagccttaattaaggcttattattttctcctttggaataggtcggctccaaggctacacaagcagcaagaagaaaaggaaaaactctgttt

SEQ ID NO: 102301 - DNA, 480 bp, Homo sapiens
agagagggctagaggcctggaacagacccagcaaagtgcaaaacattgcgggcagggtgtgagccggcggcgcccagttattccgaagcgcccatgccggagggggcgggtgccgatcgccggcgcctccagtgctggaatctgcgtagtggattcaggacgttgacgttttaggatgaggacctgggttgacgtgaaaatgggggtacctctggcacctctgactcaactgtgatgtgaaagggactttttctacttaagtaacttgaaatggttgacgagctgacaccttaaaaaattgtatagggaatgggttttgtgttcttttttgtttggatgcgtgggtgcctttcgatgcatctgtaggggtaactgttccagtcgctctgttcatacaggtttctgtgtggcattgtgttgggtagcagagattcccaacgaattcacacggaactgtctggggctcaaagctctggtggg

SEQ ID NO: 102302 - DNA, 166 bp, Homo sapiens
gatgattcacgctaaaagaatacttaaaaggtcttcgataatccagcatgctagacacttgctggtagacttcacagagacacaaacatgctgtattttttttacgctatgtatcctgcacctagtagagtttctggcttgttgcagtttagtgaatgtcctggga

SEQ ID NO: 102303 - DNA, 476 bp, Homo sapiens
atttggcatccaaattaatgagaaagattggccctgtaattttctgttcatgtaatgcccttgtcagaacaaaacaaattggtctcataaaacaagttgggaattgttctctcttcttaattctctagagaaattgttttagagagtcatgttatttcttccttaaataattgaaaattttattctttaagccatttgtttaacctcactttttaaaaggggggcagctttttaatgattgattctgttaaactttttcaataaacttttccatttaatctaaaatcttaaaattttggcataaagttgttcagaacccttcttaatcattgtttgctataggatccttggtgatatctcctcttttcttattggtaatttgtatcctcctcttttttttttcttgaactatattgttaggggtttatcagttttttttagtttattcaaagaaccaactcttagttgattatttg

SEQ ID NO: 102304 - DNA, 766 bp, Homo sapiens
tccccactccacatctgcctcatagggcttccttgccttccttcatctggccttattgagggcagcctcttagctcagccatagtcttaggttttgggtctctgtggtgggattaggctgggcagagctttgggagaaaggagcaggagattcagcctttgcttctgtcctctaagagctcccagaccacctggagaggtaagcatcataattagactatatgtggtgacatataaacagaggctaaattgtgtgttagaaactctgagatatagaagttcagaggagaggaaaatagctaagggtaataatcagggaaaatgtcagaaatgagacttgaaggataggaatattaagaaaaaaatgttctttcaatttctgagtttttgttttgtttttttttttcttttttagaaagtttgaggcatgagccaccatgcccggccctgttttccatctttcaaggtactggaatattcaatgccattttcccagccttacagttctagtctgggcataaaaaaccttctctaagcaccctgcatagaaccacattttagaggccaggcgtggtggctcacgcctgtaatcccagcacttgggaggccaaggcgggcggatcacagggtcaggagtttgagaccagcctggccaacatggtgaaaccccatctctactaaaaatacaaaaattagctgggcgtggtggcgggcacctgtaatcccagctactcgggaagctgaggcaggagaatcgcttgaacctg

SEQ ID NO: 102305 - DNA, 447 bp, Homo sapiens
cctttcaagcaaaattaataatttggcaaatttatgtaaagataagacttttaataaaagtatttctactgaccaatccatgtgtccatctacacgagcctagagagagaggtcctacagtggcagccacctgcttgtgcttctgggtggtgggactgagtgactttagagctttctgctttaaaaaacaaaccacggatcagttttacaaaaacaatgtcattatgttttagttagttagcacgaagcactcttagaaacaacctctagctttgaagcaatcagcaaatggcagtgtaagatggcacacacagcaggtggtccgcagcctctctacaactggtgatgacagcaccaggtcctcctgtttggttgacagaagtcaccctcagaatcctcttgggaaaatcagggcactagctgtccatctctggagtctctgaatca

SEQ ID NO: 102306 - DNA, 378 bp, Homo sapiens
ctgaactccataggcagttgtgagcatggaaataatcatttaaaaaagtaagtagttcttggatgcctacaattcacatagttgtgaatagtatagtactgggataagcattttatctcacttaaccctcacacatcttttgaatatgggcactattgtccacattatgtaaatgataaaaattggcctggcacattttgttgttatcagttactcagctaccatgccacagtcagattttgaacttggaagtggccagtggccaggaagcctaggccagcttccctggtgttctcctgctctcagcctcttctgttcttcaggtggagtgtggtagaaaggtgtgccccacagcagggccttgcttacttaggttag

SEQ ID NO: 102307 - DNA, 356 bp, Homo sapiens
aattaagactaggttcttttttcatacaagttcctagtcctggtttctgactgtcctattggggcaattgtgctttccaaccacattgaaggaattgaaatatcctcattatttgtggattttatatttgtaaatttgcctccttgctcaaatctatccataaccccagaaccagtacttgcacaagtgcttttgagccatttgtaggcaaaaatgtgagtcacctcccaacagaagtgaaacaaatggtactctgccttctagtttcagctctcataccgtaaacatgtatcctttttgagtctacttagtcccatctcttcctaatttctgttctttttgttggtgattttact

SEQ ID NO: 102308 - DNA, 213 bp, Homo sapiens
tggtgatgtcatggtgcccaggcatgggaggaaagaggagggagggagaggggagagggcacagccccaggccagtggcctaacaggccagaggggaggctgccagcctggtgggcgaggggatggatagtgtccttatttcttccctaccttccatcctcataccccagagctggcttctgaactaagctactggcttctaagaaggtgagc

SEQ ID NO: 102309 - DNA, 338 bp, Homo sapiens
atagaacccaggcatcgactctgagtccagcactttttccaagactcttccctggatgcagggtgagaagagccagagctgagagcctgcatggcagagtggcggggatgcagctgggaaggcttctggaaccaactgcagtgccaagggagctggatgcctatttggacttggttcagaccagtgtttcctgaagtgcattctgagatgactgtgccagaaccatcagtgtgcttgttaaaacgacactgtgtaaggagggggacctaaaaatctgcatgttaaattccttcccagggtgattcttatgcacttcataagctggaaaatcaaaaata

SEQ ID NO: 102310 - DNA, 685 bp, Homo sapiens
taggacatgcctgtttaacttccttactgaatagatggagggtgagggcatatgcaagactgaggggctccagcatctgccatatgtcacctgtgtgcttaacaaaaaccccaatcctggggccatctcagacctgacctgctgtttcagaatttctagagaaagggcctggaaatctgtatatttaatttgtgcctcagggaagtttctgtactagaggatggcgaagggaacaacaggtgtggagagggaggctggacgtggcttccttgaaagggaaagggccgcatgaggctctgcattcctttccccaggacttatattgaaatcatggccaatgatttatttattttttaaaaatattaattcagtttttaaattttagttttttttctgttttttccttttttctatcttctaagacatcctgttatagcaaatttttacattttttcattgccctgccctgaaaatgtttttatttctcgtttttttttttaacatatttctctaggtttagaatttgtattttgtgcttatttactgtcaggccttcaaacataattgatttgtttttaatctttttctactaaaaattaaaaaaaattgtggtaaaatatacataacggtcaggcatggtggcttacacctgtaatcccaatactttgggaggctcagatggctg

SEQ ID NO: 102311 - DNA, 329 bp, Homo sapiens
aactagagattactagtggcagcaggctgagaaaactcagtagcaaaatgtggtagagacttgttgaatgtattatgctttcaaggacattttcagtgaaaggaataactattttagttattctttttagctgatctaaggttaagtctaactttacagaatttaccttaatctgcttttataaattagtcattcctgttttattttgtcccttatttatgatatatttccgtaaaatgtaagaataagtagaaggcatgatataatttattcaggagaattatttatttttaactgagaaagcttattaaggaattttatttatagtt

SEQ ID NO: 102312 - DNA, 388 bp, Homo sapiens
tgggtgacagagcaagactccatctcaaaaaaaaaatgctgtatcatatatatatatcagcatatttataagtatccaaattaattgccacagacatttcatagagttctctgatttttaaaaaatgtctactccacctataattatgttcaatttttctttctgatattgttcatttgtacctttatcttttttctttaatattgccaaaggtccctattttattagtttttgcagcatattttcattgtcattcatttctatatcttatctaacaatatttcttatttgacagatgtattatttagaagtacatttaaaatttctaaacatctctggcttagagttgcaaaataaaattctaaacatgttttttcagtaatttttg

SEQ ID NO: 102313 - DNA, 392 bp, Homo sapiens
ctcaaacaatgcatccttgttccacagcctcccagctgtgacagccatgataaaaatggagatgtttttatactctatgtgctgtttgtatactgacagcagcatggttattcgccaaataatcagagtatgttggcatttttataaataaagtgcttgggtttgacagtaatctgtgcaaggaagacttggaggatggacaaaaatgtcttctttcccatgcagaggaaaaaagcctccttggctatttttcagcacactaacatctcttctgactaaaaggcagccaggagcatagctatgacatcagcccagccgaagcccagctctctccaaaaggacacagggaagtatttctttcctccatggcttgcaggaatgtgttcctgggg

SEQ ID NO: 102314 - DNA, 203 bp, Homo sapiens
aatcaacttatttttggaggggtttttttttttcccccagattaagaggaaggaatgctatttattgaccagggaattcacttagagatcctgggaaatctgaatctgtggaatgcagttgcgagcattcacaatgtccccattaggtattgcagttgcgtttgcattccattataacagagacggaacagctgccacatcta

SEQ ID NO: 102315 - DNA, 645 bp, Homo sapiens
tacaacaatttctgttccctccaatagcatagtaaaatgcaaatttcgccatggccaaacctaggcattacctttgcgatgaaaaccaaatcaaaacaagactttactaaactaagaggtgaaatagggattttactttctcacttttatcatgagacaacatttttcactttactggggatttttgtgtatttcatgatgtgtccaaatccttactcattttattttactgggatatttgtctttttattttgtgtccctttgttttgcaaatattgttgcaaatgttctttcccagtgtatttaccttttaaaatttggttatggtgttggcattttcatttttttaatttaatcaatacaaagtcctgaagatagtgttagcattttatgtggttaaatatgtctgtattttctttcttggttctgtgcatttaataattagcactctcggctgggcacggtggctcacgcctataatcccagcactttgggagaccgaggcgggtggatcacgaggtcaagagatggagaccatcctggccaacatggtgaaacctcatctctactaaaaatgcaaaaattagctgggcatggtggcacgcacttgtagtcccagctactcgggaggctgaggcaggagaa

SEQ ID NO: 102316 - DNA, 100 bp, Homo sapiens
ccccactggcctcattctcatcattggacatgccaggcaccctcctatctcacagccttcgcactggctgtcccctgtcctgagatgtgcttccctccag

SEQ ID NO: 102317 - DNA, 464 bp, Homo sapiens
aggcaccagttacgtccgctctactattttttctacacaggctacctggctcaacccacctgcaaaggagttccccaagtcaggaggcccctgatatccccgtcacctggtccacgctggctgccaggccaccttcactgggagcggaagtgggagggctagaggggagtgtcaagggtccaccatgtcctcatgtcacctgcttctgccacagatgcaggcagtgtggccaggccagcaggagcacctcgtcggttcacagtgcaccagtctgttctgatgccccttgctgtggccttttccttagaatgttctgttagtatctgctgatttggggggaagaactgcaccagaaggagattcttgtgaagctgtttgggactatgctctataggcaagaacagtgaggccaccactaaaagtcttgatgtttagaatattaaaaataagataataagaaaata

SEQ ID NO: 102318 - DNA, 97 bp, Homo sapiens
tgtgtggagtgcgttcaactcagtctctctgacggtttttagggaacagaacacaaataacaacgtggcctgaggacccaaagtggccctagcaagg

SEQ ID NO: 102319 - DNA, 271 bp, Homo sapiens
tgcctggcatgtagtaaaatcacaacgaaaaccttgtgcttcaacccagaaagaatttgcacagccgcacatgggtctgggggctcagcagggagccctgggcctgtcagtaggtgaagtgaagtttgtcactgaggttaccctctcttcatctttacaagaagttgccagatagctctcccaaaatgtttgttcccatttccacccccacccgcagtgactgagtgttccccttactccacaacttcagcacatttggtgttgtcagcct

SEQ ID NO: 102320 - DNA, 273 bp, Homo sapiens
cctgttcctatatccactacattagaaaaagtcaaacaagtttccttacttgaggacttgttagagccttttaacacgttactctgcattataaatatccaatagaagattatgtacacattattggctgggtgctgtggctcacacctgtaatcccagcactttgggaggccaaggtgggcaaatcacgaggtcaggagatcgagaccatcctggctaacacagtgaaaccccatctctactaaaaacacaaaaaatcagctgggcgtggtg

SEQ ID NO: 102321 - DNA, 750 bp, Homo sapiens
gaatcctgttctgcatagtactctgagtcaggccctgtgctgagcactttctaagtattgtctcatttaatccttacaactcgaggctcagataacacaaatctcactcatagaaggtgacaaaatcaaggcagatggggagtgaagagatagctgagggtggctcctctcatgggcctggatcttgaagttctcacagcgcctggaccatagcatgcagcccagtctttgctagtcagtgctgtttttctcttcatcttacggacgaggatgttgaggcccagagaggggaggtgcattgtcctgggccacacggcttgcagggacagagctgagatttggacccaggcctccccatctctctgccttatcttgtcctgcccctactttgagcaggcctggccctaggggtcagacacccctgggataggagagaactgctctcctcttgtcatcctgccctgtggccctgcaggtcctcccctttcctgggaggtgggggagcctgcatgtcaggggcaaggctcagacgccttcattttcccacctcctcatgctacaaaaatgaaacgatcaagtggtattttggtgggattacagacataattatatctgagttgtcaagcggcaattgttgtttccaaagccaggaggccctctgtggaggtggcagcagtgacatctgtttctaacacaaggctctgcatcgggatgagtaacttctcctgtggaattgcttaaagaacgtct

SEQ ID NO: 102322 - DNA, 507 bp, Homo sapiens
catgggtatatgtgtgccagttatgttgggggttggtggagcccactctaattgacatttgcaatctgggttatatcacctctgaggtaggcaggtacctacatgaggtaggcagggaatgatggctttaacttagttcattcaataaatgaatatcagttatctattcctattgtccaggatggtggtgggcagaatgtctgagaagcccatgttgtgtatggcaggttgtgactttaccagagatggcattttctggttaaacttgggtgataggatgtgtttttaacagaaagggaaaaagaatctgaactagtttccttggtaataatagccatttgggttggggagctgatactggttaggaaaatgtgaggcccctttgacatcatccatttgctgctgagaaatcaaaattaaaacatcactcggtgtcagaatgttccagaaggcagttgagctgctaatgttttgaagtgttcagaggtatgtgttttatgaaaaaaa

SEQ ID NO: 102323 - DNA, 505 bp, Homo sapiens
ttatgacctgcatctcctgaacaatcagtctttatacaaataataatgtagaatacatatgtgagttatacatttaagaataacatgtgactttccagaatgagttctgctatgaagaatgaagctaattatccttctatatttctacacctttgtaaattatgataatattttaatccctagttgttttgttgctgatccttagcctaagtcttagacacaagcttcagcttccagttgatgtatgttatttttaatgttaatctaattgaataaaagttatgagatcagctgtaaaagtaatgctataattatcttcaagccaggtataaagtatttctggcctctactttttctctattattctccattattattctctattatttttctctatttcctccattattgttagataaaccacaattaactatagctacagactgagccagtaagagtagccagggatgcttacaaattggcaatgcttcagaggagaattcca

SEQ ID NO: 102324 - DNA, 1076 bp, Homo sapiens
cctgcacttctctggctggtcatggtgtcaccactggggaggctgggccggcacgtcagtctatgcctggcatgcagggccgtccctgagatatttgctctcaccactcacaaaacatccttctcgctcctggattgaacttttatgcctcacagccctaacccatcatttttcaaagcttcctataataatttgaaaacatcttgtaaaaatgacataagtcacagccgcttgcggcaaataactggccagtgttgaagcgagtcagaccgggtgctcctgcaccaagtgtgtgccagccgtaacccgggcaggcctgtcctctggcccttgctgcaggcaccagctcttaacacggggtgcactggggctccccatcacgcaggacctgcccagaatttccacagtggatggtgttcaggagcggtggttaggatggctggcgggggcctcactgacgctccagctcccatgctccccttagaagacagcttttggccgggtgcggtggctcatgcctgtaatcccagcactttgcgaggctgaggtgtgcgaatcacgaggtcaggagatcaagaccatcctggctaacacggtgaaaccccatctctactaaaaatacaaaacattagccgggcgcggtggcgggcgtctgtagtcccagctactcgggaggctgaggcagaagaatggcgtgaacccgggcagcgtggacgtgcacgaggtgtgcatcaccggatcacaacggaggctcgacaccactggagtccaaatgaatccactgggctctggcccccaggagtagctgaggacatacagacagctcatcacacaacctgaacacagaagcaaagggaaacaaggagaaagatgaaaaaagggagcaaacgacagcaaacaacaaggacgcgcgcataaccccggagatagcaacaacatacgccagcaggcaaccagagacgagacaaaccaaaggcagcagacagcccaacaaacacaacaaaagaacgacacaaacaaacatcaaaagaaagacatgactgacacagaacaaataaaagaaataaggagcaacc

SEQ ID NO: 102325 - DNA, 305 bp, Homo sapiens
gtcatttgtacccttctcttgggtcataacactaagaatattcattatttgttctttaataaatgaatttaaggccatgcatttacatcttggtacttgatatggtttggctgtgtgtcccctcccaaatctcatcttgaattgtagctcccataattcccacatgttgtggaagggacacagtgggagataattgaatcatgaatcatgggggcagtttcccccatactgttcttgtggtagtgaataagtctcatgagagctgatggttttataaggggaaaacccctttcacatggttctca

SEQ ID NO: 102326 - DNA, 491 bp, Homo sapiens
cagcctccttatgttgagtcaaggctttgtgtgaacaaaatccctgcttgcccagcacttaccttgtacttgacactttgctaggtgctttagaagtattacctcaccgaatccacacaagaatcctgaaaggtaggctgttatcccaactgtctagctaaggaaactgaggccagagaggccaaataacccatccaccaggtcccacagctggtaaaaggtcagagctagaatcagaacccacgtttgtttgcttccgagcccaccgtggattccagtataccagttccttcaatctcatctcctaaaactgcaggctgaacccaataagatgaaataaaatgagccgggcagagttggccatcctgcttgtcaatttcaaacaacagttccgcaagtgtaggataagaaaatctgactgagcagcagaaaagtcctgaggattttatcatctgcaaaatctccaaaagccaatggtgaagcagcaactt

SEQ ID NO: 102327 - DNA, 806 bp, Homo sapiens
gcaggctggtacgccgccagaggaagatggcgccgcggagggtcaggtcgtttctgcgcgggctcccggcgctgctactgctgctgctcttcctcgggccctggcccgctgcgagccacggcggcaagtactcgcgggagaagaaccagcccaagccgtccccgaaacgcgagtccggagaggagttccgcatggagaagttgaaccagctgtgggagaaggcccagcgactgcatcttcctcccgtgaggctggccgagctccacgctgatctgaagatacaggagagggacgaactcgcctggaagaaactaaagcttgacggcttggacgaagatggggagaaggaagcgagactcatacgcaacctcaatgtcatcttggccaagtatggtctggacggaaagaaggacgctcggcaggtgaccagcaactccctcagtggcacccaggaagacgggctggatgaccccaggctggaaaagctgtggcacaaggcgaagacctctgggaaattctccggcgaagaactggacaagctctggcgggagttcctgcatcacaaagagaaagttcacgagtacaacgtcctgctggagaccctgagcaggaccgaagaaatccacgagaacgtcattagcccctcggacctgagcgacatcaagggcagcgtcctgcacagcaggcacacggagctgaaggagaagctgcgcagcatcaaccagggcctggaccgcctgcgcagggtcagccaccagggctacagcactgaggctggtgagtgcccgcccgggactgttggttcc

SEQ ID NO: 102328 - DNA, 1016 bp, Homo sapiens
gcaggctggtacgccgccagaggaagatggcgccgcggagggtcaggtcgtttctgcgcgggctcccggcgctgctactgctgctgctcttcctcgggccctggcccgctgcgagccacggcggcaagtactcgcgggagaagaaccagcccaagccgtccccgaaacgcgagtccggagaggagttccgcatggagaagttgaaccagctgtgggagaaggcccagcgactgcatcttcctcccgtgaggctggccgagctccacgctgatctgaagatacaggagagggacgaactcgcctggaagaaactaaagcttgacggcttggacgaagatggggagaaggaagcgagactcatacgcaacctcaatggctcttggccgtggcatttccgtggacagcccgccgtcagggtggctggggctggcacgggtgtcgaggcaggaaggattgtttctggtgactgcagccgctgccgtcgcgacacagggcttggtggtggtagcatttgggtctgagatcggcccagctctgactgaaggggcttggcttccactcagcatcagcgtggcagtcaccaccccagtgaggacctcgatgtccagctgctgtcaggtctgatagtcctctgctaaaacaacacgatttacataaaaaatcttacacatctgccaccggaaataccatgcacagagtccttaaaaaatagagtgcagtatttaaaccaacaatcacaccacaccagtgcgggcctcattcgcgggcgcggaaaacaggcatgcaccggtgccgggccatatgggtccggccccaccatctgtgtcacagagggaacatcggcggatcccaaggagcgatctaatactcaacggctcatagcagtcgaagcacatgcacagaggagcagcagtagcagccaggagcggacgatcctagatgagatgaacgcgacagcagagagagaacacaatggatgacagcaagcaacaagacgacagtgcagcaacgcaccg

SEQ ID NO: 102329 - DNA, 1787 bp, Homo sapiens
  misc_feature (1)..(1): n is a, c, g, or t
naattggtggtcgaggctggtttaatcggccgagggtcaggtcgtttctgcgcgggctcccggcgctgctactgctgctgctcttcctcgggccctggcccgctgcgagccacggcggcaagtactcgcgggagaagaaccagcccaagccgtccccgaaacgcgagtccggagaggagttccgcatggagaagttgaaccagctgtgggagaaggcccagcgactgcatcttcctcccgtgaggctggccgagctccacgctgatctgaagatacaggagagggacgaactcgcctggaagaaactaaagcttgacggcttggacgaagatggggagaaggaagcgagactcatacgcaacctcaatgtcatcttggccaagtatggtctggacggaaagaaggacgctcggcaggtgaccagcaactccctcagtggcacccaggaagacgggctggatgaccccaggctggaaaagctgtggcacaaggcgaagacctctgggaaattctccggcgaagaactggacaagctctggcgggagttcctgcatcacaaagagaaagttcacgagtacaacgtcctgctggagaccctgagcaggaccgaagaaatccacgagaacgtcattagcccctcggacctgagcgacatcaagggcagcgtcctgcacagcaggcacacggagctgaaggagaagctgcgcagcatcaaccagggcctggaccgcctgcgcagggtcagccaccagggctacagcactgaggctgagttcgaggagcccagggtgattgacctgtgggacctggcgcagtccgccaacctcacggacaaggagctggaggcgttccgggaggagctcaagcacttcgaagccaaaatcgagaagcacaaccactaccagaagcagctggagattgcgcacgagaagctgaggcacgcagagagcgtgggcgacggcgagcgtgtgagccgcagccgcgagaagcacgccctgctggaggggcggaccaaggagctgggctacacggtgaagaagcatctgcaggacctgtccggcaggatctccagagctcggcacaacgaactctgaaggcactggggagcccagcccggcagggaagaggccagcgtgaaggacctgggctcttggccgtggcatttccgtggacagcccgccgtcagggtggctggggctggcacgggtgtcgaggcaggaaggattgtttctggtgactgcagccgctgccgtcgcgacacagggcttggtggtggtagcatttgggtctgagatcggcccagctctgactgaaggggcttggcttccactcagcatcagcgtggcagtcaccaccccagtgaggacctcgatgtccagctgctgtcaggtctgatagtcctctgctaaaacaacacgatttacataaaaaatcttacacatctgccaccggaaataccatgcacagagtccttaaaaaatagagtgcagtatttaaaccaacaatcacaccacaccagtgcgggcctcattcgcgggcgcggaaaacaggcatgcaccggtgccgggccatatgggtccggccccaccatctgtgtcacagagggaacatcggcggatcccaaggagcgatctaatactcaacggctcatagcagtcgaagcacatgcacagaggagcagcagtagcagccaggagcggacgatcctagatgagatgaacgcgacagcagagagagaacacaatggatgacagcaagcaacaagacgacagtgcagcaacgcaccg

SEQ ID NO: 102330 - DNA, 923 bp, Homo sapiens
ccaggtaagaaggaagttgtgtttgttttttttattaaaaaagtcgggcaacgagggtcaggtcgtttctgcgcgggctcccggcgctgctactgctgctgctcttcctcgggccctggcccgctgcgagccacggcggcaagtactcgcgggagaagaaccagcccaagccgtccccgaaacgcgagtccggagaggagttccgcatggagaagttgaaccagctgtgggagaaggcccagcgactgcatcttcctcccgtgaggctggccgagctccacgctgatctgaagatacaggagagggacgaactcgcctggaagaaactaaagcttgacggcttggacgaagatggggagaaggaagcgagactcatacgcaacctcaatgtcatcttggccaagtatggtctggacggaaagaaggacgctcggcaggtgaccagcaactccctcagtggcacccaggaagacgggctggatgaccccaggctggaaaagctgtggcacaaggcgaagacctctgggaaattctccggcgaagaactggacaagctctggcgggagttcctgcatcacaaagagaaagttcacgagtacaacgtcctgctggagaccctgagcaggaccgaagaaatccacgagaacgtcattagcccctcggacctgagcgacatcaagggcagcgtcctgcacagcaggcacacggagctgaaggagaagctgcgcagcatcaaccagggcctggaccgcctgcgcagggtcagccaccagggctacagcactgaggctgagttcgaggagcccagggtgattgacctgtgggacctggcgcagtccgccaacctcacggacaaggagctggaggcgttccgggaggagctcaagcacttcgaagccacgtcaacccggaccagctattat

SEQ ID NO: 102331 - DNA, 1338 bp, Homo sapiens
tattcaggtctttcatcaaatttaggaagtcttcagccattatttcttcaagtattctctctctccctcaaccccacttctggaactgggcgggagttcctgcatcacaaagagaaagttcacgagtacaacgtcctgctggagaccctgagcaggaccgaagaaatccacgagaacgtcattagcccctcggacctgagcgacatcaagggcagcgtcctgcacagcaggcacacggagctgaaggagaagctgcgcagcatcaaccagggcctggaccgcctgcgcagggtcagccaccagggctacagcactgaggctgagttcgaggagcccagggtgattgacctgtgggacctggcgcagtccgccaacctcacggacaaggagctggaggcgttccgggaggagctcaagcacttcgaagccaaaatcgagaagcacaaccactaccagaagcagctggagattgcgcacgagaagctgaggcacgcagagagcgtgggcgacggcgagcgtgtgagccgcagccgcgagaagcacgccctgctggaggggcggaccaaggagctgggctacacggtgaagaagcatctgcaggacctgtccggcaggatctccagagctcggcacaacgaactctgaaggcactggggagcccagcccggcagggaagaggccagcgtgaaggacctgggctcttggccgtggcatttccgtggacagcccgccgtcagggtggctggggctggcacgggtgtcgaggcaggaaggattgtttctggtgactgcagccgctgccgtcgcgacacagggcttggtggtggtagcatttgggtctgagatcggcccagctctgactgaaggggcttggcttccactcagcatcagcgtggcagtcaccaccccagtgaggacctcgatgtccagctgctgtcaggtctgatagtcctctgctaaaacaacacgatttacataaaaaatcttacacatctgccaccggaaataccatgcacagagtccttaaaaaatagagtgcagtatttaaaccaacaatcacaccacaccagtgcgggcctcattcgcgggcgcggaaaacaggcatgcaccggtgccgggccatatgggtccggccccaccatctgtgtcacagagggaacatcggcggatcccaaggagcgatctaatactcaacggctcatagcagtcgaagcacatgcacagaggagcagcagtagcagccaggagcggacgatcctagatgagatgaacgcgacagcagagagagaacacaatggatgacagcaagcaacaagacgacagtgcagcaacgcaccg

SEQ ID NO: 102332 - DNA, 1720 bp, Homo sapiens
gcaggctggtacgccgccagaggaagatggcgccgcggagggtcaggtcgtttctgcgcgggctcccggcgctgctactgctgctgctcttcctcgggccctggcccgctgcgagccacggcggcaagtactcgcgggagaagaaccagcccaagccgtccccgaaacgcgagtccggagaggagttccgcatggagaagttgaaccagctgtgggagaaggcccagcgactgcatcttcctcccgtgaggctggccgagctccacgctgatctgaagatacaggagagggacgaactcgcctggaagaaactaaagcttgacggcttggacgaagatggggagaaggaagcgagactcatacgcaacctcaatgtcatcttggccaagtatggtctggacggaaagaaggacgctcggcaggtgaccagcaactccctcagtggcacccaggaagacgggctggatgaccccaggctggaaaagctgtggcacaaggcgaagacctctgggaaattctccggcgaagaactggacaagctctggaaatccacgagaacgtcattagcccctcggacctgagcgacatcaagggcagcgtcctgcacagcaggcacacggagctgaaggagaagctgcgcagcatcaaccagggcctggaccgcctgcgcagggtcagccaccagggctacagcactgaggctgagttcgaggagcccagggtgattgacctgtgggacctggcgcagtccgccaacctcacggacaaggagctggaggcgttccgggaggagctcaagcacttcgaagccaaaatcgagaagcacaaccactaccagaagcagctggagattgcgcacgagaagctgaggcacgcagagagcgtgggcgacggcgagcgtgtgagccgcagccgcgagaagcacgccctgctggaggggcggaccaaggagctgggctacacggtgaagaagcatctgcaggacctgtccggcaggatctccagagctcggcacaacgaactctgaaggcactggggagcccagcccggcagggaagaggccagcgtgaaggacctgggctcttggccgtggcatttccgtggacagcccgccgtcagggtggctggggctggcacgggtgtcgaggcaggaaggattgtttctggtgactgcagccgctgccgtcgcgacacagggcttggtggtggtagcatttgggtctgagatcggcccagctctgactgaaggggcttggcttccactcagcatcagcgtggcagtcaccaccccagtgaggacctcgatgtccagctgctgtcaggtctgatagtcctctgctaaaacaacacgatttacataaaaaatcttacacatctgccaccggaaataccatgcacagagtccttaaaaaatagagtgcagtatttaaaccaacaatcacaccacaccagtgcgggcctcattcgcgggcgcggaaaacaggcatgcaccggtgccgggccatatgggtccggccccaccatctgtgtcacagagggaacatcggcggatcccaaggagcgatctaatactcaacggctcatagcagtcgaagcacatgcacagaggagcagcagtagcagccaggagcggacgatcctagatgagatgaacgcgacagcagagagagaacacaatggatgacagcaagcaacaagacgacagtgcagcaacgcaccg

SEQ ID NO: 102333 - DNA, 1793 bp, Homo sapiens
gcaggctggtacgccgccagaggaagatggcgccgcggagggtcaggtcgtttctgcgcgggctcccggcgctgctactgctgctgctcttcctcgggccctggcccgctgcgagccacggcggcaagtactcgcgggagaagaaccagcccaagccgtccccgaaacgcgagtccggagaggagttccgcatggagaagttgaaccagctgtgggagaaggcccagcgactgcatcttcctcccgtgaggctggccgagctccacgctgatctgaagatacaggagagggacgaactcgcctggaagaaactaaagcttgacggcttggacgaagatggggagaaggaagcgagactcatacgcaacctcaatgtcatcttggccaagtatggtctggacggaaagaaggacgctcggcaggtgaccagcaactccctcagtggcacccaggaagacgggctggatgaccccaggctggaaaagctgtggcacaaggcgaagacctctgggaaattctccggcgaagaactggacaagctctggcgggagttcctgcatcacaaagagaaagttcacgagtacaacgtcctgctggagaccctgagcaggaccgaagaaatccacgagaacgtcattagcccctcggacctgagcgacatcaagggcagcgtcctgcacagcaggcacacggagctgaaggagaagctgcgcagcatcaaccagggcctggaccgcctgcgcagggtcagccaccagggctacagcactgaggctgagttcgaggagcccagggtgattgacctgtgggacctggcgcagtccgccaacctcacggacaaggagctggaggcgttccgggaggagctcaagcacttcgaagccaaaatcgagaagcacaaccactaccagaagcagctggagattgcgcacgagaagctgaggcacgcagagagcgtgggcgacggcgagcgtgtgagccgcagccgcgagaagcacgccctgctggaggggcggaccaaggagctgggctacacggtgaagaagcatctgcaggacctgtccggcaggatctccagagctcggcacaacgaactctgaaggcactggggagcccagcccggcagggaagaggccagcgtgaaggacctgggctcttggccgtggcatttccgtggacagcccgccgtcagggtggctggggctggcacgggtgtcgaggcaggaaggattgtttctggtgactgcagccgctgccgtcgcgacacagggcttggtggtggtagcatttgggtctgagatcggcccagctctgactgaaggggcttggcttccactcagcatcagcgtggcagtcaccaccccagtgaggacctcgatgtccagctgctgtcaggtctgatagtcctctgctaaaacaacacgatttacataaaaaatcttacacatctgccaccggaaataccatgcacagagtccttaaaaaatagagtgcagtatttaaaccaacaatcacaccacaccagtgcgggcctcattcgcgggcgcggaaaacaggcatgcaccggtgccgggccatatgggtccggccccaccatctgtgtcacagagggaacatcggcggatcccaaggagcgatctaatactcaacggctcatagcagtcgaagcacatgcacagaggagcagcagtagcagccaggagcggacgatcctagatgagatgaacgcgacagcagagagagaacacaatggatgacagcaagcaacaagacgacagtgcagcaacgcaccg

SEQ ID NO: 102334 - DNA, 718 bp, Homo sapiens
  misc_feature (666)..(666): n is a, c, g, or t
  misc_feature (689)..(689): n is a, c, g, or t
gcaggctggtacgccgccagaggaagatggcgccgcggagggtcaggtcgtttctgcgcgggctcccggcgctgctactgctgctgctcttcctcgggccctggcccgctgcgagccacggcggcaagtactcgcgggagaagaaccagcccaagccgtccccgaaacgcgagtccggagaggagttccgcatggagaagttgaaccagctgtgggagaaggcccagcgactgcatcttcctcccgtgaggctggccgagctccacgctgatctgaagatacaggagagggacgaactcgcctggaagaaactaaagcttgacggcttggacgaagatggggagaaggaagcgagactcatacgcaacctcaatgtcatcttggccaagtatggtctggacggaaagaaggacgctcggcaggtgaccagcaactccctcagtggcacccaggaagacgggctggatgaccccaggctggaaaagctgtggcacaaggcgaagacctctgggaaattctccggcgaagaactggacaagctctggcgggagttcctgcatcacaaagagaaagttcacgagtacaacgtcctgctggagaccctgagcaggaccgaagcagccacgagctgaggagagctggcacatcaacaggcctgaccgctgncaggcagcacaggctcagactgngctgagtcaggacccagggatgaccgtgt

SEQ ID NO: 102335 - DNA, 1808 bp, Homo sapiens
ccaggtaagaaggaagttgtgtttgttttttttattaaaaaagtcgggcaacgagggtcaggtcgtttctgcgcgggctcccggcgctgctactgctgctgctcttcctcgggccctggcccgctgcgagccacggcggcaagtactcgcgggagaagaaccagcccaagccgtccccgaaacgcgagtccggagaggagttccgcatggagaagttgaaccagctgtgggagaaggcccagcgactgcatcttcctcccgtgaggctggccgagctccacgctgatctgaagatacaggagagggacgaactcgcctggaagaaactaaagcttgacggcttggacgaagatggggagaaggaagcgagactcatacgcaacctcaatgtcatcttggccaagtatggtctggacggaaagaaggacgctcggcaggtgaccagcaactccctcagtggcacccaggaagacgggctggatgaccccaggctggaaaagctgtggcacaaggcgaagacctctgggaaattctccggcgaagaactggacaagctctggcgggagttcctgcatcacaaagagaaagttcacgagtacaacgtcctgctggagaccctgagcaggaccgaagaaatccacgagaacgtcattagcccctcggacctgagcgacatcaagggcagcgtcctgcacagcaggcacacggagctgaaggagaagctgcgcagcatcaaccagggcctggaccgcctgcgcagggtcagccaccagggctacagcactgaggctgagttcgaggagcccagggtgattgacctgtgggacctggcgcagtccgccaacctcacggacaaggagctggaggcgttccgggaggagctcaagcacttcgaagccaaaatcgagaagcacaaccactaccagaagcagctggagattgcgcacgagaagctgaggcacgcagagagcgtgggcgacggcgagcgtgtgagccgcagccgcgagaagcacgccctgctggaggggcggaccaaggagctgggctacacggtgaagaagcatctgcaggacctgtccggcaggatctccagagctcggcacaacgaactctgaaggcactggggagcccagcccggcagggaagaggccagcgtgaaggacctgggctcttggccgtggcatttccgtggacagcccgccgtcagggtggctggggctggcacgggtgtcgaggcaggaaggattgtttctggtgactgcagccgctgccgtcgcgacacagggcttggtggtggtagcatttgggtctgagatcggcccagctctgactgaaggggcttggcttccactcagcatcagcgtggcagtcaccaccccagtgaggacctcgatgtccagctgctgtcaggtctgatagtcctctgctaaaacaacacgatttacataaaaaatcttacacatctgccaccggaaataccatgcacagagtccttaaaaaatagagtgcagtatttaaaccaacaatcacaccacaccagtgcgggcctcattcgcgggcgcggaaaacaggcatgcaccggtgccgggccatatgggtccggccccaccatctgtgtcacagagggaacatcggcggatcccaaggagcgatctaatactcaacggctcatagcagtcgaagcacatgcacagaggagcagcagtagcagccaggagcggacgatcctagatgagatgaacgcgacagcagagagagaacacaatggatgacagcaagcaacaagacgacagtgcagcaacgcaccg

SEQ ID NO: 102336 - DNA, 1226 bp, Homo sapiens
  misc_feature (1148)..(1148): n is a, c, g, or t
  misc_feature (1169)..(1169): n is a, c, g, or t
ccaggtaagaaggaagttgtgtttgttttttttattaaaaaagtcgggcaacgagggtcaggtcgtttctgcgcgggctcccggcgctgctactgctgctgctcttcctcgggccctggcccgctgcgagccacggcggcaagtactcgcgggagaagaaccagcccaagccgtccccgaaacgcgagtccggagaggagttccgcatggagaagttgaaccagctgtgggagaaggcccagcgactgcatcttcctcccgtgaggctggccgagctccacgctgatctgaagatacaggagagggacgaactcgcctggaagaaactaaagcttgacggcttggacgaagatggggagaaggaagcgagactcatacgcaacctcaatgtcatcttggccaagtatggtctggacggaaagaaggacgctcggcaggtgaccagcaactccctcagtggcacccaggaagacgggctggatgaccccaggctggaaaagctgtggcacaaggcgaagacctctgggaaattctccggcgaagaactggacaagctctggcgggagttcctgcatcacaaagagaaagttcacgagtacaacgtcctgctggagaccctgagcaggaccgaagaaatccacgagaacgtcattagcccctcggacctgagcgacatcaagggcagcgtcctgcacagcaggcacacggagctgaaggagaagctgcgcagcatcaaccagggcctggaccgcctgcgcagggtcagccaccagggctacagcactgaggctgagttcgaggagcccagggtgattgacctgtgggacctggcgcagtccgccaacctcacggacaaggagctggaggcgttccgggaggagctcaagcacttcgaagccaaaatcgagaagcacaaccactaccagaagcagctggagattgcgcacgagaagctgaggcacgcagagagcgtgggcgacggcgagcgtgtgagccgcagccgcgagaagcacgccctgctggaggggcggaccaaggagctgggctacacggtgaagaagcatctgcaggacctgtccggcaggatctccagagctcggcacaacgaactctgaaggcactggggggtggccaggaaggcctgccanatatttgtgagaaatctgccnttcgatttcacatggaagatgctaaaggacaaattcaacgagtgcggccacgtgctg

SEQ ID NO: 102337 - DNA, 1735 bp, Homo sapiens
ccaggtaagaaggaagttgtgtttgttttttttattaaaaaagtcgggcaacgagggtcaggtcgtttctgcgcgggctcccggcgctgctactgctgctgctcttcctcgggccctggcccgctgcgagccacggcggcaagtactcgcgggagaagaaccagcccaagccgtccccgaaacgcgagtccggagaggagttccgcatggagaagttgaaccagctgtgggagaaggcccagcgactgcatcttcctcccgtgaggctggccgagctccacgctgatctgaagatacaggagagggacgaactcgcctggaagaaactaaagcttgacggcttggacgaagatggggagaaggaagcgagactcatacgcaacctcaatgtcatcttggccaagtatggtctggacggaaagaaggacgctcggcaggtgaccagcaactccctcagtggcacccaggaagacgggctggatgaccccgggagttcctgcatcacaaagagaaagttcacgagtacaacgtcctgctggagaccctgagcaggaccgaagaaatccacgagaacgtcattagcccctcggacctgagcgacatcaagggcagcgtcctgcacagcaggcacacggagctgaaggagaagctgcgcagcatcaaccagggcctggaccgcctgcgcagggtcagccaccagggctacagcactgaggctgagttcgaggagcccagggtgattgacctgtgggacctggcgcagtccgccaacctcacggacaaggagctggaggcgttccgggaggagctcaagcacttcgaagccaaaatcgagaagcacaaccactaccagaagcagctggagattgcgcacgagaagctgaggcacgcagagagcgtgggcgacggcgagcgtgtgagccgcagccgcgagaagcacgccctgctggaggggcggaccaaggagctgggctacacggtgaagaagcatctgcaggacctgtccggcaggatctccagagctcggcacaacgaactctgaaggcactggggagcccagcccggcagggaagaggccagcgtgaaggacctgggctcttggccgtggcatttccgtggacagcccgccgtcagggtggctggggctggcacgggtgtcgaggcaggaaggattgtttctggtgactgcagccgctgccgtcgcgacacagggcttggtggtggtagcatttgggtctgagatcggcccagctctgactgaaggggcttggcttccactcagcatcagcgtggcagtcaccaccccagtgaggacctcgatgtccagctgctgtcaggtctgatagtcctctgctaaaacaacacgatttacataaaaaatcttacacatctgccaccggaaataccatgcacagagtccttaaaaaatagagtgcagtatttaaaccaacaatcacaccacaccagtgcgggcctcattcgcgggcgcggaaaacaggcatgcaccggtgccgggccatatgggtccggccccaccatctgtgtcacagagggaacatcggcggatcccaaggagcgatctaatactcaacggctcatagcagtcgaagcacatgcacagaggagcagcagtagcagccaggagcggacgatcctagatgagatgaacgcgacagcagagagagaacacaatggatgacagcaagcaacaagacgacagtgcagcaacgcaccg

SEQ ID NO: 102338 - DNA, 1610 bp, Homo sapiens
gcaggctggtacgccgccagaggaagatggcgccgcggagggtcaggtcgtttctgcgcgggctcccggcgctgctactgctgctgctcttcctcgggccctggcccgctgcgagccacggcggcaagtactcgcgggagaagaaccagcccaagccgtccccgaaacgcgagtccggagaggagttccgcatggagaagttgaaccagctgtgggagaaggcccagcgactgcatcttcctcccgtgaggctggccgagctccacgctgatctgaagatacaggagagggacgaactcgcctggaagaaactaaagcttgacggcttggacgaagatggggagaaggaagcgagactcatacgcaacctcaatgtcatcttggccaagtatggtctggacggaaagaaggacgctcggcaggtgaccagcaactccctcagtggcacccaggaagacgggctggatgaccccaggctggaaaagctgtggcacaaggcgaagacctctgggaaattctccggcgaagaactggacaagctctggctggaccgcctgcgcagggtcagccaccagggctacagcactgaggctgagttcgaggagcccagggtgattgacctgtgggacctggcgcagtccgccaacctcacggacaaggagctggaggcgttccgggaggagctcaagcacttcgaagccaaaatcgagaagcacaaccactaccagaagcagctggagattgcgcacgagaagctgaggcacgcagagagcgtgggcgacggcgagcgtgtgagccgcagccgcgagaagcacgccctgctggaggggcggaccaaggagctgggctacacggtgaagaagcatctgcaggacctgtccggcaggatctccagagctcggcacaacgaactctgaaggcactggggagcccagcccggcagggaagaggccagcgtgaaggacctgggctcttggccgtggcatttccgtggacagcccgccgtcagggtggctggggctggcacgggtgtcgaggcaggaaggattgtttctggtgactgcagccgctgccgtcgcgacacagggcttggtggtggtagcatttgggtctgagatcggcccagctctgactgaaggggcttggcttccactcagcatcagcgtggcagtcaccaccccagtgaggacctcgatgtccagctgctgtcaggtctgatagtcctctgctaaaacaacacgatttacataaaaaatcttacacatctgccaccggaaataccatgcacagagtccttaaaaaatagagtgcagtatttaaaccaacaatcacaccacaccagtgcgggcctcattcgcgggcgcggaaaacaggcatgcaccggtgccgggccatatgggtccggccccaccatctgtgtcacagagggaacatcggcggatcccaaggagcgatctaatactcaacggctcatagcagtcgaagcacatgcacagaggagcagcagtagcagccaggagcggacgatcctagatgagatgaacgcgacagcagagagagaacacaatggatgacagcaagcaacaagacgacagtgcagcaacgcaccg

SEQ ID NO: 102339 - DNA, 489 bp, Homo sapiens
cctacacgttcatgctcaccggctcctcgttgtagggagagagtggggactcccagccaaggatgtacacccggcccttgaggacggacacctgcgctttccctcccacttgcccctaggacttggcgatgcagtggcggacaaattcacactcagggctatgccagaaagcggtgtacaccagctcagcaaatttcaagcccaggccttgtttgattttgcacacctcccagtccatggtgaaggccttgatgtctaaatgagtgtggtaaaggatggtgcctgctggggtctcatagatacctcgggacttcattccagtgaagcggttctccacgatgtcagtacagcccacaccgtgtttgtccgcgacttcgttcaggtacatgaagaactccaaggaggtcgggtgggtggagccatcgttgacgttggtcaccttcacggggaccccttttttaactcgatctcgaggatgtcaggggtgtt

SEQ ID NO: 102340 - DNA, 662 bp, Homo sapiens
aaggtggcacaagacgtatcgggcagccgttaattgctctgtgggtgctggagggaggaagcacacatcagcacaggagaataatacccggattcaggtcaagcagagatgtgattaaagaaaggacatgcacagtgctttttcaaacaaggacagtcttacaccgggaagagagttattgaaaagaagaacaccgcacccctcgttcctacaataccctgatatcccagggagcccaggcctgctcccgaggaggctgcagcggctaaggctccccaaacctttaggtttcacatcccctttagatgagttcatacccagggctaaagttgtaagccttcccatacatcccacctcccaacatcgggaacaaaggcctcttctgccaagagggtgacagatcttccctagcagccccgagagtcaccgaggggcactgtcactgttttctgctgtctgtctaggcgatctgacccaggagttatactccctcccaatcatcagcagggcctgcctttctattaacaggctgtgggctctgaatcctacagagaagtgaacaagcagcccctccacagctcggactggagtttgctacaattcttaaccgaactcctctctctccctcttcctgggttcttgttcacctggcggcactacct

SEQ ID NO: 102341 - DNA, 463 bp, Homo sapiens
gagattcggggacccgctggtctgctgtggcgttgggccacagtcagaggaccatcaagtccggggtgtcatggacccggggtcctggcctgctgtctggaccccagtcttgcctccccaacccaggacggaggacctttcttgacaccatctctagctactccacacctgctggggctgcggctggaggcttgggggtcgtgcttccgggcagtgacaccataaccaccagactccagacaagccctggacacctgtgtggacggccgcaggggcacattccagcgggttcacagcagaccggcgccagtcaggacccagtctcgggcagcgaagccagcacttggtttgaatccctccggggcaatgtagaccccagatgaaggagatgggtggccccccagcaactcaggcaaagaagcacccctgaggaaaggagatgcagcccagcgctgcccccaag

SEQ ID NO: 102342 - DNA, 204 bp, Homo sapiens
gctgtgcagctccttatcatggtgagttggctgttggggtgagggtttcggctgtagctgattcggtttatcttatttggtcccgaagcgaccttgaaatccctcagccacccagaggaggggtcattggagttgaagtcgggccccttggcaggagcggctgtctcccaaaatgttccccttcagagttctggtccctttcgg

SEQ ID NO: 102343 - DNA, 702 bp, Homo sapiens
ccaaagtgttgggattacaggcgtgagccaccgtgcccggccctaatattatcttagctgggggttcaggaaggcctcttagcagagccctgaaaggaggtgagggagtgagccagtgaaaaacgtgggaagaacgttccaggagcaggcgctaaggccctgaggcaggagctaggtgtggtggaagagcctgcttagctggagaggtgagggagactggtgggaaaggtcagatagcggcacgtctcgtgcgggattcaaatggggtaccctttgcgcgccaaaaggtggtctgtgcgtgactcccgccccaaaaatatctatcgctttataggcagaccccacaattcctgaaatcctttatctgtattaaaggtccacgtactgactgtcaacattctgccactcctttgccccaattcaaccctggattaccgtatcccttatgcgtatatgtatatgacatcattgggagacagaacaaagggggtgtcaatcaccacaatcgtgatacaacaccaagggactacgaagtatgccaccgcgtgggccatttgcaatataacatggtgtcaacagggcaccgacctttggtagccctcccaaaggggtaaaaggttagaatcacatagcccgatcacgtcgggctttccacagaaagttagactgaagaaatatacaagggccaacagagttgccaaa

SEQ ID NO: 102344 - DNA, 149 bp, Homo sapiens
gctgctgtagactgggaactcacggcatgcaaagtgccttatgcggctttcccttctgcccttagccacctccatgagcagatggctcgccctgactgcggtggagccgagaaaatgcagaggcggggaggccagcagtcagcgaggca

SEQ ID NO: 102345 - DNA, 309 bp, Homo sapiens
  misc_feature (21)..(21): n is a, c, g, or t
ccagatataggctgctggttngtctagatcagtgtactcaaaggatcttttttccttatgcttttctcctcctgtgtgttgacttacaaaaaatctattttcctcccagtctgtcatgttacttttgtgtgtatacaaattgagataaaatttacccttttaaagcatacggtccagtgatttttagtatattcacaaggttgtgcaaccatcaccactatctaattttagaacacttttttcttatcccctgaaggaaacttccagcctgttagcagtctttccttattccccctttctctctccact

SEQ ID NO: 102346 - DNA, 772 bp, Homo sapiens
ggaaaatgagaagtgagatctagttctccctagcttagcaatgcttatctatatcctttcgagttttactgagatttcagaaatggaacagaatcttggctgcactttccctcttcataaaatttcacatttatatgagattctgcatttatttttttctattactgtttctaatgctgcaatttgggtagtcacaatgttccacttaacctaagtcttccttgttaatatttgagtccatttttgcatttttttattgttaattagagaatgatttctgaacattttctatttttagagcaattttacctgcattatcttattacacacacaaaagctttttgaataagtaggacatcataggacattcaaaagaacacagactcagacaagcctgagtatgaatctgaattctgccagtcaagctgtattattttggtcacttcatttaacctcatttgcatctcagcttcctcatccataaaatgaggatcattatgcatgtctcataaagttgccataagaattaggataatgtatgttaagtgttagaccagcacctgaaatttagtagatactaaataagtagctgctattattatttgccatattttataaattaggaaactgaaacacagacatattcctcatgccagtatagggggttaggtcacctagttattacaggcaaactgcagactttgttttgaacaagccttattgagaatgatggtatagagtacaaagtacacaagcaaaagatacagaaaaa

SEQ ID NO: 102347 - DNA, 323 bp, Homo sapiens
aacctctctaggacccatttgatagattaaaattccagctctaggccaggcgcagtggctcacatctgtaatcccagcactttgggaggccgagatgggcagatcaccctgaactcaggagttcgagaccagcctaggcaacatggagaaaccccatctttaccaaaaatacaaaaatattagccaggcgtagtgttgtgctccagctacttgggaggctgacatgggaggattgcttgagcctgggaggtggagggtgcagtgagctgagattgtgcccctgcacttcagcctgggcaatggagcaagaccctccctgtctc

SEQ ID NO: 102348 - DNA, 279 bp, Homo sapiens
tttcagaacagtataggtcaggttgcaaattgtctgtcatgtctgatttttccttgtgctttagaaagaaaaccctaggttgtagttgtccacatggcagcctaggtaatccttgtgtctcagctttccttgcagtaattatggctgtgtgtctaactaacttttaggctactgggatatgcacaaatgatgtgtgtcacttccaaatcattacaaaatatgaagccacttgctgtggacttttctccttatctagaaggctagaagcagctgtaggac

SEQ ID NO: 102349 - DNA, 143 bp, Homo sapiens
tgggtagatagatggataaaataaatatactaatagctaacatttattaagacttaccaaagcactcttctaagtttacatgtttaattagctcatttcattcacatggccactctgtgaaagcagctctactgtgcttccac

SEQ ID NO: 102350 - DNA, 353 bp, Homo sapiens
aatagagcatataaaatggttaagtattggttcctgaaatactgtttcagctaaatattctatttactgtgtatactgggtcacaatataaagtgtttcctgttatgaaatgcaatttaaaaaaagaaagcttgaaagactgctgcaggaggcaccggccatccagtgattgttggaagagtctggattgtgtggagcctgaccttagataaggagcagcagatccacaactcaggaagtctagagatgcttagcacttcttcttttgagtgagaagatggaatcactcttggtttctaaaatatttttcttctctgctgtgtatcgggcaacctcacatgattcagtgggac

SEQ ID NO: 102351 - DNA, 642 bp, Homo sapiens
agcagtggcaatcccctcaggtcttccttcgctgtgtggaagctttgttctttcgctctttgcaggaactcttgctgctgctcgctctttgggtccacgctgcctttaggagctgtaacactcacggcgaaggtccgcagcttcactcctgagccagcgagaccacgagcccaccgggaggaaagaacaactccagacgcgccgccttaagagctgtaacactcaccgtgaaggtccgcagcttcactcctgagccggcgagaccacgaacccaccagaaggaagaaactccaaagacgttcaaacatcagaaggaacaaactccggacacgccacctttaagaactgtaacactcaccgcgagggtccatggcttcattcttgaagtcagtgagatcaagaacacaccaattctggacccagtatctccccataccctaactcctttcccaaagtaggcagaaaaacagccctgttgttccggtggaagccttagctctgtattccttttagactgtatttcaaaacgcattattagagccccaaagtcacctggtgaaagaatgtgagagctggaagtggcctcaaaatccagttgaaccctcttatttcatatgtttggaaactgagcactagaaaagg

SEQ ID NO: 102352 - DNA, 423 bp, Homo sapiens
ggcatcagatttcctgtctttgtggggatgatggacccgagtaaagatgcccattcggggtcaaaggcagagccgcttctgcagcttctcaaagcgttgtttgttttttttctgagacggagtcttgctctgtcgcccaggctggagtgcagtgccgcgatcttggctcactgcagccttcacctcccgggttcaagcgattctcgtgcctcagcctccctgagtagctgggactacaggcgtgcgccacagggtggtttatgttcgtttaaaaaatgtattgcttagtgattcaatatttgttagttatgaaaaaaccctcgtgaggatatcatttaattgttaacagatggttaactttaaccagtggtttacttcctgattttaagatccttttcttgattacatgattttccaccctaa

SEQ ID NO: 102353 - DNA, 1112 bp, Homo sapiens
gatgtgggtggatcacttgaggccaggagtttgaaaccagcctgggcaacaaagtgagaccccttctctgcaaaaaataaaaaaattagctgggtgtggtagcgggcgtctgtagttccagctactcttgggaggctgaggttggaagatggcttgagtgcaggaggcgaaggtttcagtgagtcgagatctcgccactgcactccaccctaagtgacagagtcagatcctgtcccaaaagaaagagagaaaaaaagagatctgtcttgaaagaaaatatgagggtttgtgggcttctgagcaaaagagaaagcaggcatgtgcctcttcaccattgttaataaagtgggctttttttctttccatgaaatgttcaaactaattaccgctttctgtatttctgaaaaatccactctaataggaacttcatattttactctatgctgtaaaaacagaatctagttttacagtggtatataaaagttgcttttgagcaaaagtaaacatttaatctactttcttccaaatattgtcataaatgaggaagctccatttacatgagttttacctatatattttagatccataaattaagagaaaaggaaagtccaaagagactaccgggattacaggcatgagccactatgccaagctcagtcggactgggctaggtgcatgtgagcgatgcagtaggcaggaacaaaaagatattggcgaccgagcccaaccccgtgtctcaaaacgaacacacaaaggtaaatcacaatctgcatggacaagtactggcatttcacattaaaggaagcaaacagggctacctgcacatacaccttaccattaccacagtgaacaaagaagcacaaacaagaaaacacaaacacacggtaggcagcacaacacgacacacagaaacaaacaaccgggcctatacgacaacacagcgagcgatccaagaaacagtgagaaccagcagcacacccgagcaacagtgagaagacaccgcgcccacaaacagacaatagtaacaacagcaaacacaaaagaactaggacgacaactaaggcgcagcacgcacacacgctgccatatactgcgcgcgataacggcacacc

SEQ ID NO: 102354 - DNA, 301 bp, Homo sapiens
taatctcctcacaggaaagactttcctccagcctccatctgcaggaattggtggtgcagatactcaaagggagccgctggaaaggaggttctaccagggagagcctggactcagacacagtgctcactcaacagacacccgctcagtgggtggacaaacgaacaaacgcagagatggccccgaggtccttccacctgtgagaccctagccctgtgggtccatacaaatgctcagctcacgtctctcttattctgcaaaggtgatgctaagaaccccggggtcaacaatttttttccccgta

SEQ ID NO: 102355 - DNA, 411 bp, Homo sapiens
tccacttcagccagggtgaggctgaggaaggcatccctggggagtggcctgagagcaatgaggaatcggcctgagacagggacagggttggtgaggtcagtgtggctggagcaaggtgtggggtggagaatcgcagggagatgctgtcagagaggtgggcagaggctggatcctatggtgaggagtttccattttattctagtgtgatgagcagccactgacggctttaagcagaagagtgaggctatcacctttaccagctggtggggatttgcaaagtgccattccatctgctctcaccacctgcagatgtgggtggggtcaggtggaacatccccatttgcggatgaaacagctgaggccccaagaaaggaagacacttgccagaggtcatccatcctccatgtgaga

SEQ ID NO: 102356 - DNA, 128 bp, Homo sapiens
ggatatttgtaaaatggattattatacagcaatgaaaaggagtgagttatcaccacacttaccagcaaggatgaatcttaaaaattaatattgaccaagaaaagaaagttgcaaaggagccacagttg

SEQ ID NO: 102357 - DNA, 452 bp, Homo sapiens
aagccatcattattcttacataaaatcttttcaagtttattaaccctaaagcttgaatatttagttgaatccaatgttcttagatcgtattctatttctccctgcaaattatagagaaatcaccaataaacatcctggttcataatacgagagctgcaacgatttttgcccttgcctctgtctctgcaacagaaagggagagagaggaaagaatggatttggcattctagctgagctccaggcacccatgcatccatgcagcatatgcacttcaaagggtactgggcagccaccaagagaggccccaaactgcaccctcaccaggtactgtggtttagttggtcttcactccctgcccccactgcacctccacttaatattcacttttattgcaaccacattcttcacaattgatcagcagtttcttttggaaattcaggataaaaaaaaaa

SEQ ID NO: 102358 - DNA, 272 bp, Homo sapiens
aaggaattgaaatgccattgtgggataaaattaaatattgtcaaaggcctgctctgagccagtctatggactaggtagatatattggggagataatgaagtaggctcttgttggaaacagagcagaccaaaccaaacagaaaatgaatttgtcagaccaggcacggtggctcactcctgtaatccccacactttggtaggctgaggcgagtggatcacctgaggtcgggagtttgagaccagcctgatgaacatgaagaaactccctctact

SEQ ID NO: 102359 - DNA, 216 bp, Homo sapiens
aagttcttagcatttccttcaaggaagacataatttctacggaagcaatacgtagtgtttttcctgttccctgcttgtttaacattataaaagtaatccagacttgttttacaccagtagtgaaaagagggctctaccaggcatggtggtttacacctggaatcccagcactttgggaggccaaggtgggagggccacataaacccaggagtttga

SEQ ID NO: 102360 - DNA, 283 bp, Homo sapiens
tgcctcattatactggctatgacctctagtataatgttgaatagaagtggttagagtggacatctttgcctttttcctgattttcggggtaacatgttcaatatttcacaattaagtacaatctatctgtagctctttcatacatgcacttcctctatttctaatctgctgaatttttatcatgaaagggcactgaattttgtcagatgcgttttctgtatttattgaatagactatatggtttttctcctttattatctttttttttttttttttttttttt

SEQ ID NO: 102361 - DNA, 225 bp, Homo sapiens
agagaaaaccaaaaactatgtcccatatcccccatatctgtacccaccaaatacagataatagaaaagattagtgctaactggcatcctaatactatctgaacttaaaatgcaaatttaggctggagtcccaggctctgacctcaccatcccataaaatacaacatcatcttttgtgggataaaaatctctacctttcatccttctgtttttttttttttttttt

SEQ ID NO: 102362 - DNA, 407 bp, Homo sapiens
tgtgggtgtgtccagctctgacatgttcattctggcagactgagcaggaaaggagcaagtcgtgtgcctggcacaagttgaccttcttgcctagtgctctgtaccaaatgaccctctccactgcctggaagagagaaagggttaaacctctccaaagagaaactgtcagccggtggtggtaccaccagctgagatgacaggtggagaatccaaagcagagccatggcaagaaggtcccacccagccagtggttcagtgaccaggcatagaagctccgtgaccagtgcttctgtgcgtcttgtgagaacgcagaggctacatcatcctgaatatgattttcccatggtagggacaaggaaaccaaagccctgagacatcaagcaagtagcccgaggacacagtgctgg

SEQ ID NO: 102363 - DNA, 548 bp, Homo sapiens
tgtgggtgtgtccagctctgacatgttcattctggcagactgagcaggaaaggagcaagtcgtgtgcctggcacaagttgaccttcttgcctagtgctctgtaccaaatgaccctctccactgcctggaagagagaaagggttaaacctctccaaagagaaactgtcagccggtggtggtaccaccagctgagatgacaggtggagaatccaaagcagagccatggcaagaaggtcccacccagccagtggttcagtgaccaggcatagaagctccgtgaccagtgcttctgtgcgtcttgtgagaacgcagaggctacatcatcctgaatatgattttcattcactcaattcacaaggatgtgcagctgttataggcacggaacaaggggttgcattctattgtaagccatcaaaactttcactgggactgggttcaatggcttacacttataatccgagcactttaggaggccaaggcaggaggatcacttgaggccaagagtttgagaccagcctgggcaacatagtgagaccccatttcttaaa

SEQ ID NO: 102364 - DNA, 445 bp, Homo sapiens
gaatatgacccacctccctctccgacatctaagaggagaaggccttctctccactcccctccctgcatatctgaactctgggaagaggcagctaccccaaggctcagtcttcagttctgggccatcaaacatttaaccgatgattcaagtgaagatgtaaaaagtatgtctaataaaagaccacagactgggaggtattgctaaatgcacgaaagaacaaaccctaaaggtttgaatgttatcccaaatgcaaaagataaaatctatacagaaatattgaaatcttggcttgaaacacttgatagctgagaacctcctaaggttgcagagggggtgcaagactcagagaaagggacagagacccagagaaagggatatgggtcaacacgatgacaggcaggaccagggcgatagaaatgcagagaagaggatgtcggagagggag

SEQ ID NO: 102365 - DNA, 234 bp, Homo sapiens
cccaagtggtgcagaaaaagcatttgacaaaattcaacatcctttcatggtaaaaatgctcagtaaactctgaatagaaggaaactaactcaacataacaaaagctgtctgtgaataacccacagcaaacatcatacttaatggtgaaagactgaaagctttttctctaagatcagaaacaagaaaaaaatttccactttcaccgtatagcattggaaatgctagacatagcaa

SEQ ID NO: 102366 - DNA, 1309 bp, Homo sapiens
ctggacccagggtgtgctcctcatttccacacagtggtggagggaagggataggaacagaacatggagggaggctcagcaggctcccaggacacatgcacttgaggcccaaaaggacctctgctcccccagtcacttgatgcgggaaaacatgcaccttcttagggaagatctaggagaaaggaaacagtaagccactgcttcttggaaaatcttctgggggtctgacctgctgggactgttccctttcctcttgccccgtaagattcctagggcgggggggggaggagggggcacagtacctatttggtggagattataccttttgtatggatcgcgcggggaaccatcgctataacatggggtgcggagagagatcctgaacctgagtctgtggcgaccagaacacagagggctggagctgctgcctgctcacacagaactaggtcgggtggactcggctggatgagggagttacagttgaaacggcctgccttaattattccaaagagaccacggagttaagcactccacagagagagcccactcgagcgccgtgtcttaggagcctctcactaaacagggggtgtgctcgatgggaagacagcctctacttatagatagggttacaggggttgctctccaccccgtcacacattgtggaattacccccaccttgaaacgcccgtatacctctttgagacaaggcgggcaagcaatatagcacgctataagctcgcaaggcggaacactcttttggttagataaacggagcagctcttcaagagacgggggttcgagcaagatagaaaagcacaaacacccctttggtgtggcgtcagccctatgtgcgccccggaagtgatgtgaagcagtgagggcaaaatgggttgacgcgaagcaccactattgtgggttgtcgactcatggagcacacgctcggccttggagcaatatctgtatagaacggcgctgaaagggtggcacacgcctggcgttaaacacactgtccgccaatgcagacaaggcacgatgggggagtactgtgcgcaaaaacaggcacaaccctcacgcgccagagggggagctcacgcccaacaggagccccctcccgagtagggcgaacaaaaaagggccccggcaacagaactcacaggtgatatccaggcgcgattggcgtcaccccaaccatgagggggccacgagggaaacaccgaagcacacagcacacaatgggggcggccttgcaccagtaggccacagaggggaggaaaacaacagagaacacatcggggggggaaaaataaggg

SEQ ID NO: 102367 - DNA, 313 bp, Homo sapiens
ataaagtatattgtgatttttttattgcttgagccctagtgcttctgtttctccttgtgtagctattaagactcaagtatatcctatggaatctttgtgtatttggaaagtattaatttgtttttaaaaacttgaggcattaaaatgaccttttgattatcacttaacagtagatggttccttttcttcctttttctcttttctttttctttttttttgagacagggtcttactctgtggcccatgctggagtacagtggcaccagcatggctcaatgtagccttgacctcttgagcttaagggatccttctg

SEQ ID NO: 102368 - DNA, 364 bp, Homo sapiens
gaaatattatgcagccactaaaacggacatcaattcagatttctaaatgacacaatgtagcagagacagggccaggttcatgggtgtgggtcctacacagtcatacagggctccacacttacaagggccctacacttggtttaatgctccatggctgccaccttgaaattctgaatagttttataacaagagtcctccacatttacatttcacattgagcctataaattgttagctagtcctgagcagagatgactctgagtgcccattttctcctgtcttttagtaatagaacctcctccctttgcttcatacatacaccctgactagtgtttccacgctggaattccttcccagtatttctt

SEQ ID NO: 102369 - DNA, 388 bp, Homo sapiens
gagacactctacatattataactttataatgaagaacaggaatatgcagtaaaaatctgggcgtagtcaggagtaaaagcattatatatttaaaattcatggtaagagcgttaacatttataaaaaatatattttgttgtctaaaattcctaggttattaaaaatcaaaaaatctacatttaaaatgaaaatcactataacttataataaaaaagacatttttaaaagatctcccttaccgtcatgttttaaactgcatttgtctttcattatattaaattatgttgtcgccaaccgagcgtgccaagatcatgaattgtggtcttcagaggaaccacagagcaggcagtgctccctgtacagacgtccaagcccgctattagtgggt

SEQ ID NO: 102370 - DNA, 348 bp, Homo sapiens
gtcatgcctctgcccaaagccttgcaatgcctccccactgccaaggcacctaccctctgcaggtgtggctctgtgctctctgaactccggccaaaccacctctaccattcctagtaggtgctccaggctctcctccttctgctgtcacctctacctgaaatgcccttccttttcttcccagctcacctaaccttcaaggttcaaatcaactgtcacttcctcctgaagatgtccaagtccttcaggctggatatcaccactccttcagcactgacccctaggcagggtctggtctggatcccagctttccatgcgtgtcaccctgacctccccagtgcctcacatgga

SEQ ID NO: 102371 - DNA, 148 bp, Homo sapiens
cagctcatattcttgattatcaaaatataaagacatactaatttgacggatttaaaccttctctaactttctttgagatgatatacttccttctttccatagaagttaagtttcaaatatttcaacactgctaaggaataatcagggt

SEQ ID NO: 102372 - DNA, 105 bp, Homo sapiens
gtctgtgacgattcatttactcttctgccaaagatttgctgaggaccaggaatggcaggaactcgaagaggccctgcgggacacacactccctgctggaatcatg

SEQ ID NO: 102373 - DNA, 1532 bp, Homo sapiens
attctgaaagttttctgactccatatttccaagaaacttgtcccactccttaatatttcaaaggactaccatgccaaataaagataaatctttattttatgtagtgaaagcaacaatgtataatcttctcttttctacttacggcttgttaaagagaccggtaactggttctaatgttttgaaatctgcatgcttaccaatgatgtcttcatgagttagctgtaggctaatggaaaaaggaagcttatcatactttttagaactttttataattaaggtcagacctctatattattattaatattacacctcagtatttgcaattaacattgagacatccttgcaacaaaccctttggatattaacaaatattgacacacatataggaatatattaaaaatccttattaaggggaacaccaattagaatcaccataaatgatgtttatacatttcatcaagcaccaagaggccataaattatttggatgagattagccacctaaatgattacatgaaatgaccttagataccaattttgttgaacaagctttccacagtacttatcatttactcatacactattaaaagtttgacattcaggatattagctacaactcttggttatatgtgagagaaactcaactccaactagcaaagaaggaaattaatttattggcttatctaactgcaaagtccacactgtagggctgattccaagcacagctagatccagaggctaacataatgtcatcaggactctgtctctctctttcagtcccttgcaaggctactccataagcataatgattgctcaaagcagcctgaagtccaaattctagcagcttagcagctacggcagaaaaagagcatggcaaggtagcaacttccaaaatggtgacattaggagccctgtggaattgctccccagtgaaacaagcataacttgtgaaaataatttttaaaataactatctaaatactttggaaattgtcctaaggacctaggcaaatgaaggaacatttattcaagaaaatctactaaaacttggtaagaagagtgagaatcggtgacatttgaaccacagcctccctccttcccccttccagttcagtgtgataaaaattcaccttctacctgaagttcattcaagaacacagggattcctctctctccagctcccagttgaggaacatggtatctccttgggaggcacaggccatcagcatttcttattgctactagctagctatgtgttgcagagcctaaattccatggaggtgtggcctagaagccagggtgtttcttaattaagaggaggcttgcaccttaatgagaacagcaagctaaaccataggccagttagtttacaagggagagccagaggacaatgcaggtaaaacgtgccctcctggagtcataacagatatcacagactagcctcaaaaattcaaatggtccttaatttaattggatcagactgtgggggcaatttgtgctccactgaggaaataactccaaaaaaaaaccccat

SEQ ID NO: 102374 - DNA, 533 bp, Homo sapiens
tgatgagctcaggactctgtgcctttgtcctttcccgtgttgaggtgtggaattggtccctttccaagggcatgtgataaactgactcacaccaaggcagtaataagggaggccaatctccccctggggccttcgacttttagtggagtattaaaacttaatttaaactgatgaattgtaatggtgagatttcaagcccttccatgggacaatgggaagatatatttctttttaaataaagggctttcttctgaaatcagaccacgccctttcaatgactgacacaaactgctggagagacgcaaaagatgaagcagttaatcccaccacctctagctcaggatgagagagcaactcacacatccctcttagaagaccaaactctggccggttttctgcatgcctggtgctccttgcagaaacagagccttcctgcctacctctggaatcctggggcctcaggtggtgcccagtccacagtaggaacacaataggagatgagtgagtaggggagaagtgagcagttggatatg

SEQ ID NO: 102375 - DNA, 657 bp, Homo sapiens
gacctgaaagatgttcacaaatgttgtggctgaaaaggccgttttctctgactcccacttctctgggtgcccaaatgcactatctcgtagcacttaccacctggtttatttgcatcacctccgagagactgagtcacctttgactcaagccaggtctttgaaggtagagccaggtccctcttctctgtgtctccagcttctaggccagggattgatttggagcaactgcttcaaaactgttgagtaaatgaatgaatcagaggatacccagtctatctctctcatggtgtagatatggcactgaggcccagagatgagatgtcttggtcaagatcctaagccagttggtggtggcttacctccagcagatcaaggtttgcttcaagaagatcagggtttgtaggcatctccctgaatatcatgatttttatgtcctaggttattttctagtaataataataactggcattagaggttgttaaccattgtgtgccagttacaatacagagctctttataatcttcatcataaacaataggcatgcattttatctccattttacagataaggtgaagtagctttccaaggagtatacaattagaaggtggcaggatccagcctgagtccacatgtatatagctccaaagtttatgctct

SEQ ID NO: 102376 - DNA, 156 bp, Homo sapiens
tacgcaaatagtcccaaagagagcttttgtttcttactgtgagatctccatgatgcttaaaaattcttttacttaaaaaaataagctttaaagttcagcagtaacaaatgcttattcttaaaaaaaaaaaaaagcaatatgaaagtttccaataaa

SEQ ID NO: 102377 - DNA, 359 bp, Homo sapiens
aacaactctactggagccacccacaaaaaaatcagccagggttctcacccttgttgcatctgctcaaaccagcatctccttatctgaaaatattgtcttgatatgtgccgcttctgtttccacaagtacttaaaggatataggtctcattaagttggactaagtgatgctccttgaattaataagcaagacatccactcagtgaaagaaaccatgctaactctttgtacatgaataaaaattaaaataaagaaaccaatacaaacaaacaagaacaaaaaaaaaataggcatccatcactggtccacatcttgctgaagccaactatacccgtattttcatcttctctgaaaacgtttc

SEQ ID NO: 102378 - DNA, 389 bp, Homo sapiens
agggcaggggaataaaagggatgggagtgaggttgctgggggcaactgaattcacactggcccagggtggtgggccagctccctcctctctttgctcctccaatatataggcacctggagccagagggtttgttagttttaagaccccacctacatttcctatcctgggttactgacactggcagggactgacttgtaatggcaggagctggctaatcagttgcaagttcctgacatctggtaatggagaggaacaaagagtgggaggccaaatagggaacagacaagccccatgcggggtaaagtgaaatagggcagaagtggctgggcaggaagaccgagaaacacacacatgacatgttcagacatatccacgttctctctccact

SEQ ID NO: 102379 - DNA, 405 bp, Homo sapiens
agtttctgttctttaatgtttagttttttatgtaaaacattttcttattatccacacagcccctgattttctgatgtcactgattgatggagctttgtagaatacttaattttttctttttgaggcatgtttagagttacaatagtgattatttaaatataaactagtgagtttccattctttttgctaaagtaatagaggtttgttttcatctaattttttttgagacggagtctcactgtgccacccaggctgtagtgcagtggcacgatcttagctcactgcaacctccacctcctgggttcaagcgaatctcctgcctcagccgcccaagtagctgggattacaggcacccgccaacacgccgggctaattactgtatttttagtggtgacagggtttcac

SEQ ID NO: 102380 - DNA, 555 bp, Homo sapiens
cttctttttctggaagttttttttgagacagggtcttgctttgccgcacagactggaatgcggtggcatgatcatagctcattgcagcctcaaactcctgggcttaagcagtcctcccacctcagacttcgaagtagctggtattacaggtgcataacaccaccacccacgcctggctaattgttttgttttttttgtggagatggctctcactttgttgcccaggctggtttttgaactagtttcaaagtgatcctcctgccttggcctctcaaagtactaggataacagtcatgagccaccatgcccaccctagaatcatactcttttaaagcaagttaaatcagcagtaatagttctggaactagaagttaactacttactggacttttgagatgtaagtttaccatacatcaagcttaaaaacttgtagcgttctgggaaagtcaagtcaaactcttgaatgctatcctctgtggaaatagggttgggaaagagcaatgtacaagtccaagctccttaatacacataaaactctgggttgggctcatcctg

SEQ ID NO: 102381 - DNA, 193 bp, Homo sapiens
tgataagtgcagcaaaccaccatggctcatgtttacctatgtaacgaacctgcacatcctgcacatgttccccagaacttaaaattaaattaaattaaaaaaaagaagggaaaaaagtgaacagagcataaatcagctgtaattggaatccctaaaaaagtaaaaaagaaacaagtatttggagaaataatgg

SEQ ID NO: 102382 - DNA, 337 bp, Homo sapiens
acaggactggactgcattctttttctgtgcctagattgtttgacacacactcatttctacatctttgctggaggtcaaagaaccaaagcaggaaatccagaggagaatgtcaaaagtaaagactttagaaacagggctcttaaagaaagttaacggtgcccaaattatgcacctttagaaaaagaaggtgaaaaaaaggctttgtcggccgggcgcggtggctcacgcctgtaatcccagcactttgggaggccgaggcgggcggatcacgaggtcaggagatcgagaccacggtgaaaccccgtctctactaaaaaaaaaaatacaaaaaattagc

SEQ ID NO: 102383 - DNA, 185 bp, Homo sapiens
atcttagactcttatacttcaaacactgatcacgggaacagccggctcagcggctcctgagttcctaatgctcagaatatgggtgagatgataaatgtttgttgtgttaagctgccaacctttggcgggggggtaattcgtcacatggcaacagctggctaatacatatatacctacatgtatat

SEQ ID NO: 102384 - DNA, 266 bp, Homo sapiens
gaggcggacccaacttatgcggggtgaactcagaaagcttccggggctttctatcaacagcaagacctgtgtggaacaccagacctgtcccacaaccaggaacaatcctcttttgtttccagcccatttctgtacgtttcgctgttgttatctgagcattgccgaggttttcgcgtgggctgttccttaggtgctacgctaatgggagattgttactttaagcctgttctactgaacaatcccactctttcttgaaactactaaat

SEQ ID NO: 102385 - DNA, 640 bp, Homo sapiens
tggcacgaggggggtggataaacagtgtaatgtttcctttcttctgcgacaaatccttttatcttgataaaataacgtttcccgaattccattgaggtgcttcttccaactctcaccaaagcccatggacatgttacaggccatgagtcttgagtagggccacagcctcgttgctctggatactgaccaactgcccagcagcaagaagggcagcgtcttgggcttgtcttatctggccggggccttcttggcaggagcggcccccgcatcctcactctcctcaccatggctgccctgctggtccccaggtcatccggctcagggctgcaggcacgttgcttcctggtggggctgtgggaacgaatgcacaccacttggggactgcaaggcttgccctggctgtagtgttcagtaattgatctatattgctttttgacttactgaattgcagagttgggaggaacattagatcagtgatttctcagaccataatgtgcatatgaataatctggagatcttgttatattgcaaaggaggggcctagtttctgtgtttcaaacagttctcaagttatagtgatgcagtttcaggttcacacaacacacttccagtagcaaggctttaaatgattatgaaacgg

SEQ ID NO: 102386 - DNA, 696 bp, Homo sapiens
cctgctgctgctggtgcttctcaccacttttggactcagacaaagcccctgatgcagggcttgggatctggctctctagcagctggtgagggagtgcatatcatcctttacacactggaagtgcaggagaattaacttccatggaggcaaattttgaccactgggatccaggagatgaaggagaaccagcagatcaatgatatttttgtcctttgcttagatggatggagatgcagaagttcagccctacgaggtccatgattaattagctgagcagaggccagctcagtagcgcacctcctgtttgctctccctctttctttgctgcacacccctttctccctcacttttgcttccctgggattgcattcccaataaagtgttcatacataaacctttgcctcaaggctctgtttcctgggaacgcaggctggctgggcccttccccactgccagtcctggacacacactgcaaatgttccctcctagaattctcgtgactgttgtccgggctccactactgcactgcacccccatcaagccaggcattctttctttaccacagagcaattgattagattgaacctttcttcactgtgaccacaattctgtcccaattccctgaggcctacattagcctgttccacataattcctcatgttttattttttcaggtaactgatattagactttaca

SEQ ID NO: 102387 - DNA, 184 bp, Homo sapiens
atctcttagataaagtttgttaatgggccataaatacacaaagggtctggttgccaagtatccctgcaaaagggaggagaggccatatatcacttcctgggggatgggagggagtagcatctcaaggagaagtagcacaaaggcccctcctgagataggaaacaggccctgggtcaggcagctg

SEQ ID NO: 102388 - DNA, 1863 bp, Homo sapiens
  misc_feature (1766)..(1766): n is a, c, g, or t
  misc_feature (1770)..(1770): n is a, c, g, or t
  misc_feature (1813)..(1813): n is a, c, g, or t
  misc_feature (1838)..(1838): n is a, c, g, or t
  misc_feature (1862)..(1862): n is a, c, g, or t
ccctagccctgttttgtgagaagttccatacataatgctcctccacccaatacataccctcctgagagaacaggtaacaccactcgaacaaatggaggatcaaatggaaagttatccttaaaagagaagttaagcaaaatatattctatgccttctttttcttttaagatctgaagatcactgtgcaaaggactatcagggtcaaccttctgcagttaacatgccagtcatataaactgtcatttatgagttccactgtataaatccctgttttataactctgtgatctgtatatgtccctgagctctttcataagtctatctgaagcttgcactgacccagacactgcaccatttaaatggtcttgcctttgagtcttcctaattttctctaatattgccaaattttctttttcaattccttcatcctctgactttttcccactaataggctcttcttccttcatctcatagtgatctaagtcttctatatcttcagccatctcttcttcttcttcctcttcttctgaagtcacttcttctgttgtcccattctgacccgtgggtagtggttgatctagcatctcaacatccaggtgcttaggaaggttatataaactgcagagttcacatatcaaccacttcaattgctgacgaagcaaattgttgttcttagtatcttctagacgttccagaactgatgtcagatttgggtcttcagaatccacaaaccatatcggtgaagaagatggataggattccgtgatgttgcagtggagcgtgagtggcggcggcacgagtgcgggctgccctgctgcggcaccaggaactggcagtgcagctcgtccagcttccaactgacgatgcggaatcgctcgtggttcttgtcgaagatggacgccaggaacttcagctcggccttgagccctgacacggacatcttcccctcatctccggcgggaggggcgcggaaggggagccgggcgcggaaggggagccgggcccggagccgccgtcacggccgcgaccgccccgcgggccggcctgggccgcgctctccgcctcgtcgagcgctgctggaaaatggcgagggggcgcggaagcctcggcgtctgggagcccgcggccggagaagggctgcgggttagggggccggcgcccgcggttcagagtacctgtggagaagaaacaatggattccttagaccatatgctgacagatcctctggaacttggtccgtgtggagatggccatggcacgcgcatcatggaggattgcctcctgggaggcaccagagttagtctgcccgaggaccttctggaggatcctgagatcttctttgatgttgtcagcctctcaacatggcaggaagtgttaagtgattctcaacgtgaacacctccagcagtttctgccccagtttcctgaagacagtgctgagcagcagaatgaactcatcttagccttgttcagtggggagaacttccgctttggaaaccctctgcacattgcccagaagcttttccgagacggacactttaaccccgaggtggtcaagtaccggcagttatgcttcaagtcacagtacaagcgctacctcaactcccagcagcagtatttccatcggctgctgaagcaaattcttgcttcccggagtgatctgctggagatggcccggcggagtggccccgcccttcccttccggcagaaacgcccttcaccatcccgcacaccttgaaggaaccggggaattggccgggaacccaancaanccgcttactttgaaagggtcttaaaaggggaaagttgaaaaanaaaggaattgttgggtgaacaccanccccttggttcatccttggaattna

SEQ ID NO: 102389 - DNA, 6210 bp, Homo sapiens
ccctagccctgttttgtgagaagttccatacataatgctcctccacccaatacataccctcctgagagaacaggtaacaccactcgaacaaatggaggatcaaatggaaagttatccttaaaagagaagttaagcaaaatatattctatgccttctttttcttttaagatctgaagatcactgtgcaaaggactatcagggtcaaccttctgcagttaacatgccagtcatataaactgtcatttatgagttccactgtataaatccctgttttataactctgtgatctgtatatgtccctgagctctttcataagtctatctgaagcttgcactgacccagacactgcaccatttaaatggtcttgcctttgagtcttcctaattttctctaatattgccaaattttctttttcaattccttcatcctctgactttttcccactaataggctcttcttccttcatctcatagtgatctaagtcttctatatcttcagccatctcttcttcttcttcctcttcttctgaagtcacttcttctgttgtcccattctgacccgtgggtagtggttgatctagcatctcaacatccaggtgcttaggaaggttatataaactgcagagttcacatatcaaccacttcaattgctgacgaagcaaattgttgttcttagtatcttctagacgttccagaactgatgtcagatttgggtcttcagaatccacaaaccatatcggtgaagaagatggataggattccgtgatgttgcagtggagcgtgagtggcggcggcacgagtgcgggctgccctgctgcggcaccaggaactggcagtgcagctcgtccagcttccaactgacgatgcggaatcgctcgtggttcttgtcgaagatggacgccaggaacttcagctcggccttgagccctgacacggacatcttcccctcatctccggcgggaggggcgcggaaggggagccgggcgcggaaggggagccgggcccggagccgccgtcacggccgcgaccgccccgcgggccggcctgggccgcgctctccgcctcgtcgagcgctgctggaaaatggcgagggggcgcggaagcctcggcgtctgggagcccgcggccggagaagggctgcgggttagggggccggcgcccgcggttcaggattccagaattggaaataacgggagggaggacctggtccagcttcccttcctcaaataaggaaattgacacctggcgtgagaaggggttttgccatgttcgctaggctggtctcaaactcatggattcaaggggactgcccgcctggacctcccaaagtactgagattagtacctgtggagaagaaacaatggattccttagaccatatgctgacagatcctctggaacttggtccgtgtggagatggccatggcacgcgcatcatggaggattgcctcctgggaggcaccagagttagtctgcccgaggaccttctggaggatcctgagatcttctttgatgttgtcagcctctcaacatggcaggaagtgttaagtgattctcaacgtgaacacctccagcagtttctgccccagtttcctgaagacagtgctgagcagcagaatgaactcatcttagccttgttcagtggggagaacttccgctttggaaaccctctgcacattgcccagaagcttttccgagacggacactttaaccccgaggtggtcaagtaccggcagttatgcttcaagtcacagtacaagcgctacctcaactcccagcagcagtatttccatcggctgctgaagcaaattcttgcttcccggagtgatctgctggagatggcccggcggagtggccccgcccttcccttccggcagaaacgcccttcaccatcccgcacacctgaggagcgggagtggcggacccagcagcgctacttgaaggtcttaagggaagtgaaagaggagtgtggtgacacagccctgtcatctgatgaagaggatctcagctcatggcttccgagctctccagcacgttctcctagtcctgcggtgcccctgcgggtggtgcccacactttcaaccacggatatgaaaaccgcagataaagtagaactgggggacagtgacctgaagataatgttaaagaagcaccacgagaagcggaaacatcagccagatcacccggaccttttgacaggggacctgactctcaatgacatcatgactcgagtaaatgctggcaggaagggctctctggcagccttatatgacttggctgtccttaaaaaaaaggttaaggaaaaagaggaaaagaagaagaagaaaataaaaacgatcaaatcagaggcagaggacctggccgagccgctaagcagtactgaaggggtcgcacctctctcacaggccccctctccgctggcaattcctgctatcaaggaagagccccttgaagacctcaagccttgccttggaatcaatgaaatatcttccagcttcttctctcttctattagagatcttgctgctggagagtcaggctagccttcctatgctagaggagcgagttttggattggcagtcatcgccagccagctccctcaacagctggttctctgcggcccccaactgggctgagttggtactaccagccctgcagtatcttgctggagaaagtcgagctgttccttccagtttctctccatttgttgaattcaaagagaaaacccagcagtggaagttgcttggccaatcccaagataatgaaaaggaattagctgccctcttccagctatggctagagaccaaagatcaggccttctgtaagcaagaaaatgaagacagctcagatgccacaacacctgtccctcgggtaagaactgactatgtggtgcgtcccagcacgggggaggagaaacgggtttttcaggagcaggagcgttacaggtatagccaaccccataaggcgttcacctttcgcatgcacggctttgagtctgtggtggggccagtgaagggcgtgtttgacaaggagacctcgctcaacaaggctcgggagcactccctgctgcgctccgaccggcctgcctacgtcaccattctgtctcttgttcgggacgctgcggctcgactgcctaatggagaaggcacacgggcagagatctgtgaactgcttaaggactcccagtttcttgcaccagatgtcaccagcactcaggtaaatacagtagtgagtggtgcactggatcggctacattacgaaaaagatccctgtgtgaaatacgacattggacgaaagctgtggatctacctgcatcgtgaccggagtgaagaagagtttgagcggattcaccaagcacaagcagctgcagctaaagccagaaaagctcttcagcaaaaacccaagcccccatccaaggtgaagtccagtagcaaggagagctccataaaggtccttagcagtggcccttctgagcagagccagatgagcctcagtgactccagtatgccacccaccccagtcacacctgtaacccccaccacaccagcattgcccgccattcccatctcccctccacctgtatcggcagtgaacaaaagcggcccttccacagtctcagaaccagctaagtctagctcgggtgttcttctggtgtcttcaccaacaatgccacatctgggaacaatgctttccccagcttccagccagactgcacccagttctcaggctgccgcccgggtcgtgagccactctggctctgctggactgtctcaggtgcgagtggtggcccagcctagccttcctgctgttccccagcagtcgggagggccggcacagacattgccacagatgccagcaggaccgcagatccgggttccagccactgccacacagaccaaagtagtgccccagacagtaatggccactgtgcccgtcaaagcgcagactacggcagccactgtgcagcggcctggacccgggcagacagggctcacggtgacaagtctccctgccacagccagccctgtgagtaagccagccacgagttctcctgggacctctgctcccagtgcctccacggctgccgtcattcaaaatgtcacaggacagaacatcatcaagcaggtggcaatcactgggcagcttggtgtgaagccccaaacaggcaacagcattccactcacagccactaacttccgcatccagggtaaggatgtattgcgtctgccgccctcttccatcaccacagatgccaagggccagacggttctgcgaatcactccggacatgatggccacattggccaagtcccaggttaccacagtcaaattgacccaggacctcttcgggacaggaggcaacactacaggcaaaggcatctctgccaccttacacgtcacttccaatccagtacatgcagctgatagccctgccaaggccagttcagccagtgccccttcatccactccaacaggtaccactgtggtcaaagtgactcctgacctcaagccaacagaagcctcaagttcggcttttcgcttgatgccagctcttggcgtgagtgtggctgaccagaagggaaaaagcacagtggcctcttcagaagcaaaaccagctgccacgatccgcatcgtgcagggactgggagtgatgcctcccaaagcaggccagaccatcaccgttgcaacccacgccaagcaaggggcctcggtggccagtgggtctggaactgtccatacttcagcggtgtccttacccagtatgaatgctgctgtgtccaagactgtagctgtggcttctggggctgcaagcacccccatcagcatcagcacaggagcccccaccgtgcggcaggtccctgtcagcaccacggttgtgtccacgtcccaggctgggaagttgcctacacggatcacagttcccctctctgtgatcagccagccaatgaagggcaagagcgtggtcacagcccccatcatcaaaggcaaccttggagccaacctcagtgggttgggccgcaacatcatcctcacaactatgccagcaggcactaagctcattgctggcaataagcctgttagtttcctcactgctcagcagttgcagcagcttcagcagcaaggtcaggccacacaggtgcgcatccagactgtccctgcatcccatctccaacagggaacagcttctggctcctccaaagcagtctccactgttgttgtgactacagctccgtctcctaaacaggcacctgagcaacaatgattatgagagaggatggcttccgtgaaagaccatgcctggtctgtcctggctgagaagggaccagggaggttgcatcattgttttaagcttgcctgttcaaggcagccaggcgaggggtgatggcaacggtggcctggattcgtggcctggattctgctgccacgtgccatagtggagcaccctgagaaaggttcactccagggttccaaggtctgctctctaccaatctaggagaatattctgttgaaattgcaggaattaccagttacgtccaacaagccagagttctgagagtaagacccccagggaaggcttaccagttgcagagtgcacacagcgaataggctggttctccatgaggattgtattttttggcttctggtcttctccatgactagtggtctggataggagttttgtgtccagaaaattttatgtaatttatttttttaaagaacctgttgtacatctttctcaaatacaaacttgggctttagctgccccctccactaaaccgatgacttacttttttgactagaatgagaaaatggcaagaatcttagtaaggtggtagccagcttggtaactgcatagtaatcgagaggctgtaagatgggaattcatcgtaggcagcgaggtagagtgggtcccctgaaatgggattcgcttggcactgcctcttaaagataggggtgttgggatcttgattgtggccgccccccccagctttacctgcccactttgtccttcttggcaagcctgttcacatggacgtccagagccagtggacagagaggaggggacggacagcagaggtgctgcttttgcagcagaaactttgttgcagttcagagtataccttctgctctgctccagagcaagagttgcaaaccaggcccttggggctggccatttgtttttgtaaataaagttttattggaacacaaacaga

SEQ ID NO: 102390 - DNA, 5055 bp, Homo sapiens
  misc_feature (2)..(2): n is a, c, g, or t
  misc_feature (4)..(6): n is a, c, g, or t
  misc_feature (8)..(8): n is a, c, g, or t
gnannngngctgtttagctgtaattagggtgcaaggataaggtgtaagaactggctggaggttgaatgttttcctggaggagtgttagcatcaactagatccctggaatttctgcctttctgtctcaagatgcatgtctttgtccagagtacctgtggagaagaaacaatggattccttagaccatatgctgacagatcctctggaacttggtccgtgtggagatggccatggcacgcgcatcatggaggattgcctcctgggaggcaccagagttagtctgcccgaggaccttctggaggatcctgagatcttctttgatgttgtcagcctctcaacatggcaggaagtgttaagtgattctcaacgtgaacacctccagcagtttctgccccagtttcctgaagacagtgctgagcagcagaatgaactcatcttagccttgttcagtggggagaacttccgctttggaaaccctctgcacattgcccagaagcttttccgagacggacactttaaccccgaggtggtcaagtaccggcagttatgcttcaagtcacagtacaagcgctacctcaactcccagcagcagtatttccatcggctgctgaagcaaattcttgcttcccggagtgatctgctggagatggcccggcggagtggccccgcccttcccttccggcagaaacgcccttcaccatcccgcacacctgaggagcgggagtggcggacccagcagcgctacttgaaggtcttaagggaagtgaaagaggagtgtggtgacacagccctgtcatctgatgaagaggccacgttggatttacaagaacaattttcttttgaagatctcagctcatggcttccgagctctccagcacgttctcctagtcctgcggtgcccctgcgggtggtgcccacactttcaaccacggatatgaaaaccgcagataaagtagaactgggggacagtgacctgaagataatgttaaagaagcaccacgagaagcggaaacatcagccagatcacccggaccttttgacaggggacctgactctcaatgacatcatgactcgagtaaatgctggcaggaagggctctctggcagccttatatgacttggctgtccttaaaaaaaaggttaaggaaaaagaggaaaagaagaagaagaaaataaaaacgatcaaatcagaggcagaggacctggccgagccgctaagcagtactgaaggggtcgcacctctctcacaggccccctctccgctggcaattcctgctatcaaggaagagccccttgaagacctcaagccttgccttggaatcaatgaaatatcttccagcttcttctctcttctattagagatcttgctgctggagagtcaggctagccttcctatgctagaggagcgagttttggattggcagtcatcgccagccagctccctcaacagctggttctctgcggcccccaactgggctgagttggtactaccagccctgcagtatcttgctggagaaagtcgagctgttccttccagtttctctccatttgttgaattcaaagagaaaacccagcagtggaagttgcttggccaatcccaagataatgaaaaggaattagctgccctcttccagctatggctagagaccaaagatcaggccttctgtaagcaagaaaatgaagacagctcagatgccacaacacctgtccctcgggtaagaactgactatgtggtgcgtcccagcacgggggaggagaaacgggtttttcaggagcaggagcgttacaggtatagccaaccccataaggcgttcacctttcgcatgcacggctttgagtctgtggtggggccagtgaagggcgtgtttgacaaggagacctcgctcaacaaggctcgggagcactccctgctgcgctccgaccggcctgcctacgtcaccattctgtctcttgttcgggacgctgcggctcgactgcctaatggagaaggcacacgggcagagatctgtgaactgcttaaggactcccagtttcttgcaccagatgtcaccagcactcaggtaaatacagtagtgagtggtgcactggatcggctacattacgaaaaagatccctgtgtgaaatacgacattggacgaaagctgtggatctacctgcatcgtgaccggagtgaagaagagtttgagcggattcaccaagcacaagcagctgcagctaaagccagaaaagctcttcagcaaaaacccaagcccccatccaaggtgaagtccagtagcaaggagagctccataaaggtccttagcagtggcccttctgagcagagccagatgagcctcagtgactccagtatgccacccaccccagtcacacctgtaacccccaccacaccagcattgcccgccattcccatctcccctccacctgtatcggcagtgaacaaaagcggcccttccacagtctcagaaccagctaagtctagctcgggtgttcttctggtgtcttcaccaacaatgccacatctgggaacaatgctttccccagcttccagccagactgcacccagttctcaggctgccgcccgggtcgtgagccactctggctctgctggactgtctcaggtgcgagtggtggcccagcctagccttcctgctgttccccagcagtcgggagggccggcacagacattgccacagatgccagcaggaccgcagatccgggttccagccactgccacacagaccaaagtagtgccccagacagtaatggccactgtgcccgtcaaagcgcagactacggcagccactgtgcagcggcctggacccgggcagacagggctcacggtgacaagtctccctgccacagccagccctgtgagtaagccagccacgagttctcctgggacctctgctcccagtgcctccacggctgccgtcattcaaaatgtcacaggacagaacatcatcaagcaggtggcaatcactgggcagcttggtgtgaagccccaaacaggcaacagcattccactcacagccactaacttccgcatccagggtaaggatgtattgcgtctgccgccctcttccatcaccacagatgccaagggccagacggttctgcgaatcactccggacatgatggccacattggccaagtcccaggttaccacagtcaaattgacccaggacctcttcgggacaggaggcaacactacaggcaaaggcatctctgccaccttacacgtcacttccaatccagtacatgcagctgatagccctgccaaggccagttcagccagtgccccttcatccactccaacaggtaccactgtggtcaaagtgactcctgacctcaagccaacagaagcctcaagttcggcttttcgcttgatgccagctcttggcgtgagtgtggctgaccagaagggaaaaagcacagtggcctcttcagaagcaaaaccagctgccacgatccgcatcgtgcagggactgggagtgatgcctcccaaagcaggccagaccatcaccgttgcaacccacgccaagcaaggggcctcggtggccagtgggtctggaactgtccatacttcagcggtgtccttacccagtatgaatgctgctgtgtccaagactgtagctgtggcttctggggctgcaagcacccccatcagcatcagcacaggagcccccaccgtgcggcaggtccctgtcagcaccacggttgtgtccacgtcccaggctgggaagttgcctacacggatcacagttcccctctctgtgatcagccagccaatgaagggcaagagcgtggtcacagcccccatcatcaaaggcaaccttggagccaacctcagtgggttgggccgcaacatcatcctcacaactatgccagcaggcactaagctcattgctggcaataagcctgttagtttcctcactgctcagcagttgcagcagcttcagcagcaaggtcaggccacacaggtgcgcatccagactgtccctgcatcccatctccaacagggaacagcttctggctcctccaaagcagtctccactgttgttgtgactacagctccgtctcctaaacaggcacctgagcaacaatgattatgagagaggatggcttccgtgaaagaccatgcctggtctgtcctggctgagaagggaccagggaggttgcatcattgttttaagcttgcctgttcaaggcagccaggcgaggggtgatggcaacggtggcctggattcgtggcctggattctgctgccacgtgccatagtggagcaccctgagaaaggttcactccagggttccaaggtctgctctctaccaatctaggagaatattctgttgaaattgcaggaattaccagttacgtccaacaagccagagttctgagagtaagacccccagggaaggcttaccagttgcagagtgcacacagcgaataggctggttctccatgaggattgtattttttggcttctggtcttctccatgactagtggtctggataggagttttgtgtccagaaaattttatgtaatttatttttttaaagaacctgttgtacatctttctcaaatacaaacttgggctttagctgccccctccactaaaccgatgacttacttttttgactagaatgagaaaatggcaagaatcttagtaaggtggtagccagcttggtaactgcatagtaatcgagaggctgtaagatgggaattcatcgtaggcagcgaggtagagtgggtcccctgaaatgggattcgcttggcactgcctcttaaagataggggtgttgggatcttgattgtggccgccccccccagctttacctgcccactttgtccttcttggcaagcctgttcacatggacgtccagagccagtggacagagaggaggggacggacagcagaggtgctgcttttgcagcagaaactttgttgcagttcagagtataccttctgctctgctccagagcaagagttgcaaaccaggcccttggggctggccatttgtttttgtaaataaagttttattggaacacaaacaga

SEQ ID NO: 102391 - DNA, 4462 bp, Homo sapiens
  misc_feature (103)..(103): n is a, c, g, or t
aaaatctgaaacagtagtacgaagggacagtgcggcaagcggacaaaggaatagccagagccaagccgttctccagagtgtctgtgagttggaaaagagtttnttgttggaacaggaagcaaagatggttaagaactttaagtgtgttttaggaccagctgagtcacagaagtcatatattaccaacgtatggaaaagtggaagtgtcgatcctgtgactttaaagatttttggtacttgtagttcacaggtgtcagaagggaaactcagaaatatcttacttttgacaagtgaccagaaagatgtaaattggagaatcatgatagtgaatatggtttggtttgttttctcagataaagtagaactgggggacagtgacctgaagataatgttaaagaagcaccacgagaagcggaaacatcagccagatcacccggaccttttgacaggggacctgactctcaatgacatcatgactcgagtaaatgctggcaggaagggctctctggcagccttatatgacttggctgtccttaaaaaaaaggttaaggaaaaagaggaaaagaagaagaagaaaataaaaacgatcaaatcagaggcagaggacctggccgagccgctaagcagtactgaaggggtcgcacctctctcacaggccccctctccgctggcaattcctgctatcaaggaagagccccttgaagacctcaagccttgccttggaatcaatgaaatatcttccagcttcttctctcttctattagagatcttgctgctggagagtcaggctagccttcctatgctagaggagcgagttttggattggcagtcatcgccagccagctccctcaacagctggttctctgcggcccccaactgggctgagttggtactaccagccctgcagtatcttgctggagaaagtcgagctgttccttccagtttctctccatttgttgaattcaaagagaaaacccagcagtggaagttgcttggccaatcccaagataatgaaaaggaattagctgccctcttccagctatggctagagaccaaagatcaggccttctgtaagcaagaaaatgaagacagctcagatgccacaacacctgtccctcgggtaagaactgactatgtggtgcgtcccagcacgggggaggagaaacgggtttttcaggagcaggagcgttacaggtatagccaaccccataaggcgttcacctttcgcatgcacggctttgagtctgtggtggggccagtgaagggcgtgtttgacaaggagacctcgctcaacaaggctcgggagcactccctgctgcgctccgaccggcctgcctacgtcaccattctgtctcttgttcgggacgctgcggctcgactgcctaatggagaaggcacacgggcagagatctgtgaactgcttaaggactcccagtttcttgcaccagatgtcaccagcactcaggtaaatacagtagtgagtggtgcactggatcggctacattacgaaaaagatccctgtgtgaaatacgacattggacgaaagctgtggatctacctgcatcgtgaccggagtgaagaagagtttgagcggattcaccaagcacaagcagctgcagctaaagccagaaaagctcttcagcaaaaacccaagcccccatccaaggtgaagtccagtagcaaggagagctccataaaggtccttagcagtggcccttctgagcagagccagatgagcctcagtgactccagtatgccacccaccccagtcacacctgtaacccccaccacaccagcattgcccgccattcccatctcccctccacctgtatcggcagtgaacaaaagcggcccttccacagtctcagaaccagctaagtctagctcgggtgttcttctggtgtcttcaccaacaatgccacatctgggaacaatgctttccccagcttccagccagactgcacccagttctcaggctgccgcccgggtcgtgagccactctggctctgctggactgtctcaggtgcgagtggtggcccagcctagccttcctgctgttccccagcagtcgggagggccggcacagacattgccacagatgccagcaggaccgcagatccgggttccagccactgccacacagaccaaagtagtgccccagacagtaatggccactgtgcccgtcaaagcgcagactacggcagccactgtgcagcggcctggacccgggcagacagggctcacggtgacaagtctccctgccacagccagccctgtgagtaagccagccacgagttctcctgggacctctgctcccagtgcctccacggctgccgtcattcaaaatgtcacaggacagaacatcatcaagcaggtggcaatcactgggcagcttggtgtgaagccccaaacaggcaacagcattccactcacagccactaacttccgcatccagggtaaggatgtattgcgtctgccgccctcttccatcaccacagatgccaagggccagacggttctgcgaatcactccggacatgatggccacattggccaagtcccaggttaccacagtcaaattgacccaggacctcttcgggacaggaggcaacactacaggcaaaggcatctctgccaccttacacgtcacttccaatccagtacatgcagctgatagccctgccaaggccagttcagccagtgccccttcatccactccaacaggtaccactgtggtcaaagtgactcctgacctcaagccaacagaagcctcaagttcggcttttcgcttgatgccagctcttggcgtgagtgtggctgaccagaagggaaaaagcacagtggcctcttcagaagcaaaaccagctgccacgatccgcatcgtgcagggactgggagtgatgcctcccaaagcaggccagaccatcaccgttgcaacccacgccaagcaaggggcctcggtggccagtgggtctggaactgtccatacttcagcggtgtccttacccagtatgaatgctgctgtgtccaagactgtagctgtggcttctggggctgcaagcacccccatcagcatcagcacaggagcccccaccgtgcggcaggtccctgtcagcaccacggttgtgtccacgtcccaggctgggaagttgcctacacggatcacagttcccctctctgtgatcagccagccaatgaagggcaagagcgtggtcacagcccccatcatcaaaggcaaccttggagccaacctcagtgggttgggccgcaacatcatcctcacaactatgccagcaggcactaagctcattgctggcaataagcctgttagtttcctcactgctcagcagttgcagcagcttcagcagcaaggtcaggccacacaggtgcgcatccagactgtccctgcatcccatctccaacagggaacagcttctggctcctccaaagcagtctccactgttgttgtgactacagctccgtctcctaaacaggcacctgagcaacaatgattatgagagaggatggcttccgtgaaagaccatgcctggtctgtcctggctgagaagggaccagggaggttgcatcattgttttaagcttgcctgttcaaggcagccaggcgaggggtgatggcaacggtggcctggattcgtggcctggattctgctgccacgtgccatagtggagcaccctgagaaaggttcactccagggttccaaggtctgctctctaccaatctaggagaatattctgttgaaattgcaggaattaccagttacgtccaacaagccagagttctgagagtaagacccccagggaaggcttaccagttgcagagtgcacacagcgaataggctggttctccatgaggattgtattttttggcttctggtcttctccatgactagtggtctggataggagttttgtgtccagaaaattttatgtaatttatttttttaaagaacctgttgtacatctttctcaaatacaaacttgggctttagctgccccctccactaaaccgatgacttacttttttgactagaatgagaaaatggcaagaatcttagtaaggtggtagccagcttggtaactgcatagtaatcgagaggctgtaagatgggaattcatcgtaggcagcgaggtagagtgggtcccctgaaatgggattcgcttggcactgcctcttaaagataggggtgttgggatcttgattgtggccgccccccccagctttacctgcccactttgtccttcttggcaagcctgttcacatggacgtccagagccagtggacagagaggaggggacggacagcagaggtgctgcttttgcagcagaaactttgttgcagttcagagtataccttctgctctgctccagagcaagagttgcaaaccaggcccttggggctggccatttgtttttgtaaataaagttttattggaacacaaacaga

SEQ ID NO: 102392 - DNA, 1982 bp, Homo sapiens
ccctagccctgttttgtgagaagttccatacataatgctcctccacccaatacataccctcctgagagaacaggtaacaccactcgaacaaatggaggatcaaatggaaagttatccttaaaagagaagttaagcaaaatatattctatgccttctttttcttttaagatctgaagatcactgtgcaaaggactatcagggtcaaccttctgcagttaacatgccagtcatataaactgtcatttatgagttccactgtataaatccctgttttataactctgtgatctgtatatgtccctgagctctttcataagtctatctgaagcttgcactgacccagacactgcaccatttaaatggtcttgcctttgagtcttcctaattttctctaatattgccaaattttctttttcaattccttcatcctctgactttttcccactaataggctcttcttccttcatctcatagtgatctaagtcttctatatcttcagccatctcttcttcttcttcctcttcttctgaagtcacttcttctgttgtcccattctgacccgtgggtagtggttgatctagcatctcaacatccaggtgcttaggaaggttatataaactgcagagttcacatatcaaccacttcaattgctgacgaagcaaattgttgttcttagtatcttctagacgttccagaactgatgtcagatttgggtcttcagaatccacaaaccatatcggtgaagaagatggataggattccgtgatgttgcagtggagcgtgagtggcggcggcacgagtgcgggctgccctgctgcggcaccaggaactggcagtgcagctcgtccagcttccaactgacgatgcggaatcgctcgtggttcttgtcgaagatggacgccaggaacttcagctcggccttgagccctgacacggacatcttcccctcatctccggcgggaggggcgcggaaggggagccgggcgcggaaggggagccgggcccggagccgccgtcacggccgcgaccgccccgcgggccggcctgggccgcgctctccgcctcgtcgagcgctgctggaaaatggcgagggggcgcggaagcctcggcgtctgggagcccgcggccggagaagggctgcgggttagggggccggcgcccgcggttcaggattccagaattggaaataacgggagggaggacctggtccagcttcccttcctcaaataaggaaattgacacctggcgtgagaaggggttttgccatgttcgctaggctggtctcaaactcatggattcaaggggactgcccgcctggacctcccaaagtactgagattagtacctgtggagaagaaacaatggattccttagaccatatgctgacagatcctctggaacttggtccgtgtggagatggccatggcacgcgcatcatggaggattgcctcctgggaggcaccagagttagtctgcccgaggaccttctggaggatcctgagatcttctttgatgttgtcagcctctcaacatggcaggaagtgttaagtgattctcaacgtgaacacctccagcagtttctgccccagtttcctgaagacagtgctgagcagcagaatgaactcatcttagccttgttcagtggggagaacttccgctttggaaaccctctgcacattgcccagaagcttttccgaggtttgtagctcagtattctttctttgaggggggtggtggatgggcacacgttcactttatgtgggtattcctttcttccttttcttctttttatcttcatgtacagatactgaggcagcaaagagcggttttgtgtaacactttgctgtctaggctgtgttttaaaaaacaaaaatgtattgacttatatagaaaatacataatatgaattcagcttgtaaccagcatcagcttgtaaccagcatctacataaaaaaataaaacatttccagcataaaagaggtgc

SEQ ID NO: 102393 - DNA, 2330 bp, Homo sapiens
ccctagccctgttttgtgagaagttccatacataatgctcctccacccaatacataccctcctgagagaacaggtaacaccactcgaacaaatggaggatcaaatggaaagttatccttaaaagagaagttaagcaaaatatattctatgccttctttttcttttaagatctgaagatcactgtgcaaaggactatcagggtcaaccttctgcagttaacatgccagtcatataaactgtcatttatgagttccactgtataaatccctgttttataactctgtgatctgtatatgtccctgagctctttcataagtctatctgaagcttgcactgacccagacactgcaccatttaaatggtcttgcctttgagtcttcctaattttctctaatattgccaaattttctttttcaattccttcatcctctgactttttcccactaataggctcttcttccttcatctcatagtgatctaagtcttctatatcttcagccatctcttcttcttcttcctcttcttctgaagtcacttcttctgttgtcccattctgacccgtgggtagtggttgatctagcatctcaacatccaggtgcttaggaaggttatataaactgcagagttcacatatcaaccacttcaattgctgacgaagcaaattgttgttcttagtatcttctagacgttccagaactgatgtcagatttgggtcttcagaatccacaaaccatatcggtgaagaagatggataggattccgtgatgttgcagtggagcgtgagtggcggcggcacgagtgcgggctgccctgctgcggcaccaggaactggcagtgcagctcgtccagcttccaactgacgatgcggaatcgctcgtggttcttgtcgaagatggacgccaggaacttcagctcggccttgagccctgacacggacatcttcccctcatctccggcgggaggggcgcggaaggggagccgggcgcggaaggggagccgggcccggagccgccgtcacggccgcgaccgccccgcgggccggcctgggccgcgctctccgcctcgtcgagcgctgctggaaaatggcgagggggcgcggaagcctcggcgtctgggagcccgcggccggagaagggctgcgggttagggggccggcgcccgcggttcaggattccagaattggaaataacgggagggaggacctggtccagcttcccttcctcaaataaggaaattgacacctggcgtgagaaggggttttgccatgttcgctaggctggtctcaaactcatggattcaaggggactgcccgcctggacctcccaaagtactgagattagtacctgtggagaagaaacaatggattccttagaccatatgctgacagatcctctggaacttggtccgtgtggagatggccatggcacgcgcatcatggaggattgcctcctgggaggcaccagagttagtctgcccgaggaccttctggaggatcctgagatcttctttgatgttgtcagcctctcaacatggcaggaagtgttaagtgattctcaacgtgaacacctccagcagtttctgccccagtttcctgaagacagtgctgagcagcagaatgaactcatcttagccttgttcagtggggagaacttccgctttggaaaccctctgcacattgcccagaagcttttccgagacggacactttaaccccgaggtggtcaagtaccggcagttatgcttcaagtcacagtacaagcgctacctcaactcccagcagcagtatttccatcggctgctgaagcaaattcttgcttcccggagtgatctgctggagatggcccggcggagtggccccgcccttcccttccggcagaaacgcccttcaccatcccgcacacctgaggagcgggagtggcggacccagcagcgctacttgaaggtcttaagggaagtgaaagaggagtgtggtgacacagccctgtcatctgatgaagaggatctcagctcatggcttccgagctctccagcacgttctcctagtcctgcggtgcccctgcgggtggtgcccacactttcaaccacggatatgaaaaccgcagataaagtagaactgggggacagtgacctgaagataatgttaaagaagcaccacgagaagcggaaacatcagccagatcacccggaccttttgacaggggacctgactctcaatgacatcatgactcgagtaaatgctggcaggaagggctctctggcagccttatatgacaaaactgtccttaaaaaaaaaggttaaggaaaaagagggtttcttagcgatggggtcct

SEQ ID NO: 102394 - DNA, 3411 bp, Homo sapiens
ggctggaagccggaagcgagcaaagtggagccgactcgaactccaccgcggaaaagaaagcctcagaacgttcgctcgctgcgtccccagccggggccgagccctccgcgacgccacccgggccatgggggccgcacgcagcccgccgtccgctgtcccggggcccctgctggggctgctcctgctgctcctgggcgtgctggccccgggtggcgcctccctgcgactcctggaccaccgggcgctggtctgctcccagccggggctaaactgcacggtcaagaatagtacctgcctggatgacagctggattcaccctcgaaacctgaccccctcctccccaaaggacctgcagatccagctgcactttgcccacacccaacaaggagacctgttccccgtggctcacatcgaatggacactgcagacagacgccagcatcctgtacctcgagggtgcagagttatctgtcctgcagctgaacaccaatgaacgtttgtgcgtcaggtttgagtttctgtccaaactgaggcatcaccacaggcggtggcgttttaccttcagccactttgtggttgaccctgaccaggaatatgaggtgaccgttcaccacctgcccaagcccatccctgatggggacccaaaccaccagtccaagaatttccttgtgcctgactgtgagcacgccaggatgaaggtaaccacgccatgcatgagctcaggcagcctgtgggaccccaacatcaccgtggagaccctggaggcccaccagctgcgtgtgagcttcaccctgtggaacgaatctacccattaccagatcctgctgaccagttttccgcacatggagaaccacagttgctttgagcacatgcaccacatacctgcgcccagaccagaagagttccaccagcgatccaacgtcacactcactctacgcaaccttaaagggtgctgtcgccaccaagtgcagatccagcccttcttcagcagctgcctcaatgactgcctcagacactccgcgactgtttcctgcccagaaatgccagacactccagaaccaattccggactacatgcccctgtgggtgtactggttcatcacgggcatctccatcctgctggtgggctccgtcatcctgctcatcgtctgcatgacctggaggctagctgggcctggaagtgaaaaatacagtgatgacaccaaatacaccgatggcctgcctgcggctgacctgatccccccaccgctgaagcccaggaaggtctggatcatctactcagccgaccaccccctctacgtggacgtggtcctgaaattcgcccagttcctgctcaccgcctgcggcacggaagtggccctggacctgctggaagagcaggccatctcggaggcaggagtcatgacctgggtgggccgtcagaagcaggagatggtggagagcaactctaagatcatcgtcctgtgctcccgcggcacgcgcgccaagtggcaggcgctcctgggccggggggcgcctgtgcggctgcgctgcgaccacggaaagcccgtgggggacctgttcactgcagccatgaacatgatcctcccggacttcaagaggccagcctgcttcggcacctacgtagtctgctacttcagcgaggtcagctgtgacggcgacgtccccgacctgttcggcgcggcgccgcggtacccgctcatggacaggttcgaggaggtgtacttccgcatccaggacctggagatgttccagccgggccgcatgcaccgcgtaggggagctgtcgggggacaactacctgcggagcccgggcggcaggcagctccgcgccgccctggacaggttccgggactggcaggtccgctgtcccgactggttcgaatgtgagaacctctactcagcagatgaccaggatgccccgtccctggacgaagaggtgtttgaggagccactgctgcctccgggaaccggcatcgtgaagcgggcgcccctggtgcgcgagcctggctcccaggcctgcctggccatagacccgctggtcggggaggaaggaggagcagcagtggcaaagctggaacctcacctgcagccccggggtcagccagcgccgcagcccctccacaccctggtgctcgccgcagaggagggggccctggtggccgcggtggagcctgggcccctggctgacggtgccgcagtccggctggcactggcgggggagggcgaggcctgcccgctgctgggcagcccgggcgctgggcgaaatagcgtcctcttcctccccgtggaccccgaggactcgccccttggcagcagcacccccatggcgtctcctgacctccttccagaggacgtgagggagcacctcgaaggcttgatgctctcgctcttcgagcagagtctgagctgccaggcccaggggggctgcagtagacccgccatggtcctcacagacccacacacgccctacgaggaggagcagcggcagtcagtgcagtctgaccagggctacatctccaggagctccccgcagccccccgagggactcacggaaatggaggaagaggaggaagaggagcaggacccagggaagccggccctgccactctctcccgaggacctggagagcctgaggagcctccagcggcagctgcttttccgccagctgcagaagaactcgggctgggacacgatggggtcagagtcagaggggcccagtgcatgagggcggctccccagggaccgcccagatcccagctttgagagaggagtgtgtgtgcacgtattcatctgtgtgtacatgtctgcatgtgtatatgttcgtgtgtgaaatgtaggctttaaaatgtaaatgtctggattttaatcccaggcatccctcctaacttttctttgtgcagcggtctggttatcgtctatccccaggggaatccacacagcccgctcccaggagctaatggtagagcgtccttgaggctccattattcgttcattcagcatttattgtgcacctactatgtggcgggcatttgggataccaagataaattgcatgcggcatggccccagccatgaaggaacttaaccgctagtgccgaggacacattaaacgaacaggatgggccgggcacggtggctcacgcctgtaatcccagcacattgggaggccgaggcaggtggatcactctgaggtcaggagtttgagccagcctggccaacatggtgaaaccccatctccactaaaaatagaaaaattagccgggcatggtgacacatgcctgtagtcctagctacttgggaggctgaggcaggagaattgcttgaatctgggaggcagaggttgcagtgagccgagattgtgccattgcactgcagcctggatgacagagcgagactctatctcaaaaaaaaa

SEQ ID NO: 102395 - DNA, 2270 bp, Homo sapiens
actccagtgtatttcttttcctttccagggcctggaagtgaaaaatacagtgatgacaccaaatacaccgatggcctgcctgcggctgacctgatccccccaccgctgaagcccaggaaggtctggatcatctactcagccgaccaccccctctacgtggacgtggtcctgaaattcgcccagttcctgctcaccgcctgcggcacggaagtggccctggacctgctggaagagcaggccatctcggaggcaggagtcatgacctgggtgggccgtcagaagcaggagatggtggagagcaactctaagatcatcgtcctgtgctcccgcggcacgcgcgccaagtggcaggcgctcctgggccggggggcgcctgtgcggctgcgctgcgaccacggaaagcccgtgggggacctgttcactgcagccatgaacatgatcctcccggacttcaagaggccagcctgcttcggcacctacgtagtctgctacttcagcgaggtcagctgtgacggcgacgtccccgacctgttcggcgcggcgccgcggtacccgctcatggacaggttcgaggaggtgtacttccgcatccaggacctggagatgttccagccgggccgcatgcaccgcgtaggggagctgtcgggggacaactacctgcggagcccgggcggcaggcagctccgcgccgccctggacaggttccgggactggcaggtccgctgtcccgactggttcgaatgtgagaacctctactcagcagatgaccaggatgccccgtccctggacgaagaggtgtttgaggagccactgctgcctccgggaaccggcatcgtgaagcgggcgcccctggtgcgcgagcctggctcccaggcctgcctggccatagacccgctggtcggggaggaaggaggagcagcagtggcaaagctggaacctcacctgcagccccggggtcagccagcgccgcagcccctccacaccctggtgctcgccgcagaggagggggccctggtggccgcggtggagcctgggcccctggctgacggtgccgcagtccggctggcactggcgggggagggcgaggcctgcccgctgctgggcagcccgggcgctgggcgaaatagcgtcctcttcctccccgtggaccccgaggactcgccccttggcagcagcacccccatggcgtctcctgacctccttccagaggacgtgagggagcacctcgaaggcttgatgctctcgctcttcgagcagagtctgagctgccaggcccaggggggctgcagtagacccgccatggtcctcacagacccacacacgccctacgaggaggagcagcggcagtcagtgcagtctgaccagggctacatctccaggagctccccgcagccccccgagggactcacggaaatggaggaagaggaggaagaggagcaggacccagggaagccggccctgccactctctcccgaggacctggagagcctgaggagcctccagcggcagctgcttttccgccagctgcagaagaactcgggctgggacacgatggggtcagagtcagaggggcccagtgcatgagggcggctccccagggaccgcccagatcccagctttgagagaggagtgtgtgtgcacgtattcatctgtgtgtacatgtctgcatgtgtatatgttcgtgtgtgaaatgtaggctttaaaatgtaaatgtctggattttaatcccaggcatccctcctaacttttctttgtgcagcggtctggttatcgtctatccccaggggaatccacacagcccgctcccaggagctaatggtagagcgtccttgaggctccattattcgttcattcagcatttattgtgcacctactatgtggcgggcatttgggataccaagataaattgcatgcggcatggccccagccatgaaggaacttaaccgctagtgccgaggacacattaaacgaacaggatgggccgggcacggtggctcacgcctgtaatcccagcacattgggaggccgaggcaggtggatcactctgaggtcaggagtttgagccagcctggccaacatggtgaaaccccatctccactaaaaatagaaaaattagccgggcatggtgacacatgcctgtagtcctagctacttgggaggctgaggcaggagaattgcttgaatctgggaggcagaggttgcagtgagccgagattgtgccattgcactgcagcctggatgacagagcgagactctatctcaaaaaaaaa

SEQ ID NO: 102396 - DNA, 3112 bp, Homo sapiens
gtggaagattgacgagtatgcaatgagcgatattagagtcatgataagaaagtatgcagatagagcatatgtaatcattatgcctcatagggatagtacaaggaaggggtaggctatgtgtttagtcagggggttgagaatgagtgtgaggcgtcttataccatagccgcctagatttataagagtactgcggcaagtactattgacccagcgacatccaaaccccctgagacttccgcagggccatccccggagccatccgatgtcccgggggatgtcgctgtggatgtcgcggtgatgttggcgttcaccacctgcccaagcccatccctgatggggacccaaaccaccagtccaagaatttccttgtgcctgactgtgagcacgccaggatgaaggtaaccacgccatgcatgagctcaggcagcctgtgggaccccaacatcaccgtggagaccctggaggcccaccagctgcgtgtgagcttcaccctgtggaacgaatctacccattaccagatcctgctgaccagttttccgcacatggagaaccacagttgctttgagcacatgcaccacatacctgcgcccagaccagaagagttccaccagcgatccaacgtcacactcactctacgcaaccttaaagggtgctgtcgccaccaagtgcagatccagcccttcttcagcagctgcctcaatgactgcctcagacactccgcgactgtttcctgcccagaaatgccagacactccagaaccaattccggactacatgcccctgtgggtgtactggttcatcacgggcatctccatcctgctggtgggctccgtcatcctgctcatcgtctgcatgacctggaggctagctgggcctggaagtgaaaaatacagtgatgacaccaaatacaccgatggcctgcctgcggctgacctgatccccccaccgctgaagcccaggaaggtctggatcatctactcagccgaccaccccctctacgtggacgtggtcctgaaattcgcccagttcctgctcaccgcctgcggcacggaagtggccctggacctgctggaagagcaggccatctcggaggcaggagtcatgacctgggtgggccgtcagaagcaggagatggtggagagcaactctaagatcatcgtcctgtgctcccgcggcacgcgcgccaagtggcaggcgctcctgggccggggggcgcctgtgcggctgcgctgcgaccacggaaagcccgtgggggacctgttcactgcagccatgaacatgatcctcccggacttcaagaggccagcctgcttcggcacctacgtagtctgctacttcagcgaggtcagctgtgacggcgacgtccccgacctgttcggcgcggcgccgcggtacccgctcatggacaggttcgaggaggtgtacttccgcatccaggacctggagatgttccagccgggccgcatgcaccgcgtaggggagctgtcgggggacaactacctgcggagcccgggcggcaggcagctccgcgccgccctggacaggttccgggactggcaggtccgctgtcccgactggttcgaatgtgagaacctctactcagcagatgaccaggatgccccgtccctggacgaagaggtgtttgaggagccactgctgcctccgggaaccggcatcgtgaagcgggcgcccctggtgcgcgagcctggctcccaggcctgcctggccatagacccgctggtcggggaggaaggaggagcagcagtggcaaagctggaacctcacctgcagccccggggtcagccagcgccgcagcccctccacaccctggtgctcgccgcagaggagggggccctggtggccgcggtggagcctgggcccctggctgacggtgccgcagtccggctggcactggcgggggagggcgaggcctgcccgctgctgggcagcccgggcgctgggcgaaatagcgtcctcttcctccccgtggaccccgaggactcgccccttggcagcagcacccccatggcgtctcctgacctccttccagaggacgtgagggagcacctcgaaggcttgatgctctcgctcttcgagcagagtctgagctgccaggcccaggggggctgcagtagacccgccatggtcctcacagacccacacacgccctacgaggaggagcagcggcagtcagtgcagtctgaccagggctacatctccaggagctccccgcagccccccgagggactcacggaaatggaggaagaggaggaagaggagcaggacccagggaagccggccctgccactctctcccgaggacctggagagcctgaggagcctccagcggcagctgcttttccgccagctgcagaagaactcgggctgggacacgatggggtcagagtcagaggggcccagtgcatgagggcggctccccagggaccgcccagatcccagctttgagagaggagtgtgtgtgcacgtattcatctgtgtgtacatgtctgcatgtgtatatgttcgtgtgtgaaatgtaggctttaaaatgtaaatgtctggattttaatcccaggcatccctcctaacttttctttgtgcagcggtctggttatcgtctatccccaggggaatccacacagcccgctcccaggagctaatggtagagcgtccttgaggctccattattcgttcattcagcatttattgtgcacctactatgtggcgggcatttgggataccaagataaattgcatgcggcatggccccagccatgaaggaacttaaccgctagtgccgaggacacattaaacgaacaggatgggccgggcacggtggctcacgcctgtaatcccagcacattgggaggccgaggcaggtggatcactctgaggtcaggagtttgagccagcctggccaacatggtgaaaccccatctccactaaaaatagaaaaattagccgggcatggtgacacatgcctgtagtcctagctacttgggaggctgaggcaggagaattgcttgaatctgggaggcagaggttgcagtgagccgagattgtgccattgcactgcagcctggatgacagagcgagactctatctcaaaaaaaaa

SEQ ID NO: 102397 - DNA, 438 bp, Homo sapiens
agggagcagggcagtaaagctgaggacgcggccaagggccacaggctggaaggccgcgggcccctgagctgtttgctgtctagctgtctgtacctgctgctggggcatctcagggtctcggctataagtctctgaatgttgcttttccctggctgccaggtacctgcctggatgacagctggattcaccctcgaaacctgaccccctcctccccaaaggacctgcagatccagctgcactttgcccacacccaacaaggagacctgttccccgtggctcacatcgaatggacactgcagacagacggtgagtgggcatgccagcagggccctgggggattctccctgcctccaagtggctctcccagtcaggctcaggattgggctcccagtcctgtgctcagacatgggggttcaaatttagtgctataaggatccg

SEQ ID NO: 102398 - DNA, 710 bp, Homo sapiens
ggctggaagccggaagcgagcaaagtggagccgactcgaactccaccgcggaaaagaaagcctcagaacgttcgctcgctgcgtccccagccggggccgagccctccgcgacgccacccgggccatgggggccgcacgcagcccgccgtccgctgtcccggggcccctgctggggctgctcctgctgctcctgggcgtgctggccccgggtggcgcctccctgcgactcctggaccaccgggcgctggtctgctcccagccggggctaaactgcacggtcaagaatagtaagtcatctttttctgttcttcttcttgttgccttcttaatcaagtgagagcctgctgccaacttctgacagaagtcttgccatgccactccaggttcaggctgtgagctacagccatccgcaggagggttcccggagaattgtggatgcgtgcacctgcgcttcctgtcgagaacattcattatgcaaaagtcaggaaaggagaaacagaactgtcatttggattgtgaaagtattctctggggagctgccctactgtatctataatataatttgatttgccacagcttgtcactgtaaagtgagagacatctgtgctgttgattttgttttgttttaattcaaagaggcacatattcaagtgtctgagccaattagagacccctgacatataacaataaagcagctcttactacaactg

SEQ ID NO: 102399 - DNA, 641 bp, Homo sapiens
atccagcagagaaggaactggagggaccaagattgcttgctcacccacagcaagctcaggaggaatgcacttgcatcaggagggttccccgagagatgaggatcagacaggcaggctggcacccatgccaaggtgggtccagccctggagctcactctgaaggggccacctgcggacaggctcccagtggggaaaagattgttgttcttggtgtcaggagtctggaagaacagatttctgaaggcagaggcttaatgagtttccttttttctgggtcgacagactgtgagcacgccaggatgaaggtaaccacgccatgcatgagctcaggtaacagctggcccgggagagctttatttggatgcatacacatgcacatgtgcgtgcccctcctcactcccagcctgcgtgtgtgaccttggcaggcagcctgtgggaccccaacatcaccgtggagaccctggaggcccaccagctgcgtgtgagcttcaccctgtggaacgaatctacccattaccagatcctgctgaccagttttccgcacatggagaaccacagttgctttgagcacatgcaccacatacctgcggtaactctgctctttttgacccctctagcatagctcaggaccaccctccaag

SEQ ID NO: 102400 - DNA, 236 bp, Homo sapiens
ggcttcagaagctattggaagattcatatcaacttactaataatcaagcactttcatattaagacaatgtatgatgtttagtaaaattgatttttccataaaagaagtttaaaataaattagctatttcaagagaatcatggttgtcagcaaatagaaatgttgtgcttaactcaaatcacagtaatattctgtgttagtcaattgatttctttgagcctttattctttcatctgt

SEQ ID NO: 102401 - DNA, 564 bp, Homo sapiens
agtacatccatctgtaatgcgtctgtcaccccacaacaggaggggttagctgtgcgtggggagagggtgaagaagggcttttgcctggtgctagactgcctgggttcaaatcctgctcctacttagtgctgtgcaatttgggcaaaatacctaaacctctctgtgccttcatttccacctctctaaagcggggtctgtgacaatgcccactcctcattcataaggtggtggtgaggattaaatgagctgatgccctcacaaggtgtttgtccatcagtgatagggtttggctgtggcccctgtgtccccacccaaatctcatcttgaattgtaatcctcataatccccacgtgtcgagggagggatcccgtgggaggtgatcagatcatgggggtggttcccccatgctgtcctcatgataatgagtgagttctcacgagatctgatggttttataaggcagtttcccttcttattgcatgccctatgacgccctgtcgcattacttttacaagggctaccccatttttggccaaggctgtaaactttcctgattgtcctccac

SEQ ID NO: 102402 - DNA, 694 bp, Homo sapiens
agtacatccatctgtaatgcgtctgtcaccccacaacaggaggggttagctgtgcgtggggagagggtgaagaagggcttttgcctggtgctagactgcctgggttcaaatcctgctcctacttagtgctgtgcaatttgggcaaaatacctaaacctctctgtgccttcatttccacctctctaaagcggggtctgtgacaatgcccactcctcattcataaggtggtggtgaggattaaatgagctgatgccctcacaaggtgtttgtccatcagtgatagggtttggctgtggcccctgtgtccccacccaaatctcatcttgaattgtaatcctcataatccccacgtgtcgagggagggatcccgtgggaggtgatcagatcatgggggtggttcccccatgctgtcctcatgataatgagtgagttctcacgagatctgatggttttataaggcagtttccctgctcttacacgctctcttttgcctgccgccatataagacatggcttttccctttccaccatgattgtaagtttcctgaggcctccccagtcatacagaactgtgaatcaatttaacctctttcctttataaattgctcagtctgaggtagttctttatagcagtatgagaatgaactaacacagtaaattggtactgcggagagtagagtattgctataaagata

SEQ ID NO: 102403 - DNA, 161 bp, Homo sapiens
atggagaaactgactcctagagagaagaaggaacctgcgcaggaaactgaggaagatggtagctgagctgggacctgggcctcagccagagccttccccagatgtcttactggtgttctcttctgcctgcagccccctccccattcaaccaaccattgcct

SEQ ID NO: 102404 - DNA, 2622 bp, Homo sapiens
gggagcgcacagcctggacgcgtgcgcaggcgtcaggcgcatagacctgctagcccctcagctagcggccccgcccgcgcttagcatcactaactgggctatataacctgagcgcccgcgcggccacgacacgaggaattcgcccacgcaggaggcacggcgtccggaggccccagggttatgagactatcactgctcaggacctactaacaacaaaggaaatcgaaacatgaccaaatcgtacagcgagagtgggctgatgggcgagcctcagccccaaggtcctccaagctggacagacgagtgtctcagttctcaggacgaggagcacgaggcagacaagaaggaggacgacctcgaagccatgaacgcagaggaggactcactgaggaacgggggagaggaggaggacgaagatgaggacctggaagaggaggaagaagaggaagaggaggatgacgatcaaaagcccaagagacgcggccccaaaaagaagaagatgactaaggctcgcctggagcgttttaaattgagacgcatgaaggctaacgcccgggagcggaaccgcatgcacggactgaacgcggcgctagacaacctgcgcaaggtggtgccttgctattctaagacgcagaagctgtccaaaatcgagactctgcgcttggccaagaactacatctgggctctgtcggagatcctgcgctcaggcaaaagcccagacctggtctccttcgttcagacgctttgcaagggcttatcccaacccaccaccaacctggttgcgggctgcctgcaactcaatcctcggacttttctgcctgagcagaaccaggacatgcccccccacctgccgacggccagcgcttccttccctgtacacccctactcctaccagtcgcctgggctgcccagtccgccttacggtaccatggacagctcccatgtcttccacgttaagcctccgccgcacgcctacagcgcagcgctggagcccttctttgaaagccctctgactgattgcaccagcccttcctttgatggacccctcagcccgccgctcagcatcaatggcaacttctctttcaaacacgaaccgtccgccgagtttgagaaaaattatgcctttaccatgcactatcctgcagcgacactggcaggggcccaaagccacggatcaatcttctcaggcaccgctgcccctcgctgcgagatccccatagacaatattatgtccttcgatagccattcacatcatgagcgagtcatgagtgcccagctcaatgccatatttcatgattagaggcacgccagtttcaccatttccgggaaacgaacccactgtgcttacagtgactgtcgtgtttacaaaaggcagccctttgggtactactgctgcaaagtgcaaatactccaagcttcaagtgatatatgtatttattgtcattactgcctttggaagaaacaggggatcaaagttcctgttcaccttatgtattattttctatagctcttctatttaaaaaataaaaaaatacagtaaagtttaaaaaatacaccacgaatttggtgtggctgtattcagatcgtattaattatctgatcgggataacaaaatcacaagcaataattaggatctatgcaatttttaaactagtaatgggccaattaaaatatatataaatatatatttttcaaccagcattttactacttgttacctttcccatgctgaattattttgttgtgattttgtacagaatttttaatgactttttataatgtggatttcctattttaaaaccatgcagcttcatcaatttttatacatatcagaaaagtagaattatatctaatttatacaaaataatttaactaatttaaaccagcagaaaagtgcttagaaagttattgtgttgccttagcacttctttcctctccaattgtaaaaaaaaaaaaaaaaaaaaaaaaaaaaaaaaaattgcacaatttgagcaattcatttcactttaaagtctttccgtctccctaaaataaaaaccagaatcataattttcaagaggagaaaaaattaagagatacattccctatcacaacatatcaattcaacacattacttgcacaagcttgtatatacatattataaatagatgccaacatacccttctttaaatcacaagctgcttgactatcacatacaatttgcactgttactttttagtcttttactcctttgcattccatgattttacagagaatctgaagctattgatgtttccagaaaatataaatgcatgattttatacatagtcacccccatggtgggttgtcatatattcatgtaataaatctgagcctaaatctaatcaggttgttaatgttgggagttatatctatagtagtcaattagtacagtagcttaaataaattccccccatttaattcataattagaacaatagctattgcatgtaaaatgcagtccagaataagtgctgtttgagatgtgatgctggtaccactggaatcgatctgtactgtaattttgtttgtaatcctgtatattatggtgtaatgcacaatttagaaaacattcatccagttgcaataaaatagtattgaaagtg

SEQ ID NO: 102405 - DNA, 533 bp, Homo sapiens
gcaatggttttcaaactgcttcgtatggacccttaagattctttggggttttaaaatgcttgagttgcattaaatttttaagtatgttttaacttattttaaaactgtaatttaaaaatatgggtacccccaaatatgtacacataattttaataactggagtctaacaccattatctttcattacaaaattattcttgtgccaggtcttgaattacaatttgttctgctatctttgtacagatatttgaatttttttttgttactgtgtcatgtatgagaaagattgtcattgattgtgaaggaactggctttttaaaaagaattccttccatatttacttaagttaaatgtttacttgtgagaacacaaatttattgttatcagtagttgtaactttattactaaaatacttgaaagttgcttggtatatttatatgctttatagttcaggttcaatagaagatttaatttgtaaaaagtgttctgctgcttcccccaactccccaccctaaataaatagaaaacataact

SEQ ID NO: 102406 - DNA, 354 bp, Homo sapiens
cttcaattcactccatttctccccagttcttcttttttctgtcttctataattctagataaaattatgacatgacttaaaatatcctccttttttgtccgtgattgctttcaatggttctaatgaccccattggaagtctggtgattaggccctgaggggccacagtaatggaaaccttgtgttcagccttcataagggtgatccaaaaatgttattacattacttacacctctttctgtaagtattttttcttcattcacttcgaagtatgggatgcttcccatgtgcaggagaattagctcattcataactcaaaggcaagtaatttcatgttttgctatttataagagagg

SEQ ID NO: 102407 - DNA, 284 bp, Homo sapiens
aaaaaataaagtgaatttattggttcatgtaactggaaagtctcatgaaaatgtcagcttcaggagaagcttgacccagcagcttcatgatgtatggaaatacctgggttttttgtttctgctctgctactgtggtatcagctttattccaagtctggcttcctttgttgttgcaaaatgcttgtcagaagaagcctgggtccatctgttaggattaagtttactctgtatgctgtagtagtggctatgacaagatagaagtgtatttctcctccatataaaag

SEQ ID NO: 102408 - DNA, 427 bp, Homo sapiens
ttttatgtcattaaaaaaactccttttaatcatgtgtaggtatctacatacattccagtatatggatatactgtactgtaatttaacactttttaattatttattatacattataatgttttgataataaaagaatcatgtgatgaacttttctatatataaatatatctctctgggccgggcgcggtggctcacgcctgtaatcccagcactttgggaggatcacgaggtctggccaacatggtgaaaccccatctctacaaaaatacaaaaattagccgggcgtggtggcacgctcctgtagccccagctactctcaggaggctgaggcaagagaattgcttgaacccaagaggcagaggttgcagtgggccgagatcgcaccactacactacagcctgctgggcaacagagtgagactacgtct

SEQ ID NO: 102409 - DNA, 828 bp, Homo sapiens
cgagagaatgagagagacaagaggaccaaactcatccttttataaggaaaccattcccatttcttttttcagtagcccgaaactgagccccaggcactgtcttatataaaatattttagtctcttataagcttagcattaaccatcactatgtttggcctcatcaatagatgtctggaatctagaatgagagatgggatttttcagtcctatgcttagagagtaaatcagagatagaatacattgttgtgtactggggaatcatattttcccagaaagacatacaaatggaacaaacagaatagtggaattcaattgaaaccatgtaatacaaaaaatagttgtggttcttctgggtaaaaataatgctaaatttgttatttataaccccaagggttaaagaaagtactaatgaaaaaattttagggcaatggattaaatcttaacataaggaagaactttctggtagtaaagaccgttcaaatattatttagagatatattcaggcactaaaaaccattaagaataacaagagaatgccacgaagtcagaatagtggttatttctaagaggaaaggtacttgggtgcgggtttctgggatgcaggcaaagttctatttctagatgccaattatatagtttctcactttataaattccttaaacttacattatgtgtatgtcttatgcacagtttcatatgtacgacacagctcacaaagtttaaaaaacaaaacagccaggcacagtggcttgcgcctgtaatcccagccctttaggagactgaggcaggtggatcacttgagcccaggagtttaaaaccagcctgt

SEQ ID NO: 102410 - DNA, 381 bp, Homo sapiens
gcaaagaaagacctagaagtgagaaagcaggacattggaaagacagaaaaaaaaccccagatgttgctggatcctaagtgtgctaggggtgtttgcacagaatgaactagaaacactggcagagagtagaagtttgggttcattaaatctgttaaccaaaaatctactaattggctgggtgtagggctcatgcctactatcccaccactgtgagaggccaaggtgggaggaccacttgaggaaaggagggcaagaccagtctggccaacagagtgagactttgtctctacaaacagtgttttagaaatcagccagtaatttgaggctacagtgagctgtgaacacaccactgcactccagcctgggcaacaaagtgagacc

SEQ ID NO: 102411 - DNA, 360 bp, Homo sapiens
acatcacaacgctcatagtgctgcagaagctctcgataagcgttttcctctaattcccaggaagcatctctttttttgttcttgagacgcagtcttgctctgtcgcccaggctggagtgcaatggcacaatcacggctcactgcagcctcgacctttcaagctcaggtaattctccgacctcagcctcccaagtagctgttctgcaggcacataccaccacaactggcttattttttatatagacagtgtttcgccatgttgcccaggctgtactatagcatttattaacacataatgtagtatactgtctagtgatctatttccccttatagacaatgagtgccatgacaacagaaagt

SEQ ID NO: 102412 - DNA, 137 bp, Homo sapiens
cccgcggagttccccctcacccctcagccgccccgccggctgaagcatcggcgctgggaggcggcggcgctgctgagaggcagggacccgagcgcgaagtgtgtgggagtctacgaactcaacccctctctaccctc

SEQ ID NO: 102413 - DNA, 370 bp, Homo sapiens
ccctcacctcggctcccaacacactgagattacaggcttgggcatcactgtgcctggcctcagctttatttgttctaaaggaaattatgaatagtaatggttattacataagtaatctctatgatgtgggaaaccattaagcaccttttacatactctaaataagaattatgctttgggtttttatcatatttctaaaatattttctagcatgaaacatctaacttaacattacacacaaacacatattcctatttatccttccagacataatatagtcactgtcattacaaagccttctttgtgctaacttctttgttctctcttctctgctcccatgttacattttaccataatcattttcttgtatc

SEQ ID NO: 102414 - DNA, 149 bp, Homo sapiens
gttagtctacagcttgtgtctgagatgtgctaattgaatatttgctcagtacctcatcttaactgcctttggctttatgttgcttatccttcatagtatcttgttcattggccttttacatccataggcatcacttctctgatattcgt

SEQ ID NO: 102415 - DNA, 532 bp, Homo sapiens
gatgattgtgacatattgccccaaaaggcaggtgatgtgagtcttctggtcaatccctattcactggtgggattgtgatacatatcttatccaaacttataggggcaatatgactctcatacctctaaacaaccaatagcagatacactagttctcatagccagggtcaggaaaatgagtaatgtcttgggtttcttctttgtatgaaggtcataaagaattaacactctgtcacatactgtgtaaagtcgtcaagaggtacagggaatgtcctaacagaactcagcacacaggggaggttgcgacactcatatgcatagcctgccaacagtaaagactgtcatccttccacataaacacagctcactgttgaggttctgaatctcatacccagatgaagttgaaagttagaaaattaaatctcatgttaattcgatccatagagaggttagtgtctctgagaccaagattcagcacacctgtgagtcagtgacttcatttcattgagactgtcactcaggtacttacaccc

SEQ ID NO: 102416 - DNA, 693 bp, Homo sapiens
cccacgcgtacgcccacgcgtccggcctcagagcctaccaccactcctggaacatggcaggtactcagtaaatggtaggaaggtgtgaggagctgccagccacaacataactatccaaagcccaaatccagacaattttaagggttactgcacccacttctttagctaagtatacaaatgctgaacataatctcatcttctttatgactagttcagtattgccattttagatataaattctcttctgccacaatgatgtccttcaaaattcctaaggtgggtaggagtagtttgctttttcactgcattcccctaggaatgctctttctgattgttgcaattggtgttaacttttatcaacttcagaaatgtactttggccattaatatataatgtatattgacctactctattccaggaaatgtataagatttctacataagttatttgctccaaaagtcatggaatcatagaatttcggagctggaatgggtcttcgagataatctaatcaaaccactttatttacaagtaaaaaaacctgaggttaggggagagactggcccaaggtcacactgctgattagtgacaggagtagcattgggatctggctttcctgacttcctgttcactgctcttaataccatgctgtttagatctcactcctcagcagtatccataatagtgataatat

SEQ ID NO: 102417 - DNA, 246 bp, Homo sapiens
tagagatggggtcttgctgtgttgcccaggccggttcatattgctttaatgctctacaacaaacgttacaaggtttaagagtggacaatcctcacaaggctggcttaaagtccaaaccaaaactccttgtccctgaagaggaaatttctagaagcttcacagactacagaggcaagcaaatgtcctatagaacatacagttttagtaacattaactataaaactgtaacagaagtgctactcaaaa

SEQ ID NO: 102418 - DNA, 157 bp, Homo sapiens
ctgaatcctttgtcatcatttccacagtgttcacagcatcttcaccaggagtagattccatttcaagaaaccccttccttccttccttccttccttccttccttccttccttccttccttcctaccctccctccctccctccctccctctctccctc

SEQ ID NO: 102419 - DNA, 629 bp, Homo sapiens
gcaaccactaatcacttcttattacattgccctatcttctcgaagcacttatcagtatctgaaattatctttcttcacatttgttttcacatttattttctatctgtaacctgcccccaatagaaattagaatataagctacttagagctgtatatgacatgcatttttgtttaacactgtatctccaacaccaagacaatacatactcactgactaactgctcaactctttgcatacttaagttgaatccttccaagatgcaaataaaaatcaacctcttctgtataaccttcccaattccagtgatttctccctcatctgatcatctgtagtatttactttcctaaaggccatatcttctgaagttagtaacaacgatttcaacttcctttggtttagaaggtgtctggtatatattctatatacccttactttcaacctttttaggtatctcttgtgcttagcatggaatataatttttaaaaatctaaagtgatagtctcttctaaccagtgagtttagtgcatttatattcgttattcaattacttattcctatatttggacttgtttctgcaatcttattttttgttttcattcaactcactttttaatgcttctttttccca

SEQ ID NO: 102420 - DNA, 1190 bp, Homo sapiens
gtccggcgggcgcgaggcggcggcggaggcccgagcccggcccagcctcgtcccgcccggagcccgcctggctgctaccccgaccccggctccggtcccgtcctgtcccggcgcgccgcggcctcgccccggcccccgctcggcgcctcccgagggagcggcgctgccggccgagagcgcaggcccggccatgaccgacttcaaattgggtatcgtgcggctcggccgggtggccgggaagaccaaatacacgctgatcgatgagcaggacatcccgctggtggagagctactcctttgaggcccgaatggaagtggatgcagatggaaatggtgctaagatatttgcctatgcctttgacaagaaccgaggaaggggctctgggagactccttcatgagctgctgtgggagcggcaccgggggggcgtggccccgggcttccaggtggtgcacctcaacgctgtgaccgtggacaatcgcctggacaacctgcaactggtgccgtggggctggcggcccaaggctgaagagacctccagcaagcagagggagcaaagcttgtattggcttgcaattcagcagctgcctacagaccctatagaagaacagtttcctgtcctaaatgtgacccggtattataatgccaacggggatgtagtggaagaggaggagaactcttgcacctactatgagtgccactaccctccctgcacagtgattgagaagcagctccgggagttcaacatctgtgggcgctgccaggtggcccggtactgcggctcccagtgccagcagaaggactggcctgcccacaagaagcactgtcgggagaggaagcgtcccttccagcatgagcttgagccagagcgatgacgggcaggggagccacacatactcacagcccccgggctctaccctgggcacagcagagacagactggtggttgaacctggaggtgccaaaaaagccagctgcgggcccaggacagctgccgtgagactcccgatgtcacaggcagtctgtgtggttacagcgcccctcagtgttcatctccagcagagacaacggaggaggctcccaccaggacggttctcattatttatatgttaatatgtttgtaaactcatgtacagttttttttgggggggaggcaatgggaagggtagaaattacaaatagaatcatttgc

SEQ ID NO: 102421 - DNA, 544 bp, Homo sapiens
attgttactgcgtgcaccaaaggaagcctccttcctcttcagtggagggtgatagcacgttccccaccctggaagagagttgctgctttgccatgccttgattctggttgagagtcccaaaggatgacagaatcacttcccttgggcctcactgccaaatataacccacttaatatcctccaagtttgaggccataagtctgtggcgcatccagatgcgacccccgaggcgatagcatcaacgtgggagccaatgcaactcaaaagaaggatggggcttcgcacctcctccttgggtaggaagtaggttagctgcttggaaaatgcaggaactggcactgaagagatctgagtctgaacatatccctcacccgtcagtagcactgggaccttgtgcaatgttagttttcccttccctgcttcaacttagatggctcgggccctgagaaagtgattcacagctgaaaaataaatcaaaggcctcgtgttctaaaaagagtttatggaaggagaggcagctgatgaaagtctagaaagaaggctga

SEQ ID NO: 102422 - DNA, 494 bp, Homo sapiens
tggcgcgatctcagctcactgcaagctccatctccgggttcacgccattctcctgcctcagcctccccagtagctgggactacaggcgcccaccaccacacccggctaattttttttttaagaggcggggtcttgctttgtcacccagggagtgcagtggcgggatcacagctcactgccgccttgaattcctgggctcaatggttcctcctgcctcagcctcctgagtagctggggctataggtgtgcaccactgcacccggctaatctttttattttttggagatggagtctagccatcttgcccaggttggtcttgaactctcaggcctgaattctaccccatgctggctgtatgagcctggactactctattgtcctctctgggcattacctcagggttgggcgaaccagggaggtgacggtgtgaagggaccaggtttcagtcctgggcctttgcagctattcattcacacctattgtgtgacttcagg

SEQ ID NO: 102423 - DNA, 373 bp, Homo sapiens
  misc_feature (7)..(7): n is a, c, g, or t
ctgctcncgtgtgggtggtgggtctgtgcctgtgtgggtgctgcctgtgtggatgatgggtctgtgcctgtgtgaggtgctgcactgtgtagggtgcagtgggtatgtgccatgtgtgggatgcatgcactgtgtgaggtgcagttggagtcctgggattaggttaagagctcagggaacatgcctctgggagaggagctgactgaggctgggataccttaataagaggtcaggccggggacgatgagcaggattttgaagacaggcagaatctctgattagacttacaggatgagacatgagagagggacgtcgcccgaaaagaggccctgagacaggatgattaggggtctccactgcctccctttaaaga

SEQ ID NO: 102424 - DNA, 683 bp, Homo sapiens
ggcatggtggctaatgcctgtaatcccagctacttgggaggctgaagcaggagaatcacttgaataatggaggtggaggttgcagtgagctgagatcacaccattgaactccagcctgggtgacaagagtgaaacttcatctcaaaaagaaagataagctcattagcaattttgatccggagctgagtaaacctgagtcaggggataaacatgtccccagcaagtgggaattaattattatactcaggaggtggctgagtttgtgagctttgaatgatcccagagagaaattcattcttctgaatctccaagggcattccacaatgtgctggaactgtgctaagagaaggaaccgtgaccttggagctctcctgcagattcagcattattgcctgccaattactagcctgaaatgttgaacaagactgataggttgtcaggaaagcacacatctacattagcgtcacttagcgacagactgaaaaaatgaattggcaatcaatcatttaatcctatagaattctatattgctgtagaaataatggccttcctccatagacctcaagtattttataacatatattttcattcatttctcaaggttccaattaggaagattgtgtgaaagtcatgctaaaatattaacagtaagagagacttaatttttttaattcatcatgaat

SEQ ID NO: 102425 - DNA, 639 bp, Homo sapiens
tacaaagtgacttaatatcaatatttttattcaagatctaggaatttatttatgtctacacatggatgtcctttacttaggaactctaaaaaagcattaatattatataattgctaaatgatttttcctactgctattggcccaacatatgcattataaattccaacaacagacaattattgtatcatgttataacttaaaaactcttcacgttttcagtttttatgtttgcatggtcttgtcttctttttctggatatttgttttccatgggggtatatatatgggtgaatcatttctttgccctcttccatttgatcatagaacttaaggacatcattctgaagtcagacatagatggatatgaataacatatattagctgtgtgatactagaaaattatttacccttcttgagcactgaaacttctcattataatggctataattggtatctatttacaaggttgctatgaagattaagtaaggcactttagcatattttggcataaaaatgtgttattaagatgaaacattagttttgtatgttttttcagatgcattatcatatgctgttaagcttattgctttgaatgtactatccttctgagaaaaggtaggaaagacaggaaagggggtta

SEQ ID NO: 102426 - DNA, 421 bp, Homo sapiens
agagactggcgggtctggaaagaagctctgagcccatccgcgtttctctgttggaccctgtcaggtctcttgttccgtgtccaatgtcagtcgggtagggaggcagtggggcagtcttggttctcatcccaccccggagtctctgcgcagccacaattcaggaaaacaatctggaggcgggttcaaaacactaagattgattgaacgcgctgatggtttggttttctcctatagcgctttggtagtggcttttatccagaccgccccccccccacccccccggaatgaaccctggtatagaaatgttacccgtatgtgtgcatatgattgtttttaatatatttcaatttgatgaatcagcctttttcaaggtcagattccagaccgacccttctggcgcccaccccccgctttttttttt

SEQ ID NO: 102427 - DNA, 424 bp, Homo sapiens
gattttggtggagtggtgagtatagaagctagactggagagaaccgataggtgaagtgcaggagacaaagtgaataacactagtttagataacgcaataaattttactgtgaatcatagaaagagagatgtgggataggagaaatagtatttaggagacgtataacagaatgaaaggaggtttgcgtttttattaatttaaaaactttgaatttttcaagaatttttacatttttaaatctttagatgggctatattctattttgctgatttgggagactaatgatgtaggaaatagagggaaatggtttgtaccaaacaagtagtgatgcagaaaagtgagagatgtcatggagctgaagttgctagaactgaatcttaatggaagactcataggcaggaccagcctttcaggctaaggaagt

SEQ ID NO: 102428 - DNA, 774 bp, Homo sapiens
gcacagcagaaattattctttcacagctcaggaggccagaggttttgaagtgaaggtgtgccggcaggcgtgcctccctcagaaggcgccaggcaaggacgtgccaggcctctcccccagctcctggggctgctggcacccatggctggtggacacctcactccagtctctgcctccatcatcatgtgactgtcttctccgtctccatttcccaaatctcttacagtgacactagtcgctgcattgagggcccaccctaaatctggaatgatctcatctcgtgatccttaactaaattacatctgcaaaaaccctgtttccaaataagatcacattcacaggtaagggatggagacttggatgtccctctcagagggacaaaattccaccttctctgcctttgtctgaggttcctgccggcccccctggctcctcggctggactcccaaaacggcccacacctggccagcagaagcccaggcacttgctcctgaggactggactttgagacgtgccagccaccctctcccggcccctctcccatctgctaccagggcctcgttcctaggcttggaagcaacaaaactgccaaagcagtttacccaaagccaccatcgagtggaagccactatcggagaggaacccaggaaagagtgtttgctcccgaggctgcagccgtggtgcccgtcggcgcgcctgcattctgcagcgggaaccgagggaaggccgtaagtcagggcctgctgctgccgggtgctgcccctccacgggctc

SEQ ID NO: 102429 - DNA, 249 bp, Homo sapiens
ttttctgtaaaacgttcagcagtaaagggatttatgggccacatatagttctgtatttttcttctttttatttatttattcggattattgttgttttgtttattaaaatgacatcctttattttttatttttatttgataaataacaaattatgtgcttattatgtacaacattatgttttgatatgtgtgtgcattatggagtgatgaaaccaaagtgaataacatacccttcaccttactagttatc

SEQ ID NO: 102430 - DNA, 932 bp, Homo sapiens
gccatttattagatgatcacttgttttagctttgaaagtgacagcaaaggcagcttacttgtggttacctagaagacacagggttggctgggcgcggtggctcacgcctgtaatcctagcactttggtgggccaaggcgggcagatcacctgagattggaagtgcgagaccagcctgaccaacatggagaaaccctgtctgtactaaaaacacaaaattagccaggtatggtggtgcatgcctgtaatcccagctactcgggaggctgaggcgagagaatcacttgaacccggaagctggaggttgcggtgagccaagatcgcgccattgcattccagcctgggcaacaagagtgaaactttgtctcaaaaaaacaaaaacaacaacaacaacaacaaaaaggcacagggttgttgattcatggttatccagaaatccagattttttctaaactttggaatgtattaatatataaacactttctcctgcagaatgaggacgtgggctttgagtgaaatgatctggctcttttagctctaacaactattgaaagaaaaccgtttatctatcagggcaagtgttacccctaatgcaagatttcaaatgataaatgaagctgaagactgaaggcctatctaaaaatattttattgaacccagaaataggattaggagtagaaatggaaagctggaagggaaaagaagagcattggggcttctttcaccagaaatgcccgaaaagggacaattgcttaaattttcagcttgtttgactagaaacagatgtgttattaaaagtgatttgagcctgggcacagtggctcatgcctgtagtcccagcactttgggaggtcaaggcggggaggattgcttaaggccaggagttcaagaccatcctggcctgatatagcaagactcatctctgtttaatta

SEQ ID NO: 102431 - DNA, 541 bp, Homo sapiens
aggcaaggacctggagaggaagctccagtggggctcccacccaaggggtccaactttaccaatcccacaggtccccagtctggggctcattctatgtctgtaggcctgggaccctgcacccaggagagttgtcctgctaccggccatccctccgcagaggtccccctctggctctatgctgtcttcagcaaagggcctctgctccatttcacacctctcctgagggcctggggtagcttactgcgaagcagcctcagggaatagaggcttcagcagggcatcttggcccccaacacagaatcctggttgtaggatctggaagaacagaggagaaatggaagttggcagttcccaggaggggagaaggtgctggtgagccacgaaagcaaaccccagtggctgaagcatcctggatgactcggccacatttccttaagaatctttgtgtgtgtgtgtgtgtgagacggagtcccattctgtcacccagattgcgccactgcactccagcctgggcaacagagtgagactccgtcacaaaaaa

SEQ ID NO: 102432 - DNA, 323 bp, Homo sapiens
attgggcgagagggtcgagttgcatttagcgcggcgggggaagttttgcatcagcctcctgggctgtgcctggaacaaggagcccagggcaaccaggtacatagtcacagcccttcatctctgaccgtgttcttattgcatttggcaaaaaagtagaagccgcctaatacaggggttttctgttcaagaggccccaaggctgtcctccgtgggctctccctccggcaggtggattggaacgagatggggattctgggacacagctcaatccacatggccttccccacggccagggatcctcatttgaaactgctctttgggct

SEQ ID NO: 102433 - DNA, 392 bp, Homo sapiens
tccttcgtcggggtggaatgcctctgggatcctgtgggccagctctttagactccctcaggccttcatgatacctgtggccaaaagccctaaagcagggcctacatttaagactaacatgaggactaaaggacaaaataacaggaatgaagatgtggtctgggtcaaataaccaagaagtctatggatgtttgattttggacacctaaacaaatgagaggggaagacgacagactccaccaatcctcggaagggtcatagggtcattctatatcacccccagaaccatttctttctggcaactcccccactcacacataccactcacatagctccagtgggtggtactatggccttacctgaccacatccctgctggcctcaacaacctaac

SEQ ID NO: 102434 - DNA, 243 bp, Homo sapiens
cccctgctttgagctaagacctctgtccagcgcccggacccaggtgagccccacagtccctgtcccgaaagagctgagagcctgctggggaaacagtcctagaaacacctcgctagcacccagtgtggacccagaggaaggggctcctaggagaagtggcccagggcccaactcggaaggaagcagccttcagaatcagccgctggagctgcgggactcgcccacggccctcaggactccctg

SEQ ID NO: 102435 - DNA, 260 bp, Homo sapiens
aactcctgacctcaagcaatgctcccaaagtgctgagattacaggatgggccaccacgcctggtctgaagacattcttaaggcttcaatttcatttcaaactcaaacagtgaatagtgtataccgtatctctttgaggtgctaggatgatacatttacagtagataatattaaaataggaacttagaaaataattaacaagctataagaagggcagatgatgaagaggatttctcagcctcagcactgttgacattttgg

SEQ ID NO: 102436 - DNA, 280 bp, Homo sapiens
atccacccaccttggcctccccgagtgctgggattacaggagtgagccaccatgcccagctttttaattttttttttttgaaacctattacagtaactccctgagatgaagatgagacgtttagcttcctcacactccctcctcctcctccttccccatgcacctcccatgctttgttcaatgttactctccttttacttgcttaaggtactctttcttatgccattgactttagacggaattccttggctttactgagtaagatggggaaattagaaat

SEQ ID NO: 102437 - DNA, 172 bp, Homo sapiens
agaaacggctacccgacaaaccatgacaattctagtcaacgatttattttagcccatcattaagaatttaatgttatcatataaataaatgcaggagctcctatcactttataagtaccaccaatatgtacaaattctggtaggaaggtagtttattctttctctttttttt

SEQ ID NO: 102438 - DNA, 345 bp, Homo sapiens
tgagacaggatctcgctctgtcacccagcctggagtatagtggcacaatcatagcgtactgcattctcaaactcctgggctcaggtgatcatcccacctcgacctcctaagtagcaaggactacaggcacatgccaccatgtccagggttttttttttcttttcttgtaacaggctctatgttacccaggctggtcttgaactcctggcctcatgcaatcctcccacctcagcctcccaaagtgctggtattaccagcgtgagccactgtgcccagcccatcctaccttttagtggaatgtttgtcgacacttggtatactgcatttttatgtgttaatacaagc

SEQ ID NO: 102439 - DNA, 371 bp, Homo sapiens
catgtggtgattccaggatgaatgaagttgtagccctttctcttaggaaacttataaactaataggagataaaaggcattctcagggaagtctacaaagtgctatgagggagccactttggccatcctggggcagagcagaccagaggctcagagcatggacacttcctcatccacccagcagaagcctttcacttgattttgaaggtgggcaggattgagaaaggcccagaaggggatgagttcaaagctgtttgtgggcatgtgacccctgcagtcacatatggccctagcttgtgtttcgtttagtgttctgctatcattatcctgataatatcctgataataaaattatccttaataattttatatt

SEQ ID NO: 102440 - DNA, 221 bp, Homo sapiens
gttaaatgtcagctaattctgcctatgtatagtgaatagaattcatgattagaatttaaattatcagttcctgttcctacctgctctgataattggcctcataaagataattgatagcttatgcctaaactcatgcctggtcaagccttctccttctatgtacgaaaccacttttaagggacaaggaattgttaattaaataacatcataagtaagtgaaa

SEQ ID NO: 102441 - DNA, 429 bp, Homo sapiens
ccccctctagcgttcctcacctaattgggaggggagaaactatacaagaagaaacacttcccttttgattctcggtgatcacaggtcaaagatgcaagtcaggtaaaaggctgagacttaattggaaggttgtagaatgcttcaccgcctccacagtttctcatcataccaacggggctccagtataacaagaggatattacagctgaaagaactgaaagacatggatcttctctaagaagaagtactttgggaatttgaagcctctggtacctatagctacagcaaacataaaacaaagcccaactcctagcccgattaacataaacctcacaccataggcatatttaccttagttcctattacgcagtacatgtctaactttcaattaaaagatataagccatgccagaaggcaaagaaaaaaaaaa

SEQ ID NO: 102442 - DNA, 647 bp, Homo sapiens
tttatagggtttataatttttttgttttttaatttatagatttatttgattaaaaaagagtttcatgtaccagagatgggttattgaaaataggcattgtttaaaatatgataaatattttatttgaaaacttggatttttatgatttacaaaaatctggagaaaaaacagggcaaaaataacagaaaatgaacatatatttaaattccccaaatattcaaatatatcattatattatgatgaagacttacatattactattttgtaatatgacaaagatctattcttacatttattatgataaaatgttgctataatatgagttcattatatgaagctctgacatgttcctctcattcttcatctaatatctaataatgactacctgcaaggagaaataatcactcaagttgtttacttttgcagaaggtgcagtctctttcagagaattctaaaaaaaaatcacattctatttaaactagaaactttctattaaaataagtgaaatgtagttaacaaaggatatttatttttatgtattttgttagttactattttccttattttgaaaaacttcagatcactggaatatctacattacaaagtggccagattgtatggtgtctgtaatctcattaccttgtggt

SEQ ID NO: 102443 - DNA, 438 bp, Homo sapiens
ggaccagctttgtccctttcccttctcatgcctagtcaggaaccctggagctggagagcacttagggagcactaaaacctcatctccacttctatataagatgctacctaaatatccaggagagatgttcatttactcttaattaattcattcattcaacaaatgtattcagtattgagtagactgtggcagtcagtacataaactctatagttagcctgcttggggttgaaatccagctctgtctcttactagctgaaggatcatcaagttacttctctctaaaaaagggagaataattcccttacagggttgttgtgaggtgtaaataagaaaaatctgtgcaaagcacttagaacaatacctggcacatgtatcaataaacgttaactgcacttactattgatatttgcagacattggtaggggagggtacaatt

SEQ ID NO: 102444 - DNA, 316 bp, Homo sapiens
agttcccaggctggagtgcagtggggtgatctcagctccctatatacctttataatctgcatgtgtatccctggaatctaaaataaaagctgaaagacaaaaacaaacaaacaaaaaacaaagaaagcgtcttgcccaagggctccgtgtggcaagtggtggtcaggctggatggtgggtgcaggtctgcactgctctatctgccccccaaaagcagaaggacagggccctcagtgatctgaggactgatgagggtgggctcaggaggaagaggccaccgagggtgtcctcgtgctggcaattctgcaagatgtgt

SEQ ID NO: 102445 - DNA, 488 bp, Homo sapiens
aaaatgttgcatagaacgaggaaggagtctccatttgagcagggagagtgcatgaataggatgtatcagcttttttggctgttgttttttttttcctccaaatattcttcagttattcctatgtaccagtagaagggatttctctgaactaaagtctaagtaggaggtatctttctacttgattggttttaaggatatgttgttttatatgtttatctaacatatgttgtcttttctgccagttctgaatcttctatctcctctccttattctagtgctccccccacccccgccaccacctacgctgtttttgttcaaaagccagagaaggaagtgagcatgcaaatcaggaaacagattgtctttttgcctatgcagatttgtctgtgattttgtttatttattaatattcacttagcatgtttagagtaaaatcttccttttctagtctatcagcatagggtttctccaattgttccctttcctca

SEQ ID NO: 102446 - DNA, 233 bp, Homo sapiens
cactgcagaatctagggtcatggagcccacatgtgcttagccaggctctcagaccttttgctctttcctggtcaggatgaggtaggaaagtctccaacatatttgctctgatttgctctcctgcacgtcccaatatgaagtttgtaggctcctgaagcaaagtcagtgttctcagatacaacccagagtgaatgcctctagaatcagcctctgctaagcgatttcccaaatgc

SEQ ID NO: 102447 - DNA, 164 bp, Homo sapiens
tgagatcacaccactgcactccagcctgggcgacaggacgagactccatctcaaaaaaaccaaaaaggactctcaaaaaatttactcctaataattgagtaattccagcatgtggatagctgtgagataccaagacatctctgtgggtaaacgtgagagaggga

SEQ ID NO: 102448 - DNA, 469 bp, Homo sapiens
cttccccaggccacatgtgacccccagaaccacccccggagggccagggctgctgcgcacctgcctgtccatgtccctgaggacagagccagccggccccatcccactgctgagctgagagctgctcccttgccctggccgaggagcacagcagatgggaacagctctcccaggctccacattctgccctgccggggaatgcctgcctggggttggtggccctctgcacgttggccctgggaggaggtcgcaagccctgcacggcttccttcctgctgagaggacgtttcctccacaccgacattccgcaggagcaggccgacgtgattgcacttcacgtgtttgtcattttaaacagaatccgtagatgttcattgtcctgtctctcaaaagacaagaatattcatttaatgtattaagttttatttttattcatctgtaattaaaaaaacacctaattagtcctcta

SEQ ID NO: 102449 - DNA, 243 bp, Homo sapiens
gaactaatgggtgtgtgttacaaaaagtactatgactttcctaaaataaagagtaaaaatattcctacccacaaacgttaagtcacaaaagcaaataaatcaaaagtataaaaatttaggaggtaatgggactgtggtagtggtcatataactgcacattgtagaagacatgaagacttttaaaaatgttcttcaagccagccattgaataaattcatagagaaacttaaaattggggggatg

SEQ ID NO: 102450 - DNA, 322 bp, Homo sapiens
aataaaataatttaaaaaaaacaagagaatgttactttttaatttgaaaacaataagaaaatgtccaagtctgcaaaatagagtctttttgaaagactcttcgtacttattaatttattcaccagacatctttaaacggaaacagtggttaagtgtgagagtttggaagtcccacagatcagaaccccagctgccgtttactcactgcagtccctgggcaagtaattcagtcatctgagtttccttgtccctacccgtgtaatgggggatctctggtacccatctcatggagctgctaaagtgattaaatgagacaaaagta

SEQ ID NO: 102451 - DNA, 399 bp, Homo sapiens
aaacaacagaaatttatttctcatagttctggagtctaggaagttcaagatcagggtgccagtgtggtcaggttctggtgagggtcctcttctgaatgcatactgcctcctcactgtgttctcacatggaggaaggcggaattactttccttaatagcatttaattgttaagtccgtcagattttggtggtttgaaaagatctttgttctttgatttcctccaaatattatttggatttctaggtttagattcaacatagaaatatatccatgattgttgttttttactattgagtatccatggtgtactaggtgtttggaatggcaagctagatttcagtactgttttagtctcttgagatttctttaagatttctagattttaaattagtatcatga

SEQ ID NO: 102452 - DNA, 380 bp, Homo sapiens
atgaataggcatacacaggaatattcattatatgtgtaaataccatcatttgtattcaggcacaccttgttttattgtggctttattgcacttcacagatattgtattttttttagaaattgaaggtttgtgacaaccctgtgttgagcaagtctatcagcactgtttttccaacagcatgtgctcactttgtgtctctgtgtcacattttggtaactcttacaatattttgaacgtttttatgactattatatctgttgtggtaatctgtgatctttgatgttactattgtaattgttttggagcttcatgaaccatgcccatataagatggcaaatttaattgataaatgtcgtgtgtgttctgactgctccaccaac

SEQ ID NO: 102453 - DNA, 444 bp, Homo sapiens
aaagaaaaggtcttgctgtgtcgcccaggatggagtgcagtggcacaatcacattgcactgcaacctcaatatcctgggctcaagcaatcctcccaccgcagcctcccgaattgctgagactacacatgtgtgctaccatgcctggctaattgttttaattttttttatagagacggggtttcgccatgttgcccaggctggtcttgaactcctgggctcaaagcgatccacccaccttggcctccaaaagtatgggattacaggtgtgagccactgtgcccagccttattttttttttttaagataatattgttaacattttgtatttctctgcataaatatatttcaaaaataaaaatagagctcataatatatgctgttttgtaatgcttttttcacttaataggaattttttccgtatcattaagtactctgatttaatg

SEQ ID NO: 102454 - DNA, 663 bp, Homo sapiens
aatgaggaattattccagactgaagacgataaaaatacatgacacataaacaatatatgattctggaatgaatgattttggtaaaaagatcattaggatatgtgacaaaacttgaatgatgtttgaaagttagatggtataatgtatcaaatgtattcatttcctggattttgactgtcagtcatactgtggtaatgtagcagaatgttcttgtttataggacatactatattggcaacttactctcatatggttcaagtggcaagggcttactttttgttgtacttccaacttttctaaaagtctaagatattttcaaagtaaaaaaaaaaaaaaagtagccataattttgtaagtcaaaatagagataacaaggaattgctaccatgatgtaagtgaaaagtcatttctgaaattatggcatcgtacaatcggtctcagtcattataactgcacatcagaattacctggaatgctttcaaagaacactgaggtttggagatccaatccaggccaattaaatctctgggggtgatatgcaggcatcagcattctttaaaaagctttctattaattctgatgtgcagtcaaggctgagaaccaccagcatgtgctaggtcctgaaggttgttcaccctgagagagtttcatttaggcattttc

SEQ ID NO: 102455 - DNA, 115 bp, Homo sapiens
caggccggatgcccgcagtccggggcgttggggagggcgcggctggacctgcggggctacaagaaggcagccggacccccgcaccgcaggcccggacctgacaggaccgcgaccc

SEQ ID NO: 102456 - DNA, 663 bp, Homo sapiens
tttgattgattattaatcaaggtaacagtagaaaactaaggaaaataatcagatcagcagaagcatcttttttccgagacaactgttggaatactattttcccctggatgaataactaaccaggtaaatagaaagaggacagatattttgatcactacttgtatttctttgtaaatttttattttttcacttaataaatcatgaatgctttccatatcttaaatatgattccacaaaatgattgtaaatcctgcattttacttgtgctgcactaacatttatgtgcctacttcttcattaattgcagaaagagggaaataaaggtagggaaggagtgtaggaaccagaatgaatgaaaaagagagtgacgagaagacgagacaggtagatggtagagtgcagaagcagagagaatagtgagacggtaagctctattgatttggggtttgggtctcagtttactagctctcctgatgcagaccacctctatttgttatctgatttcaaattgtacatcgtctacttgaatctctcaatgtacagattaagaccctagcaaattagaaaattatctgaccttgaaaccaaagagattggtatgcaatttcgcagtagttttctgtcttggaccactttggtctttggctcagcagattggagaaa

SEQ ID NO: 102457 - DNA, 605 bp, Homo sapiens
gctaggctggtctcaaaactcctgaggcatgagccactgcacccggccaatttttttgtatttttaatggagatgggggttttgccatgttggccaggctggggttttgccatgttggccaggtctcgaactcctgcactcaagcagtccacctgcctcagccaaccaaagtgctgggattacaagtgtgaggcactgcacccggcctccagtcttttttttcttatgtgtagactttacctagttgtaagcagacatttcagaaccaatgtctttgcctaagggaacataaatgtggatgtattaaacggctaagttttaaaaaacaattatatgcctagatattaattactagaattctttctcatgtgctgaatacaatattgtattgcactgtaaacacagaaaggtactgccaattcagttatcagggttgtcatttattagaaatgcaatagtaaaattgtaaaataaggctgggcatggtggctcatgcctgtaatctttcctgcctggcactttcagaggccaaggcaggaggattgcttgagctcaggagttggagaccagcctgagcaacatagcgagatcttgtctctactaaa

SEQ ID NO: 102458 - DNA, 430 bp, Homo sapiens
tacagatcttgagatggggaaattattctggattatacagatggactgtgttcagtcacaggagctcttaaaagcagagacgctttcccagcttgggtcagagagattcatcatgagaagatctccactagctgttgctggatttcaggatggaggaagactcaagcagagagacctggtggccactagaagcttggaacagccctcagttgatagcaaggaaatgaggactcagtgacacaacctcaaagaactgaattctttcaatgacctgaatattaatgaaatgaaatttctcctagaacctctggaaaagaatgcagccctgctaacactgtaatttcagctcagtgagactgtgttagacttctgacctacagaagtcgtgagacaataaatttttgttgttttaaaccattaagtttatggt

SEQ ID NO: 102459 - DNA, 1466 bp, Homo sapiens
aaaaactagctgggtgtgttggccacacctgtagtcccagcttctcgggaggctaagatgagaggattacttgagcccagaagtggaggctgcagtaagctgtcattgggccactgcgctccagcctgcatgacacagcaagaacttgtctcaaaaacaaacaaacaaaaaccagaaaataacaagtgttggcaaggatgtggtgagactggaacccttgtgcactgctagtgagaatgtaaaacagtgtatctgctgtggaaaacagtaggacaattcctcaacaaattaaacaggctggacatagtggctcacgcctgtagttccagcactttgggagaccgagacaatggactgcttgagcccaggagttcaaggccagcctgcctgtctccacctcccaaagtgctgggattacaggcatgagccactgtgcttggccacctttgaaactttttaagtgtacagttctgtggtattgagtgcatttacattgttgtgccatctttaccacccttatccacagaattattttcattttataaaactgaaactctgaacctattaataactctctatagtcttttctccccagcccctggcagccaccattctactttctgtctccgtgagtttaactactttgtgtacctcatataagtggaatcatacagtatttgaccttttgtgactggcttatttcatttagcgtaatgtcctcaagattcatccatgttgtagcatgtgtcagaattttctctttttttttttttggagatagggtctcgctctgtcatgcgtgctgaagtgtagtggctcaatcatagctcactgcagccttgacctcctgggctcaagtgatcctcccacttcagcctcctgagtagctgggaccacaggcatgtgccaccacgcctggctacttttttttttcttttttgtagagatggggtctccttatgttgcccaggctggccttgaactcctgggctcaagcaatccattccgccttggcctcccgaagtgcaaggattacaggcatgagccactgcatctggcaagtttttcatatattttgaatatcaatccctcatcagatatatgatttgcatgtatttttcctatcctatgggttgctgtttcagtctgttgatactattctttgatacacaaaagttttaaattttcatgaagtccaacttatttttttttcttttattgcccactcttttttttttgacagggtcttgcactgtcacccaggctagagtgcagtggcaaattctagactcactgcagcccctgcctcccaggttcaagcaattctcctgcctcaccctcccaagtagctgggattacagtcatgcaccagcacacctggctaatttttatgtttttaatagagagggggttttcccatgttggccaggctggtctcaaactcctggcctcaagtgatccgccca

SEQ ID NO: 102460 - DNA, 332 bp, Homo sapiens
ttggctggggctggccaaactggcatcggtttttcatctcctgaacttactctttcgtaatttcctttatttcagccagtaaatggctgcatccctaagtcttcttttttaaaacatctcattcccaaaagttacctgcctgaaagtatcagattctgcttttttttttttaactgtggttattaaatgaggcggtaattcagaacttccccactgcttccttatccagaagctaacgccataagcccaggacagggaaaggagaagtcactgagactgtgtttgctagaagcgtttagtaaggcttgtcctgtttttctttgtataccagg

SEQ ID NO: 102461 - DNA, 747 bp, Homo sapiens
tgtggcttctcattgggccccgtgagtgctggcagggctgtgaagcaggtgtgactaatgggtcagctccccgctgggactgtgaccctgaagctaacaaacctaagggcaaggccaggcgcagcagctttctgagtctcttctgaagtggcttgaagtcgatactgtgtgtgtatgtaagatctagcctgaaggaaggcgctttgttcagttgctaacttattttcttggtggtaagctttagatatcacttagcttttatgtttgcttgttttgttacagattaagtagctgtcataagaaaaaggactatttacttactatctggagtcttgttctgtttgatacccctaggcacatgttcaattcagagataagagccctggaagttatagattgcaaacagttttttccctgaaaacaaaactgacatatttatatacaatgataaatacatagatagactaatgatcagtttatggatatttggcaatatgcctctcaataatcatcacattattcataatgtttataaattcataaatataagcgcacattacagcaacttattaacaatgttctataagccagaaaagcaccatgaatacaaaataaattattatagttcctgaacagtacttttacctgctaaatattttgtggccttcaacagctcagccagacagtcaaaaggagagcaacttagcagaagattttggtctagctgaggattcagatcactgaaga

SEQ ID NO: 102462 - DNA, 439 bp, Homo sapiens
ctggactgctgcagctgcaagccaagaaacaccaaagattgctggcaagcgacaagaagctagaaagtggcaaggaaggaccccctatgggtttcagaggggatctcgccctgaggacaccttaattccagacatccagcctcgagatctgcaagaccacacatttcagttgaaattaatttcaatacgtttttgctactatgaagtttgtggtattttgccagggcagccccagatggagaaggggactggaagaaagagagaagccaagctgtggtgaaaggaaaccacagaacacgtttaggaaatgcctttctctgatcctgctgaagacctgtgtcctactttactcaatggatgcatggcactggaatgagttcacctccacatcctcctctctgcacccaaagcactctccagcttcacccttcttcttttg

SEQ ID NO: 102463 - DNA, 482 bp, Homo sapiens
cacatatgtgagaataaaaaataatgtgtttctttccccattccattaatacctattgatgaacttcctatagtaaatgctgagcaaactgatgtgagtatagattgaaactgagaggttgaatcacaggataagaatatcctgagtcaaattagccccttgaatttgttgcctgtaactttttaaattgagcagggatggtactcatttaaatgtctctgtttttaatggtgatactcagctaaaaacaaacattagacaattcacaattcacttgtaatgggcacatggagggagaaagtgcttgagaaatggtatctgaatttatagctcaacttgtatgcagagttgtttgttgtgtagaaaaatgcaacaattaaaaagtcattacattatacatttctaattggagcatctcaagatgttcattaaacagcataaaggatcatctgaggccattgaatacctgtagttgagtggca

SEQ ID NO: 102464 - DNA, 309 bp, Homo sapiens
cctgaaactgaaaaactaccagaagaaacagggggaaacccacatgacattggtctgagcaatgatttttttggatttgaccccaaaagcccagggagcaaaagtgaatacagacaaatgggataacatcaaactaaaaaacttctgtacagcaaaggaaacaatagtgtgaagagataacctatgggttgggaaaaaatatttgcatgctatacatttgataggggttaatatccaaaataatatggaactcaactcaatagcaagaaaacaaacaaacaaacccaattaaaaaacaggcaaaggacc

SEQ ID NO: 102465 - DNA, 311 bp, Homo sapiens
ggtagtcctatttctccttttatatatatatggccatacttaccccttattcttctgtgtgggaaattatttttcttaggctacaaataaaaaaagtcagcaaagcatttgattaaaatttcaggggcatgataagctctcaatatattcataaaacatgtctttttatgtttttcagaagagtttgacagcttttataacataggttctgtaatttctccctcttcactcccttccttttcacctagaaccttttggattggtttgtctaagcacccctgcgatgtgtcaccccgctcagcattggcttt

SEQ ID NO: 102466 - DNA, 397 bp, Homo sapiens
cttagcccagcctaccttaaatgtgctcagaacacttacattagcgtacaattaggcaaaatcaaagcccattttataataaagtgttgaatagctcttgttatttattgaatattgtactgaaagtgagaaacagaatggttgtatgggtacttgaagtacagtttctactgaaagtgaacttcacaccattataaaactgaaaaatcataagttgaatcattataagtcagaggtgtctataattaagataattcctgagtcctccccaaatgttcccagtttgattagggtaggtgtccaaaccagattgccacagagtaaagatttttcttactgagcactgtcagcttaatgcacagtttacccctggacctcccaaggcccagcttccaag

SEQ ID NO: 102467 - DNA, 1063 bp, Homo sapiens
gttactggacctcagatactaaaaggacaaagaaaagggacagatgagaacagctacgaagcgatagtgaaaacatatggtgtccatcttgtaagcataaggctccctggtattgctgccactctccctgtgctcgggaaagctggaagaagccagtaggcaatctggtgtctcgtcagaagagtgccagaaacaggtgttgctgacctaaccctttcctcctaccacagattctcttggtggccaggcgcagtggctcacgcttgtaatcccagcactttggaagatggagacgggcagattacctgaggtcaggagttcaagaccagcctggtcaacatggcaaaaccccgtctctactaaaaatgcaaaaattagccagatgtggtggtgctcacctgtagtccaagctactcaggaggctgacacagaagaattgcttgaacccgggaggcggaagtttcagtgagccgagatcgcgccactgcatgcactccagcctgggcaacagagcaagactccgtctcaaaaataaataaataaataaataaataaataaaatgtttcaggttctctcttgtctccaaaccattgctaatgctatttccatgtctgatgttccaaggaaaatattatttcctctagaaagcccgactgcctctcagatttgttaggtgctttcctactgcaccctgtcagagcacaaaatggtaatcgcagtttgtctgtcccccttattagtctttaagcgaattagactttaaattctaaaagcagctatcagatctgtcttggtcctcattgtattcctaggaccttgctgtagagtgggtgctaataaatatttttgttaagtgaatgaatgtatgtatgaattgctttggctctaactggaatttgtctataccatggatcgtggatgctttgtctatggcttataatatcaattgttccattttgacttatttcattcctagaaaatttgtcctatgctttgttatttataatcacattaatgatttatttcagaatatactgtaatataaaaaatgatgcatgctaa

SEQ ID NO: 102468 - DNA, 133 bp, Homo sapiens
ggcgaagtgcaatggctacaaatagtgttccccatccctccattatcactccaactcctggtggagagtggataattatactggaagacagaaacaacacttttttttttttttttttttgggaaaaaggttt

SEQ ID NO: 102469 - DNA, 332 bp, Homo sapiens
tgttccagttccttttcactattcaaagcccaattctgcttagttcaacttactttcaactgggcatggtggctcacgcctgtaatcctaccactttgagaggccaagataggaggattgccgcagctcaagagttcagcatcagtctgggaagcatgagatgctgtctgtacaaaatttagaagacaaaaaaaaaaaaactgggtgttgtggtgttgtggcccatgcctgtggtcccaactacttgggaggctgaggtgggaggatcacttgagactgggagatggaggctgcagtgagccagttataccactgcactccagcctgtgcca

SEQ ID NO: 102470 - DNA, 632 bp, Homo sapiens
gctcctgacaagtggggattgcgggcgcgcgccaccacgccctggctaattttttgtttagtagaggtggagtttcaccatgttggccgggctggtcttgaacccctgacctcaggtgaccaccccctcccagcctcccaaagtgctgggattacaggcgtgagccaccacacccagcttacgcctggttaactcttaatgaccaaaatcaaagtatggatgaaaaagacgagaatctgggaagtcacattgctgaggtctgagagtcatgactccactgtcaccggggaggcccagcagagggcagcacctggatgatgagacccagttcaggaggcgcagcacagagcggtcaccatccttccccggttcaccgggaagcttgctccccctccttctgtattcctggcaaatgacaacgggcaaagcgaagcgtgggccaaggacggaggaggcggtgccgcgcgtctgccgtggtcacaagccacagaagtttgcttcactcctgccagaaaccggcaggacgcggaattctcttttaaagcacgtgttgaacagagtgtgtaataacatgagattaaaaagttactgccaaacgacaaaatataactattaaaatgaagcttccaatg

SEQ ID NO: 102471 - DNA, 443 bp, Homo sapiens
tccacaattgtagtttcatatatgtgcatcctctgtgctatccttcagatccaatcaagggaagttcagaggaaagccttctgcacctgcttctcccacctctgtgtgattggactcttttatggcacagccattatcatgtatgttggacccagatatgggaaccccaaggagcagaagaaatatctcctgctgtttcacagcctctttaatcccatgctcaatccccttatctgtagtcttaggaactcagaagtgaagaatactttgaagagagtgctgggagtagaaagggctttatgaaaaggattatggcattgtgactgacagtgacctaggaagttacatcattgagcggttcttaacccatctctgcactggtgggacctctgccctcaatggacatgagaattatctgagacatttatttaaaatggagctat

SEQ ID NO: 102472 - DNA, 575 bp, Homo sapiens
tcccccctataatttacacttctagtaagcctctacctgcacgacaacacataatgacccaccaatcacatgcctatcatatagtaaaacccagcccatgacccctaacaggggccctctcagccctcctaatgacctccggcctagccatgtgatttcacttccactccataacgctcctcatactaggcctactaaccaacacactaaccatataccaatgatggcgcgatgtaacacgagaaagcacataccaaggccaccacacaccacctgtccaaaaaggccttcgatacaggataatcctatttattacctcagaagtttttttcttcgcaggatttttctgagccttttaccactccagcctgggcaaccaagtgagactctgtctcaaaaccaaccaaccaaccaaccaaacaacaaacaaaaacaacttgagaatgggtaatttataaaagagtggaacatttatttcttacagttctagaggctgggaggtctaaggtcaaggcactggcagatttggtgtctggggaaggcttgctcattgctttatagatggtgtcttatgg

SEQ ID NO: 102473 - DNA, 853 bp, Homo sapiens
gcttacttggggaaactattgtactatgtgccaggtactgttccagacattctatgtgtctattagcatatttaatcctgacttagctgtaactgtcctcaatctcttatccaaagtcctaagacagatatgtgctttggaatctgaacatatgcagtttactaagaaacactcctaatatgcagaccaggcaaaatgtaggacagcactccataatcaagcatattacatttctgtagcaagcacatgaataattatatcaggtaggataaatgaaaagagcctcatgtctattcaggtcagcttttgccaccaatgagttcatgtcaaattttgctgttcacttctgactggttaagactgctgcccccagaaaatgtcccatatctatgacatctatcatcttgcagacttatttcactgtggtgaacacatttaaaatctactttagcaattctggaatatacattattaactatagttaccttgctatgcaatagatcaacaaaacttattcctcctgtctaaatgaaactttggaccctttgaccaaccactacattcccctcaagcctatccatgattgaaaataccagcttccaaatatcaacttattcagaaataattacagattctaaaaggctggctataaagatgtctaagctgattgaacagcatattggggtacatggtgtacaaatagtcaacatttattcactcaacaaacacatagctgccttctttatgttcatttaaagcctgcttcaaatagagtatttcacagaataaaacactgtagtggttgcctcagatactatattttgcagagcctaagcagtaactaggtataccc

SEQ ID NO: 102474 - DNA, 435 bp, Homo sapiens
tattcacgccatcacccagttctattttacttacacgcttcgtcacaatctcataaccttatttagattttatctgctccttccttctagaatgtaagactcatgaggacaggaattctgtcctgctcaccaccatgtcccctggccaataacagtgaatggtatctagtaggcctcaagaagtatttgttaaacaaaaatgaaaagatgtggccggcacggggagagtacaaatctacataaaacaataaaacgaggaactgaaaaaaggaaagaaaaccacgctgagatgtacaagctgacaggactcaaagctatcatgccagctcggaggtttggtggacatttttcagggtggacaggtgcttcacacctatctaagcgcatagagcccttccaggaagaagaaaatccacagagaggtgtccagatagc

SEQ ID NO: 102475 - DNA, 789 bp, Homo sapiens
tttcttctgctcttccactcttacattttgttaggttaccccaaccacttctgtcccagttcggaatcccttatcctaactgcttttcacaacacattccagctctcaggtttatagccctcaatctccatgttggaaatacaaatttgttgtaagtgaccaagacctaaattaatagtggctgaaacaagatggaagtatatttctctcctatgtgaaaatccagacatacgaatgcagggctagttgattgcaatactccatggggtccttaggagccaggcccctgctgccttgctctcccatgcatggcccactttcttacactcactccatgacccaagatggccaccccatctctagttatggtgtctgcattccagccagtaagaataggaagagaagacaatcctaccggctagaccttagtctcatagccacacctggctagtgggaggtggggaaatgtagtctgtattttgggtcatcatgtgtccagctaaaatttagggctctactagtgtaaaaaaagggaacattgatcttggggaacaaatggcaattgtctgctacatatatttgacgtttaaagtttttttaattgtaaattttcatgggtacatatatatggggtacatgagttattttaaacagtcgtacaatgtgtaataattatatcagggtaaatggggtttccatcatctcaagcattcatcatttcctggtgttacaaacattccaatcgtactccctcagttattctaaaatgtgcaacatattattgctgat

SEQ ID NO: 102476 - DNA, 482 bp, Homo sapiens
attggcagtatgtcgactctagttccaaattttggcttagaaaactgagagggaaaagagccacaaagagtattaggttaatttttcatattaacttacatttaaaaattcttaacaagggaaaattctagttatctttccaagcttttatattaaattcagaaatagggttctgggctgggcgtggtggctcaggcctgtattcccagcactgtgggaggctgaggtgggcggatcatgaggtcaggagattgaggccatcctggccaacatggtgaaaccccatctctactaaaaatacaaaaattagctgggtgtggtggcatgtgcctgtagtcccagctactcagggggctgagactgatccccactctgttgtcaggctggagtgcagtggcgccttctcggctcactgcaacctcagctttccgggttcaaatgagtctcctgccttgtcgacgcggcccggaatttagtagtag

SEQ ID NO: 102477 - DNA, 270 bp, Homo sapiens
gcggccgcctactactactactactactactaaattcgcggccgcgtcgacacaaaacaaagtccctattatcctagcacttatattttattggttagtagaaaataaatgatcaaaaacatattatttgagctggagataagctggagattatttgagctggtggctcatgcctataatcccagcacttcaagagaccaagatgggaggatcccttgagcctaggacttcaagaccagcctgggccacatggtcagaccccatctctac

SEQ ID NO: 102478 - DNA, 553 bp, Homo sapiens
tgatgagctgtcctgcagtgctagagtctgagagaaaccagcccgactcagagcaagttgcaacaacctacagggagcgccttcctggcagggaacggttaatgttgagagtcacgtgccaactcttcagggctaacacattcccagaatatttgacacaagatacttatgttctcttcatctccccaaatactcttctcaggggctctttgtacccacaagatagtgcacagaggtcagactcagcctgggttcatccagaagatctgagctctagatgcacagacagctgacagctgtgcagaaatcccgcctccggggagcttttgttgaggcagactcaggctccagttcctaaaataagtggcgtctgccctcctagcctggcccccaaggagccttcagagatgcaggcagcggctctcagccctgctagggacagacctgccatcctgttcccagagcctactgaatgaaggtaagggaggccaggaagcactggtgacacgtgaaaagccccaaggctcacagcccaggccctttggacaccagc

SEQ ID NO: 102479 - DNA, 804 bp, Homo sapiens
aaaggcttgggcgtgcggcttgctcttcctctccgcttgacgggcggtggttcccccgagacagaaacttgactgaaaaataataccaaatacccgtgctgcggcccgtggccctccatagggccacctgaactagcctcgcctgtccccttgctctttgccgttcgtccttcgcgttttgtgaaaacagttggcgccgcagaaatgagataaacgcccctgagctcgaaacccgcactcgaactgccaccgagccgacccttcctgttttggaactcagggcccggccacccgagaagcaccctcatgggcactttgtttctacaagggcccgtttccatttccttcctaaggtttccttatcccctgcggcaggaggggcccgctgggctcgggttttcagctgcgttggagctgcagaggctgcggagtgaacgcggccaggagcccgcctgggagcgcgcagcgctctaggagccgagagccgctgcttggccctcgctggccgggtaaaccgaggggaagctcctggcctcctttcccttaagccccttattgcttctgtggggaaggccctcctaggtagaggcgaaggaccggggagataacctctcccatgggccacatccgctgccatggtctgtgtcgtgccagaaggtacctctcagccctcagtgccgtgaaaaatctgacactcaagaaggtcgattgacacgcctaacgtcgcacagcaatttagtagcacagcacagaatagaagctacccaggctggctgtctcccaagcctgtgtttctctaccaca

SEQ ID NO: 102480 - DNA, 104 bp, Homo sapiens
tccctctgcaagatgactcatgaggtctgactgagtctcatttatattcctccccagcaggtaatttaaatgtgatttatacagaaaggaaaagaaagagaaca

SEQ ID NO: 102481 - DNA, 393 bp, Homo sapiens
cgcctcctggacagctgttcatggcttctctctcttcagacttccaacatctcccttctctccctgcctcctaagcagatgctcttctttgaggaattatttttcatacataattattttgtcattattccttatgatgatgacagctaatgcttatattatacctactatgtaccagtcactattcttgtatatcagttttctaggtccaattattagccccatttttcaggtgagacatctgaggcacagaaagattaagtaacctgcctgaggttgcagggccgataaacggcagaactaggatttcaggccggcactgcctccgagtcttccctgtgctcttgtttactgcagtctggagaagagttgctctcactgccttctgtctgc

SEQ ID NO: 102482 - DNA, 287 bp, Homo sapiens
ctggatggaattctgaaacagaaaaagacactaggtacaattaaggaaatgtaaataaatgagggactttaattaatgacaatgtatcaacattggtttattaattataacaatgtaccatagtaatgtaagatgttaataactggaattccgcactatcttctcaattttctgtaaatctacaattgttgtaaaaactaaagcctattattaaagaaaaaaagttaaaatttagaagttaaggctgggcccagtggctcatgcctgtaatcccagcactttgggag

SEQ ID NO: 102483 - DNA, 613 bp, Homo sapiens
gaagttgcctgaagtgaaggagggggtagcggctgcagaagctaaagcttccgccaaacaaaagaggacagcacttccggtcacgccatcgttgctgccttcttcgtcaagcccccaggctccgctcttgccagagggacaggagccatggctcagaaaatggactgtggtgcgggcctcctcggcttccaggctgaggcctccgtagaagacagcgccttgcttatgcagaccttgatggaggccatccagatctcagaggctccacctactaaccaggccaccgcagctgctagtccccagagttcacagcccccaactgccaatgagatggctgacattcaggtttcagcagctgccgctaggcctaagtcagcctttaaagtccagaatgccaccacaaaaggcccaaatggtgtctatgatttctctcaggctcataatgccaaggatgtgcccaacacgcagcccaaggcagcctttaagtcccaaaatgctaccccaaagggtccaaatgctgcctatgatttttcccaggcagcaaccactggtgagttagctgctaacaagtctgagatggccttcaaggcccagaatgccactactaaagtgg

SEQ ID NO: 102484 - DNA, 442 bp, Homo sapiens
aaaaaaaaaaaaaaaaagatcttacatgagacaacgtcatattccaatagcttcttctacttcattctagttactctgcctggggtcacaacaataattttgaaggtattttaatgtctttctccttttttaaataaggagaatactaagacctgattggagagacttgccttacggctctggccatctgcagtgttggaagtagatgatctaacttgaatctaatattctttccactatatgatatatacacaaaccagtattgccttttgcgttgttacccttttatgtacgtgtgtgtatgtgtatacacacatacatgttacaaagtaatcaagtcccagttaaaaatatatattcacaaatatttctgtgacttcaaaaaatgtgaagactcttagtttagacaaaaatgcattaaagttaggattgtagactcttc

SEQ ID NO: 102485 - DNA, 409 bp, Homo sapiens
cagccttgcaggcactgaagaaggcagaatgggtttaagagttttccaaaacttccagctgcagagaattgttactatttgacttgtctgacagttcgctggaaaccccactcacagggcttatcttttttcacctgacttggagtttattcactgcaaacagtgttttccctggtgcatttgttgaaaataatcagcagcacttgtttgacataacatggagtgggtaacagctgggtcaaacaagaagctggggaatgagatgtccatcctgacatctggaaagctctgacatatttctagaatgtaatatgtgtaaggttggacacattttccaggaaaaacctgagaggtctctaagctctcacctcacatttagtctctgtccgagcacgaatggaaggtgtgt

SEQ ID NO: 102486 - DNA, 275 bp, Homo sapiens
gcaacctccacctccctggtttaagcaattctgcctcagcctgctgagtagctgggtctataggtgtaggctgccatgcctggccaattttttgtattttagtagagatgaagtttcaccatgttgcccaggctggtcttcaactcttgaacacaggcaatctttccgcctcaacctcccaaagtgctaggattacaggcacgagacaccgcgcctggctgaaaattcgccattttaaagtagaaaatgcagtggcttttagtaattcacaaagt

SEQ ID NO: 102487 - DNA, 419 bp, Homo sapiens
ggacagcttgtggggcttaaagcatgggctccacagcaagcctgcctgcaggtagattccggtgcccctgagtgccagctctgtagcccaggacagggagcccaatctgtcctcactttgtcatctgtaaagtgggaatcacaacagtatctacccatagcttattttgaggcataaacatggcaatgcatgtttagcacatgcctggcacgtagtcagcactcaaaaaacagtcctaagagttggtggtatccgtagagtagagcagccgtacttgtggctgctgttgtcctgatgataaatgaggatagaacaaaggacaaggaagaagaggagttggaagctgactctggcatttgaagcccttcacattctggccccaactggtccttttgcctcagtccttcctacactcccca

SEQ ID NO: 102488 - DNA, 413 bp, Homo sapiens
gcttgcgattttgaggtcttagttgtgaattctttgcctagaccaatatccagcagtttccctgggttttctgccagtatttgtatagtttctggttttatattgaagtatttactccatcttaagttgatttttttatgtggtgagagataggagtccagtttcattcctctgcatgtggcaatccaattttcccaagaccatttattgaaaatgatgtcctataaagatgggaacaatagacagacactggggactgctagaggtgggagagaaagagggggctaaaggctgagaaactacctattgggtactatgttcactaccagagtgacagatttagtcataccccaaacttcagcattatgtaatatacctttgtaacaaacctgcacgtgtaacctctaattcta

SEQ ID NO: 102489 - DNA, 667 bp, Homo sapiens
cgctgcgggacaaattggaccggagattaaaggaccggagtttaactcgaggtgactgcgttcgtatgcaaatggaatatataaaactcttctttccggggtagtctttaaagactttttacctccgggtgggcggcaaagactaaagtttcccctcctcccctttcattttccccctgcccatagaacagatgggcaaactaagctccgggccattggggctattaaagaaagccctaggctcttgaccccaggtgtcttgaaaccttccgtttaagagggatcccttgcccagccttgtttgccttcccctttcctcagtttccctatctgtaaaagggggttggaataaggacaggatcaagttggaagatcgcaaacccctgcccctcccacctcagtttcccgaagctttccggaagcaaaatcccgaattttgcagcggctcccggccgaatccacccgctgcggccaccaggtggcgcgcggccaccggtcactaggcccgccggggtgtccgtcttcggcgaccccatcgggaaaggatttcgctgctgccgccaagggtctaaggcctacctggcccacttgaagacaaagaacgagaacgttggtgctttgcccacttctgctctgccggattatgctgcagcttcctcggtggccg

SEQ ID NO: 102490 - DNA, 180 bp, Homo sapiens
ctcaagcctccctttcactcttacgtctctagctcgcagtgatttttctcttctgagttcccgcagcacctatttccctgaatcacatggttagtacttgataactcactcattcaataattatttaatgcctgctatgggccacaccttgtgctagccacctgagatggtcttcctgaa

SEQ ID NO: 102491 - DNA, 193 bp, Homo sapiens
gctctgtggccctgggcaggctgaggacttctccagctagcctcggtttcctcacctggagaactggggtgatggcgtcgaattgccgtgtggattaaaggaggatgctgaggacctagagttgtgcctgccacagagaaggtctccacgtgggctacctttggcatcgccatgacacagatggagaaactga

SEQ ID NO: 102492 - DNA, 388 bp, Homo sapiens
ttttcccattgaactacacagccattctgcagccattggatcagggtacagttggcacagtgacagctcacttctgaaagcagttggaacaactctttctaaatgtagagcatgaagagaaaaatggagaaaagcaacatgagtaagccattgacatgattgcagagacttggtgatctataaagttatctgtaatcatgaaatgttagcaaaacacaggcatgattcctgtggaatcccctgaggtcctcctgtaagaagactgcaactaaatgtggtatttgaaccaatctagcactcaactgctgctgtcattgatgtctcaaaccagtttaattttgaagactgtgtggctacagatagcaatttaactatttcccaagttacc

SEQ ID NO: 102493 - DNA, 427 bp, Homo sapiens
tgagacaaacctgagtttcaatctcaattgtttgtttgtggcttgcctctcagcatcttaaattctctgaatcttaagttcctccactgtgtaaaagaaataatatccctctgacctcactgtggttaggcaagagacaatgcagtgattttttcagtaatattatgagacattttattactataattaaatgattgtattttccccagattgacaaattcaaattttctattttgaaatcttattgcaaatgttaaaaaaacaaacaacccaccctttggctcctgttatgttgtcttccagctgctagtaatggaattgggacagctaatgttccctgagagccatggggaaccaggcagtgtgcttttcaggaactgtcttactttatcctcacaacaatcccaaaaggaaaaacctagtttta

SEQ ID NO: 102494 - DNA, 120 bp, Homo sapiens
catgaggataagaaaagaaagcaaagccctgagctgcagcattgtccaggcctgcccgtgtgagtcctcctgcctgcggtgtgagtgatcccgcctgcggtgtgagtgctcccgcctgcg

SEQ ID NO: 102495 - DNA, 491 bp, Homo sapiens
ggagaatcagagctttctctggctgcttttggccggctggaggggtggaggaaccttcaggtaatgttatttaccatcaataggaaaaaggattactccaggcttctttccttacaacaatatgctaatcaaccccttgggcccacaagggtctgggaagccaggcagctgcctctgtcgcatctctaggagcatggccactgatttaatgagggggagggcagggctccgctgggctcctgggagtgggatcagacaatgactgggggtgggtggccgtcagggcagcgtggaagaagcgggtctgaccagggcgcctgcgtggagaggaatggcagcagccagggctccccaccacccccagtgctgctgcagggtcaggtgagagcagctgctcatgttctatttattagagagacagagtcccctgaagaagggtggaaatgtaaatattttaaaaaatgaatccgaggcttgagtcaagggcataa

SEQ ID NO: 102496 - DNA, 310 bp, Homo sapiens
cccccaaagtgctgggattccaggtgtgagccactgcacctagctgctttatctttttaaatgtgttgtttcttaggaaattagttattgtgttatagattcttacctaaggagaacacgtatgattatcatcagcattttacagcccagttgggttcttcttgcctgctgcacagaaaaagccagtaccctgagacagcagaatttgcagcagagaaagagtttaataatcgcaaggctgattgaggtggacaagatacctttcaaatccacctcccaaagaatttggagactaggtttttaaagatgg

SEQ ID NO: 102497 - DNA, 185 bp, Homo sapiens
taagggactgttgcaaaaagaagacagacttgatgggtttttcaacttatgaggaatttttccaactcacaaaagtaaactgaagcctctttcttggcaaggcaagctactcagtttgaagaaagacctcataatgcattatctagactataaaagcaaaatactgagagtcttccctagagata

SEQ ID NO: 102498 - DNA, 771 bp, Homo sapiens
atcaattccctacaaacgttgccatttcatccaaatggaaaggcaagcattaggactatgagtcaaacactctaccctaatatctaatgacatataaatttgagagttaacatttactttaattgctgaagcagtcatgctaagtgcatcatctgacatattaccaggtgttaaaaagggtaatttctgaggggaaaaaagtctctaaaaccaagagacagtattccactaaaagcgttgttcatctcttttaaaaaatcttcagttaaatagattgcctcagtagtttgggaaatggtccctgacatggaaacatatttctgtaatctttgaagggaaggggagtgctggttattctctgtgtttcctcccaacacatagccattctctatccatctctcctgaccccatgagctgcatctgtcaggttcctttgccccctggtttccacctgggttttgctaatggaaggcatcagctgcaagagatcaaagggcagagggagagagagcaggcagagggagagccagcgagcagtcctcaccgttcccttttcaccttgggatgcagctggttctggcaggcagcccctcctctcagctcttgctaactgctcctaacactggtttctcccctaagacctacagacaaggggagaaaacagttccctactgttattatgctctggtgtcttcctcacttgttgatccctcaacttacctactccctttgttaaaacctcttcaattgaatcatttcagtggaattcca

SEQ ID NO: 102499 - DNA, 548 bp, Homo sapiens
aaggaaggaaagaaggaaggaaagaagtaagggagagagagagatgctgtagtgtgttagccacattgttataagcagactgcacttacagtcacacacacagaaacacacacacacacccaatgccacacagacacacagacatcaaacacacagatattcaacactcacaacactcccacagaaacacacagtccaggagctcctgaggctgtgtggttctacaagaagccccacctggagagagccaccctggtgaacacagggggcctgtacttaaaaatcacagtggggcaagtttcaagaggactcacccctacaatgtctaggcaggctggaggaatcctgtagatccttttggatccttagggattttgtggtttattcctggagctgtatttgatgtttcttcaggctggctcacatatgccctctcctaagatcatgggactatctatggatcccacagagaagacagttgagagttcaccactgagacacctccacagaattctcctttgccgagacaaagggacttattgctagat

SEQ ID NO: 102500 - DNA, 729 bp, Homo sapiens
tcaaacttgtgagctcttggcctcccaacatgctgggattataggtgtgagccaccatgcttggccggttctctttaactattcactatttctatcttactttaaaagcaaccaaccaccaacaactaaagtctgtgccttatttggatttccttagtttttacctattgtcctttttctgttccaggagtccgtctaggatatcacattacatttagtcttcagactttacttggccatgaccatttctcagacttcccttgttttcgatgaccttgacagttgtaaggaatactggtcagggatgttgtaggaggtcccaccattgggatttgtctgatgtgtctcctgtggtcaggctggggtagtgtgtctctgggaagaaggtctcggaggcagtgtgccattctcatcacagcccggggacatactgtccgtgtaacttaccacagttgatgctgaccttgaccacctggctgaggttgtgttcatcaggtttctttctccgtggtaaagttgcttttttctcccctttccgtactgtcctcggaagaaagtcattgaaggggcagggagttcttcactgcataagggtggggcatctacataaattactttggaacttctgcacaggggatggtttgcatatcctgtttagttattccatcatttatatcagtatgcattcatggatatttatttaatattttgggttgtaacacaacacta

SEQ ID NO: 102501 - DNA, 403 bp, Homo sapiens
tggagtgtgaataagtgtcatgtactgtgcgtacatcatttatatatcaacatttctgcgtcgggggctttgatggcaccatgaatggtcaggtggtgtaatcttcagctgtgtgtttatctgtgtaaatgtatgatgtgtttggcagaaagaaagacagaccaagttggagacagtctttaatcagaaaggggagacagactgctgctctcagttcccagtctccaggccttaatccttcctatttagagacccccaactctgttccagagttctcctcagccctgggcttcctcacatgctgggtggggaatgggaattcaaacagaaactcaagttgggccaggaaacccaagttggatgaaaacagtagggagagaggagtgggatggaagggggaagc

SEQ ID NO: 102502 - DNA, 463 bp, Homo sapiens
caactgtaatcaccccaagcttcctgccaattaaatatttcttagaaaacatacatgttgaaatctggcaggttcatttcaggagtattaaaatttgtgaaatgttcaagactatgatcacacactaaaagaaaggaaaaatcaaaagttggggtaaaaataaacttgtgtatacacatatatacatattttggagacactcatgctctgtcacccaagctggagtgcagtggcatgacctcgacttactgcaacctccacgcctccctggttccaatgattctcctgcctcagcctccagagtagctaggattacaggcgcgcacgacaccacacccggctaatttttgtatttttagcacagatggggtttcaccatgttggccaggctggtcttgaactcctgaccttgtgatctgcccacctcggcctctcaaagtgctgggattacaggcgtgagcta

SEQ ID NO: 102503 - DNA, 619 bp, Homo sapiens
gacacagcccctgtccctgagggtttagataaaaaggaaagatcctgtaggaatgcctagtgcaaagaatggcgctgtgtttggggaaaatcaagctgttcagctgagctggggcacagggtgtggtgagggagggggctccctctttcagtcatgaaatgcaccctttccacaacttgggaaagaatccttcctggaaacttcatatgaaccctctcaaagtacttattgatgtagacatttggaacacgctgtaggtcctgggtgtctgtaaaatagcatcatccagccgatcatctctccccacattgctgaactgaggacatgtgaactggtatctctcggtggttcagaacaggggccagcaacctacggccctagggccaccacctgtgtagtaaagaaagttttttttttggaacacagtcttggccattcatttaaatattatctatgatcactctcatgctacaatgtcagaggcattataaagaccacgtagcccaaaaacctgtctgggtctgtaagaaaaagctgccaacccctggtctaggcgctctgcttacctgaaatacaaaccaataatgagtttctgacacaccaagttcaattccctccc

SEQ ID NO: 102504 - DNA, 481 bp, Homo sapiens
ctggtctcaaactactgaactcaagcaagtagcccaccttggcctcccaaagtgctgggattacaggcatgagtcgtcaggtccagccatacctccttttcttaatgggctctgaaggcaaaaaccagaggagtcccaggggttttgaaaaagacttatctggatatatgttctgaagtgggtgtttttaagaccgcattttatcatgaaagactagttcctctttggatctcaaataatcacctcaaagagccctctgatcactctatcccccaacccctcctttttctctcacagtaccttttaaaattatgttcactctgccctcatcttgttaacatttttacttgtttctcatctaccaccaccctcactagtctgtaaactccatgagaacagggatcttgtcgtttatgagtccagagcctagaactgtgtctggtatgctatagtcaataaatatttgttgaataacaacttt

SEQ ID NO: 102505 - DNA, 157 bp, Homo sapiens
aatttgctcaacaggaaagaatgagctccattgcgcggactggtacattgaagcctgagatggaaagctacttgctcaaagtcccacagcaaatccgatgcaaagctgggtaaaaataagtctccttacatgcgtgtgtgcattccttcattcacga

SEQ ID NO: 102506 - DNA, 630 bp, Homo sapiens
ggcacgatctcggctcactgcaacctctgcctcccactttcaagcaattctctgcgtcagcctcccaagtagctaggattacaggcgcctgccaccacgcccggctaatttttgtatttttagtagagatggggtttcaccatgttggccaggcttgtctcaaactcctgacctcgggtgatccgcccgcctcggcctcccaaagtgctgggattacagatgtgagccactgcgcccagtggcactggtgcttttcatgtctgcagtttcaaccccttacccccaaccccaaggtcatgtgtaatcctggtatgaataaatgtaaatggtgcttgctggccttaggtgtgtgagagtcagaagcatccatttcaccactcaggcctaaggttctctatgtctcactacccaccctgcaccccagacctcacacagcaacactcatgagagccaccaaaattgtaacgaaaatataatgatgacaatgaggacaagtctttcctataactgagaaagttctgtgctaaacatgttacctatggaaattatttcagtgcattctctggatttcactgagaagtagctaccattattattcttatctccatcttatggaacaggaaatggtga

SEQ ID NO: 102507 - DNA, 674 bp, Homo sapiens
taaataaataaataaataaattctctattttgatgtcatttacaactgtagattcgatatcataaaaatttaatatccatagttatttgaaaatatgacttgaataatttttcattcagttctattaaatgatgtctgtcttgatatttttattgtattatgctttattaaaagagcagatatttacaaatttaaatagtgccaatacagtagtatatttgttcatttaattaacagtattttaatgtgtattatattctccatatttagtcttgaaaaccctttaggaaaaactatataaacaggtgttcaatcttggtattttaatgttaccaaaattgacaacatatttttccatatatttaaaatattggttcttgcttctctgataacttagtcttcgaattggcttgacttcatagacttcattgtcatttgggtttgtgatgcttcagaaatatggaaccttgcaaagtgaatgttagtattttggtaattagacacaatgatgcttacttactatgtgccagacacttttctacaggctatttatatatattttttcattaatcttattaacatatctataatatacattaatgtttacaacttaaacagtttattacatgttcttcctttgacaagccaaaattaatacgatttggaagttatat

SEQ ID NO: 102508 - DNA, 174 bp, Homo sapiens
  misc_feature (84)..(84): n is a, c, g, or t
ggaaaacaatttcacttttaattaacttagtgtaatttaggattaactcttttattgtgaaggaattatctgcctcagaacttnggcttattagaacttggcttattaccttcatgggttttgtactcggcacatgtgatttctaaaactacagaatgaatgattccctgtgat

SEQ ID NO: 102509 - DNA, 242 bp, Homo sapiens
cttcacctcactaataattaaagaataattaacacgtaaaaacagctctgatacgccatatcatgtaacaagaataaccttagtttaacaaatttttttttgtttgtttgtttgagacggagtctcgctctgtcgctcaggctggagtgcagtggcatgatctcggcttgctgcaagctccgcctcccaggagaattgcttgaacctgtgaggaagaggttgcagtgagcttagatcgtgcc

SEQ ID NO: 102510 - DNA, 423 bp, Homo sapiens
tacttgaggagatctcttacgggcaatttttatccagccttaccctaaagtgttttctctggaggtgccatccaaggaaaggacagagagccacttccagacccaaacttcagggaaaaagagtcagctcttatccagagtttctgaaagatgagaaaacaaaatctctctttttttgagatagggcctttctctgtcacccagactggagtgcagtggtatgagcacagctcactgtagcctcaacctcctgggctcaagagatggtcctgcctcagcctcccgagtagctggaaccagaggcatgcatcactgtactcagctgatttttttatttttttgtagagacaaggcctcagcatgttgcccaagctggtcttgaacttctgggctcaagcaatcctcctgcttcagcctcccaaa

SEQ ID NO: 102511 - DNA, 812 bp, Homo sapiens
aggaaagtgcacagcagatttgaggaattcagggtgaattttgttggccagtggctacaggggctgattgggagcggggttgggccaggtgaaatggattagtttatccaaatctcccagctgtcctcatggtttagccacaccaccacctttaaccctagaactaagacaaggggagaagtgcgggtgagaagtgagtaaggcgaaggttgcttccaagcaccccctcacccaccgtttgtgcccctcccaaccctatggactggtacttcttccctggctgagggcgggctggtattaatggttcctgtgttccatgcctgggggaggcaaggaagggctggagatgggtctcggggcacatctgcacaggacagaggtctcccacggtagccccggtctaggcttaagccccagagcactcacagttccttccccagctcctgtccactgagtaggttcagcctttgttgctagaagtggaaacttttctccttggttgattttctttcaagacccagtcagaggatgggaacctgactgctgtgaggtctctcactttatcaccacatggagggagtggaattgggttacattcaggttgccagaaccttctttctggctggaaagaaggtttcccaacattctaaacccagattgctcggtaatagttaacaatagccaagctggtagtatacgtctccaagggctttccctgtagtgatccatttagccttcatagtagccctacaaaataggtatttctattttttatttttattttttagacggagtctcgctctgtctcccag

SEQ ID NO: 102512 - DNA, 551 bp, Homo sapiens
gtgtgatctaaggatcccgcgggagccttaacctaaatcatctctctcaagttcaaagttccacaaatctttagagcaggggcacaatgcctgccagtctctttgctaaagtatagcaagagtgacctttactccagttcctaataagttcctctgtctgagaccacctcagcctggatttcaccgttcatgtcattttcagcatctgggtcacacaccttttgaggatcagatgaaagctgtaattctctcaccaggaaaaagattcacaaacacaatttccctcagttttacagggttcagagacccctgaagcccttctatgtatcgattctccataagcccccagggaccctccgagttaagaatgcctgaattcattggcgattacctgatctctgacctctggcccttatattatttttcttaaataaggcctctgccctcatcaacagggttacaggtctaatctcgagttgacagggtctgtttcattttttttgagacggaatctcgctctgtctcacccaggctggagtgcagtggcccga

SEQ ID NO: 102513 - DNA, 205 bp, Homo sapiens
ttctttttatgctggcaagttttgattgggtgccaaacactgtgaattttatcttgttgagtgctggatatttttattatttatatttattttatattattcctattttatattattcctataaaaatccttaaactttgctttgggatagaattaaagtactgtaaacagtttgagtccttcaggtcttgcttttaagctttgt

SEQ ID NO: 102514 - DNA, 677 bp, Homo sapiens
agaggaaccgacttacagagtgggctgctgtgcatcctatggcacagggtccccaacctttttggcaccaggggccggtttcatggacgacaatttttccagcaggtttgtgggggtagggtgatggtgtcaggatgaaactgttctacctgagatcatcaggcattagattctcataaggagcacacaacttagatcccttgcttgtgcagctcacgatagggttccgctcctttgagaatctaatgccaccactgatttgccaggagttggagctcaggcggtaatgctctctcacccactggacgctcgcctcctgctgtgcggcccggttcctaacagaccttggactggttttggtctgtggtccgcggcccagggtttggggacccctgctctggcagacaggagagaaagggatgttctacctaggtgtgtccaccaggagtgggtcaggatgtggagtttattgagggtttaaggaatttggctccaggccagggctggtttcttccagtgtcttggggagtatcataaaaacctttatcggtgtctgggagttttgaagcatgcagaggaaaacatgcacctagctgggtcagagtggtcaaaggcactcctgtcctagaggaagaagtgggggaggttgggggccctacagtagctgatatgatgcc

SEQ ID NO: 102515 - DNA, 388 bp, Homo sapiens
tgccctcaacttaaagccctggcaactgtagcacaggtttgtttgcaaagactttatattagaagatccccaagaaaacatcaaactcaaaggcccatatgagaatggaattcttgattggcataaaccaactaatccaatcaagtacaaaaagctatagtaatgttgggcacaaatctttattaataaaatttacagagagctgaaatgctctgataacaagtcattctggataatatatatcttatgctttttatactctaaaacatattattttagtcttctggattaaaataactctaaacgtattatgtaaatttttttgccactgacagagtttacagaatataattcccaggtcatcatgatggtggccaattaacatact

SEQ ID NO: 102516 - DNA, 824 bp, Homo sapiens
atcactgcctgttctgtgtccttaacatgcatctgttatcaggacatctctgcttacttctgtttctccttactagacttacctgctggaggatgagaacttgctctcctattcatttttatatccccaatttttaatatagtgtcttagacactggggcgtttcctccttgtcatacttataatcctcatcataattagcattttattgagctcttattaatgagatgggtactgttctaagtactttatttgggttttctcatttagtcctccaataaacctatgagtaagatctctaatgaatcttgtgagtttactggtttttaaataaaaaatggcaatgagagcagagagaagctaggtaatctgtataggttgcacatttcccgagtggtagagctgggatcccagcagtctaactgcagcatctatgcttgtaaacctttctctaaattacattgaaaagttaacaactactcacaagttaaataatagttgtctgtgtattcatgttattgtactcctttttatatatttcttccatgttttgtattaaaaaaattttaaatccacagaagagttgaagcaataggaacagtaaatacccatatatccttattgttaacgttttacacatttttttttctctcttccttcccgcctcacccttctctctttctccctcaaccatttttaagtaacttacagacctaatgacacttcgtgcctaaacacttcagcattcatctccagagagcaaggacatttacttacaaaccacagtatcatttcacacttaaaaaatttagtattgatataata

SEQ ID NO: 102517 - DNA, 452 bp, Homo sapiens
tcttaagaccaaaacatcttttcactgtccatgtagctggttggaattaccaaaagacctataaaatcacagaatttagagcctagtgagatccttaaagatgatcccctcatttcaaagattaggaaatcaagggattaaaacaagtagttaatgtttattcagtgcttgcccatgtgccagtgctcagtacattatgcctattatttaatctttgccctgtccttctgagagttggtctatttctatccttattttataaatgaggaaactgaggcttagagaaattaacttgcccataattaagtggtggaactgatatttgaacccaggtctgtctgactccacatcatgtaatggaatgcagtaagtttttaactgacctgctcaatgttacattgcttattattagtgggagagggattaacagcctgatgtcttgactgaaaatt

SEQ ID NO: 102518 - DNA, 539 bp, Homo sapiens
gttatcccagtgaagagtgtggagagggcactccaggtagagggacacatgaggaaaggcattcagatgtaaatgtctgtgacatggttggggatgactaacagttcagtgcagctaaactgcaggctgctaggggctagactgtgaagggactcctttagccatgttcaggagtttggactttattctgtaatctagataatgggagccttcagaggtttttttaagccggattgatcacatgtccggaattggaagggtaaaactgcaagtggggagaccatttgagacactttcataattgtctgagcaggaggggatgagggcctgttctaagccaatgaaaagatactgggggagagtgaagtagaagtagaaatagagaagtaagggaggtgatctgatttgggaaataaatataatgacttgatttttagatcgattatagtgaagctattaagctctcaggctgtggaatcaggaagaatcttgactacgtgacaccccagttatgtgaccttagacattatttaacatct

SEQ ID NO: 102519 - DNA, 143 bp, Homo sapiens
ctcctattctttgatgcatccttttcttatcattccaccagctctaaaactgaactctgcatctccttaaccacacaccagtatttcctcctgacatctatatttttcaaaagtttgctcctttacactcttttcttcttccc

SEQ ID NO: 102520 - DNA, 408 bp, Homo sapiens
cgttgcccggaagtctgatgcgtgaggcgggaaggttaaaacttgttggctttggaggtttactgataggtcgttctgagtaggacaaatgttttcctttccgtgctttaaaagtctcatcttagaccgggcacagtgactcatgcctgtaatctcagcctcctgagtagctgggattacaggtatgagccaccgtgctcggccttcattattatttttaggacaaaagtgaaggtggaaagttcggaccagtgggctgtatgtttcagaactttacacataggaagaggaagtattgtgtatggaagaaagtgagtgttgcattattcagggttctcagagaagcagaaccatatggaagaggaggtctgttaggggaattggttcgtgagattatggaggtccaga

SEQ ID NO: 102521 - DNA, 192 bp, Homo sapiens
tgtgttcactggagggagggagcgtgtgcgttgtgttcactggagggagggaccgtgcgccgtgtgttcactggagtagtgcccatgctcacctgaggcgttcttccgttacctgtcaaacgtccctagaaggtcatagaacggttacacgccgccattttgcctctcagtgcacacgcttgagccaactcg

SEQ ID NO: 102522 - DNA, 365 bp, Homo sapiens
aaaccaggctccctcctgacctcctagccagcctagtccagcttgccccaccttcacgtttccctggctcgcggctgctgggcatgaggctttgtgtctcccttcccgcctcaccaacgttctcacttcattccttcctgcgtcctggccctgcccttctccaaacgctcccaagcgttcaacctctgaggtttgcacctgctgtctctgctggctgaaacggccattccctgcctggcgaactcctgttcagcctccctggcccagctcaaacactcactgtggggaagcctgccctcatccccgaagctagtttcccagcatccacttctccattttgtcccccacctcctgccacggcccta

SEQ ID NO: 102523 - DNA, 194 bp, Homo sapiens
catctccaaaaaaaaaaataggcagtttcagagcttataaccatgataaggaacaggggctccccacggcatatcatttcttatatgaaagaaggccctaatagtaggaagtatcttagtgctgtcagaaaactatctgaattcacaagtgtcattaaatgttcccggccagaagggtttcttcattggaaagt

SEQ ID NO: 102524 - DNA, 307 bp, Homo sapiens
gacaatctggagaccctggaggttagtttttgacaagttaagtttggaaaacctgttagacattcaaacagagatgtcatgtaggcagttgaatgcacaagtttggatttcaggagattgttcagggctaaatgtatatttgtggttgtcctcagcatatatatggtattaaaatatcctgaagctggatgaggccacccaggggtacagtaaagacagagaactaagagattcagaactgagctctgagaaatccggtatttaggtattggacgatgagaattcagcgaaataaaaatattaggga

SEQ ID NO: 102525 - DNA, 708 bp, Homo sapiens
ggttgaactttgcagccccttccgtctccgggcagcttctctcagtggcagctgtgttccccatggtttgtcctggatgtctcccttgtgccatccttgcaagcccgcgccagcgcctccacccacgctccggccttgctcccactcccaccgctctgccacctcccacctcagcctcccaccttggtgtggagggaccagcgtcgaagacaaaggaatctctgacgagaaccggccagtccgggagggacggcggggaagggggtgctgctctggcggagccctcacttcactcgcttcccctcgagcgcccctctaggctggggcccggccgctctgggcctgctcctcctcccgctcctgttgcggggcaccaggtcagaccctacagggggctccgcagggggagggggagaggggctcccttcaaactcggcccggccgcgggggtcccgggtgccctctgctgggctccttccacgtccttgtccctcctgaactcccgttcaagccctgccccggccccgaagtaggaaacggattcgtttttgccccgcccggggttccggcggcccgcccgcttcagcttcagcaacgtcaaggccacgttccctccgctccagctcgaaagacggtggcgctgactctgctctgcgcgccgcagcttcctcccgctgctccgcccagcggtttctgatcccctttcgg

SEQ ID NO: 102526 - DNA, 347 bp, Homo sapiens
gaataacctccccacaacgtaacaacaggtactttttttttgggtggggggaggagggacaaagtctcactttgtctcccaggctggaatgcaatggtgcagtctcggctcactgcaacctcaacctctgagattcaagtggttctctcacctcagcctccctacaggtgcataccatcatacccagctaatttttgtatttttttgtagagacaggatctcaccatgttgcccatgctggcagagccttatctccctttgtttaggctggaaatgtcaaatattcactttcccagcttccttggtaactaggacatgggaatatgtcccatttctccaaaagtctt

SEQ ID NO: 102527 - DNA, 277 bp, Homo sapiens
ctctagtgatcccccttgcgccagggtctcatctccattgcccaggttggtctcaaattcctgaactcaagccaacctgctgcctcagcctccgaaagtgctaggaccacaggcatacaccaccacacccaactaatttttttaaaatttttttgtaaaaaccaggtctcattatgttgctcagacttagaatgagtgaatgagtgcttctattttttcctgatacatggcttaagtgtatagctcaatgaattatttgtcccctattcagtcagta

SEQ ID NO: 102528 - DNA, 476 bp, Homo sapiens
aattaattttttttttttttagagacaagttctacattgcccaggcaggtcttgaactcttgggctcaagtgatcttcctaccttagtaggaaagtgctagtattacagatgtgagccattacactggcaattcttgagaggtggttgtaagaaatacaaccaagactggggagaaatgtcaatttaatcaagctggcaatagaatttagggttacaaacagggctgaatcccaagacatattttcctgtatgcctcctaaggtggtgagaagtaattccaaatggatttctcaagatgttctgaacagcagcagcatcagaggaaaaacaggtttcaaggtgactgctttgaaggatatattcctttgaatttattatttatgaacaattaaaaaccaacttctggtcagttgtggtagctcacacctgtaatcccagcactatgggagataaaagtgggaagatcacttgaggc

SEQ ID NO: 102529 - DNA, 423 bp, Homo sapiens
aattaattttttttttttttagagacaagttctacattgcccaggcaggtcttgaactcttgggctcaagtgatcttcctaccttagtaggaaagtgctagtattacagatgtgagccattacactggcaattcttgagaggtggttgtaagaaatacaaccaagactggggagaaatgtcaatttaatcaagctggcaatagaatttagggttacaaacagggctgaatcccaagacatattttcctgtatgcctcctaaggtggtgagaagtaattccaaatggatttctcaagatgttctgaacagcagcagcatcagaggaaaaacaggtttcaaggtgactgctttgaaggatatattcctttgccagcttgattaaattgacatttctccccagtgtcttggggacagagctcgatt

SEQ ID NO: 102530 - DNA, 596 bp, Homo sapiens
gtttccactcaatgcagttgtctcagctacccacaatatattaccgctaggatttctttagctttaggaattgtcgataggcaattcttctgatctgcccataagaacatttttaaggggtcaaaggtgagcccatctcatggcaatacgataaccatgtaaattaggttcactgctagttttcagaaaagccattagtactttctacacaagtggatattaaaaatatctacaagaatattttattataaaataataaaaagtactaatgggacttctatatctatagattattggtaatctttgagcaatatcattgacaaattaattttcagtagcaaaactgaataaaactaagctcttttagctattctccaaaactcttatgacaaaaggattccaccatattgtacgctttagcatttgtaactcgtcaagaattgtttttatttctcaagtgtactacttgtatatagacacatatatgaccttattttatcacacatccaccttaaaaatacatagcaagtaaaagtagctcttaaagaaagtagctcttaaaagtagctctttagaaagcaacattgggtgcagga

SEQ ID NO: 102531 - DNA, 467 bp, Homo sapiens
tgcagtagggagatacagggaactgggcctgacttaggcttgagaaagttaaagtgagctatggtggtaggatagaagagcctattttaggattagccagccctacaaaagatccaggagccacatctatatatatttctgtggcctatgaaaaacagagtgcttgctgggcacagtggtgcatgccagtagtcccagctcctcagggggctgcagtaggaggatcgcttgaacccaggagttctgggctctagtgcactatgcccattgggtattcatactaagttcggcatcaatatggtgatctcctgggagcaggggatctctagattgcctaaggagaggtaaatggcccgggtgagaaatggagcaggtcaaaactctgtgctgactaatagtgagatagcacctgagaatacccactgcactccaacctggccaacacagaaagacactgtgtctttata

SEQ ID NO: 102532 - DNA, 184 bp, Homo sapiens
atgattgatgatgacggtcatcatcaatcatcatcatcatcatcatcatcatcattatcaccatacttagttttggcataactcctggtccatttggtcctccaagtttatttagccttcaactacgccttgctctaagattgctctaccagtctctcttctgagttttgagctgattagcaat

SEQ ID NO: 102533 - DNA, 483 bp, Homo sapiens
aagtcaaagtaatatcaaatcctaaattcagttgatctgggccgagcatggtggctcatgcctgtaatcccaccactttgggtggccgaggggggcagattacttgggctcaggagtcggagaccagcctgggcaacatggcgagatcctgtctctgcaaaatatacaaaaattagctgggtgtggtgtcagatgcctgtagtcccagctacttgtgaggctgaggtgggaggatcgtttgagcctgcaaggtggaggttgcagtgagctcagatggtgccactgcactccagcctgggtgacagagtcagaccctatctcaaaaaaataaaaaataaataaaaaatcagttgaactatatggaaacttctgtacctgtgtcaacggtgcatcttatctaatactatatgatactgtaatctaatattatctctgataattcaaaaatgctaataaactctgctcaaatgtgaaaaattttca

SEQ ID NO: 102534 - DNA, 271 bp, Homo sapiens
ctgagatgtgctgaagaggcagggaattgcttcctgccccacgacacagagaaacgtgtgtctgctcaatgcctcattcaaggagacgagtggctttctgtgaggagagaaattatcccccttcccatctttcctgatcatcataacccccactttacaaaatgagaatacagagacacagagaaggtaagtaacttgcccaaggtcacacagttagtaagtggcagagccaggatttaaaccaagactccagcatcgagcccctaaccac

SEQ ID NO: 102535 - DNA, 313 bp, Homo sapiens
gttagaattacaagcatcaatatgcataaaatgcttagagatggacctgatatatagcaaacactcagtaaatgttaactattattatcacagcacagcaatttatttaagattactgagtgttcaaatgaaaaaaaagacatattaacttatatagtgccatttctgacataagaaatacacaaatagaggtagtttctgaaacaaagaccaaaaaaatctattgtatggtgtcttgtatcaatgtggctaaaattttcgagctaagttttataaagacagatcatatttcaagtaggtgatttttgtattg

SEQ ID NO: 102536 - DNA, 826 bp, Homo sapiens
cccgattacaagttcaacaggctttgctacttgcattgcttggcaagtgcatttggcacgtttcccaggtataattgataatcactatcctcatgtaaaattatttcagttccttaaactcacgtcttggattttacgtaacattactagaaacaccccattacctgaagctgtcactgttttcactgatgcttcctctaatggccgagcagcatatacaggacccagagaacgtgttcttaacacaggggctatttcagcacaacgagctgaactgcctgctgttatggctgtccttgaagattttcctgagccagttaacattttctctgactcagcgtatgtcgtacatgttgctcgcaacattgaaactgccttaatcaaatttctgcctgatgataacctattccttctttttcaaaagtttcagtctgtgctcagagcaaggtcttctcctttctacagtactcacattcgggcccacacacccctccccggacccctctcggcagcaaatgccagagctgatacattagttactcccgtttttacagatgcagaaaattttcatgctttaactcacgtcaatgctgcgggactccgaaacaagttcccccttacatggaagcaagctaaaactactgtgcgtcactgtcctacttgtcaagtgttaattttaccaccactgtcttcaggagttaaccctagaggactttcacagaatgctctttggcaaatggatgtgactcattatcctccttttggcaagctttcttttatacatgtaactattgataccttttctcattttatttgggccacttgt

SEQ ID NO: 102537 - DNA, 364 bp, Homo sapiens
gagccacctttatgttagtgcatgccatgagaatacctacagtgcatgccatgggaatctaatggtgattcgttccacttctaagagttgactaaaggccaggtttatcagatgtgcagtttatatttggactacagatattagtgactgggaaaagagctttcatgttaacttctttgtaatgtagcatcatcctgcaacttcagattttacaggttagattatgatttcagttttcatagaatagttgttggcctttaggttggctagagtcggaaagaactaaaatgaatcattttgtccttgtgtgcttagtatagttgatagtgttcttcctaattcttgtttttatagtatcataagc

SEQ ID NO: 102538 - DNA, 327 bp, Homo sapiens
aaacagagtctctcagttcattgcctgggaagtcctaaccgttcttcgatagaattgtttgtcgtggccaggcatggtggctcaacgcctgtaatccatgcactttgggaggccgaggtgggcggatcacgacgtcaggagttcaagaccagcctggtcaatatagtgagagacaccatctctactaaaaacacaaaaattagccaggcatggtggggtgcacctgtaatcccagctacttgggaggctgaggcaggagaattgcttgaacccaggaggcggaggttgcagtgagtagagatcgtgccactgcactccagcctgggt

SEQ ID NO: 102539 - DNA, 348 bp, Homo sapiens
tttagttgctggcgggtccttctccctggaggaaggaagctgttattcttgacgataccagcctgggcttgggccagggcgccccaaagaaagaggtgatctgcagaactccagcataacagggaggagggcctgctgggctgtggcatgggcaccataacagggaggagggcctgctggggccatggcatgggcaccattgtgggcttggattctggccagggcagggaggaccgtccactggggagagacaccagcccctgcctccactctgtctggggacacaacccatccatggcctgacctgcttacctactatgtgccagctaccctgggaagcctctggtc

SEQ ID NO: 102540 - DNA, 549 bp, Homo sapiens
ccaggtccaatccatacttcttcctccacgattggagcagagggtgatttttttttatgagcaacggatgaagtcatttagagaccatttgcagtaggagccctgtgtactagagaccaatcaatgtgccctcgtggctccatttctgcctctctccctctttgttcttgccaagtacccacagctcattttccatagattaaaagagcccaagttgggcctatacctagaagtacaattgctgggtcatttggtaactccatgtagaattgtttgggaagttgttaaactgtttctcacagtggctacacaattttaactcctaccagcagtgtatgaaagttctagtttctctgcatcctcaccaacacttgttattttccgtattttttttttttgagacaaagtcttgctctgtcgcccaggctggagtgcagtggcacaatctcagctcactgcaacctctgcctcccagattcaagttactctcctgcctcagcctccagagtagctggtattatagtcacctgccaacatgcctggctaatt

SEQ ID NO: 102541 - DNA, 772 bp, Homo sapiens
ggtcttgcccactcccaccccaccagccaaggccaaggccatctcctctggcccaactaagtctcctaacctggaaccccacctccttcccccagtccaggaggagccctcctcccaatcccaggacttcccaggtgggctctctgtgtgggggcttagcaagctgagggctttccctgctcagatcagatcatcagggagcctgaccaacccaccccagccttgagtgccacccaaaggtctggcctgtgggatctgagatgccaggcagcccctcgccctgccagagcagcaccgtggaagaactcgtgagtcttttaagctaggcattgacctagctgcagcttccggaaggagacagcagagccccgcattagctcagtgacttgaggccaggaagccaggggtggggctaaccaaagcttgccaggccggggtgggagctacaggtgaaggaaagtgattctttccccgttaactttgtttcacgccagatacctggcagtgggcaaagcagagcctgggctgcagagcctgtgctccggagcctgggctccaaagccctgggttccgggctctgacttaactgccaaaaatacaaaaattagcccagcatggtggtgcattcctgtaatcgcagctactcaggaggctgaggcaggagaatcacttgaaccagggaggtggaggttgcaatgagccgacatcgcgccacagcactccagcctggcgacagaggaagactctgtctcaaaaaaaaaaaaaaaaaaaa

SEQ ID NO: 102542 - DNA, 141 bp, Homo sapiens
tgctgagattacaggcatgagccactgcatgcagccttatccaactttttattgtgaaattctttcaaacatacagcaaagttgaagattactttttctatttttgtttgtcacaagatcttaagataaggatgtgtttaa

SEQ ID NO: 102543 - DNA, 677 bp, Homo sapiens
taaggcttttaaaaaatatatatgaataagactataaggaaaaaaaaacagaatgctaaccctgggtgtgttagggtggtagatttaagggtatatttttctgagcttttctttttgctcagctttttgtggataatgtggttataatgctctcataataaaatatgattatttagaatggcaatataatttttttcattgctactatttggaagcaactgtatgaaacattttgtgtgagagcattgtgttgtttgaagcctattgaaaatatatttacccaaaaatacaggttttcattttacccaatctctacccttccccaatccctactagatttaaattctttgagaatttttccaaataaaaggaagattttgtccacttttaagatcctgaagttcttgagtataatctccctcctccctttttttaaaggactgaagagagaacaaaacaattcccctctgatcgtttctgtaagcacttttgaaacttacaataaggtactaattcagccagataattgaatgctctccaccccatactatatactatatatattctgcattgttgtatctagagcgctgaccactccgtttctcttgtgtatgctgagccttctccacctaggttccctgctccctgaacacaagggcagcccctctttttacagt

SEQ ID NO: 102544 - DNA, 275 bp, Homo sapiens
gactattattgactatgtaactaataaatgttattatggtacttttagattaaaagtctattccaaattgcattttgatttttcagatgttctaaattctagtgtgtaaatattataaaagtattgacattttgaagtgggtggagttccgtcgcctctctttggattagcttctaaaacttaatgaaatagaaagtaagtgtcttttcccactgaaaaaaaggttacattttattccttattgtacggagacccaaataaaatagacaaatcag

SEQ ID NO: 102545 - DNA, 355 bp, Homo sapiens
caacagccaaatgaacaacttcacctgagcccttacctccaaggaagtgccacaggggaacccaaaggcccttaatcattaaaaaaaactttagagatgctggctgagccatcagtgagaacatggatgcatacacagaacctacatcttgtcatctctgctcttcgaggaatggagctggagaggcagagaagcaatgaagccgaattctgagtagtatactctgatgaagaggatattttacaagcatagaaaaaggagggctccagtcttcaaagaaccagagcatgggtaccaaagcctcccagagctagttctggtcccagctcagccacttgtctgtttgggtgactat

SEQ ID NO: 102546 - DNA, 355 bp, Homo sapiens
gcttcccaggttcaagtgattctcctgcctcagcctcccaagtaactgggattacaggcacgtgccaccatgcccggccaacttttgtatttttagtggagacaggattttgccatgttggccaggctggtctcgaactcctgacctcaagtgatctgcctgccttggccttccaaagtgctgggattacaggtgtgagccactgctcctggcccttaactattttttttttttaaccttccacagtccttttattttggaataggctgtaaacaatcaaaccacgagaacatgattgtacaacagtaaaatgttctcctgtattaaactgaagatatctgtttaataaaaaaaa

SEQ ID NO: 102547 - DNA, 312 bp, Homo sapiens
acaatcttagcaagtgctatcctcattatacatgtgagaaaacctatccttaaatgttaatttgtccaaggttaagttaaacaagcttgaacggatttgtgacaatactcaaggttctaaacactacagaacctctgcccccacagggccatagattccactccttgaataaaacaaacattaaaaactctagataatcctacactaaaatagcacaaatcctgtccatctattaggaaccaattactcaagaaaaagctaaagggccacacacttcatgcaagcatcatatgtaaagggaattaaaagaat

SEQ ID NO: 102548 - DNA, 383 bp, Homo sapiens
gtggggtggggggagaggggacggatagcattaggagatatacctaatgtaaatgatgagttaatgggtgcagcacaccaacatggcacatgtatacatatgtaacaaacctgcacgttgtatacatgtaccctagaacttaaagtataataaaaagaaatattaaaaaaaataaaataaaataagagatctcaaagacaaagcttaaagtagattcgataaaatctcaaacattcacatttaacctcaggataactcatgtgtgagtagtaaacggaaggaaaacattttcacatgatataaaattttgctgttcctgtaaatgatagatagaagtaaactcatgtatgttgacagaaattgaacttgacacacacaaaaat

SEQ ID NO: 102549 - DNA, 281 bp, Homo sapiens
tccaatccagaaaactcaaaaccataagtaatgttaaacaaatcccctttttaataaattcctcaacttccaatttctaaataccaaatgtacttataaaataggctaattatttcctaacaggtcctaagatatcagttcgtcctatttaacttatcttagagttgaaagatgagagacaacatatgccaaagtgacaattttataatgaagtttttcttttctttttaagacggagtttcgctcttgttgcccaggctggagtgcaatggtgctatctc

SEQ ID NO: 102550 - DNA, 400 bp, Homo sapiens
aactactaaaaaatgctgagggaattatgccaaccaaaatttcaaatatagtgtaagacaactaatatagcactctattgatatggaaatcaattcatcagtaaaacagaatagaaagttcataaatacactaattactataaaaaataacacaggcacagtgactcacacttgtaatcccagtaatttaggaggctgaggcaagaggatggcttgaggccgggagtttgaaatcagcccagataacatagtgagacccctgtctttacaaaaaattcaaaaaattagctatgggtagtggtgcctgcctgcagttctagctgctcgagaggctaaggcgggaggatcgcttgagcccaggagtttgaggttgcagtaaactataatctcacaactgcac

SEQ ID NO: 102551 - DNA, 146 bp, Homo sapiens
gaagaggaaaatgaaactcagagctgcaggacttgcccaaggcctccaggcagctaatggccggggccagaatgggaaccaaggaccccggaaccccagagctcctgccctctctgtgcccacagatggaatctactcctctgcag

SEQ ID NO: 102552 - DNA, 387 bp, Homo sapiens
agctatactgctaatacactgacttaccttggacaggtttcttaccgtgtctttaaagcagggataataatacacaccttattgggttagtgtgcagatataaggagatgatccatgtaaagtcccaagtataatgccaggaagttagtaggtgattattaaaagttagtcattatttttgtgtctctcttattggtgctgatatcagaagtattataaaaggatattactatagttgatgttactgaaatcttctacaatgagggtgccaacatgtgttcctgagtccacttatcgtcatcaccattgctgccaaagcaattgttatggctttgttagcctccccatttaatttagcaaatactgaactccttaaaccaagcttta

SEQ ID NO: 102553 - DNA, 327 bp, Homo sapiens
agctcacaggagtcagatctgcaagcagggttaggtgggcctgtttttcatcccttccatcacccatgcctgaccccagagagtcttccatggaaagagagaaacagaggacatgcaagagccagggaaatgggaagcagatatggcaaaatattaaaaatgggtgaatctaggtgaagggcacatgggtgcttattgttctattcattcgatctgagatttgaaaactcttaaaataaaaagttaggaataaataataaactaccctgcaagtaaaacctgctcttatcacccacctctctgggttttcaattccctccctgtaac

SEQ ID NO: 102554 - DNA, 419 bp, Homo sapiens
acgtggacttagcagtgcacacagagctaatgggcactttctggggatgatctgccatgatgttatgtttcaaaagcacacattagagtaggtggttcttctgaaggtgaaatgcccttctctgataccagactcgtacttattctatatcgtgacatcagaacattttgaaagccactatttgtaaaataagctgcccctgtaataaaaagactgcttcatatgattgttttggtgtaagttagtactgatttattctccagaaacctgttggacctgagtattcacctgtaaggtgaaaccaaattgcaggtttggttcttgagggatccaggcagaggcacgccttacaggtgaactgggtgggtacgctgaccctgccaacgtcactgtgagggatttagctgcctccttagaga

SEQ ID NO: 102555 - DNA, 306 bp, Homo sapiens
cagaatctcagttcatggctaaggccaggttgtgatctaagactactaacatgtcctgatcggaagttatcggccccctgctttgttgcctgttctggctgtgagcttgcagggcagggccatgtttattacttgtgtacaccccaagggcatcgttctgtatgaacttgtagtcacttatacttgaaaaaatgttggcttgaaaaaagagccacgctttgtttttagaacactttttctcttaaaaaagataaaactatttttcattttttaatttaatttttttcttttgagataggatgttgc

SEQ ID NO: 102556 - DNA, 126 bp, Homo sapiens
gtaacactcggggggggtttcggtcccgccgccgccgccgccgccgccaccgccgccgccgccgccgccccgacccgcgcgccctcccgagggaggacgcggggccggggggcggagacgggggag

SEQ ID NO: 102557 - DNA, 349 bp, Homo sapiens
tgagacggagtcctgttctgtcacccaggctggagtgcagtggtgcgatctcagctcactgcaagctctgcctcctgggttcactaatttttttgtatttttagtagagacggggtttcactgtgttagccaggatggtctcgatttcctgacctcatgatccacccacatcggcctcccaaagggtgaattctttatttcaattcctaaataactttgtcctattttatagtcagaacaacgagaacaaatgtatggtgtgagcaaagagatgaggtgagggagtacattaaatagatgactattaaatacatagttcaatgataaagatagcagtatagtttcaaac

SEQ ID NO: 102558 - DNA, 521 bp, Homo sapiens
ctcttccctcagtcccaatatcactgggtcaaaataacaggaaacggaggtctcacctaagtctcctcctccaatagataggaaaaaggacagaggatatgctatagccatcagtgtgttagatatgagttctaaatttctctttaaagaatcagtatgtcagtatgttcaattctttgccttctacttgtaaacttaacttcctcataaagcaacctttttcgattacctgctccatcctgactcattccgatttcctgctctgccataaccatttttcccgccaaaccactcaccctgtcactctctttaaattagccagttggagttagtttggcctgtgtggtctaaccctagccaataggggaatgacacagcagcaggggccatgtgcatcagggataagaaccctttcccctcccttgtccaggtgtgcactcaaccattgctccatctgtaagggcgcacccttctgtagaagtacattgacttgctgagaattaaaaagaaaattttatatt

SEQ ID NO: 102559 - DNA, 387 bp, Homo sapiens
gacctgaggcagagtcatctctaccttacactttgacaatctcctttgctgtacaacttatcatttgctgaacaaacaaactgcatgtctaagcttcctctcccttcatgccagactactagaaaggcacatctacactcagcaccatgtatacatccatgcatttcctttccccacaacctctatccttcttctgaaatactcttgggtcctcccagtcaccaaatcccatggtttttcttggcctgcatccttcttgactcttctgtgacactgcagactcaactcaatcaaaactgaacttaatgctcttctcctccattcccaccactgctgactgtgctcacaatcctcccagttaagccaaagcctcctggtcttcactga

SEQ ID NO: 102560 - DNA, 185 bp, Homo sapiens
tgtcctcgctccggggcgtggagacagcggtggggagatctctgctgtgtgttcctagtatacactggctgggctgtgtgctacgtgtacggcctgtcctcgtggggtttacagtcacagccacaggcatggtcatctagcaaagctctggcagtgcagcctccccattttcaggcaggtcaaaa

SEQ ID NO: 102561 - DNA, 917 bp, Homo sapiens
gcgctgtccagcatttcagcaagcggcggcagcacccgcggggaggcagagggtgcggggccgtgggggccgcggagctgccctgcccaactcagcccagactaggcggcagcccggaccggcgggacccgagggcctggccccagcgcccggtagatcgcggcggtcagcggtgagggccagcggcccaggccagcggctccagggccagccacgatgtcctccaccgtgaacaacggggcggccagcatgcagtccacacccgacgccgcgaacggcttcccgcagcccagctcctcctcggggacctggccgcgggcggaagaggagctgcgcgccgcggagccgggcctggtgaagcgcgcgcaccgcgagatcctggaccacgagcgcaagcggcgggtggagctcaagtgcatggagctgcaggagatgatggaggagcaggggtattcggaggaggagattcggcagaaagtggggacattccggcagatgctgatggagaaggagggagtgctcaccagggaggaccggcctgggggccacattgtggcggagaccccgcggctgaccgagggcgctgagccgggcctggagtacgcgccctttgacgatgacgacggcccagtggactgtgactgcccggcctcctgctaccgcggccaccgcgggtacaggaccaagcattggtctagcagctcggcatcgccccctcccaagaaaaagaagaaaaagaaaggcggccaccggagaagccgcaaaaagaggagactggagtccgaatgcagctgtgggagctcctcacccctccgcaagaagaagaagagtgtgaagaagcatcgccgagacaggtctgattctgggtcccggaggaagagacggcacagatctcgaagctaccaagtgcaaaaaaa

SEQ ID NO: 102562 - DNA, 534 bp, Homo sapiens
gtctcttaaacaaaaatggagttaattatattcattcatttgctgttccgctatcccaccgggtagcagcccgcagacttgcggggctaggtcaggccccctgcgccgagaaaaggggtgaagaaaagtcgtcccgagactggtggtgagcgtccctgtcgccggcagtgtggcggagaccccgcggctgaccgagggcgctgagccgggcctggagtacgcgccctttgacgatgacgacggcccagtggactgtgactgcccggcctcctgctaccgcggccaccgcgggtacaggaccaagcattggtctagcagctcggcatcgccccctcccaagaaaaagaagaaaaagaaaggcggccaccggagaagccgcaaaaagaggagactggagtccgaatgcagctgtgggagctcctcacccctccgcaagaagaagaagagtgtgaagaagcatcgccgagacaggtctgattctgggtcccggaggaagagacggcacagatctcgaagctaccaagtgcaaaaaaa

SEQ ID NO: 102563 - DNA, 2216 bp, Homo sapiens
ccacacacacaggacccgcatcctgggtgatgaagtcagacacgcagcagctgggtgagtgctaacgctcagataagcatctgtgccattgtggggactccctgggctgctctgcacccggacacttgctctgtccccgccatgtacaacgggtcgtgctgccgcatcgagggggacaccatctcccaggtgatgccgccgctgctcattgtggcctttgtgctgggcgcactaggcaatggggtcgccctgtgtggtttctgcttccacatgaagacctggaagcccagcactgtttaccttttcaatttggccgtggctgatttcctccttatgatctgcctgccttttcggacagactattacctcagacgtagacactgggcttttggggacattccctgccgagtggggctcttcacgttggccatgaacagggccgggagcatcgtgttccttacggtggtggctgcggacaggtatttcaaagtggtccacccccaccacgcggtgaacactatctccacccgggtggcggctggcatcgtctgcaccctgtgggccctggtcatcctgggaacagtgtatcttttgctggagaaccatctctgcgtgcaagagacggccgtctcctgtgagagcttcatcatggagtcggccaatggctggcatgacatcatgttccagctggagttctttatgcccctcggcatcatcttattttgctccttcaagattgtttggagcctgaggcggaggcagcagctggccagacaggctcggatgaagaaggcgacccggttcatcatggtggtggcaattgtgttcatcacatgctacctgcccagcgtgtctgctagactctatttcctctggacggtgccctcgagtgcctgcgatccctctgtccatggggccctgcacataaccctcagcttcacctacatgaacagcatgctggatcccctggtgtattatttttcaagcccctcctttcccaaattctacaacaagctcaaaatctgcagtctgaaacccaagcagccaggacactcaaaaacacaaaggccggaagagatgccaatttcgaacctcggtcgcaggagttgcatcagtgtggcaaatagtttccaaagccagtctgatgggcaatgggatccccacattgttgagtggcactgaacaagcagaccaacaacactgaggaagatagagtggtgacttagaattaactcgtgctaaggggtcgggggctttgaaaatgccacccccctttcttattgcaagacggcttctcgcacatgaactgcatccttctcattctgtcggaaatgaaattcacacaactataccttttggggaggttccagttgattgaagtgagttggctgcattttcttatctgatcacaatggcaggggacagaatgtgcatggagtggagcatgtgtgtgttgggaggggggctaggaactgcacagcccttgtgtaattttcgttgtttgtttttgttttgagacagagtctcactctgtgtcccaggctggagtgcagtggcacagtctcggctcactgcaacctctgcctcccgggttcaagcaattctcctgcctcagcctcccgagtagctgggattagaggcgccagccaacacacccggctaatttttgtatttttagtggagacagggttttgccatgttggccaggctggtctcgagctcctgacctcaggtgatccgcctgccttggcctcccaaagtggtgggatcacaggcgtgagccaccgtgcccggcctcccctgtgtcattttaaatggctaagtaaatgggtatatgtgtttgaatggggcatgtcactctcttagggctatggggcagttagcagcatttcctatcctctgaccttaaatcattccttatctcagaaaacagaaaccgggctcagtcaatcaatgctttatttcaggccgaatgaggctctttagattgggatctattgatctatcaattttcatctttacatttctttgtacatctgtacattttgtccaaatgtacatctgtacgtctgtcatcattgtgacttcctggtagcccaagaagaacaacaacaaaacaatctgctctgaccttcttcaaatctttgtatttcaaagaaggtgctgagggatctgtttccttgccctggcttctccagtgggatgtgctgagtcca

SEQ ID NO: 102564 - DNA, 384 bp, Homo sapiens
cagcaggtttctgagatttgctgaacagatgaatagatatttgggtagcatcactgcagggtgatataataagactatgggtaggaactcaaggggaagggactcttctcccgctcccaaccaaccagagtttgttaatctctgactatcaaagagaatatggcaagccctaaaacttaacatggtgcttccatccccagcaaacaataactgaaatgtaaaacaaaatttctgagcttcctatgattttgccattgctggggaagaagaaaacaccatctgcagcacatgtttctattcagacttgaacctcacttcatctcaccagacaattctgaaagcacttcagcattctttccagtaccatctttgctagtctgtccc

SEQ ID NO: 102565 - DNA, 297 bp, Homo sapiens
cttcatccagtttcctctggtggttacatctttcttagctgtagtatacagtatcaaaactaggaaattgacattggtacagtgtgtgtatggttctgtgttattttatcccatgtgtaggtttggataacccagccgcaattaagatacagatatatggcaccaccacaaagattccctttgtgccatccctttatagtcatactgctcctctctacgccaccttctctaacccctaaacagtcagaattctaagatactcccagaaaagaatgactgtgcagatgtctttgtcat

SEQ ID NO: 102566 - DNA, 324 bp, Homo sapiens
cagagcaagactcggtctcgggggaaaaaaaagaaaagaaagaaacaaagagcatccactttccacctttcacacacaacacagccaattaaatcaaaagattccactatcatagcataataccccttgagttttcaggcagataagacactcagacacaccttgcttgttatagaacaggcccaaatgagacacaataaaacgatgattccatgttaggaattccctaccaaccatatcctcctctttttggtgactagattgtaaaataagtcaattaagagttcataacggaagtgctgaagcaaccgcaaatccagacac

SEQ ID NO: 102567 - DNA, 521 bp, Homo sapiens
gtgggttgaacaggtgttggtttaagtcagcatctcacttttacagaggaaaagctgaggttcagaaaatttatttttccaaggctgtggcaggaccaagattcgaactgtaactcccagctctgtgacttaatcctcaaacttgtggactttgatcctaataattcttgtcagaaatagttaaatactgctatcagttgccataaataaaaattggatatagaaatacatatataaagccgggcgtggtggctcacgcctgtaatcccagcactttgggaggccgaggcgggcagatcacaaggtcagaagatcgagaccatcctggctaacacagtgaaaccccgtctctactaaaaatatttaaaaaattagccgggcgtggtggcaggtgcctgtagtcccagctactcgggaggctgaggcaggagaatggcgtgaacccgggaggcggagcttgcagtgagcggagatcgagccactgcactccagcttgggcgacagagtgagacttgtctcag

SEQ ID NO: 102568 - DNA, 2337 bp, Homo sapiens
ggggccagcccgctgacagattctcggtggcggcggcagcggcggcggccctggactgcggggaatgggaatcctaggtccctgactgagcacctcccccgcctccctgcccccgacatggctcaggagaagatggagctagacctggagctgcctccgggtacgggcgggagcccggcggagggcggtggcagcggcggcggcgggggcctcaggaggtctaacagcgcccccctgatccacggcctcagtgacacttcgccggtgttccaggccgaggcgccgagcgccaggcggaacagcacaacgttcccgagccgccacggcctgctgctgccggcctcccctgtccgcatgcacagcagccgcttgcaccagatcaaacaagaagagggcatggacttgatcaaccgagagacggtccacgaacgggaggtgcagaccgcaatgcagataagccactcctgggaggaaagtttcagcctgagtgacaacgacgtggagaaatccgcctcccccaagcgcatcgatttcattcctgtgtcaccagcaccgtcacccactcggggaattgggaagcagtgtttttcgccatccttgcaaagttttgtaagtagcaacggattgcctccaagccctattcccagcccaacgacccgatttaccacccggagaagccagagccccatcaattgcattagaccaagtgttcttggaccattgaaaagaaaatgtgaaatggaaactgaatatcagccaaagagatttttccagggcatcaccaacatgctttcttctgacgttgcacagctgtcagatcctggtgtgtgtgtatcttcggatacccttgatggaaacagcagcagtgccggatcttcttgtaactcaccagcgaaagtcagcactaccaccgactctcctgtgtcacctgcccaagcggcttctccatttattccactagatgaactttcgtctaagtgattcactcatcctgagactttctttttgcagtggagagagagaataatctagttggggcaaacactgaactttgtcaattaatttgaggctatttcctatttgaccccttttcttttttgaaattccctgaaatgatgttattctagagaacttctatgtcaggttcctttggatacccttgaattcagtgtagtaatattttcagacgtttccccaataagtgtgttgaagcatacatctttacgctgctaatatgtctaaatacatatgttatcccttgatttttttaaataactgagagctctatttatttatgggattattaagttctgatgaaaatataaatgttgacttaatcagcatagtaaactgatgtttaaaattccatacttcatgcccacactaatttttaatgttattttcagtggttgccgatttccatttgatgaagaactatacagcttaaaaaaatacgttagttatatctatctagtggttgtctgttttacccaggaattcttggatatttagttttctgggtactgaagtggatgggagggggaatgattaaagaacaaattataaaagtttgaacaaatcttttcaaattaagtatataaaagtaaacttttaagaaaaacatttttaatgagattttaatagtaattctagtcagtcatacaactataactactatagagaaaataaaatttttcctttttttttttaaccggaaagtgcatttgcttgggtgtaatcctaaagtgaaatgggacagtgccttgcagtctttgcccactgtacataggctaaggctaagctctttgtactactgcaaacttaaaagtttttcaaatgtgggaaacgtgtgggaaggcttgttgaactttggcgcactcaggtaaacaatactctctcaattgttgatatactttaaaatattcagttgtgcctcagttccagaaattattgccaaacaggagccacagcaatttttggctacttttctgctctgcccatctgtcaccttactggttttcccttgttcaggaaggaagcagctgtttccttgccaacaggtcccttcctctccatctcccaccaaactagggcaccattgattagacaaaggtacagtgtaacttgggtttctgacagcaacaacaggactgtgaattgtttaacctctgtggttaaagctacagcttgagttgactgccttggggatgtcagttaattaaggggtgatgatttgcaagagaaaattagtggagagtcacataggtaaatcattatttaacttaggttttcctaaagttagaatagtcgaatgttcttttctttacctttacaatt

SEQ ID NO: 102569 - DNA, 1260 bp, Homo sapiens
ggggccagcccgctgacagattctcggtggcggcggcagcggcggcggccctggactgcggggaatgggaatcctaggtccctgactgagcacctcccccgcctccctgcccccgacatggctcaggagaagatggagctagacctggagctgcctccgggtacgggcgggagcccggcggagggcggtggcagcggcggcggcgggggcctcaggaggtctaacagcgcccccctgatccacggcctcagtgacacttcgccggtgttccaggccgaggcgccgagcgccaggcggaacagcacaacgttcccgagccgccacggcctgctgctgccggcctcccctgtccgcatgcacagcagccgcttgcaccagatcaaacaagaagagggcatggacttgatcaaccgagagacggtccacgaacgggaggtgcagaccgcaatgcagataagccactcctgggaggaaagtttcagcctgagtgacaacgacgtggagaaatccgcctcccccaagcgcatcgatttcattcctgtgtcaccagcaccgtcacccactcggggaattgggaagcagtgtttttcgccatccttgcaaagttttgtaagtagcaacggattgcctccaagccctattcccagcccaacgacccgatttaccacccggagaagccagagccccatcaattgcattagaccaagtgttcttggaccattgaaaagaaaatgtgaaatggaaactgaatatcagccaaagagatttttccagggcatcaccaacatgctttcttctgacgttgcacagctgtcagatcctggtgtgtgtgtatcttcggatacccttgatggaaacagcagcagtgccggatcttcttgtaactcaccagcgaaagtcagcactaccaccgactctcctgtgtcacctgcccaagcggcttctccatttattccactagatgaactttcgtctaagtgattcactcatcctgagactttctttttgcagtggagagagagaataatctagttggggcaaacactgaactttgtcaattaatttgaggctatttcctatttgaccccttttcttttttgaaattccctgaaatgatgttattctagagaacttctatgtcaggttcctttggatacccttgaattcagtgtagtaatattttcagacgtttccccaataagtgtgttgaagcatacatctttacgctgctaatatgtctaaatacatatgttatccctt

SEQ ID NO: 102570 - DNA, 204 bp, Homo sapiens
gcgttgaagcacgtattgaccacgcctgtttccacggttcgtccgcattgaagcacgtattgaccacgcctgtttccacggttcgtccgcactgaagcacgtattgaccacgcctgtttccacggttcgtccgcattgaagcacgtattgaccacgcctgtttccacggttcgtccgcgttgaagcacgtattgaccacgcctg

SEQ ID NO: 102571 - DNA, 484 bp, Homo sapiens
gggatgcagatgccaagagttgcagagctcagagattttaggaaaggaggagacagcagcctggaaactgcaaggtggacattggctccatcttcagttgctttgatccaagagggatgggaataaaagcacaaccccctttcctctccctgacatacctcctggaaaaagctgcaggaatattggagtctcagaggcataagattttccattaaatcaagaaaaaaaaagaaagtttagaggtggaggattggagagattttgcttgtgatttggcatgaatttgagaaggcccagtggaaacttttggaatcactaagtctaggactcaaatcctacctttccagttattggccatgtagcttttggcacacttattgacctctgggatgacccaggttccttgcctatgctgttgtgaaagttaaagaaaataaggcatgcagagtgcccagtataaagtggccgtcagccagggccacac

SEQ ID NO: 102572 - DNA, 796 bp, Homo sapiens
gtttagatggtaacacggcattttgaatattggcttcctttcttgcaggcttgatttgcctgttgactgaattactagtgactagtttactaactaggtcattcaaggaagtcaagttaacttaaaagaaacatgtcacctaaatgcacttgatggtgttgaatgtccaccttcttaaattgttaagatgaacttagttctaaggaagataacaggccaaccctgaagtactcccagtttgctgcagaatctcacatattttggatgttatagaagagtcctatttgccctagttaatttaactttttttttgcctgttttgtggactggctggctcttttagaactctgtccaaaaagtgcatggactataacttgtaaagcttcccacaactgacaatatatatatgtgcatgtatttaaaccaaatctggaaaacttacaatacagctgcataatggtagtatttattaaagaatcacaattgtaaacatgagaataacttatggattctagtttagttctttagtaattgcaaattatatttttgctgttgttatattagaataatttttgaatgtcatcttgaaatagaaatatgtattttaagcactcatgcaaaggtaaatgaacactgtttaaatgtgtgctttgcttattttttctgtaacaatcgtaaacattaaactgaacaaattacctacagtagttttgattaatgacctaagagcaagctggtttggccagacagtgtacccaaacttttatataccatcgaatgttattacacttgtgaa

SEQ ID NO: 102573 - DNA, 1230 bp, Homo sapiens
ggcacgagctgatgctgaagtgaaaatcttactcttattcaacaggaagtggatgctttggaagaattaagcaggcagctttttctggaaacagctgatctatatgctaccaaggagagaatagaatactccaaaaccttcaaggggaaatattttaattttcttggttactttttctctatttactgtgtttggaaaattttcatggctaccatcaatattgtttttgatcgagttgggaaaacggatcctgtcacaagaggcattgagatcactgtgaattatctgggaatccaatttgatgtgaagttttggtcccaacacatttccttcattcttgttggaataatcatcgtcacatccatcagaggattgctgatcactcttaccaagttcttttatgccatctctagcagtaagtcctccaatgtcattgtcctgctattagcacagataatgggcatgtactttgtctcctctgtgctgctgatccgaatgagtatgcctttagaataccgcaccataatcactgaagtccttggagaactgcagttcaacttctatcaccgttggtttgatgtgatcttcctggtcagcgctctctctagcatactcttcctctatttggctcacaaacaggcaccagagaagcaaatggcaccttgaacttaagcctactacagactgttagaggccagtggtttcaaaatttagatataagaggggggaaaaatggaaccagggcctgacattttataaacaaacaaaatgctatggtagcatttttcaccttcatagcatactccttccccctcaggtgatactatgaccatgagtagcatcagccagaacatgagagggagaactaactcaagacaatactcagcagagagcatcccgtgtggatatgaggctggtgtagaggcggagaggagccaagaaactaaaggtgaaaaatacactggaactctggggcaagagatgtctatggtagctgagccaaacacgtaggatttccgttttaaggttcacatggaaaaggttatagctttgccttgagattgactcattaaaatcagagactgtaacacttttgccttacgttcattttatcaagcatagcttggtatttattatgcttgtgtgatctaacatgagttagcatcccacacctcctcttctgatcctgccccattaaaataaccaagaaagaggttatctgttcttttc

SEQ ID NO: 102574 - DNA, 461 bp, Homo sapiens
tcctgccaccctatgatcatgccactactgttaataacttttcaaaagtgttatttaggtcactgtgatattgagctgacagataataaagcaaattggaaaattaaatatcatcgatctctaaaattttgaaaaatgtgtcctgtaggtagagtcaaaatatagaatatttaaactaacatacaagagtaattgtataatcgattttctaaaaaatcccaaaacacagagcttccttacttctgccttatcagtagatctaatattaaaagcagtctttttaagaacttctatactcagatttctgcaaagatgcatactagagtataatatatattttagatgggtgtggtagctcacacctgtgatcccagcactttgggaggccaaggttggcagttcgcttgagcccagaagttcaagactaacctgggcaacacggcaaaacctgatgtctacaa

SEQ ID NO: 102575 - DNA, 244 bp, Homo sapiens
agctgtatacctacatgaatattctacatcttccaacacagcgggctctccaggggaccgtccacctggaaggaacaaacgcacacgtcttgatttcctctgtatgggaagtttggggcatacccagagggaacggcaactctttccccaggctaaacttattcatccacagtaatgaaatctttctgagttcccaggatattgactacaagggagacccaccagagcaggaaagagaataaag

SEQ ID NO: 102576 - DNA, 425 bp, Homo sapiens
tgagacagagtctcgctctgtcacccaggctggagtgccggggcatgatcttggctcacagcaacctccgcctcccgggttcaagcgattctccagcctcagcctcccgagtagctggggccacaggtgcccgccaccacgccgggctaatttttgtatttttagtagaaacagggtttctccacgctggtcaggctggtctcgaactcctgacctcgtgatccacccaccttggccccccaaagtgctgggattacaggcgtgagccaccgcaccaggccccacctatgtaattataaccagataccgtcacatgatttcaatcttgagatcagtttgtatgtacagttacatgtgtaccaaataatattaccctagctgatgctggcaagattaatgaaaaaagatgagaggtggattttcat

SEQ ID NO: 102577 - DNA, 324 bp, Homo sapiens
cccggtgtgtgctcactcaacaaatattggttgagcacttcctatattccatgccggccggtgttgcgctgctgagaggctcacacagtggagagatactctatcagccataaaatgctggacaaaccgcagcaatcgtccacatcctgtgtacttttgcacctacatcctgaacagtctaaactttgataccaggtgtgatgtcagttgtcttacagaggcggcagctaaggtccagccattgcaggtgtgctgggagggcccctggtcaacagcacccacggggcaccatatgcagggcctgccagaggagaaatgtagggg

SEQ ID NO: 102578 - DNA, 383 bp, Homo sapiens
agacagggtttcaccatgttgcctaggttggtcttaaactcctgggctcaagcaatctgactgcttcagcctcccaaagtgctgggattacaggtgtgagccactgtgcccagcttatacagtttctaaagactctggggtctcttaaggaaggtcgagcaactcagtaggtcctaaggacacatccttgtaaacatcaaaacactatcatttatagtgacgtccctggggccggggcctgtcggggactcgggggctaggggaaggataacattagaaatacccaatgtagatgacgggttgatgggtgcagcaaaccaccatggcacatgtatacctatgtaacaaacctgcacgttctacacacatatctgagaacttaa

SEQ ID NO: 102579 - DNA, 199 bp, Homo sapiens
gcagaagaagtgggaggaaaagagtttatactgcatgaataaaatttaataagtagtataccacccagtcacattttaaaatattaactatgttagcctcattaaatgctatggccgcatgagcctggtttgagctggtaagaatgtattaaggcatattgtgtttctaggaatgatgggcatagaggggcatgcaagg

SEQ ID NO: 102580 - DNA, 116 bp, Homo sapiens
ggtacagaacgagcaccgactgtctgctgccctggcccctgggggtcatgtatcagagggagaggaagagaagccaatggtgcatgggtaccggtgcggacggacagcaggatccc

SEQ ID NO: 102581 - DNA, 659 bp, Homo sapiens
caactccaagctccccccgccccagagaaacacacagagctgttccacgatggcgtcctcataatgtgatcccagctttcctgaagagaacgttgccctcatgatttttggcctacttgaatttataaatttttagggatgtaaatagaacactcaaatgtcttaaaatatttaatttattaatttagttatacatacatactgtaaatcacatattatataaaataatatattaatttagaaaataccccatttttgccaccctccctttcacgaaatcattttactctgactcctcaccgtcttcaccaacatgggaaccctgtttgagtcatcagacagtttcaagacacacccagtcacttccatccgagctctgcacggtcgctcagtgacgatcccttcatgaggctctcattagaaattttctcccaagccataagaccatatttgcagaacattaggacgatttctcttgtcgttttttaatctgtcctgtgactgtacaatataaccacttaaggtcatactttttcaaacaacctttaaacgtcttttcttttaaagcacccaaaatgtcattgtgaggccaaacgcctagtaacagttactgaatctgggttaaatgtcggtatctttttttcttaaaccatttcaat

SEQ ID NO: 102582 - DNA, 350 bp, Homo sapiens
gactctcagctgattacctcatgggtgcaagatggctgctacagcagccatcagatccatattctaggtagagagaatggcaaaaatgtgaaaagccccaccagctgggtccgttttccttttttcaggaaaactatttagtactttgtgatagaaatacaatgcaagccacagatataatttaaaactttccggctgggcacggtggctcatgcttgtaattccagcactttgggaggctgaggcaggtggatcacttgaggtcaggagttcaagaccagcctggccaatatggtgaaaccttatctctactaaaattacaaaaattagctgggtgtgatggcgggtac

SEQ ID NO: 102583 - DNA, 758 bp, Homo sapiens
gaaatttgggaatcctatacttggaattctggaatggctagcctgggccaggaaaaatcactttgtaatctaagaaggaattgagttaagaagatttgttcatcacaccacatttccatgttgttgaggaaaatagattggcagtggtgacaaggtcaaggatgtgttgttcgaagttgtagaagataagcagcaatttaaaggcgttacaatacatttttaagagtggaaattgcattgaagagtggaagaaaagtcgacataagagaattagggcatgttgtttgcccaggctggtcttgaactcctgagctcaaccaatccacctgcctcggcctcccaaagtgctgggattacaggcgtgagccaccgtggctggcccttaatatgttttaaaaggatgtttaatactcttcattactgtgttatgcaatagttgcatgatgatttttctgatctctacattctattttttttctttttaaaatggagcacagaagtacttagtttctgatgtttttccatcttggcccagtaatttcctttttttttgttattttatgaagcacaaaactaaatatttttgaaccaagagactactgtgtggtattaattttgattttgtactaaattcatgttatttacacaaatcaaatagtgtcaaccttaaaatttttttaagcaatatttttcttatgtttgagagttaacatgtatggttgattagaatcttcaccttctaaagggattaaggaaaa

SEQ ID NO: 102584 - DNA, 416 bp, Homo sapiens
atgagggtggtagctgcttgcctagggaaattttgagtatttggagccactgacactgtttctagacaaaagactcaagggttcctttgctggtcaacagtaaaagagcagaaaatcatctaacaggcacactggctcactcttgtaatcccagcactttgggaggccgaggcagacagatcacctgaggtcaggagaccaacctggccaacatggtaaaactctgtctctactaaaaaaatacaaaaacttagccaggcgtggtggcacatgcctataatcccagctactcaggatgggctggggcagaagaatcgcttgaacctgggaggtggaggttgcagtgagctgagattgtgccactgcactcctgcctgggcgacagagtgagaatctgtctcaattaaaaaaaaaaa

SEQ ID NO: 102585 - DNA, 435 bp, Homo sapiens
gtctttccctaaccactggagacttcatagataaacttgcggggtcacggtgagggaggcactgtgtggaagggtaaatgggcttcctgggggtttagtacaagttgaccaaccttcttgttggtaacatgactgaggcattacctgcactgattaagtcaaccatcaagcagcatttattaagtagaacattgataagggcttgagggtgagagaagttgtccttaactgaaggagggggttctataaatggaagtgtcagagcagggtgacagatgccaaggaagagtgcccaggtgtgcacaggtgtgcccaggtatgaggggagaagaaggggtcagggccagcagggaaagagcttggggactcctgagtccagctcccagtgatgtgtagagttgagctccatcctgctgatcccagcaggagatagtg

SEQ ID NO: 102586 - DNA, 373 bp, Homo sapiens
tccagatttcgctgcctccttggcaccctcttccacgatgctgggccctccagggccgggcctccctcggacacgtgccctcgttagccttggaatatgcacactctgttttgacggagactctcttgcgagcctggtctagatttctcccctcaccagccaggcacaggcaccaatgggaggtgcctgggctccacaggcccgtcggggccagagggtcgccggtagcgtcaaccaagtgcacgacagcccacgggtggctaggcgcgtgggaagagccggagcccgacccccgcccacccggtttcctggcagcgcactgccgcgtaggggcggagccgcgcgcctacacagggtgtggcctccagcccgc

SEQ ID NO: 102587 - DNA, 462 bp, Homo sapiens
ggctcgggttgtctgccaaggggcaggaaaggcctggagggcagcttcctccacaatctacccgggagcttctgcaatggttaagaagctaaacacctgcaataactcaacagtaaggatatccacaggacaggaagtggttctgttttggtttttatgttaatttcagcctgtcggtgctgaggggcatatgaatgaaccaaccatgaagcaagtcctctgtgaatctgcttcacaatttgtagggaaaaactgggcaaaagctcgatgggtctgagacaagccctttctctgtttccactctctgagtaaggactacctaccgctggatgggcaggagagaacaggtggggagacagagaagaaagaaagaaggcatctgtatcactattcccactcaatctggactctgaaataaactaaagttgataaataatctgccaaaagttcccgttattctca

SEQ ID NO: 102588 - DNA, 349 bp, Homo sapiens
acaacgttccccaaatgggaggaggagccccttggatgacggaggagcagctcagactgctcccatctctgctcccagctccctggtgacaggccctgccctgactccacctggggtgggacccaggtgtatggaaaaggtgctcaggtggcctatcccaaatctggctaaatcaagttgccagttgaagccaagcctccccccagtcaggctgcacaaaaatgggaagacagggagcctccgggaagactcctgagcagtgtcctagctctgaagtcacgggctgcatgaggctgtggatacaacacagaggacagtgagtgatgcacacttggagacacagggagat

SEQ ID NO: 102589 - DNA, 364 bp, Homo sapiens
caggtgcccacaaccatgcccagctaatttttgtattttttgtagagacagggtttcgccatgttggccaggctggtcttgaactcctgacctcaggtgactgaccgacctccgcctcccaaagtgctgggattacaggcgtgagccaccgcacctggcccatgacactattttttaatcctcctaaagaatagccaaaataagctcccctatttccctttagagaaaaacatggaggaaatctaatctagtgggtttgtttgcaaagtcagtatcacatgcagcatgacatcctggggtttaattacttaaaccgtcaaattggatatgtaatcctaatttccaaatagcattcaatgccttt

SEQ ID NO: 102590 - DNA, 236 bp, Homo sapiens
gtactctagaggacccccgctctcacccaccacgcaggcttgagggcagcactaaaccttaaatttctttcttttttttaagataggatctctctctctctgccacccaggccagagcgcagttgatgcaggtcaggggagccccccagtggagcatagtgtgtccagaactggtgggttgttggtctcactgacttcaagaatgaagccacggaccctcggggtgagcgtcacag

SEQ ID NO: 102591 - DNA, 630 bp, Homo sapiens
aacagaataaaatgtctgctgaggctgcacaaaagcctcccactcctaaagctgaggacaataaaagcaaaggctgataaatgcactgcttatttcttcttatttccctttaatgaaaactctgaacagaaacacttggcttactttcaaaatcattaaaggaacccaggcataatgggaaaagctacactttcaaatagaagaggttttcaatgtgttgttctcataagactgctgtttgcacagctaaaagctaacagcagtgtctttactgctcttgtggtttcttctcttcggtgtacttctgtttttcttattctgagtctttataggaaaggaagaggcgcagctcatgcggttaagcacacaggcgctaccaaatggtgcaataggttgccatagcaccagcataatcagccctatctcggggttaaaaccacaacttctctagttgacgttgaagctgcctgactatacatttaactgctacaaaatgctgaatttcagattgatttgtgtttgcttcaataaaaatgtatttcaaaagtaaggttagttttattatgtgatttatttcagaagcacttcattttgaaaagcactcacaaatgatattttaatgacaaaaat

SEQ ID NO: 102592 - DNA, 223 bp, Homo sapiens
ccaccttctgtcctgggggtttgcccgttcagggtttttcctcctcgtgccagccacccaggcatcccccatgagcaccttgaagccctgcaaccatgtgggcctccatgcttggccatgtggccactggcctgtcagggtcactgctaggtgtgctggcctctccctgccactgcctcttgaacggcacccccacaggtgcttcctctacccacaagtgccc

SEQ ID NO: 102593 - DNA, 686 bp, Homo sapiens
aactgtcacgagaatgtaaatttgagaacaggagatactagggcacattaagaggaaaatagaaatggcaagattagctctgttagcaaggacaaatgaagaaacctagacagtctactgagcaagtgactacattgaggcagaaatttaaataataataagtactgcatttattcactccaagaaaagtaaaaactaaggcccagaatgtggcaaggcaagagttaaaaagaaaagaacaagttttcctctgcctagtagctcactttgaagacagttagaagataacgctgtccaaatagccaaggccaaaggaataagctccagacaccaccctccccccgacccctggttccagagcaaggttgaaagaaaaaaaaaagagaaatacaagttcttttaatgttactcttttcccgggcttcttaagcatgattagcatgattatgttttacaaatgtctgtatttagccagttcttgtttttcttttaatgcagctacaaggccactggctaagtcacaagttatgttacgctatagattatgtaacctgttactgtatgattaattgcttttattttgcttctgtaaagccacttataaaaacccgctcagtctttgttcaaggctcagcttttagatgtgaatcctccgagccggtgcgtgcctaaaataaacaaatcct

SEQ ID NO: 102594 - DNA, 558 bp, Homo sapiens
ccagatccacccatatccctgcatgaacctatatctagaaaacccccatagtctcagcccaaaagcttcttaagctaataaacttcagcaaagtctcaggatacaaaaaatcaatgtgcacaaattactagtattcctatacaccaacaacagtcaagctgagagccaaatcaggaatgaactctcattcacaattgccataaaaggagtaattgctgttctttaatgatacagtgatgttattagatgaaagagttttgaggccccatctatcttagaagactcattctcttgactctcttgaaagctgtttcagcctctttggaaggaatgagcatctatctttccatagcattgggacagactacgaagtactcagttgtctgctgatttcctctctagtctttgcttttcttggctgctgctttcttctgatcccttgtaacactagagtccttgtaactccattctgctcagtgaactgcaggtgccattcaaaactcaagaaagtgttccctccagattgtgatagtaagtttgcaggatagacttgcttaa

SEQ ID NO: 102595 - DNA, 583 bp, Homo sapiens
atatttttagtagagacggggtttcacagggttgaccaggctggcctcaaactcctgccctcaggtgatctgcctgcctcagcctcccaaaatgctgggattacaggcatgagccaccatgcctggcctgcagactttcacgtgaatgaaatacgcttctgtgttaagacactgttattctgagtctctgttactcagatgatcctatttataactgatatagtgagacccagaagagaaagcctggcctctgaggttgagggccctgtgctccaccagccagcagtagtcccacggacacctcccttggtggttctgtgggttcagagtagctctgggctcctggaagtctcagtgtccactcctgactttaacacagcctttctcctcacactgttcccgcacccctcgaaacccagcccttcctgactcttcagaagcctcggtcacatgcctctcttgcccctgatttctagaaccctccacatttcctctctccaagtctcctttccacccacagcctctgcacctccagatgtttcctggctgttgcaggaatcagcagagaagagacattgggact

SEQ ID NO: 102596 - DNA, 353 bp, Homo sapiens
tcttgccagttctttctctttttttcttttaaacttaatgtgtccaaaatcaaattagtttattctccagatctacttatctcatttatgtttattacttttttttttgtcttagtgaatgactgccatccaagccagaacctggggtcatctttgatttttcttgccccctacatgcagcccccaaatttcagcctccacctgcttctcacccctattgccactgcctcagtgtggacaatcgctaacctgcagctgggctctcgtgcattctctagatcctcggaactcttggccctttttccacatcctgaacctgccactggtgatccttcgaaaatgtgaatcttgca

SEQ ID NO: 102597 - DNA, 411 bp, Homo sapiens
cgggcactggcctggttctgcaacgaaccagcttggtgaccttgacaaagtcactgttctctgatctcactttcctacactgaaaaatgaaggagctggaggagatgatctccatgttcccattcggcaatgtcattctatcattctactaaatgggaatgacaaccagatctaatcagctagaactcattcaaccaatatttttaggtatcttcaatgtgcaagcctctaatttaccaaaaaaaaaaaccctacatttttttcctgaatggctacaggcagtggaagaagtggaggggcccaccacctatccatcatagtggacaaatccccccagcacagcataaggggctgcctaaaccccgccatcagcatccactccccagagcctccccgtcagcaagcccccct

SEQ ID NO: 102598 - DNA, 395 bp, Homo sapiens
gttccagggggagtgggggaggcaccgtctgctgctcacccacatggctgagggtttatagaaggatgtgcaggtggaaacatgcacacagctgcagatctgctaagtggggcattaggtccctcttcctcctaaagtcatcccttccctaaccaggcagaggatcatttcagcccctgggattctctaaataacacagctgaagccacaattggtcactgagagcttcctttatagcaacacaaagccacataattgaggttcctaagccccgtgacctctggacaagtgaggcttatataatcagtaccattacctgttgttgttgtaaaaatggtgccttgggctaaactgttctcttggcctttgctcacacagctatttctctgccatcc

SEQ ID NO: 102599 - DNA, 522 bp, Homo sapiens
attattccacacagttcatatggctgcctgtagccactcagtcagggtgtggtctccttgcgctgccactaaccacctgctcacttgcagccgctgacagagagaggggtgagtcatggtggaggccagcttgtccatctcagaggtggaatgggagataccatctgctcccttgttccacagacgaagcatccaggcaggcaggggttcccctggacactggcaacactgcttgcctaattcctgcaactcagttggggtacaggcaatatacgaaatgtgttgcattatggtggggagtccctgagtccacccttggagccccagtggctgttcatgatctaccttctgtcagaccaccgggtgagcccgcaacaggggttcttcctccttggtatgaaactgagtggggatctccagacaagatgatggacccaggcctgcattcatggtagcctctaattccttttccaagctctgaagccacacctccaggcatcctgcctgcacctggaggtcccc

SEQ ID NO: 102600 - DNA, 423 bp, Homo sapiens
tggcagaggggcactgttctccagttgtgggactgagggtccccttctcagccctgatgaagactggatccctgcccagatgtgaacgctggagggggcaggccggggtccagctgtggccacagggaggggttgagtcagccgcttcccagcagtacaacctaggctgggcccagctgttcctggaaaccagtagagggggtgggctccccaatccagctgggggctgctggcccagacctgcacaccagggctctgtgtccctacaaatggcggccttcagaccatcccccaaaacgttgggggctctctttacctaaaacaggggtttggatccttcttccaaaatgtggagggtttttcagcccctcttgctgaattaaaggtgcctggatctcgcacagcggggctccctgtgtttca

SEQ ID NO: 102601 - DNA, 1197 bp, Homo sapiens
gaatctggagaggcaaagtaatgaaggaccttatgaattgggtgaccatagaatatactatccaaacctatacacttttgaaaatgaaagagatacccgggtgcagtggctcatgcctgtaatcccagcactttgggaggccaagcaagacaggccgatcatctgaggtcaggagtttgagaccagcctgaccaacatggtgaaaccccatcactactaacattacaaaattagccaggcatggtagctcacacctgtattcccagctactcaggaggctgaggtagtagaatcgcttgaacccgggaagtggaagttgcagtgagccaagattgtgccattgcactctagcctgggtggcagagcgaaactctgtctcaaaaaaaaaaaaaaaaaaaaaaaaccggtgtgaaaggaagatatttctttcacactcatgggtccccattagaggaaagccaatgggggaattgggccaccaatgtggggacatgtgtcccttgaggcacgcccaggaaacttttgaattacccctacactttattaaccccccgtgtgttacactcttttttcctcttaactccccccgtgcgtgagacgagatcttctgtggggagaagacttgtgggacaagagatctcttccgagaagagaagggggtgggggccacggcgggtggtgcccactattggcgttaagacaccctcttccatgtttaccccacaagttttttccccttttggcgcaggcgagaaaacctggaaccttccgcctgccgccccccatcttggggcacacacggcgggggggtttctgctcgcccaacaacggcgcggcgacaacgatcacgcagatgatagtcaatgataacaagctcgtcggagagagcgacaccatctcaatagttgacggcggcgggggcggggcaggacacaaacagacgcgtgtctcatccgaacaagatgggggccgcccaatatggtgcgtacctcaaagacaggccgggtgtctccccggtcagaaccccaccaggcgtttcgctgtgtgtggtcaaccaaacaggggcgggtgctaaagtatatgtaccgggcggaggagctactcccccccaatgaataagggtgagagaccggcgccagaagtactaggttgtgcccgaagataagcaagccgccgggcggtgtaagcgcccggaag

SEQ ID NO: 102602 - DNA, 721 bp, Homo sapiens
ggttatttgtactatagatttctgtcttgctttccagggtgatatcaacatactcttactgtaaactacaagttggcaaaataacttcatcagattaagattggactgttttgggtaggttgcctcatagatgatggtgttttcccacgaggaaacacataatgtctgatgtttctctctctctccttctctcttttatattgaccactgttaatgagcaatgcccagattcattacttcattaaaactgcaaaaatggtcaggctctaattctattacctggtccccattcattagctggaattcctctctaaagagaaatatcccccctcctgttatgtggtttcccaggggtatggtctgtataggaaaggcaggctttcactggcttttataaagttggtttctgagtgtccaccaacattgatcaattacattgtgggtgttgttaccagctcatggctttagatagatttcatgaacttcaattcagtagtttctaatcttgatgtcaaattatcccatgtttgaccaatgtgagcctcttcaaactggcttcttggtcctctgacaatgactctagcagttattaattgctcccttgcctaagaaacattccaggttcatcttgtacattttccatcaccaacttcaaatcaggaatcccagttacttctaattctttttggtggaccaaatctaggtgctaaaagtgtgtgtt

SEQ ID NO: 102603 - DNA, 401 bp, Homo sapiens
ggtcattggaggattaacagcattcctgtctgcaaagtgcacagcacctagtgcctggctttggtaagtgagtcgtgtgtttgtgagtatattattgtgcagggtggagcgcagggccagggtggtgagccctccatgaatgttggtgaatattgataccactgttatggtccacatgtgagagactgtgtcctttggggttctggatgtgacagttctgttccccttcctgccctccattgactgcaggccaatgagaacagcctgctgagtgcgcagctcaagggcttccccctgttcctgcactcaaacctgggcctgaaggactgcagcatcaaccccaagtccccgcaagtcgacccgcaagtcaaaagaaattagagctgatcctctagagtcga

SEQ ID NO: 102604 - DNA, 298 bp, Homo sapiens
aactgcgagctgctaactcaggggcgagctgcccacgccgcttcaaataccgcacagagattgcgccgggcaagggtgacatgcccacgctcactgacaagggccgtggccgcttcgccctcatcatctatgagaacatcctcaagtatgtcaacctggacgcctggaaccgggagctgctggacaagtactgtgtggcctacggcgtgggcatcattggcttcttcaagcctatagagaacagccctgctgattgcactgctccccggtcttacacctcttccctgctatcacactt

SEQ ID NO: 102605 - DNA, 8027 bp, Homo sapiens
  misc_feature (4359)..(4359): n is a, c, g, or t
gcggccgcgattcggggaggtaggcgctgggccgaggaggtgcagccgtgttaaggagaggacattcgagagggcgtggcgaagtgaagaggaacctcacgccactgcctggagctccgccttagccccgtgggccccacggagtgagcggcatgcagcacccccgggcctgtccagtgtcctctggcctgctgccctgcacccccagaaggccctgacgccctggggcacttctgctctgcacaggaccacgcgggggtttgccatggtgacataaaggggcgcggaggaaggaaggagcgtgaccagcctgtggactgcgcccctggctgggaggaaggactgggggcccagatcctccactcccagtgccccacaagggcgtcgcttcctaagtctctgtgaatttgttggtcagtggacgattctcgtgtctcctcctgtgtggggccttggggtagccagggcaggccgggcctccggtggccaaggtctcggaggccaggatgcctgccctggcatgcctccggaggctgtgtcggcacgtgtccccgcaggctgtccttttcctgctgttcatcttctgcctgttcagcgttttcatctcggcctactacctatatggctggaagcgaggcctggagccctcggcggatgcccccgagcctgactgcggggacccgccgcctgtggcccccagtcgcctgctgccactcaagcctgtgcaggcagccaccccttcccgcacagacccgttggtgctggtctttgtggagagcctctactcgcaactgggccaggaggtggtggccatcctggagtccagccgcttcaaataccgcacagagattgcgccgggcaagggtgacatgcccacgctcactgacaagggccgtggccgcttcgccctcatcatctatgagaacatcctcaagtatgtcaacctggacgcctggaaccgggagctgctggacaagtactgtgtggcctacggcgtgggcatcattggcttcttcaaggccaatgagaacagcctgctgagtgcgcagctcaagggcttccccctgttcctgcactcaaacctgggcctgaaggactgcagcatcaaccccaagtccccgctgctctacgtgacgcgacctagcgaggtggagaaaggtgtgctccccggcgaggactggacggttttccagtcaaatcactccacctatgagccagtgctgctggccaagacgcgctcgtctgagtccatcccacacctgggcgcagacgccggcctgcatgctgcactgcacgccactgtggtccaggacctgggcctgcacgacggcatccagcgcgtgctgtttggcaacaacctgaacttctggctgcacaagcttgtcttcgtggatgccgtggccttcctcacggggaagcgcctctccctgccattggaccgctacatcctggtggacattgatgacatcttcgtgggcaaggagggcacacgcatgaaggtggaggacgtgaaggccctgtttgacacacagaacgaactacgcgcacacatcccaaacttcaccttcaacctgggctactcagggaaattcttccacacaggtaccaatgctgaggacgctggggatgatctgctgctgtcgtatgtgaaggagttctggtggttcccccacatgtggagccacatgcagccccaccttttccacaaccagtccgtgttggccgagcagatggccttgaacaagaagttcgctgtcgagcatggcattcccacagacatggggtatgcagtggcgccccaccactcgggcgtgtaccccgtgcacgtgcagctgtacgaggcttggaagcaggtgtggagcatccgcgtgaccagcacggaggagtacccccacctgaagccagcccgctaccgccgtggcttcatccacaatggcatcatggttctcccacggcagacctgcggcctcttcacacacaccatcttctacaacgagtaccctggcggctccagtgagctggacaagatcatcaacgggggcgagctcttcctcaccgtgctcctcaatcctatcagcatcttcatgacgcacctgtccaactatgggaatgaccgcctgggcctgtacaccttcaagcacctggtgcgcttcctgcactcctggaccaacctccggctgcagacactgccccctgtgcagttggcgcagaagtacttccagatcttctccgaggagaaggacccgctctggcaggacccctgcgaggacaaacgtcacaaagacatctggtccaaggagaagacgtgtgaccgcttcccaaagctcctcatcatcggcccccagaaaacaggcaccactgccctctacctgttcctgggcatgcaccctgacctaagcagcaactaccccagctctgagacctttgaggagatccagttttttaatggccacaactatcacaaaggcatcgactggtacatggagttcttccccatcccttccaacaccacctccgacttctactttgagaaaagcgccaactactttgattcagaagtggcgccccggcgggcagcagccctcttgcccaaagccaaggtcctgaccatcctcatcaaccccgcggaccgggcctattcctggtaccagcaccagcgagcccatgacgacccagtggccctaaagtacaccttccatgaggtgattaccgccggctctgacgcatcctcgaagctgcgtgccctccagaaccgctgcctggtccctggctggtacgccacccacatcgagcgctggctcagtgcctatcacgccaaccagattctggtcttggatggcaaactgcttcgcacagaacctgccaaagtgatggacatggtgcagaagttccttggggtgaccaacaccattgactaccacaaaaccttggcgtttgatccaaagaaaggattttggtgccaactgcttgaaggaggaaaaaccaagtgtctgggcaaaagcaagggccggaaatatcccgagatggacttggattcccgagccttcctgaaggactattaccgggaccacaacatcgagctctccaagctgctgtataagatgggccagacacttcccacttggctacgagaggacctccagaacaccaggtagccgtggccaccacagccagactgaacgtttgtgaaagctgggacatcccaccacacgctgagccagacctgcagagtgggaagctggaccagggcagctgcgcacttatgagcaatactctgtggaggtctggtggggctgggggagcacccaggcggatctgcaagcacctcggagcacccaccgctgggtctgcggcctaagggacctccctcgccagcagaggtccattccgttcccagctgctcctggggaggccgcttcctggtaggagggagtccacgagactcttttctgtccctcactgtgttccgccgactgtcccctctcgtcacccatcactccctgcttccgcagggcgcccctcagtattcgctgccatatgtccctgtcctccaggctgtaggggaggagagcctggccgggggagacagactggacatttccctgtttcgagccaggctcttccaaggggccagctgggtccccggagtcagtcctaggctggatgggagggtggccccctcaagaggactcccagcctccacatctggttcctaccttcacatctcaccctcccgttctggggaagaatttctggttcctacagtatccactccatcctcaaggcttcccgcagggccttggggcactgccttgccatcgggcccagttctccgggccccacctgcacccctttcttccccctgggatatgatgtgtggtgtttcctgtggtaaaagactgaggcaggccaggggtctgccagtaacatgttcccatgtacagacacggtccccacaccctcccagcctcaggcccaggcagacatgggcgagctggtgagactgccagccacggctttgcttagccacctgtggccgagggctctcagagacccccttaacctcccaaatactaagaagctaaaatattttaatattttgtttttttttttcttggtgccagagtttataccctgggtgctggggtcgcactgtgttatatatatatatatatatatatataatgtgtatatatatatattctattttttttggttgggttcgtttttaattcagtcctacaaaatggtggtaagccccagtctcaggggtcaccctgtcttagagctagagatgaggtggcagggagggaggctgtgtcctcagtggcctggggctgagcagaccttaggaagggnccctccccagtgccgtggctgctctggggctaccccaggtgaacagaggtggtgagatgcgcagggaagaccagctctctccaggacatcgggctgcgtgaagtccagtgaccctgaggggattttggccaaaggaaacagccagggctgggctaggagagctggggtcaaaagctgccccacccactctccctcacatggtgctaggctgggagctgccctgagagctgggatgcccaccaaggcccacagaactgtctccaggcccttgtagacagtgggatctctgggctgatttctggttggggtctgctcctaccccaccccatttaacaatgtgaagtgactgaggctggggtgcctctccctggccccctccaactgccaaattctgcttccctctgaaccccaggaaatactttctggagaggcttgtcttgttcagaagactctagcatcttggggctggaaggtcctttgacgggtatgaaacaggtccagaaaggggaggtggcctgcttggccgacgtcatggagccagctgggagcagggctgagcgttgaacccgaggctcccggttccaagtcccatcgtgctcctcttccaatgccacactgcctctgagcccatccttgggaccctactctgtgccaggttcctgtcccttcctccgtcacagcatggtcattccaggatatggggacaaaccactccttcccagccagggtgcctttgagccttctcattccgaggtctgcgtttgcatccctgtcgtgttctccctcgaggggtccttccccagcctgtgggggcctgggtctgttctgagctgattcccttttctccagttctctgctgggatgaagaaagttggacactcagtgggaccagctgcaggtggtttcactgtgtacacagcagtgtccccatcatgcctctcaatggggcctgcaagcctgggaacttgggcatcgttgggccagcaggatgagcagcaaagggtctgaggacagggtggcatgtctgcttgtgtgctcatgaagacatgcccacgccatggagccaggggcttacagagaggggcagtgacttccagagtcccatccgtcagtgaggggactgggctgcgggatgggtgaggatcttacagctcccaggttcggaaatctaccctctaggcctggaggcctctctcgcagagcatggaaggcaggagaggtgggctggcctagggcaggagctccacttctctctgcctctggctatgggaaggagcaggcggttggaaatcctgtgacagcagagatcttctggatttttgcctggacccttctgcaagcctggagactggacctgccacatgttccaagtctgtctgcctaggtcactgctgccacttctcctcccactaacagacctttcttgaagacccactaggtccagacactgccgggacttgcaggtatggggggtagaaggagaggcagataagctgcctggggggctgttagctaatgggtacaaggacaccccctcccgagaagagaagccacagatgagtgggccagcgaggccagtcttcaatgtccactaattcactctaagcatttggccaaaaaaaggagagagaaataactgaaattgttcaggtggctccatcgtctattctgtggtcccctccatgagcctttgccccagggtgggtgcaggtgcgagtgtcacctgcagctgcctcagtcattcagagttccagagccttctgtggtggagcatcctgctgcttggaggatgagtctgaagtttaaaaatgggccttttctgagcccccctgatgagcagtcagtgcttctgggcccagctaaggaagccatctgttcccagcagaggagagctgctgcgctgacctgcagaggttggtggtcccagcacagagctgtgcccatgggcttgttagtgggaaaagcaaatacaacaatgttttaccaaacatttaattatgaatgcccactccccagcatctagatctaaaattattaacattttgccacattctttttctctctctgtgtatgtatatgttttctctgtcctaatttaaaagtacattgcaaacatcatgaaacttgatccctgaaagcttcagcctgcatctcctaagagttagggcattgtcctacacattggcccagtatcacagccaagacgagaagtcatttcccagcgatgtctgctatctaatctgtattcaaatccccccaattgtctcccaggtaacttatgtgtctggttttggaatcagcatccagtcacggtgcacacattgcattttctaactatgtttttaaaacctctttgaatgctgaaaggtcttccctcagctcactttgagtttttaaatgacattgtttttgaggccctaggcctgctgtctttttgaagccccacattctgaatttgtcagattgtttgctcatggtgtcgcataaccacttcttctatcccctgtactttcaaggataatttaggctacatgagattttgccttttgtgctgacttgacagcttcacttctgcctaagatgcgcctccactgtcacctgtaccaagtgccaaaacagcagaggggccagttagagcaagagctctgggggggcccggaaagtctccctggagaaggccgtaatatctgggccttggaaggaaggacacagggctctggaaggaggaggctgcatgcctgaaggctgggccttcgaccctggggatgggccacagggcaccaaacacatcatatgtctctctctttctattttggggtcccagggttttcatttcctggagacccgtggtctgtgtgcactggagcagagccaggctctcagttgcagcagggaaaagcctacatggggaactgcctcccgcaagctgtggtgtgagaagagccctggctggcagcaggagctgtgaagtttcatcccagccgggtgcatttagtagctgcctgaccatcttcctcccaggccctcagtttcttcatctgtagaatgagcagataggggccacagcagggattttcacacatcaaaggaggcagcctctgctctagttgatgtgaggatgagggggcggcctagaccccctgctgcccaggccgttgaggcaacactgggttcctggcttgacagctgtgggctggctgcccttgccagctcagacggctggcgagttttcagcttccctaagggactggcatagggttttgtggggtcaatgccaggaacctgggggaaactggatgcgttttatcctaagaagttcatccctcctgctcttactgtttccggccctggaggagaatgagggaggagagggttttctatgactgtgttagcttttattattagcaagagggctccttttgtaatttgtgcatgaaattcatgtcatttcctgggagaggagagggccgactggagagggtggggggcacactggggaagcaggcagaggtttccttcccttgtaggggggtggggagagtggggagagggggtgctatccagttcgcctgatgagggctctcgaaccagccgttttgggttgtgttaaaggtgagaccttcctccattaatgtacaatctcgaactaactgctaataaagtggggt

SEQ ID NO: 102606 - DNA, 7909 bp, Homo sapiens
  misc_feature (4359)..(4359): n is a, c, g, or t
gcggccgcgattcggggaggtaggcgctgggccgaggaggtgcagccgtgttaaggagaggacattcgagagggcgtggcgaagtgaagaggaacctcacgccactgcctggagctccgccttagccccgtgggccccacggagtgagcggcatgcagcacccccgggcctgtccagtgtcctctggcctgctgccctgcacccccagaaggccctgacgccctggggcacttctgctctgcacaggaccacgcgggggtttgccatggtgacataaaggggcgcggaggaaggaaggagcgtgaccagcctgtggactgcgcccctggctgggaggaaggactgggggcccagatcctccactcccagtgccccacaagggcgtcgcttcctaagtctctgtgaatttgttggtcagtggacgattctcgtgtctcctcctgtgtggggccttggggtagccagggcaggccgggcctccggtggccaaggtctcggaggccaggatgcctgccctggcatgcctccggaggctgtgtcggcacgtgtccccgcaggctgtccttttcctgctgttcatcttctgcctgttcagcgttttcatctcggcctactacctatatggctggaagcgaggcctggagccctcggcggatgcccccgagcctgactgcggggacccgccgcctgtggcccccagtcgcctgctgccactcaagcctgtgcaggcagccaccccttcccgcacagacccgttggtgctggtctttgtggagagcctctactcgcaactgggccaggaggtggtggccatcctggagtccagccgcttcaaataccgcacagagattgcgccgggcaagggtgacatgcccacgctcactgacaagggccgtggccgcttcgccctcatcatctatgagaacatcctcaagtatgtcaacctggacgcctggaaccgggagctgctggacaagtactgtgtggcctacggcgtgggcatcattggcttcttcaaggccaatgagaacagcctgctgagtgcgcagctcaagggcttccccctgttcctgcactcaaacctgggcctgaaggactgcagcatcaaccccaagtccccgctgctctacgtgacgcgacctagcgaggtggagaaaggtgtgctccccggcgaggactggacggttttccagtcaaatcactccacctatgagccagtgctgctggccaagacgcgctcgtctgagtccatcccacacctgggcgcagacgccggcctgcatgctgcactgcacgccactgtggtccaggacctgggcctgcacgacggcatccagcgcgtgctgtttggcaacaacctgaacttctggctgcacaagcttgtcttcgtggatgccgtggccttcctcacggggaagcgcctctccctgccattggaccgctacatcctggtggacattgatgacatcttcgtgggcaaggagggcacacgcatgaaggtggaggacgtgaaggccctgtttgacacacagaacgaactacgcgcacacatcccaaacttcaccttcaacctgggctactcagggaaattcttccacacaggtaccaatgctgaggacgctggggatgatctgctgctgtcgtatgtgaaggagttctggtggttcccccacatgtggagccacatgcagccccaccttttccacaaccagtccgtgttggccgagcagatggccttgaacaagaagttcgctgtcgagcatggcattcccacagacatggggtatgcagtggcgccccaccactcgggcgtgtaccccgtgcacgtgcagctgtacgaggcttggaagcaggtgtggagcatccgcgtgaccagcacggaggagtacccccacctgaagccagcccgctaccgccgtggcttcatccacaatggcatcatggttctcccacggcagacctgcggcctcttcacacacaccatcttctacaacgagtaccctggcggctccagtgagctggacaagatcatcaacgggggcgagctcttcctcaccgtgctcctcaatcctatcagcatcttcatgacgcacctgtccaactatgggaatgaccgcctgggcctgtacaccttcaagcacctggtgcgcttcctgcactcctggaccaacctccggctgcagacactgccccctgtgcagttggcgcagaagtacttccagatcttctccgaggagaaggacccgctctggcaggacccctgcgaggacaaacgtcacaaagacatctggtccaaggagaagacgtgtgaccgcttcccaaagctcctcatcatcggcccccagaaaacaggcaccactgccctctacctgttcctgggcatgcaccctgacctaagcagcaactaccccagctctgagacctttgaggagatccagttttttaatggccacaactatcacaaaggcatcgactggtacatggagttcttccccatcccttccaacaccacctccgacttctactttgagaaaagcgccaactactttgattcagaagtggcgccccggcgggcagcagccctcttgcccaaagccaaggtcctgaccatcctcatcaaccccgcggaccgggcctattcctggtaccagcaccagcgagcccatgacgacccagtggccctaaagtacaccttccatgaggtgattaccgccggctctgacgcatcctcgaagctgcgtgccctccagaaccgctgcctggtccctggctggtacgccacccacatcgagcgctggctcagtgcctatcacgccaaccagattctggtcttggatggcaaactgcttcgcacagaacctgccaaagtgatggacatggtgcagaagttccttggggtgaccaacaccattgactaccacaaaaccttggcgtttgatccaaagaaaggattttggtgccaactgcttgaaggaggaaaaaccaagtgtctgggcaaaagcaagggccggaaatatcccgagatggacttggattcccgagccttcctgaaggactattaccgggaccacaacatcgagctctccaagctgctgtataagatgggccagacacttcccacttggctacgagaggacctccagaacaccaggtagccgtggccaccacagccagactgaacgtttgtgaaagctgggacatcccaccacacgctgagccagacctgcagagtgggaagctggaccagggcagctgcgcacttatgagcaatactctgtggaggtctggtggggctgggggagcacccaggcggatctgcaagcacctcggagcacccaccgctgggtctgcggcctaagggacctccctcgccagcagaggtccattccgttcccagctgctcctggggaggccgcttcctggtaggagggagtccacgagactcttttctgtccctcactgtgttccgccgactgtcccctctcgtcacccatcactccctgcttccgcagggcgcccctcagtattcgctgccatatgtccctgtcctccaggctgtaggggaggagagcctggccgggggagacagactggacatttccctgtttcgagccaggctcttccaaggggccagctgggtccccggagtcagtcctaggctggatgggagggtggccccctcaagaggactcccagcctccacatctggttcctaccttcacatctcaccctcccgttctggggaagaatttctggttcctacagtatccactccatcctcaaggcttcccgcagggccttggggcactgccttgccatcgggcccagttctccgggccccacctgcacccctttcttccccctgggatatgatgtgtggtgtttcctgtggtaaaagactgaggcaggccaggggtctgccagtaacatgttcccatgtacagacacggtccccacaccctcccagcctcaggcccaggcagacatgggcgagctggtgagactgccagccacggctttgcttagccacctgtggccgagggctctcagagacccccttaacctcccaaatactaagaagctaaaatattttaatattttgtttttttttttcttggtgccagagtttataccctgggtgctggggtcgcactgtgttatatatatatatatatatatatataatgtgtatatatatatattctattttttttggttgggttcgtttttaattcagtcctacaaaatggtggtaagccccagtctcaggggtcaccctgtcttagagctagagatgaggtggcagggagggaggctgtgtcctcagtggcctggggctgagcagaccttaggaagggnccctccccagtgccgtggctgctctggggctaccccaggtgaacagaggtggtgagatgcgcagggaagaccagctctctccaggacatcgggctgcgtgaagtccagtgaccctgaggggattttggccaaaggaaacagccagggctgggctaggagagctggggtcaaaagctgccccacccactctccctcacatggtgctaggctgggagctgccctgagagctgggatgcccaccaaggcccacagaactgtctccaggcccttgtagacagtgggatctctgggctgatttctggttggggtctgctcctaccccaccccatttaacaatgtgaagtgactgaggctggggtgcctctccctggccccctccaactgccaaattctgcttccctctgaaccccaggaaatactttctggagaggcttgtcttgttcagaagactctagcatcttggggctggaaggtcctttgacgggtatgaaacaggtccagaaaggggaggtggcctgcttggccgacgtcatggagccagctgggagcagggctgagcgttgaacccgaggctcccggttccaagtcccatcgtgctcctcttccaatgccacactgcctctgagcccatccttgggaccctactctgtgccaggttcctgtcccttcctccgtcacagcatggtcattccaggatatggggacaaaccactccttcccagccagggtgcctttgagccttctcattccgaggtctgcgtttgcatccctgtcgtgttctccctcgaggggtccttccccagcctgtgggggcctgggtctgttctgagctgattcccttttctccagttctctgctgggatgaagaaagttggacactcagtgggaccagctgcaggtggtttcactgtgtacacagcagtgtccccatcatgcctctcaatggggcctgcaagcctgggaacttgggcatcgttgggccagcaggatgagcagcaaagggtctgaggacagggtggcatgtctgcttgtgtgctcatgaagacatgcccacgccatggagccaggggcttacagagaggggcagtgacttccagagtcccatccgtcagtgaggggactgggctgcgggatgggtgaggatcttacagctcccaggttcggaaatctaccctctaggcctggaggcctctctcgcagagcatggaaggcaggagaggtgggctggcctagggcaggagctccacttctctctgcctctggctatgggaaggagcaggcggttggaaatcctgtgacagcagagatcttctggatttttgcctggacccttctgcaagcctggagactggacctgccacatgttccaagtctgtctgcctaggtcactgctgccacttctcctcccactaacagacctttcttgaagacccactaggtccagacactgccgggacttgcaggtatggggggtagaaggagaggcagataagctgcctggggggctgttagctaatgggtacaaggacaccccctcccgagaagagaagccacagatgagtgggccagcgaggccagtcttcaatgtccactaattcactctaagcatttggccaaaaaaaggagagagaaataactgaaattgttcaggtggctccatcgtctattctgtggtcccctccatgagcctttgccccagggtgggtgcaggtgcgagtgtcacctgcagctgcctcagtcattcagagttccagagccttctgtggtggagcatcctgctgcttggaggatgagtctgaagtttaaaaatgggccttttctgagcccccctgatgagcagtcagtgcttctgggcccagctaaggaagccatctgttcccagcagaggagagctgctgcgctgacctgcagaggttggtggtcccagcacagagctgtgcccatgggcttgttagtatatgttttctctgtcctaatttaaaagtacattgcaaacatcatgaaacttgatccctgaaagcttcagcctgcatctcctaagagttagggcattgtcctacacattggcccagtatcacagccaagacgagaagtcatttcccagcgatgtctgctatctaatctgtattcaaatccccccaattgtctcccaggtaacttatgtgtctggttttggaatcagcatccagtcacggtgcacacattgcattttctaactatgtttttaaaacctctttgaatgctgaaaggtcttccctcagctcactttgagtttttaaatgacattgtttttgaggccctaggcctgctgtctttttgaagccccacattctgaatttgtcagattgtttgctcatggtgtcgcataaccacttcttctatcccctgtactttcaaggataatttaggctacatgagattttgccttttgtgctgacttgacagcttcacttctgcctaagatgcgcctccactgtcacctgtaccaagtgccaaaacagcagaggggccagttagagcaagagctctgggggggcccggaaagtctccctggagaaggccgtaatatctgggccttggaaggaaggacacagggctctggaaggaggaggctgcatgcctgaaggctgggccttcgaccctggggatgggccacagggcaccaaacacatcatatgtctctctctttctattttggggtcccagggttttcatttcctggagacccgtggtctgtgtgcactggagcagagccaggctctcagttgcagcagggaaaagcctacatggggaactgcctcccgcaagctgtggtgtgagaagagccctggctggcagcaggagctgtgaagtttcatcccagccgggtgcatttagtagctgcctgaccatcttcctcccaggccctcagtttcttcatctgtagaatgagcagataggggccacagcagggattttcacacatcaaaggaggcagcctctgctctagttgatgtgaggatgagggggcggcctagaccccctgctgcccaggccgttgaggcaacactgggttcctggcttgacagctgtgggctggctgcccttgccagctcagacggctggcgagttttcagcttccctaagggactggcatagggttttgtggggtcaatgccaggaacctgggggaaactggatgcgttttatcctaagaagttcatccctcctgctcttactgtttccggccctggaggagaatgagggaggagagggttttctatgactgtgttagcttttattattagcaagagggctccttttgtaatttgtgcatgaaattcatgtcatttcctgggagaggagagggccgactggagagggtggggggcacactggggaagcaggcagaggtttccttcccttgtaggggggtggggagagtggggagagggggtgctatccagttcgcctgatgagggctctcgaaccagccgttttgggttgtgttaaaggtgagaccttcctccattaatgtacaatctcgaactaactgctaataaagtggggt

SEQ ID NO: 102607 - DNA, 8145 bp, Homo sapiens
  misc_feature (4477)..(4477): n is a, c, g, or t
gcggccgcgattcggggaggtaggcgctgggccgaggaggtgcagccgtgttaaggagaggacattcgagagggcgtggcgaagtgaagaggaacctcacgccactgcctggagctccgagtctcgctctgtcgcccaggctgcagtgcagtgacgtgatctcggctcactgcaccctccgcctcccaggttcaagtgattcccctgcctcagcctcctgggtagctgggactacagccttagccccgtgggccccacggagtgagcggcatgcagcacccccgggcctgtccagtgtcctctggcctgctgccctgcacccccagaaggccctgacgccctggggcacttctgctctgcacaggaccacgcgggggtttgccatggtgacataaaggggcgcggaggaaggaaggagcgtgaccagcctgtggactgcgcccctggctgggaggaaggactgggggcccagatcctccactcccagtgccccacaagggcgtcgcttcctaagtctctgtgaatttgttggtcagtggacgattctcgtgtctcctcctgtgtggggccttggggtagccagggcaggccgggcctccggtggccaaggtctcggaggccaggatgcctgccctggcatgcctccggaggctgtgtcggcacgtgtccccgcaggctgtccttttcctgctgttcatcttctgcctgttcagcgttttcatctcggcctactacctatatggctggaagcgaggcctggagccctcggcggatgcccccgagcctgactgcggggacccgccgcctgtggcccccagtcgcctgctgccactcaagcctgtgcaggcagccaccccttcccgcacagacccgttggtgctggtctttgtggagagcctctactcgcaactgggccaggaggtggtggccatcctggagtccagccgcttcaaataccgcacagagattgcgccgggcaagggtgacatgcccacgctcactgacaagggccgtggccgcttcgccctcatcatctatgagaacatcctcaagtatgtcaacctggacgcctggaaccgggagctgctggacaagtactgtgtggcctacggcgtgggcatcattggcttcttcaaggccaatgagaacagcctgctgagtgcgcagctcaagggcttccccctgttcctgcactcaaacctgggcctgaaggactgcagcatcaaccccaagtccccgctgctctacgtgacgcgacctagcgaggtggagaaaggtgtgctccccggcgaggactggacggttttccagtcaaatcactccacctatgagccagtgctgctggccaagacgcgctcgtctgagtccatcccacacctgggcgcagacgccggcctgcatgctgcactgcacgccactgtggtccaggacctgggcctgcacgacggcatccagcgcgtgctgtttggcaacaacctgaacttctggctgcacaagcttgtcttcgtggatgccgtggccttcctcacggggaagcgcctctccctgccattggaccgctacatcctggtggacattgatgacatcttcgtgggcaaggagggcacacgcatgaaggtggaggacgtgaaggccctgtttgacacacagaacgaactacgcgcacacatcccaaacttcaccttcaacctgggctactcagggaaattcttccacacaggtaccaatgctgaggacgctggggatgatctgctgctgtcgtatgtgaaggagttctggtggttcccccacatgtggagccacatgcagccccaccttttccacaaccagtccgtgttggccgagcagatggccttgaacaagaagttcgctgtcgagcatggcattcccacagacatggggtatgcagtggcgccccaccactcgggcgtgtaccccgtgcacgtgcagctgtacgaggcttggaagcaggtgtggagcatccgcgtgaccagcacggaggagtacccccacctgaagccagcccgctaccgccgtggcttcatccacaatggcatcatggttctcccacggcagacctgcggcctcttcacacacaccatcttctacaacgagtaccctggcggctccagtgagctggacaagatcatcaacgggggcgagctcttcctcaccgtgctcctcaatcctatcagcatcttcatgacgcacctgtccaactatgggaatgaccgcctgggcctgtacaccttcaagcacctggtgcgcttcctgcactcctggaccaacctccggctgcagacactgccccctgtgcagttggcgcagaagtacttccagatcttctccgaggagaaggacccgctctggcaggacccctgcgaggacaaacgtcacaaagacatctggtccaaggagaagacgtgtgaccgcttcccaaagctcctcatcatcggcccccagaaaacaggcaccactgccctctacctgttcctgggcatgcaccctgacctaagcagcaactaccccagctctgagacctttgaggagatccagttttttaatggccacaactatcacaaaggcatcgactggtacatggagttcttccccatcccttccaacaccacctccgacttctactttgagaaaagcgccaactactttgattcagaagtggcgccccggcgggcagcagccctcttgcccaaagccaaggtcctgaccatcctcatcaaccccgcggaccgggcctattcctggtaccagcaccagcgagcccatgacgacccagtggccctaaagtacaccttccatgaggtgattaccgccggctctgacgcatcctcgaagctgcgtgccctccagaaccgctgcctggtccctggctggtacgccacccacatcgagcgctggctcagtgcctatcacgccaaccagattctggtcttggatggcaaactgcttcgcacagaacctgccaaagtgatggacatggtgcagaagttccttggggtgaccaacaccattgactaccacaaaaccttggcgtttgatccaaagaaaggattttggtgccaactgcttgaaggaggaaaaaccaagtgtctgggcaaaagcaagggccggaaatatcccgagatggacttggattcccgagccttcctgaaggactattaccgggaccacaacatcgagctctccaagctgctgtataagatgggccagacacttcccacttggctacgagaggacctccagaacaccaggtagccgtggccaccacagccagactgaacgtttgtgaaagctgggacatcccaccacacgctgagccagacctgcagagtgggaagctggaccagggcagctgcgcacttatgagcaatactctgtggaggtctggtggggctgggggagcacccaggcggatctgcaagcacctcggagcacccaccgctgggtctgcggcctaagggacctccctcgccagcagaggtccattccgttcccagctgctcctggggaggccgcttcctggtaggagggagtccacgagactcttttctgtccctcactgtgttccgccgactgtcccctctcgtcacccatcactccctgcttccgcagggcgcccctcagtattcgctgccatatgtccctgtcctccaggctgtaggggaggagagcctggccgggggagacagactggacatttccctgtttcgagccaggctcttccaaggggccagctgggtccccggagtcagtcctaggctggatgggagggtggccccctcaagaggactcccagcctccacatctggttcctaccttcacatctcaccctcccgttctggggaagaatttctggttcctacagtatccactccatcctcaaggcttcccgcagggccttggggcactgccttgccatcgggcccagttctccgggccccacctgcacccctttcttccccctgggatatgatgtgtggtgtttcctgtggtaaaagactgaggcaggccaggggtctgccagtaacatgttcccatgtacagacacggtccccacaccctcccagcctcaggcccaggcagacatgggcgagctggtgagactgccagccacggctttgcttagccacctgtggccgagggctctcagagacccccttaacctcccaaatactaagaagctaaaatattttaatattttgtttttttttttcttggtgccagagtttataccctgggtgctggggtcgcactgtgttatatatatatatatatatatatataatgtgtatatatatatattctattttttttggttgggttcgtttttaattcagtcctacaaaatggtggtaagccccagtctcaggggtcaccctgtcttagagctagagatgaggtggcagggagggaggctgtgtcctcagtggcctggggctgagcagaccttaggaagggnccctccccagtgccgtggctgctctggggctaccccaggtgaacagaggtggtgagatgcgcagggaagaccagctctctccaggacatcgggctgcgtgaagtccagtgaccctgaggggattttggccaaaggaaacagccagggctgggctaggagagctggggtcaaaagctgccccacccactctccctcacatggtgctaggctgggagctgccctgagagctgggatgcccaccaaggcccacagaactgtctccaggcccttgtagacagtgggatctctgggctgatttctggttggggtctgctcctaccccaccccatttaacaatgtgaagtgactgaggctggggtgcctctccctggccccctccaactgccaaattctgcttccctctgaaccccaggaaatactttctggagaggcttgtcttgttcagaagactctagcatcttggggctggaaggtcctttgacgggtatgaaacaggtccagaaaggggaggtggcctgcttggccgacgtcatggagccagctgggagcagggctgagcgttgaacccgaggctcccggttccaagtcccatcgtgctcctcttccaatgccacactgcctctgagcccatccttgggaccctactctgtgccaggttcctgtcccttcctccgtcacagcatggtcattccaggatatggggacaaaccactccttcccagccagggtgcctttgagccttctcattccgaggtctgcgtttgcatccctgtcgtgttctccctcgaggggtccttccccagcctgtgggggcctgggtctgttctgagctgattcccttttctccagttctctgctgggatgaagaaagttggacactcagtgggaccagctgcaggtggtttcactgtgtacacagcagtgtccccatcatgcctctcaatggggcctgcaagcctgggaacttgggcatcgttgggccagcaggatgagcagcaaagggtctgaggacagggtggcatgtctgcttgtgtgctcatgaagacatgcccacgccatggagccaggggcttacagagaggggcagtgacttccagagtcccatccgtcagtgaggggactgggctgcgggatgggtgaggatcttacagctcccaggttcggaaatctaccctctaggcctggaggcctctctcgcagagcatggaaggcaggagaggtgggctggcctagggcaggagctccacttctctctgcctctggctatgggaaggagcaggcggttggaaatcctgtgacagcagagatcttctggatttttgcctggacccttctgcaagcctggagactggacctgccacatgttccaagtctgtctgcctaggtcactgctgccacttctcctcccactaacagacctttcttgaagacccactaggtccagacactgccgggacttgcaggtatggggggtagaaggagaggcagataagctgcctggggggctgttagctaatgggtacaaggacaccccctcccgagaagagaagccacagatgagtgggccagcgaggccagtcttcaatgtccactaattcactctaagcatttggccaaaaaaaggagagagaaataactgaaattgttcaggtggctccatcgtctattctgtggtcccctccatgagcctttgccccagggtgggtgcaggtgcgagtgtcacctgcagctgcctcagtcattcagagttccagagccttctgtggtggagcatcctgctgcttggaggatgagtctgaagtttaaaaatgggccttttctgagcccccctgatgagcagtcagtgcttctgggcccagctaaggaagccatctgttcccagcagaggagagctgctgcgctgacctgcagaggttggtggtcccagcacagagctgtgcccatgggcttgttagtgggaaaagcaaatacaacaatgttttaccaaacatttaattatgaatgcccactccccagcatctagatctaaaattattaacattttgccacattctttttctctctctgtgtatgtatatgttttctctgtcctaatttaaaagtacattgcaaacatcatgaaacttgatccctgaaagcttcagcctgcatctcctaagagttagggcattgtcctacacattggcccagtatcacagccaagacgagaagtcatttcccagcgatgtctgctatctaatctgtattcaaatccccccaattgtctcccaggtaacttatgtgtctggttttggaatcagcatccagtcacggtgcacacattgcattttctaactatgtttttaaaacctctttgaatgctgaaaggtcttccctcagctcactttgagtttttaaatgacattgtttttgaggccctaggcctgctgtctttttgaagccccacattctgaatttgtcagattgtttgctcatggtgtcgcataaccacttcttctatcccctgtactttcaaggataatttaggctacatgagattttgccttttgtgctgacttgacagcttcacttctgcctaagatgcgcctccactgtcacctgtaccaagtgccaaaacagcagaggggccagttagagcaagagctctgggggggcccggaaagtctccctggagaaggccgtaatatctgggccttggaaggaaggacacagggctctggaaggaggaggctgcatgcctgaaggctgggccttcgaccctggggatgggccacagggcaccaaacacatcatatgtctctctctttctattttggggtcccagggttttcatttcctggagacccgtggtctgtgtgcactggagcagagccaggctctcagttgcagcagggaaaagcctacatggggaactgcctcccgcaagctgtggtgtgagaagagccctggctggcagcaggagctgtgaagtttcatcccagccgggtgcatttagtagctgcctgaccatcttcctcccaggccctcagtttcttcatctgtagaatgagcagataggggccacagcagggattttcacacatcaaaggaggcagcctctgctctagttgatgtgaggatgagggggcggcctagaccccctgctgcccaggccgttgaggcaacactgggttcctggcttgacagctgtgggctggctgcccttgccagctcagacggctggcgagttttcagcttccctaagggactggcatagggttttgtggggtcaatgccaggaacctgggggaaactggatgcgttttatcctaagaagttcatccctcctgctcttactgtttccggccctggaggagaatgagggaggagagggttttctatgactgtgttagcttttattattagcaagagggctccttttgtaatttgtgcatgaaattcatgtcatttcctgggagaggagagggccgactggagagggtggggggcacactggggaagcaggcagaggtttccttcccttgtaggggggtggggagagtggggagagggggtgctatccagttcgcctgatgagggctctcgaaccagccgttttgggttgtgttaaaggtgagaccttcctccattaatgtacaatctcgaactaactgctaataaagtggggt

SEQ ID NO: 102608 - DNA, 7985 bp, Homo sapiens
  misc_feature (4317)..(4317): n is a, c, g, or t
cacggcccgggggacccaggcgtcccgctcctcgccgggagcgccccttcccccgagtggcgccccagccgtggcagccttagccccgtgggccccacggagtgagcggcatgcagcacccccgggcctgtccagtgtcctctggcctgctgccctgcacccccagaaggccctgacgccctggggcacttctgctctgcacaggaccacgcgggggtttgccatggtgacataaaggggcgcggaggaaggaaggagcgtgaccagcctgtggactgcgcccctggctgggaggaaggactgggggcccagatcctccactcccagtgccccacaagggcgtcgcttcctaagtctctgtgaatttgttggtcagtggacgattctcgtgtctcctcctgtgtggggccttggggtagccagggcaggccgggcctccggtggccaaggtctcggaggccaggatgcctgccctggcatgcctccggaggctgtgtcggcacgtgtccccgcaggctgtccttttcctgctgttcatcttctgcctgttcagcgttttcatctcggcctactacctatatggctggaagcgaggcctggagccctcggcggatgcccccgagcctgactgcggggacccgccgcctgtggcccccagtcgcctgctgccactcaagcctgtgcaggcagccaccccttcccgcacagacccgttggtgctggtctttgtggagagcctctactcgcaactgggccaggaggtggtggccatcctggagtccagccgcttcaaataccgcacagagattgcgccgggcaagggtgacatgcccacgctcactgacaagggccgtggccgcttcgccctcatcatctatgagaacatcctcaagtatgtcaacctggacgcctggaaccgggagctgctggacaagtactgtgtggcctacggcgtgggcatcattggcttcttcaaggccaatgagaacagcctgctgagtgcgcagctcaagggcttccccctgttcctgcactcaaacctgggcctgaaggactgcagcatcaaccccaagtccccgctgctctacgtgacgcgacctagcgaggtggagaaaggtgtgctccccggcgaggactggacggttttccagtcaaatcactccacctatgagccagtgctgctggccaagacgcgctcgtctgagtccatcccacacctgggcgcagacgccggcctgcatgctgcactgcacgccactgtggtccaggacctgggcctgcacgacggcatccagcgcgtgctgtttggcaacaacctgaacttctggctgcacaagcttgtcttcgtggatgccgtggccttcctcacggggaagcgcctctccctgccattggaccgctacatcctggtggacattgatgacatcttcgtgggcaaggagggcacacgcatgaaggtggaggacgtgaaggccctgtttgacacacagaacgaactacgcgcacacatcccaaacttcaccttcaacctgggctactcagggaaattcttccacacaggtaccaatgctgaggacgctggggatgatctgctgctgtcgtatgtgaaggagttctggtggttcccccacatgtggagccacatgcagccccaccttttccacaaccagtccgtgttggccgagcagatggccttgaacaagaagttcgctgtcgagcatggcattcccacagacatggggtatgcagtggcgccccaccactcgggcgtgtaccccgtgcacgtgcagctgtacgaggcttggaagcaggtgtggagcatccgcgtgaccagcacggaggagtacccccacctgaagccagcccgctaccgccgtggcttcatccacaatggcatcatggttctcccacggcagacctgcggcctcttcacacacaccatcttctacaacgagtaccctggcggctccagtgagctggacaagatcatcaacgggggcgagctcttcctcaccgtgctcctcaatcctatcagcatcttcatgacgcacctgtccaactatgggaatgaccgcctgggcctgtacaccttcaagcacctggtgcgcttcctgcactcctggaccaacctccggctgcagacactgccccctgtgcagttggcgcagaagtacttccagatcttctccgaggagaaggacccgctctggcaggacccctgcgaggacaaacgtcacaaagacatctggtccaaggagaagacgtgtgaccgcttcccaaagctcctcatcatcggcccccagaaaacaggcaccactgccctctacctgttcctgggcatgcaccctgacctaagcagcaactaccccagctctgagacctttgaggagatccagttttttaatggccacaactatcacaaaggcatcgactggtacatggagttcttccccatcccttccaacaccacctccgacttctactttgagaaaagcgccaactactttgattcagaagtggcgccccggcgggcagcagccctcttgcccaaagccaaggtcctgaccatcctcatcaaccccgcggaccgggcctattcctggtaccagcaccagcgagcccatgacgacccagtggccctaaagtacaccttccatgaggtgattaccgccggctctgacgcatcctcgaagctgcgtgccctccagaaccgctgcctggtccctggctggtacgccacccacatcgagcgctggctcagtgcctatcacgccaaccagattctggtcttggatggcaaactgcttcgcacagaacctgccaaagtgatggacatggtgcagaagttccttggggtgaccaacaccattgactaccacaaaaccttggcgtttgatccaaagaaaggattttggtgccaactgcttgaaggaggaaaaaccaagtgtctgggcaaaagcaagggccggaaatatcccgagatggacttggattcccgagccttcctgaaggactattaccgggaccacaacatcgagctctccaagctgctgtataagatgggccagacacttcccacttggctacgagaggacctccagaacaccaggtagccgtggccaccacagccagactgaacgtttgtgaaagctgggacatcccaccacacgctgagccagacctgcagagtgggaagctggaccagggcagctgcgcacttatgagcaatactctgtggaggtctggtggggctgggggagcacccaggcggatctgcaagcacctcggagcacccaccgctgggtctgcggcctaagggacctccctcgccagcagaggtccattccgttcccagctgctcctggggaggccgcttcctggtaggagggagtccacgagactcttttctgtccctcactgtgttccgccgactgtcccctctcgtcacccatcactccctgcttccgcagggcgcccctcagtattcgctgccatatgtccctgtcctccaggctgtaggggaggagagcctggccgggggagacagactggacatttccctgtttcgagccaggctcttccaaggggccagctgggtccccggagtcagtcctaggctggatgggagggtggccccctcaagaggactcccagcctccacatctggttcctaccttcacatctcaccctcccgttctggggaagaatttctggttcctacagtatccactccatcctcaaggcttcccgcagggccttggggcactgccttgccatcgggcccagttctccgggccccacctgcacccctttcttccccctgggatatgatgtgtggtgtttcctgtggtaaaagactgaggcaggccaggggtctgccagtaacatgttcccatgtacagacacggtccccacaccctcccagcctcaggcccaggcagacatgggcgagctggtgagactgccagccacggctttgcttagccacctgtggccgagggctctcagagacccccttaacctcccaaatactaagaagctaaaatattttaatattttgtttttttttttcttggtgccagagtttataccctgggtgctggggtcgcactgtgttatatatatatatatatatatatataatgtgtatatatatatattctattttttttggttgggttcgtttttaattcagtcctacaaaatggtggtaagccccagtctcaggggtcaccctgtcttagagctagagatgaggtggcagggagggaggctgtgtcctcagtggcctggggctgagcagaccttaggaagggnccctccccagtgccgtggctgctctggggctaccccaggtgaacagaggtggtgagatgcgcagggaagaccagctctctccaggacatcgggctgcgtgaagtccagtgaccctgaggggattttggccaaaggaaacagccagggctgggctaggagagctggggtcaaaagctgccccacccactctccctcacatggtgctaggctgggagctgccctgagagctgggatgcccaccaaggcccacagaactgtctccaggcccttgtagacagtgggatctctgggctgatttctggttggggtctgctcctaccccaccccatttaacaatgtgaagtgactgaggctggggtgcctctccctggccccctccaactgccaaattctgcttccctctgaaccccaggaaatactttctggagaggcttgtcttgttcagaagactctagcatcttggggctggaaggtcctttgacgggtatgaaacaggtccagaaaggggaggtggcctgcttggccgacgtcatggagccagctgggagcagggctgagcgttgaacccgaggctcccggttccaagtcccatcgtgctcctcttccaatgccacactgcctctgagcccatccttgggaccctactctgtgccaggttcctgtcccttcctccgtcacagcatggtcattccaggatatggggacaaaccactccttcccagccagggtgcctttgagccttctcattccgaggtctgcgtttgcatccctgtcgtgttctccctcgaggggtccttccccagcctgtgggggcctgggtctgttctgagctgattcccttttctccagttctctgctgggatgaagaaagttggacactcagtgggaccagctgcaggtggtttcactgtgtacacagcagtgtccccatcatgcctctcaatggggcctgcaagcctgggaacttgggcatcgttgggccagcaggatgagcagcaaagggtctgaggacagggtggcatgtctgcttgtgtgctcatgaagacatgcccacgccatggagccaggggcttacagagaggggcagtgacttccagagtcccatccgtcagtgaggggactgggctgcgggatgggtgaggatcttacagctcccaggttcggaaatctaccctctaggcctggaggcctctctcgcagagcatggaaggcaggagaggtgggctggcctagggcaggagctccacttctctctgcctctggctatgggaaggagcaggcggttggaaatcctgtgacagcagagatcttctggatttttgcctggacccttctgcaagcctggagactggacctgccacatgttccaagtctgtctgcctaggtcactgctgccacttctcctcccactaacagacctttcttgaagacccactaggtccagacactgccgggacttgcaggtatggggggtagaaggagaggcagataagctgcctggggggctgttagctaatgggtacaaggacaccccctcccgagaagagaagccacagatgagtgggccagcgaggccagtcttcaatgtccactaattcactctaagcatttggccaaaaaaaggagagagaaataactgaaattgttcaggtggctccatcgtctattctgtggtcccctccatgagcctttgccccagggtgggtgcaggtgcgagtgtcacctgcagctgcctcagtcattcagagttccagagccttctgtggtggagcatcctgctgcttggaggatgagtctgaagtttaaaaatgggccttttctgagcccccctgatgagcagtcagtgcttctgggcccagctaaggaagccatctgttcccagcagaggagagctgctgcgctgacctgcagaggttggtggtcccagcacagagctgtgcccatgggcttgttagtgggaaaagcaaatacaacaatgttttaccaaacatttaattatgaatgcccactccccagcatctagatctaaaattattaacattttgccacattctttttctctctctgtgtatgtatatgttttctctgtcctaatttaaaagtacattgcaaacatcatgaaacttgatccctgaaagcttcagcctgcatctcctaagagttagggcattgtcctacacattggcccagtatcacagccaagacgagaagtcatttcccagcgatgtctgctatctaatctgtattcaaatccccccaattgtctcccaggtaacttatgtgtctggttttggaatcagcatccagtcacggtgcacacattgcattttctaactatgtttttaaaacctctttgaatgctgaaaggtcttccctcagctcactttgagtttttaaatgacattgtttttgaggccctaggcctgctgtctttttgaagccccacattctgaatttgtcagattgtttgctcatggtgtcgcataaccacttcttctatcccctgtactttcaaggataatttaggctacatgagattttgccttttgtgctgacttgacagcttcacttctgcctaagatgcgcctccactgtcacctgtaccaagtgccaaaacagcagaggggccagttagagcaagagctctgggggggcccggaaagtctccctggagaaggccgtaatatctgggccttggaaggaaggacacagggctctggaaggaggaggctgcatgcctgaaggctgggccttcgaccctggggatgggccacagggcaccaaacacatcatatgtctctctctttctattttggggtcccagggttttcatttcctggagacccgtggtctgtgtgcactggagcagagccaggctctcagttgcagcagggaaaagcctacatggggaactgcctcccgcaagctgtggtgtgagaagagccctggctggcagcaggagctgtgaagtttcatcccagccgggtgcatttagtagctgcctgaccatcttcctcccaggccctcagtttcttcatctgtagaatgagcagataggggccacagcagggattttcacacatcaaaggaggcagcctctgctctagttgatgtgaggatgagggggcggcctagaccccctgctgcccaggccgttgaggcaacactgggttcctggcttgacagctgtgggctggctgcccttgccagctcagacggctggcgagttttcagcttccctaagggactggcatagggttttgtggggtcaatgccaggaacctgggggaaactggatgcgttttatcctaagaagttcatccctcctgctcttactgtttccggccctggaggagaatgagggaggagagggttttctatgactgtgttagcttttattattagcaagagggctccttttgtaatttgtgcatgaaattcatgtcatttcctgggagaggagagggccgactggagagggtggggggcacactggggaagcaggcagaggtttccttcccttgtaggggggtggggagagtggggagagggggtgctatccagttcgcctgatgagggctctcgaaccagccgttttgggttgtgttaaaggtgagaccttcctccattaatgtacaatctcgaactaactgctaataaagtggggt

SEQ ID NO: 102609 - DNA, 8002 bp, Homo sapiens
  misc_feature (4359)..(4359): n is a, c, g, or t
gcggccgcgattcggggaggtaggcgctgggccgaggaggtgcagccgtgttaaggagaggacattcgagagggcgtggcgaagtgaagaggaacctcacgccactgcctggagctccgccttagccccgtgggccccacggagtgagcggcatgcagcacccccgggcctgtccagtgtcctctggcctgctgccctgcacccccagaaggccctgacgccctggggcacttctgctctgcacaggaccacgcgggggtttgccatggtgacataaaggggcgcggaggaaggaaggagcgtgaccagcctgtggactgcgcccctggctgggaggaaggactgggggcccagatcctccactcccagtgccccacaagggcgtcgcttcctaagtctctgtgaatttgttggtcagtggacgattctcgtgtctcctcctgtgtggggccttggggtagccagggcaggccgggcctccggtggccaaggtctcggaggccaggatgcctgccctggcatgcctccggaggctgtgtcggcacgtgtccccgcaggctgtccttttcctgctgttcatcttctgcctgttcagcgttttcatctcggcctactacctatatggctggaagcgaggcctggagccctcggcggatgcccccgagcctgactgcggggacccgccgcctgtggcccccagtcgcctgctgccactcaagcctgtgcaggcagccaccccttcccgcacagacccgttggtgctggtctttgtggagagcctctactcgcaactgggccaggaggtggtggccatcctggagtccagccgcttcaaataccgcacagagattgcgccgggcaagggtgacatgcccacgctcactgacaagggccgtggccgcttcgccctcatcatctatgagaacatcctcaagtatgtcaacctggacgcctggaaccgggagctgctggacaagtactgtgtggcctacggcgtgggcatcattggcttcttcaaggccaatgagaacagcctgctgagtgcgcagctcaagggcttccccctgttcctgcactcaaacctgggcctgaaggactgcagcatcaaccccaagtccccgctgctctacgtgacgcgacctagcgaggtggagaaaggtgtgctccccggcgaggactggacggttttccagtcaaatcactccacctatgagccagtgctgctggccaagacgcgctcgtctgagtccatcccacacctgggcgcagacgccggcctgcatgctgcactgcacgccactgtggtccaggacctgggcctgcacgacggcatccagcgcgtgctgtttggcaacaacctgaacttctggctgcacaagcttgtcttcgtggatgccgtggccttcctcacggggaagcgcctctccctgccattggaccgctacatcctggtggacattgatgacatcttcgtgggcaaggagggcacacgcatgaaggtggaggacgtgaaggccctgtttgacacacagaacgaactacgcgcacacatcccaaacttcaccttcaacctgggctactcagggaaattcttccacacaggtaccaatgctgaggacgctggggatgatctgctgctgtcgtatgtgaaggagttctggtggttcccccacatgtggagccacatgcagccccaccttttccacaaccagtccgtgttggccgagcagatggccttgaacaagaagttcgctgtcgagcatggcattcccacagacatggggtatgcagtggcgccccaccactcgggcgtgtaccccgtgcacgtgcagctgtacgaggcttggaagcaggtgtggagcatccgcgtgaccagcacggaggagtacccccacctgaagccagcccgctaccgccgtggcttcatccacaatggcatcatggttctcccacggcagacctgcggcctcttcacacacaccatcttctacaacgagtaccctggcggctccagtgagctggacaagatcatcaacgggggcgagctcttcctcaccgtgctcctcaatcctatcagcatcttcatgacgcacctgtccaactatgggaatgaccgcctgggcctgtacaccttcaagcacctggtgcgcttcctgcactcctggaccaacctccggctgcagacactgccccctgtgcagttggcgcagaagtacttccagatcttctccgaggagaaggacccgctctggcaggacccctgcgaggacaaacgtcacaaagacatctggtccaaggagaagacgtgtgaccgcttcccaaagctcctcatcatcggcccccagaaaacaggcaccactgccctctacctgttcctgggcatgcaccctgacctaagcagcaactaccccagctctgagacctttgaggagatccagttttttaatggccacaactatcacaaaggcatcgactggtacatggagttcttccccatcccttccaacaccacctccgacttctactttgagaaaagcgccaactactttgattcagaagtggcgccccggcgggcagcagccctcttgcccaaagccaaggtcctgaccatcctcatcaaccccgcggaccgggcctattcctggtaccagcaccagcgagcccatgacgacccagtggccctaaagtacaccttccatgaggtgattaccgccggctctgacgcatcctcgaagctgcgtgccctccagaaccgctgcctggtccctggctggtacgccacccacatcgagcgctggctcagtgcctatcacgccaaccagattctggtcttggatggcaaactgcttcgcacagaacctgccaaagtgatggacatggtgcagaagttccttggggtgaccaacaccattgactaccacaaaaccttggcgtttgatccaaagaaaggattttggtgccaactgcttgaaggaggaaaaaccaagtgtctgggcaaaagcaagggccggaaatatcccgagatggacttggattcccgagccttcctgaaggactattaccgggaccacaacatcgagctctccaagctgctgtataagatgggccagacacttcccacttggctacgagaggacctccagaacaccaggtagccgtggccaccacagccagactgaacgtttgtgaaagctgggacatcccaccacacgctgagccagacctgcagagtgggaagctggaccagggcagctgcgcacttatgagcaatactctgtggaggtctggtggggctgggggagcacccaggcggatctgcaagcacctcggagcacccaccgctgggtctgcggcctaagggacctccctcgccagcagaggtccattccgttcccagctgctcctggggaggccgcttcctggtaggagggagtccacgagactcttttctgtccctcactgtgttccgccgactgtcccctctcgtcacccatcactccctgcttccgcagggcgcccctcagtattcgctgccatatgtccctgtcctccaggctgtaggggaggagagcctggccgggggagacagactggacatttccctgtttcgagccaggctcttccaaggggccagctgggtccccggagtcagtcctaggctggatgggagggtggccccctcaagaggactcccagcctccacatctggttcctaccttcacatctcaccctcccgttctggggaagaatttctggttcctacagtatccactccatcctcaaggcttcccgcagggccttggggcactgccttgccatcgggcccagttctccgggccccacctgcacccctttcttccccctgggatatgatgtgtggtgtttcctgtggtaaaagactgaggcaggccaggggtctgccagtaacatgttcccatgtacagacacggtccccacaccctcccagcctcaggcccaggcagacatgggcgagctggtgagactgccagccacggctttgcttagccacctgtggccgagggctctcagagacccccttaacctcccaaatactaagaagctaaaatattttaatattttgtttttttttttcttggtgccagagtttataccctgggtgctggggtcgcactgtgttatatatatatatatatatatatataatgtgtatatatatatattctattttttttggttgggttcgtttttaattcagtcctacaaaatggtggtaagccccagtctcaggggtcaccctgtcttagagctagagatgaggtggcagggagggaggctgtgtcctcagtggcctggggctgagcagaccttaggaagggnccctccccagtgccgtggctgctctggggctaccccaggtgaacagaggtggtgagatgcgcagggaagaccagctctctccaggacatcgggctgcgtgaagtccagtgaccctgaggggattttggccaaaggaaacagccagggctgggctaggagagctggggtcaaaagctgccccacccactctccctcacatggtgctaggctgggagctgccctgagagctgggatgcccaccaaggcccacagaactgtctccaggcccttgtagacagtgggatctctgggctgatttctggttggggtctgctcctaccccaccccatttaacaatgtgaagtgactgaggctggggtgcctctccctggccccctccaactgccaaattctgcttccctctgaaccccaggaaatactttctggagaggcttgtcttgttcagaagactctagcatcttggggctggaaggtcctttgacgggtatgaaacaggtccagaaaggggaggtggcctgcttggccgacgtcatggagccagctgggagcagggctgagcgttgaacccgaggctcccggttccaagtcccatcgtgctcctcttccaatgccacactgcctctgagcccatccttgggaccctactctgtgccaggttcctgtcccttcctccgtcacagcatggtcattccaggatatggggacaaaccactccttcccagccagggtgcctttgagccttctcattccgaggtctgcgtttgcatccctgtcgtgttctccctcgaggggtccttccccagcctgtgggggcctgggtctgttctgagctgattcccttttctccagttctctgctgggatgaagaaagttggacactcagtgggaccagctgcaggtggtttcactgtgtacacagcagtgtccccatcatgcctctcaatggggcctgcaagcctgggaacttgggcatcgttgggccagcaggatgagcagcaaagggtctgaggacagggtggcatgtctgcttgtgtgctcatgaagacatgcccacgccatggagccaggggcttacagagaggggcagtgacttccagagtcccatccgtcagtgaggggactgggctgcgggatgggtgaggatcttacagctcccaggttcggaaatctaccctctaggcctggaggcctctctcgcagagcatggaaggcaggagaggtgggctggcctagggcaggagctccacttctctctgcctctggctatgggaaggagcaggcggttggaaatcctgtgacagcagagatcttctggatttttgcctggacccttctgcaagcctggagactggacctgccacatgttccaagtctgtctgcctaggtcactgctgccacttctcctcccactaacagacctttcttgaagacccactaggtccagacactgccgggacttgcaggtatggggggtagaaggagaggcagataagctgcctggggggctgttagctaatgggtacaaggacaccccctcccgagaagagaagccacagatgagtgggccagcgaggccagtcttcaatgtccactaattcactctaagcatttggccaaaaaaaggagagagaaataactgaaattgttcaggtggctccatcgtctattctgtggtcccctccatgagcctttgccccagggtgggtgcaggtgcgagtgtcacctgcagctgcctcagtcattcagagttccagagccttctgtggtggagcatcctgctgcttggaggatgagtctgaagtttaaaaatgggccttttctgagcccccctgatgagcagtcagtgcttctgggcccagctaaggaagccatctgttcccagcagaggagagctgctgcgctgacctgcagaggttggtggtcccagcacagagctgtgcccatgggcttgttagtgggaaaagcaaatacaacaatgttttaccaaacatttaattatgaatgcccactccccagcatctagatctaaaattattaacattttgccacattctttttctctctctgtgtatgtatatgttttctctgtcctaatttaaaagtacattgcaaacatcatgaaacttgatccctgaaagcttcagcctgcatctcctaagagttagggcattgtcctacacattggcccagtatcacagccaagacgagaagtcatttcccagcgatgtctgctatctaatctgtattcaaatccccccaattgtctcccaggtaacttatgtgtctggttttggaatcagcatccagtcacggtgcacacattgcattttctaactatgtttttaaaacctctttgaatgctgaaaggtcttccctcagctcactttgagtttttaaatgacattgtttttgaggccctaggcctgctgtctttttgaagccccacattctgaatttgtcagattgtttgctcatggtgtcgcataaccacttcttctatcccctgtactttcaaggataatttaggctacatgagattttgccttttgtgctgacttgacagcttcacttctgcctaagatgcgcctccactgtcacctgtaccaagtgccaaaacagcagaggggccagttagagcaagagctctgggggggcccggaaagtctccctggagaaggccgtaatatctgggccttggaaggaaggacacagggctctggaaggaggaggctgcatgcctgaaggctgggccttcgaccctggggatgggccacagggcaccaaacacatcatatgtctctctctttctattttggggtcccagggttttcatttcctggagacccgtggtctgtgtgcactggagcagagccaggctctcagttgcagcagggaaaagcctacatggggaactgcctcccgcaagctgtggtgtgagaagagccctggctggcagcaggagctgtgaagtttcatcccagccgggtgcatttagtagctgcctgaccatcttcctcccaggccctcagtttcttcatctgtagaatgagcagataggggccacagcagggattttcacacatcaaaggaggcagcctctgctctagttgatgtgaggatgagggggcggcctagaccccctgctgcccaggccgttgaggcaacactgggttcctggcttgacagctgtgggctggctgcccttgccagctcagacggctggcgagttttcagcttccctaagggactggcatagggttttgtggggtcaatgccaggaacctgggggaaactggatgcgttttatcctaagaagttcatccctcctgctcttactgtttccggccctggaggagaatgagggaggagagggttttctatgactgtgttagcttttattattagcaagagggctccttttgtaatttgtgcatgaaattcatgtcatttcctgggagaggagagggccgactggagagggtggggggcacactggggaagcaggcagagggagagtggggagagggggtgctatccagttcgcctgatgagggctctcgaaccagccgttttgggttgtgttaaaggtgagaccttcctccattaatgtacaatctcgaactaactgctaataaagtggggt

SEQ ID NO: 102610 - DNA, 7627 bp, Homo sapiens
  misc_feature (4359)..(4359): n is a, c, g, or t
gcggccgcgattcggggaggtaggcgctgggccgaggaggtgcagccgtgttaaggagaggacattcgagagggcgtggcgaagtgaagaggaacctcacgccactgcctggagctccgccttagccccgtgggccccacggagtgagcggcatgcagcacccccgggcctgtccagtgtcctctggcctgctgccctgcacccccagaaggccctgacgccctggggcacttctgctctgcacaggaccacgcgggggtttgccatggtgacataaaggggcgcggaggaaggaaggagcgtgaccagcctgtggactgcgcccctggctgggaggaaggactgggggcccagatcctccactcccagtgccccacaagggcgtcgcttcctaagtctctgtgaatttgttggtcagtggacgattctcgtgtctcctcctgtgtggggccttggggtagccagggcaggccgggcctccggtggccaaggtctcggaggccaggatgcctgccctggcatgcctccggaggctgtgtcggcacgtgtccccgcaggctgtccttttcctgctgttcatcttctgcctgttcagcgttttcatctcggcctactacctatatggctggaagcgaggcctggagccctcggcggatgcccccgagcctgactgcggggacccgccgcctgtggcccccagtcgcctgctgccactcaagcctgtgcaggcagccaccccttcccgcacagacccgttggtgctggtctttgtggagagcctctactcgcaactgggccaggaggtggtggccatcctggagtccagccgcttcaaataccgcacagagattgcgccgggcaagggtgacatgcccacgctcactgacaagggccgtggccgcttcgccctcatcatctatgagaacatcctcaagtatgtcaacctggacgcctggaaccgggagctgctggacaagtactgtgtggcctacggcgtgggcatcattggcttcttcaaggccaatgagaacagcctgctgagtgcgcagctcaagggcttccccctgttcctgcactcaaacctgggcctgaaggactgcagcatcaaccccaagtccccgctgctctacgtgacgcgacctagcgaggtggagaaaggtgtgctccccggcgaggactggacggttttccagtcaaatcactccacctatgagccagtgctgctggccaagacgcgctcgtctgagtccatcccacacctgggcgcagacgccggcctgcatgctgcactgcacgccactgtggtccaggacctgggcctgcacgacggcatccagcgcgtgctgtttggcaacaacctgaacttctggctgcacaagcttgtcttcgtggatgccgtggccttcctcacggggaagcgcctctccctgccattggaccgctacatcctggtggacattgatgacatcttcgtgggcaaggagggcacacgcatgaaggtggaggacgtgaaggccctgtttgacacacagaacgaactacgcgcacacatcccaaacttcaccttcaacctgggctactcagggaaattcttccacacaggtaccaatgctgaggacgctggggatgatctgctgctgtcgtatgtgaaggagttctggtggttcccccacatgtggagccacatgcagccccaccttttccacaaccagtccgtgttggccgagcagatggccttgaacaagaagttcgctgtcgagcatggcattcccacagacatggggtatgcagtggcgccccaccactcgggcgtgtaccccgtgcacgtgcagctgtacgaggcttggaagcaggtgtggagcatccgcgtgaccagcacggaggagtacccccacctgaagccagcccgctaccgccgtggcttcatccacaatggcatcatggttctcccacggcagacctgcggcctcttcacacacaccatcttctacaacgagtaccctggcggctccagtgagctggacaagatcatcaacgggggcgagctcttcctcaccgtgctcctcaatcctatcagcatcttcatgacgcacctgtccaactatgggaatgaccgcctgggcctgtacaccttcaagcacctggtgcgcttcctgcactcctggaccaacctccggctgcagacactgccccctgtgcagttggcgcagaagtacttccagatcttctccgaggagaaggacccgctctggcaggacccctgcgaggacaaacgtcacaaagacatctggtccaaggagaagacgtgtgaccgcttcccaaagctcctcatcatcggcccccagaaaacaggcaccactgccctctacctgttcctgggcatgcaccctgacctaagcagcaactaccccagctctgagacctttgaggagatccagttttttaatggccacaactatcacaaaggcatcgactggtacatggagttcttccccatcccttccaacaccacctccgacttctactttgagaaaagcgccaactactttgattcagaagtggcgccccggcgggcagcagccctcttgcccaaagccaaggtcctgaccatcctcatcaaccccgcggaccgggcctattcctggtaccagcaccagcgagcccatgacgacccagtggccctaaagtacaccttccatgaggtgattaccgccggctctgacgcatcctcgaagctgcgtgccctccagaaccgctgcctggtccctggctggtacgccacccacatcgagcgctggctcagtgcctatcacgccaaccagattctggtcttggatggcaaactgcttcgcacagaacctgccaaagtgatggacatggtgcagaagttccttggggtgaccaacaccattgactaccacaaaaccttggcgtttgatccaaagaaaggattttggtgccaactgcttgaaggaggaaaaaccaagtgtctgggcaaaagcaagggccggaaatatcccgagatggacttggattcccgagccttcctgaaggactattaccgggaccacaacatcgagctctccaagctgctgtataagatgggccagacacttcccacttggctacgagaggacctccagaacaccaggtagccgtggccaccacagccagactgaacgtttgtgaaagctgggacatcccaccacacgctgagccagacctgcagagtgggaagctggaccagggcagctgcgcacttatgagcaatactctgtggaggtctggtggggctgggggagcacccaggcggatctgcaagcacctcggagcacccaccgctgggtctgcggcctaagggacctccctcgccagcagaggtccattccgttcccagctgctcctggggaggccgcttcctggtaggagggagtccacgagactcttttctgtccctcactgtgttccgccgactgtcccctctcgtcacccatcactccctgcttccgcagggcgcccctcagtattcgctgccatatgtccctgtcctccaggctgtaggggaggagagcctggccgggggagacagactggacatttccctgtttcgagccaggctcttccaaggggccagctgggtccccggagtcagtcctaggctggatgggagggtggccccctcaagaggactcccagcctccacatctggttcctaccttcacatctcaccctcccgttctggggaagaatttctggttcctacagtatccactccatcctcaaggcttcccgcagggccttggggcactgccttgccatcgggcccagttctccgggccccacctgcacccctttcttccccctgggatatgatgtgtggtgtttcctgtggtaaaagactgaggcaggccaggggtctgccagtaacatgttcccatgtacagacacggtccccacaccctcccagcctcaggcccaggcagacatgggcgagctggtgagactgccagccacggctttgcttagccacctgtggccgagggctctcagagacccccttaacctcccaaatactaagaagctaaaatattttaatattttgtttttttttttcttggtgccagagtttataccctgggtgctggggtcgcactgtgttatatatatatatatatatatatataatgtgtatatatatatattctattttttttggttgggttcgtttttaattcagtcctacaaaatggtggtaagccccagtctcaggggtcaccctgtcttagagctagagatgaggtggcagggagggaggctgtgtcctcagtggcctggggctgagcagaccttaggaagggnccctccccagtgccgtggctgctctggggctaccccaggtgaacagaggtggtgagatgcgcagggaagaccagctctctccaggacatcgggctgcgtgaagtccagtgaccctgaggggattttggccaaaggaaacagccagggctgggctaggagagctggggtcaaaagctgccccacccactctccctcacatggtgctaggctgggagctgccctgagagctgggatgcccaccaaggcccacagaactgtctccaggcccttgtagacagtgggatctctgggctgatttctggttggggtctgctcctaccccaccccatttaacaatgtgaagtgactgaggctggggtgcctctccctggccccctccaactgccaaattctgcttccctctgaaccccaggaaatactttctggagaggcttgtcttgttcagaagactctagcatcttggggctggaaggtcctttgacgggtatgaaacaggtccagaaaggggaggtggcctgcttggccgacgtcatggagccagctgggagcagggctgagcgttgaacccgaggctcccggttccaagtcccatcgtgctcctcttccaatgccacactgcctctgagcccatccttgggaccctactctgtgccaggttcctgtcccttcctccgtcacagcatggtcattccaggatatggggacaaaccactccttcccagccagggtgcctttgagccttctcattccgaggtctgcgtttgcatccctgtcgtgttctccctcgaggggtccttccccagcctgtgggggcctgggtctgttctgagctgattcccttttctccagttctctgctgggatgaagaaagttggacactcagtgggaccagctgcaggtggtttcactgtgtacacagcagtgtccccatcatgcctctcaatggggcctgcaagcctgggaacttgggcatcgttgggccagcaggatgagcagcaaagggtctgaggacagggtggcatgtctgcttgtgtgctcatgaagacatgcccacgccatggagccaggggcttacagagaggggcagtgacttccagagtcccatccgtcagtgaggggactgggctgcgggatgggtgaggatcttacagctcccaggttcggaaatctaccctctaggcctggaggcctctctcgcagagcatggaaggcaggagaggtgggctggcctagggcaggagctccacttctctctgcctctggctatgggaaggagcaggcggttggaaatcctgtgacagcagagatcttctggatttttgcctggacccttctgcaagcctggagactggacctgccacatgttccaagtctgtctgcctaggtcactgctgccacttctcctcccactaacagacctttcttgaagacccactaggtccagacactgccgggacttgcaggtatggggggtagaaggagaggcagataagctgcctggggggctgttagctaatgggtacaaggacaccccctcccgagaagagaagccacagatgagtgggccagcgaggccagtcttcaatgtccactaattcactctaagcatttggccaaaaaaaggagagagaaataactgaaattgttcaggtggctccatcgtctattctgtggtcccctccatgagcctttgccccagggtgggtgcaggtgcgagtgtcacctgcagctgcctcagtcattcagagttccagagccttctgtggtggagcatcctgctgcttggaggatgagtctgaagtttaaaaatgggccttttctgagcccccctgatgagcagtcagtgcttctgggcccagctaaggaagccatctgttcccagcagaggagagctgctgcgctgacctgcagaggttggtggtcccagcacagagctgtgcccatgggcttgttagtgggaaaagcaaatacaacaatgttttaccaaacatttaattatgaatgcccactccccagcatctagatctaaaattattaacattttgccacattctttttctctctctgtgtatgtatatgttttctctgtcctaatttaaaagtacattgcaaacatcatgaaacttgatccctgaaagcttcagcctgcatctcctaagagttagggcattgtcctacacattggcccagtatcacagccaagacgagaagtcatttcccagcgatgtctgctatctaatctgtattcaaatccccccaattgtctcccaggtaacttatgtgtctggttttggaatcagcatccagtcacggtgcacacattgcattttctaactatgtttttaaaacctctttgaatgctgaaaggtcttccctcagctcactttgagtttttaaatgacattgtttttgaggccctaggcctgctgtctttttgaagccccacattctgaatttgtcagattgtttgctcatggtgtcgcataaccacttcttctatcccctgtactttcaaggataatttaggctacatgagattttgccttttgtgctgacttgacagcttcacttctgcctaagatgcgcctccactgtcacctgtaccaagtgccaaaacagcagaggggccagttagagcaagagctctgggggggcccggaaagtctccctggagaaggccgtaatatctgggccttggaaggaaggacacagggctctggaaggaggaggctgcatgcctgaaggctgggccttcgaccctggggatgggccacagggcaccaaacacatcatatgtctctctctttctattttggggtcccagggttttcatttcctggagacccgtggtctgtgtgcactggagcagagccaggctctcagttgcagcagggaaaagcctacatggggaactgcctcccgcaagctgtggtgtgagaagagccctggctggcagcaggagctgtgaagtttcatcccagccgggtgcatttagtagctgcctgaccatcttctccttttgtaatttgtgcatgaaattcatgtcatttcctgggagaggagagggccgactggagagggtggggggcacactggggaagcaggcagaggtttccttcccttgtaggggggtggggagagtggggagagggggtgctatccagttcgcctgatgagggctctcgaaccagccgttttgggttgtgttaaaggtgagaccttcctccattaatgtacaatctcgaactaactgctaataaagtggggt

SEQ ID NO: 102611 - DNA, 7463 bp, Homo sapiens
  misc_feature (4359)..(4359): n is a, c, g, or t
gcggccgcgattcggggaggtaggcgctgggccgaggaggtgcagccgtgttaaggagaggacattcgagagggcgtggcgaagtgaagaggaacctcacgccactgcctggagctccgccttagccccgtgggccccacggagtgagcggcatgcagcacccccgggcctgtccagtgtcctctggcctgctgccctgcacccccagaaggccctgacgccctggggcacttctgctctgcacaggaccacgcgggggtttgccatggtgacataaaggggcgcggaggaaggaaggagcgtgaccagcctgtggactgcgcccctggctgggaggaaggactgggggcccagatcctccactcccagtgccccacaagggcgtcgcttcctaagtctctgtgaatttgttggtcagtggacgattctcgtgtctcctcctgtgtggggccttggggtagccagggcaggccgggcctccggtggccaaggtctcggaggccaggatgcctgccctggcatgcctccggaggctgtgtcggcacgtgtccccgcaggctgtccttttcctgctgttcatcttctgcctgttcagcgttttcatctcggcctactacctatatggctggaagcgaggcctggagccctcggcggatgcccccgagcctgactgcggggacccgccgcctgtggcccccagtcgcctgctgccactcaagcctgtgcaggcagccaccccttcccgcacagacccgttggtgctggtctttgtggagagcctctactcgcaactgggccaggaggtggtggccatcctggagtccagccgcttcaaataccgcacagagattgcgccgggcaagggtgacatgcccacgctcactgacaagggccgtggccgcttcgccctcatcatctatgagaacatcctcaagtatgtcaacctggacgcctggaaccgggagctgctggacaagtactgtgtggcctacggcgtgggcatcattggcttcttcaaggccaatgagaacagcctgctgagtgcgcagctcaagggcttccccctgttcctgcactcaaacctgggcctgaaggactgcagcatcaaccccaagtccccgctgctctacgtgacgcgacctagcgaggtggagaaaggtgtgctccccggcgaggactggacggttttccagtcaaatcactccacctatgagccagtgctgctggccaagacgcgctcgtctgagtccatcccacacctgggcgcagacgccggcctgcatgctgcactgcacgccactgtggtccaggacctgggcctgcacgacggcatccagcgcgtgctgtttggcaacaacctgaacttctggctgcacaagcttgtcttcgtggatgccgtggccttcctcacggggaagcgcctctccctgccattggaccgctacatcctggtggacattgatgacatcttcgtgggcaaggagggcacacgcatgaaggtggaggacgtgaaggccctgtttgacacacagaacgaactacgcgcacacatcccaaacttcaccttcaacctgggctactcagggaaattcttccacacaggtaccaatgctgaggacgctggggatgatctgctgctgtcgtatgtgaaggagttctggtggttcccccacatgtggagccacatgcagccccaccttttccacaaccagtccgtgttggccgagcagatggccttgaacaagaagttcgctgtcgagcatggcattcccacagacatggggtatgcagtggcgccccaccactcgggcgtgtaccccgtgcacgtgcagctgtacgaggcttggaagcaggtgtggagcatccgcgtgaccagcacggaggagtacccccacctgaagccagcccgctaccgccgtggcttcatccacaatggcatcatggttctcccacggcagacctgcggcctcttcacacacaccatcttctacaacgagtaccctggcggctccagtgagctggacaagatcatcaacgggggcgagctcttcctcaccgtgctcctcaatcctatcagcatcttcatgacgcacctgtccaactatgggaatgaccgcctgggcctgtacaccttcaagcacctggtgcgcttcctgcactcctggaccaacctccggctgcagacactgccccctgtgcagttggcgcagaagtacttccagatcttctccgaggagaaggacccgctctggcaggacccctgcgaggacaaacgtcacaaagacatctggtccaaggagaagacgtgtgaccgcttcccaaagctcctcatcatcggcccccagaaaacaggcaccactgccctctacctgttcctgggcatgcaccctgacctaagcagcaactaccccagctctgagacctttgaggagatccagttttttaatggccacaactatcacaaaggcatcgactggtacatggagttcttccccatcccttccaacaccacctccgacttctactttgagaaaagcgccaactactttgattcagaagtggcgccccggcgggcagcagccctcttgcccaaagccaaggtcctgaccatcctcatcaaccccgcggaccgggcctattcctggtaccagcaccagcgagcccatgacgacccagtggccctaaagtacaccttccatgaggtgattaccgccggctctgacgcatcctcgaagctgcgtgccctccagaaccgctgcctggtccctggctggtacgccacccacatcgagcgctggctcagtgcctatcacgccaaccagattctggtcttggatggcaaactgcttcgcacagaacctgccaaagtgatggacatggtgcagaagttccttggggtgaccaacaccattgactaccacaaaaccttggcgtttgatccaaagaaaggattttggtgccaactgcttgaaggaggaaaaaccaagtgtctgggcaaaagcaagggccggaaatatcccgagatggacttggattcccgagccttcctgaaggactattaccgggaccacaacatcgagctctccaagctgctgtataagatgggccagacacttcccacttggctacgagaggacctccagaacaccaggtagccgtggccaccacagccagactgaacgtttgtgaaagctgggacatcccaccacacgctgagccagacctgcagagtgggaagctggaccagggcagctgcgcacttatgagcaatactctgtggaggtctggtggggctgggggagcacccaggcggatctgcaagcacctcggagcacccaccgctgggtctgcggcctaagggacctccctcgccagcagaggtccattccgttcccagctgctcctggggaggccgcttcctggtaggagggagtccacgagactcttttctgtccctcactgtgttccgccgactgtcccctctcgtcacccatcactccctgcttccgcagggcgcccctcagtattcgctgccatatgtccctgtcctccaggctgtaggggaggagagcctggccgggggagacagactggacatttccctgtttcgagccaggctcttccaaggggccagctgggtccccggagtcagtcctaggctggatgggagggtggccccctcaagaggactcccagcctccacatctggttcctaccttcacatctcaccctcccgttctggggaagaatttctggttcctacagtatccactccatcctcaaggcttcccgcagggccttggggcactgccttgccatcgggcccagttctccgggccccacctgcacccctttcttccccctgggatatgatgtgtggtgtttcctgtggtaaaagactgaggcaggccaggggtctgccagtaacatgttcccatgtacagacacggtccccacaccctcccagcctcaggcccaggcagacatgggcgagctggtgagactgccagccacggctttgcttagccacctgtggccgagggctctcagagacccccttaacctcccaaatactaagaagctaaaatattttaatattttgtttttttttttcttggtgccagagtttataccctgggtgctggggtcgcactgtgttatatatatatatatatatatatataatgtgtatatatatatattctattttttttggttgggttcgtttttaattcagtcctacaaaatggtggtaagccccagtctcaggggtcaccctgtcttagagctagagatgaggtggcagggagggaggctgtgtcctcagtggcctggggctgagcagaccttaggaagggnccctccccagtgccgtggctgctctggggctaccccaggtgaacagaggtggtgagatgcgcagggaagaccagctctctccaggacatcgggctgcgtgaagtccagtgaccctgaggggattttggccaaaggaaacagccagggctgggctaggagagctggggtcaaaagctgccccacccactctccctcacatggtgctaggctgggagctgccctgagagctgggatgcccaccaaggcccacagaactgtctccaggcccttgtagacagtgggatctctgggctgatttctggttggggtctgctcctaccccaccccatttaacaatgtgaagtgactgaggctggggtgcctctccctggccccctccaactgccaaattctgcttccctctgaaccccaggaaatactttctggagaggcttgtcttgttcagaagactctagcatcttggggctggaaggtcctttgacgggtatgaaacaggtccagaaaggggaggtggcctgcttggccgacgtcatggagccagctgggagcagggctgagcgttgaacccgaggctcccggttccaagtcccatcgtgctcctcttccaatgccacactgcctctgagcccatccttgggaccctactctgtgccaggttcctgtcccttcctccgtcacagcatggtcattccaggatatggggacaaaccactccttcccagccagggtgcctttgagccttctcattccgaggtctgcgtttgcatccctgtcgtgttctccctcgaggggtccttccccagcctgtgggggcctgggtctgttctgagctgattcccttttctccagttctctgctgggatgaagaaagttggacactcagtgggaccagctgcaggtggtttcactgtgtacacagcagtgtccccatcatgcctctcaatggggcctgcaagcctgggaacttgggcatcgttgggccagcaggatgagcagcaaagggtctgaggacagggtggcatgtctgcttgtgtgctcatgaagacatgcccacgccatggagccaggggcttacagagaggggcagtgacttccagagtcccatccgtcagtgaggggactgggctgcgggatgggtgaggatcttacagctcccaggttcggaaatctaccctctaggcctggaggcctctctcgcagagcatggaaggcaggagaggtgggctggcctagggcaggagctccacttctctctgcctctggctatgggaaggagcaggcggttggaaatcctgtgacagcagagatcttctggatttttgcctggacccttctgcaagcctggagactggacctgccacatgttccaagtctgtctgcctaggtcactgctgccacttctcctcccactaacagacctttcttgaagacccactaggtccagacactgccgggacttgcaggtatggggggtagaaggagaggcagataagctgcctggggggctgttagctaatgggtacaaggacaccccctcccgagaagagaagccacagatgagtgggccagcgaggccagtcttcaatgtccactaattcactctaagcatttggccaaaaaaaggagagagaaataactgaaattgttcaggtggctccatcgtctattctgtggtcccctccatgagcctttgccccagggtgggtgcaggtgcgagtgtcacctgcagctgcctcagtcattcagagttccagagccttctgtggtggagcatcctgctgcttggaggatgagtctgaagtttaaaaatgggccttttctgagcccccctgatgagcagtcagtgcttctgggcccagctaaggaagccatctgttcccagcagaggagagctgctgcgctgacctgcagaggttggtggtcccagcacagagctgtgcccatgggcttgttagtgggaaaagcaaatacaacaatgttttaccaaacatttaattatgaatgcccactccccagcatctagatctaaaattattaacattttgccacattctttttctctctctgtgtatgtatatgttttctctgtcctaatttaaaagtacattgcaaacatcatgaaacttgatccctgaaagcttcagcctgcatctcctaagagttagggcattgtcctacacattggcccagtatcacagccaagacgagaagtcatttcccagcgatgtctgctatctaatctgtattcaaatccccccaattgtctcccaggtaacttatgtgtctggttttggaatcagcatccagtcacggtgcacacattgcattttctaactatgtttttaaaacctctttgaatgctgaaaggtcttccctcagctcactttgagtttttaaatgacattgtttttgaggccctaggcctgctgtctttttgaagccccacattctgaatttgtcagattgtttgctcatggtgtcgcataaccacttcttctatcccctgtactttcaaggataatttaggctacatgagattttgccttttgtgctgacttgacagcttcacttctgcctaagatgcgcctccactgtcacctgtaccaagtgccaaaacagcagaggggccagttagagcaagagctctgggggggcccggaaagtctccctggagaaggccgtaatatctgggccttggaaggaaggacacagggctctggaaggaggaggctgcatgcctgaaggctgggccttcgaccctggggatgggccacagggcaccaaacacatcatatgtctctctctttggttttctatgactgtgttagcttttattattagcaagagggctccttttgtaatttgtgcatgaaattcatgtcatttcctgggagaggagagggccgactggagagggtggggggcacactggggaagcaggcagaggtttccttcccttgtaggggggtggggagagtggggagagggggtgctatccagttcgcctgatgagggctctcgaaccagccgttttgggttgtgttaaaggtgagaccttcctccattaatgtacaatctcgaactaactgctaataaagtggggt

SEQ ID NO: 102612 - DNA, 6641 bp, Homo sapiens
  misc_feature (4359)..(4359): n is a, c, g, or t
gcggccgcgattcggggaggtaggcgctgggccgaggaggtgcagccgtgttaaggagaggacattcgagagggcgtggcgaagtgaagaggaacctcacgccactgcctggagctccgccttagccccgtgggccccacggagtgagcggcatgcagcacccccgggcctgtccagtgtcctctggcctgctgccctgcacccccagaaggccctgacgccctggggcacttctgctctgcacaggaccacgcgggggtttgccatggtgacataaaggggcgcggaggaaggaaggagcgtgaccagcctgtggactgcgcccctggctgggaggaaggactgggggcccagatcctccactcccagtgccccacaagggcgtcgcttcctaagtctctgtgaatttgttggtcagtggacgattctcgtgtctcctcctgtgtggggccttggggtagccagggcaggccgggcctccggtggccaaggtctcggaggccaggatgcctgccctggcatgcctccggaggctgtgtcggcacgtgtccccgcaggctgtccttttcctgctgttcatcttctgcctgttcagcgttttcatctcggcctactacctatatggctggaagcgaggcctggagccctcggcggatgcccccgagcctgactgcggggacccgccgcctgtggcccccagtcgcctgctgccactcaagcctgtgcaggcagccaccccttcccgcacagacccgttggtgctggtctttgtggagagcctctactcgcaactgggccaggaggtggtggccatcctggagtccagccgcttcaaataccgcacagagattgcgccgggcaagggtgacatgcccacgctcactgacaagggccgtggccgcttcgccctcatcatctatgagaacatcctcaagtatgtcaacctggacgcctggaaccgggagctgctggacaagtactgtgtggcctacggcgtgggcatcattggcttcttcaaggccaatgagaacagcctgctgagtgcgcagctcaagggcttccccctgttcctgcactcaaacctgggcctgaaggactgcagcatcaaccccaagtccccgctgctctacgtgacgcgacctagcgaggtggagaaaggtgtgctccccggcgaggactggacggttttccagtcaaatcactccacctatgagccagtgctgctggccaagacgcgctcgtctgagtccatcccacacctgggcgcagacgccggcctgcatgctgcactgcacgccactgtggtccaggacctgggcctgcacgacggcatccagcgcgtgctgtttggcaacaacctgaacttctggctgcacaagcttgtcttcgtggatgccgtggccttcctcacggggaagcgcctctccctgccattggaccgctacatcctggtggacattgatgacatcttcgtgggcaaggagggcacacgcatgaaggtggaggacgtgaaggccctgtttgacacacagaacgaactacgcgcacacatcccaaacttcaccttcaacctgggctactcagggaaattcttccacacaggtaccaatgctgaggacgctggggatgatctgctgctgtcgtatgtgaaggagttctggtggttcccccacatgtggagccacatgcagccccaccttttccacaaccagtccgtgttggccgagcagatggccttgaacaagaagttcgctgtcgagcatggcattcccacagacatggggtatgcagtggcgccccaccactcgggcgtgtaccccgtgcacgtgcagctgtacgaggcttggaagcaggtgtggagcatccgcgtgaccagcacggaggagtacccccacctgaagccagcccgctaccgccgtggcttcatccacaatggcatcatggttctcccacggcagacctgcggcctcttcacacacaccatcttctacaacgagtaccctggcggctccagtgagctggacaagatcatcaacgggggcgagctcttcctcaccgtgctcctcaatcctatcagcatcttcatgacgcacctgtccaactatgggaatgaccgcctgggcctgtacaccttcaagcacctggtgcgcttcctgcactcctggaccaacctccggctgcagacactgccccctgtgcagttggcgcagaagtacttccagatcttctccgaggagaaggacccgctctggcaggacccctgcgaggacaaacgtcacaaagacatctggtccaaggagaagacgtgtgaccgcttcccaaagctcctcatcatcggcccccagaaaacaggcaccactgccctctacctgttcctgggcatgcaccctgacctaagcagcaactaccccagctctgagacctttgaggagatccagttttttaatggccacaactatcacaaaggcatcgactggtacatggagttcttccccatcccttccaacaccacctccgacttctactttgagaaaagcgccaactactttgattcagaagtggcgccccggcgggcagcagccctcttgcccaaagccaaggtcctgaccatcctcatcaaccccgcggaccgggcctattcctggtaccagcaccagcgagcccatgacgacccagtggccctaaagtacaccttccatgaggtgattaccgccggctctgacgcatcctcgaagctgcgtgccctccagaaccgctgcctggtccctggctggtacgccacccacatcgagcgctggctcagtgcctatcacgccaaccagattctggtcttggatggcaaactgcttcgcacagaacctgccaaagtgatggacatggtgcagaagttccttggggtgaccaacaccattgactaccacaaaaccttggcgtttgatccaaagaaaggattttggtgccaactgcttgaaggaggaaaaaccaagtgtctgggcaaaagcaagggccggaaatatcccgagatggacttggattcccgagccttcctgaaggactattaccgggaccacaacatcgagctctccaagctgctgtataagatgggccagacacttcccacttggctacgagaggacctccagaacaccaggtagccgtggccaccacagccagactgaacgtttgtgaaagctgggacatcccaccacacgctgagccagacctgcagagtgggaagctggaccagggcagctgcgcacttatgagcaatactctgtggaggtctggtggggctgggggagcacccaggcggatctgcaagcacctcggagcacccaccgctgggtctgcggcctaagggacctccctcgccagcagaggtccattccgttcccagctgctcctggggaggccgcttcctggtaggagggagtccacgagactcttttctgtccctcactgtgttccgccgactgtcccctctcgtcacccatcactccctgcttccgcagggcgcccctcagtattcgctgccatatgtccctgtcctccaggctgtaggggaggagagcctggccgggggagacagactggacatttccctgtttcgagccaggctcttccaaggggccagctgggtccccggagtcagtcctaggctggatgggagggtggccccctcaagaggactcccagcctccacatctggttcctaccttcacatctcaccctcccgttctggggaagaatttctggttcctacagtatccactccatcctcaaggcttcccgcagggccttggggcactgccttgccatcgggcccagttctccgggccccacctgcacccctttcttccccctgggatatgatgtgtggtgtttcctgtggtaaaagactgaggcaggccaggggtctgccagtaacatgttcccatgtacagacacggtccccacaccctcccagcctcaggcccaggcagacatgggcgagctggtgagactgccagccacggctttgcttagccacctgtggccgagggctctcagagacccccttaacctcccaaatactaagaagctaaaatattttaatattttgtttttttttttcttggtgccagagtttataccctgggtgctggggtcgcactgtgttatatatatatatatatatatatataatgtgtatatatatatattctattttttttggttgggttcgtttttaattcagtcctacaaaatggtggtaagccccagtctcaggggtcaccctgtcttagagctagagatgaggtggcagggagggaggctgtgtcctcagtggcctggggctgagcagaccttaggaagggnccctccccagtgccgtggctgctctggggctaccccaggtgaacagaggtggtgagatgcgcagggaagaccagctctctccaggacatcgggctgcgtgaagtccagtgaccctgaggggattttggccaaaggaaacagccagggctgggctaggagagctggggtcaaaagctgccccacccactctccctcacatggtgctaggctgggagctgccctgagagctgggatgcccaccaaggcccacagaactgtctccaggcccttgtagacagtgggatctctgggctgatttctggttggggtctgctcctaccccaccccatttaacaatgtgaagtgactgaggctggggtgcctctccctggccccctccaactgccaaattctgcttccctctgaaccccaggaaatactttctggagaggcttgtcttgttcagaagactctagcatcttggggctggaaggtcctttgacgggtatgaaacaggtccagaaaggggaggtggcctgcttggccgacgtcatggagccagctgggagcagggctgagcgttgaacccgaggctcccggttccaagtcccatcgtgctcctcttccaatgccacactgcctctgagcccatccttgggaccctactctgtgccaggttcctgtcccttcctccgtcacagcatggtcattccaggatatggggacaaaccactccttcccagccagggtgcctttgagccttctcattccgaggtctgcgtttgcatccctgtcgtgttctccctcgaggggtccttccccagcctgtgggggcctgggtctgttctgagctgattcccttttctccagttctctgctgggatgaagaaagttggacactcagtgggaccagctgcaggtggtttcactgtgtacacagcagtgtccccatcatgcctctcaatggggcctgcaagcctgggaacttgggcatcgttgggccagcaggatgagcagcaaagggtctgaggacagggtggcatgtctgcttgtgtgctcatgaagacatgcccacgccatggagccaggggcttacagagaggggcagtgacttccagagtcccatccgtcagtgaggggactgggctgcgggatgggtgaggatcttacagctcccaggttcggaaatctaccctctaggcctggaggcctctctcgcagagcatggaaggcaggagaggtgggctggcctagggcaggagctccacttctctctgcctctggctatgggaaggagcaggcggttggaaatcctgtgacagcagagatcttctggatttttgcctggacccttctgcaagcctggagactggacctgccacatgttccaagtctgtctgcctaggtcactgctgccacttctcctcccactaacagacctttcttgaagacccactaggtccagacactgccgggacttgcaggtatggggggtagaaggagaggcagataagctgcctggggggctgttagctaatgggtacaaggacaccccctcccgagaagagaagccacagatgagtgggccagcgaggccagtcttcaatgtccactaattcactctaagcatttggccaaaaaaaggagagagaaataactgaaattgttcaggtggctccatcgtctattctgtggtcccctccatgagcctttgccccagggtgggtgcaggtgcgagtgtcacctgcagctgcctcagtcattcagagttccagagccttctgtggtggagcatcctgctgcttggaggatgagtctgaagtttaaaaatgggccttttctgagcccccctgatgagcagtcagtgcttctgggcccagctaaggaagccatctgttcccagcagaggagagctgctgcgctgacctgcagaggttggtggtcccagcacagagctgtgcccatgggcttgttagtgggaaaagcaaatacaacaatgttttaccaaacatttaattatgaatgcccactccccagcatctagatctaaaattattaacattttgccacattctttttctctctctgtgtatgtatatgttttctctgtcctaatttaaaagtacattgcaaacatcatgaaacttgatccctgaaagcttcagcctgcatctcctaagagttagggcattgtcctacacattggcccagtatcacagccaagacgagaagtcatttcccagcgatgtctgctatctaatctgtattcaaatccccacagagagagcgtcggtaccgagcca

SEQ ID NO: 102613 - DNA, 6583 bp, Homo sapiens
  misc_feature (4359)..(4359): n is a, c, g, or t
gcggccgcgattcggggaggtaggcgctgggccgaggaggtgcagccgtgttaaggagaggacattcgagagggcgtggcgaagtgaagaggaacctcacgccactgcctggagctccgccttagccccgtgggccccacggagtgagcggcatgcagcacccccgggcctgtccagtgtcctctggcctgctgccctgcacccccagaaggccctgacgccctggggcacttctgctctgcacaggaccacgcgggggtttgccatggtgacataaaggggcgcggaggaaggaaggagcgtgaccagcctgtggactgcgcccctggctgggaggaaggactgggggcccagatcctccactcccagtgccccacaagggcgtcgcttcctaagtctctgtgaatttgttggtcagtggacgattctcgtgtctcctcctgtgtggggccttggggtagccagggcaggccgggcctccggtggccaaggtctcggaggccaggatgcctgccctggcatgcctccggaggctgtgtcggcacgtgtccccgcaggctgtccttttcctgctgttcatcttctgcctgttcagcgttttcatctcggcctactacctatatggctggaagcgaggcctggagccctcggcggatgcccccgagcctgactgcggggacccgccgcctgtggcccccagtcgcctgctgccactcaagcctgtgcaggcagccaccccttcccgcacagacccgttggtgctggtctttgtggagagcctctactcgcaactgggccaggaggtggtggccatcctggagtccagccgcttcaaataccgcacagagattgcgccgggcaagggtgacatgcccacgctcactgacaagggccgtggccgcttcgccctcatcatctatgagaacatcctcaagtatgtcaacctggacgcctggaaccgggagctgctggacaagtactgtgtggcctacggcgtgggcatcattggcttcttcaaggccaatgagaacagcctgctgagtgcgcagctcaagggcttccccctgttcctgcactcaaacctgggcctgaaggactgcagcatcaaccccaagtccccgctgctctacgtgacgcgacctagcgaggtggagaaaggtgtgctccccggcgaggactggacggttttccagtcaaatcactccacctatgagccagtgctgctggccaagacgcgctcgtctgagtccatcccacacctgggcgcagacgccggcctgcatgctgcactgcacgccactgtggtccaggacctgggcctgcacgacggcatccagcgcgtgctgtttggcaacaacctgaacttctggctgcacaagcttgtcttcgtggatgccgtggccttcctcacggggaagcgcctctccctgccattggaccgctacatcctggtggacattgatgacatcttcgtgggcaaggagggcacacgcatgaaggtggaggacgtgaaggccctgtttgacacacagaacgaactacgcgcacacatcccaaacttcaccttcaacctgggctactcagggaaattcttccacacaggtaccaatgctgaggacgctggggatgatctgctgctgtcgtatgtgaaggagttctggtggttcccccacatgtggagccacatgcagccccaccttttccacaaccagtccgtgttggccgagcagatggccttgaacaagaagttcgctgtcgagcatggcattcccacagacatggggtatgcagtggcgccccaccactcgggcgtgtaccccgtgcacgtgcagctgtacgaggcttggaagcaggtgtggagcatccgcgtgaccagcacggaggagtacccccacctgaagccagcccgctaccgccgtggcttcatccacaatggcatcatggttctcccacggcagacctgcggcctcttcacacacaccatcttctacaacgagtaccctggcggctccagtgagctggacaagatcatcaacgggggcgagctcttcctcaccgtgctcctcaatcctatcagcatcttcatgacgcacctgtccaactatgggaatgaccgcctgggcctgtacaccttcaagcacctggtgcgcttcctgcactcctggaccaacctccggctgcagacactgccccctgtgcagttggcgcagaagtacttccagatcttctccgaggagaaggacccgctctggcaggacccctgcgaggacaaacgtcacaaagacatctggtccaaggagaagacgtgtgaccgcttcccaaagctcctcatcatcggcccccagaaaacaggcaccactgccctctacctgttcctgggcatgcaccctgacctaagcagcaactaccccagctctgagacctttgaggagatccagttttttaatggccacaactatcacaaaggcatcgactggtacatggagttcttccccatcccttccaacaccacctccgacttctactttgagaaaagcgccaactactttgattcagaagtggcgccccggcgggcagcagccctcttgcccaaagccaaggtcctgaccatcctcatcaaccccgcggaccgggcctattcctggtaccagcaccagcgagcccatgacgacccagtggccctaaagtacaccttccatgaggtgattaccgccggctctgacgcatcctcgaagctgcgtgccctccagaaccgctgcctggtccctggctggtacgccacccacatcgagcgctggctcagtgcctatcacgccaaccagattctggtcttggatggcaaactgcttcgcacagaacctgccaaagtgatggacatggtgcagaagttccttggggtgaccaacaccattgactaccacaaaaccttggcgtttgatccaaagaaaggattttggtgccaactgcttgaaggaggaaaaaccaagtgtctgggcaaaagcaagggccggaaatatcccgagatggacttggattcccgagccttcctgaaggactattaccgggaccacaacatcgagctctccaagctgctgtataagatgggccagacacttcccacttggctacgagaggacctccagaacaccaggtagccgtggccaccacagccagactgaacgtttgtgaaagctgggacatcccaccacacgctgagccagacctgcagagtgggaagctggaccagggcagctgcgcacttatgagcaatactctgtggaggtctggtggggctgggggagcacccaggcggatctgcaagcacctcggagcacccaccgctgggtctgcggcctaagggacctccctcgccagcagaggtccattccgttcccagctgctcctggggaggccgcttcctggtaggagggagtccacgagactcttttctgtccctcactgtgttccgccgactgtcccctctcgtcacccatcactccctgcttccgcagggcgcccctcagtattcgctgccatatgtccctgtcctccaggctgtaggggaggagagcctggccgggggagacagactggacatttccctgtttcgagccaggctcttccaaggggccagctgggtccccggagtcagtcctaggctggatgggagggtggccccctcaagaggactcccagcctccacatctggttcctaccttcacatctcaccctcccgttctggggaagaatttctggttcctacagtatccactccatcctcaaggcttcccgcagggccttggggcactgccttgccatcgggcccagttctccgggccccacctgcacccctttcttccccctgggatatgatgtgtggtgtttcctgtggtaaaagactgaggcaggccaggggtctgccagtaacatgttcccatgtacagacacggtccccacaccctcccagcctcaggcccaggcagacatgggcgagctggtgagactgccagccacggctttgcttagccacctgtggccgagggctctcagagacccccttaacctcccaaatactaagaagctaaaatattttaatattttgtttttttttttcttggtgccagagtttataccctgggtgctggggtcgcactgtgttatatatatatatatatatatatataatgtgtatatatatatattctattttttttggttgggttcgtttttaattcagtcctacaaaatggtggtaagccccagtctcaggggtcaccctgtcttagagctagagatgaggtggcagggagggaggctgtgtcctcagtggcctggggctgagcagaccttaggaagggnccctccccagtgccgtggctgctctggggctaccccaggtgaacagaggtggtgagatgcgcagggaagaccagctctctccaggacatcgggctgcgtgaagtccagtgaccctgaggggattttggccaaaggaaacagccagggctgggctaggagagctggggtcaaaagctgccccacccactctccctcacatggtgctaggctgggagctgccctgagagctgggatgcccaccaaggcccacagaactgtctccaggcccttgtagacagtgggatctctgggctgatttctggttggggtctgctcctaccccaccccatttaacaatgtgaagtgactgaggctggggtgcctctccctggccccctccaactgccaaattctgcttccctctgaaccccaggaaatactttctggagaggcttgtcttgttcagaagactctagcatcttggggctggaaggtcctttgacgggtatgaaacaggtccagaaaggggaggtggcctgcttggccgacgtcatggagccagctgggagcagggctgagcgttgaacccgaggctcccggttccaagtcccatcgtgctcctcttccaatgccacactgcctctgagcccatccttgggaccctactctgtgccaggttcctgtcccttcctccgtcacagcatggtcattccaggatatggggacaaaccactccttcccagccagggtgcctttgagccttctcattccgaggtctgcgtttgcatccctgtcgtgttctccctcgaggggtccttccccagcctgtgggggcctgggtctgttctgagctgattcccttttctccagttctctgctgggatgaagaaagttggacactcagtgggaccagctgcaggtggtttcactgtgtacacagcagtgtccccatcatgcctctcaatggggcctgcaagcctgggaacttgggcatcgttgggccagcaggatgagcagcaaagggtctgaggacagggtggcatgtctgcttgtgtgctcatgaagacatgcccacgccatggagccaggggcttacagagaggggcagtgacttccagagtcccatccgtcagtgaggggactgggctgcgggatgggtgaggatcttacagctcccaggttcggaaatctaccctctaggcctggaggcctctctcgcagagcatggaaggcaggagaggtgggctggcctagggcaggagctccacttctctctgcctctggctatgggaaggagcaggcggttggaaatcctgtgacagcagagatcttctggatttttgcctggacccttctgcaagcctggagactggacctgccacatgttccaagtctgtctgcctaggtcactgctgccacttctcctcccactaacagacctttcttgaagacccactaggtccagacactgccgggacttgcaggtatggggggtagaaggagaggcagataagctgcctggggggctgttagctaatgggtacaaggacaccccctcccgagaagagaagccacagatgagtgggccagcgaggccagtcttcaatgtccactaattcactctaagcatttggccaaaaaaaggagagagaaataactgaaattgttcaggtggctccatcgtctattctgtggtcccctccatgagcctttgccccagggtgggtgcaggtgcgagtgtcacctgcagctgcctcagtcattcagagttccagagccttctgtggtggagcatcctgctgcttggaggatgagtctgaagtttaaaaatgggccttttctgagcccccctgatgagcagtcagtgcttctgggcccagctaaggaagccatctgttcccagcagaggagagctgctgcgctgacctgcagaggttggtggtcccagcacagagctgtgcccatgggcttgttagtgggaaaagcaaatacaacaatgttttaccaaacatttaattatgaatgcccactccccagcatctagatctaaaattattaacattttgccacattctttttctctctctgtgtatgtatatgttttctctgtcctaatttaaaagtacattgcaaacatcatgaaacttgatccctgaaagcttcagcctgcatctcctaagagttagggcattgtcctacacattggcccagtatcacagccactcaatactaagccctgctaatc

SEQ ID NO: 102614 - DNA, 6385 bp, Homo sapiens
  misc_feature (4359)..(4359): n is a, c, g, or t
gcggccgcgattcggggaggtaggcgctgggccgaggaggtgcagccgtgttaaggagaggacattcgagagggcgtggcgaagtgaagaggaacctcacgccactgcctggagctccgccttagccccgtgggccccacggagtgagcggcatgcagcacccccgggcctgtccagtgtcctctggcctgctgccctgcacccccagaaggccctgacgccctggggcacttctgctctgcacaggaccacgcgggggtttgccatggtgacataaaggggcgcggaggaaggaaggagcgtgaccagcctgtggactgcgcccctggctgggaggaaggactgggggcccagatcctccactcccagtgccccacaagggcgtcgcttcctaagtctctgtgaatttgttggtcagtggacgattctcgtgtctcctcctgtgtggggccttggggtagccagggcaggccgggcctccggtggccaaggtctcggaggccaggatgcctgccctggcatgcctccggaggctgtgtcggcacgtgtccccgcaggctgtccttttcctgctgttcatcttctgcctgttcagcgttttcatctcggcctactacctatatggctggaagcgaggcctggagccctcggcggatgcccccgagcctgactgcggggacccgccgcctgtggcccccagtcgcctgctgccactcaagcctgtgcaggcagccaccccttcccgcacagacccgttggtgctggtctttgtggagagcctctactcgcaactgggccaggaggtggtggccatcctggagtccagccgcttcaaataccgcacagagattgcgccgggcaagggtgacatgcccacgctcactgacaagggccgtggccgcttcgccctcatcatctatgagaacatcctcaagtatgtcaacctggacgcctggaaccgggagctgctggacaagtactgtgtggcctacggcgtgggcatcattggcttcttcaaggccaatgagaacagcctgctgagtgcgcagctcaagggcttccccctgttcctgcactcaaacctgggcctgaaggactgcagcatcaaccccaagtccccgctgctctacgtgacgcgacctagcgaggtggagaaaggtgtgctccccggcgaggactggacggttttccagtcaaatcactccacctatgagccagtgctgctggccaagacgcgctcgtctgagtccatcccacacctgggcgcagacgccggcctgcatgctgcactgcacgccactgtggtccaggacctgggcctgcacgacggcatccagcgcgtgctgtttggcaacaacctgaacttctggctgcacaagcttgtcttcgtggatgccgtggccttcctcacggggaagcgcctctccctgccattggaccgctacatcctggtggacattgatgacatcttcgtgggcaaggagggcacacgcatgaaggtggaggacgtgaaggccctgtttgacacacagaacgaactacgcgcacacatcccaaacttcaccttcaacctgggctactcagggaaattcttccacacaggtaccaatgctgaggacgctggggatgatctgctgctgtcgtatgtgaaggagttctggtggttcccccacatgtggagccacatgcagccccaccttttccacaaccagtccgtgttggccgagcagatggccttgaacaagaagttcgctgtcgagcatggcattcccacagacatggggtatgcagtggcgccccaccactcgggcgtgtaccccgtgcacgtgcagctgtacgaggcttggaagcaggtgtggagcatccgcgtgaccagcacggaggagtacccccacctgaagccagcccgctaccgccgtggcttcatccacaatggcatcatggttctcccacggcagacctgcggcctcttcacacacaccatcttctacaacgagtaccctggcggctccagtgagctggacaagatcatcaacgggggcgagctcttcctcaccgtgctcctcaatcctatcagcatcttcatgacgcacctgtccaactatgggaatgaccgcctgggcctgtacaccttcaagcacctggtgcgcttcctgcactcctggaccaacctccggctgcagacactgccccctgtgcagttggcgcagaagtacttccagatcttctccgaggagaaggacccgctctggcaggacccctgcgaggacaaacgtcacaaagacatctggtccaaggagaagacgtgtgaccgcttcccaaagctcctcatcatcggcccccagaaaacaggcaccactgccctctacctgttcctgggcatgcaccctgacctaagcagcaactaccccagctctgagacctttgaggagatccagttttttaatggccacaactatcacaaaggcatcgactggtacatggagttcttccccatcccttccaacaccacctccgacttctactttgagaaaagcgccaactactttgattcagaagtggcgccccggcgggcagcagccctcttgcccaaagccaaggtcctgaccatcctcatcaaccccgcggaccgggcctattcctggtaccagcaccagcgagcccatgacgacccagtggccctaaagtacaccttccatgaggtgattaccgccggctctgacgcatcctcgaagctgcgtgccctccagaaccgctgcctggtccctggctggtacgccacccacatcgagcgctggctcagtgcctatcacgccaaccagattctggtcttggatggcaaactgcttcgcacagaacctgccaaagtgatggacatggtgcagaagttccttggggtgaccaacaccattgactaccacaaaaccttggcgtttgatccaaagaaaggattttggtgccaactgcttgaaggaggaaaaaccaagtgtctgggcaaaagcaagggccggaaatatcccgagatggacttggattcccgagccttcctgaaggactattaccgggaccacaacatcgagctctccaagctgctgtataagatgggccagacacttcccacttggctacgagaggacctccagaacaccaggtagccgtggccaccacagccagactgaacgtttgtgaaagctgggacatcccaccacacgctgagccagacctgcagagtgggaagctggaccagggcagctgcgcacttatgagcaatactctgtggaggtctggtggggctgggggagcacccaggcggatctgcaagcacctcggagcacccaccgctgggtctgcggcctaagggacctccctcgccagcagaggtccattccgttcccagctgctcctggggaggccgcttcctggtaggagggagtccacgagactcttttctgtccctcactgtgttccgccgactgtcccctctcgtcacccatcactccctgcttccgcagggcgcccctcagtattcgctgccatatgtccctgtcctccaggctgtaggggaggagagcctggccgggggagacagactggacatttccctgtttcgagccaggctcttccaaggggccagctgggtccccggagtcagtcctaggctggatgggagggtggccccctcaagaggactcccagcctccacatctggttcctaccttcacatctcaccctcccgttctggggaagaatttctggttcctacagtatccactccatcctcaaggcttcccgcagggccttggggcactgccttgccatcgggcccagttctccgggccccacctgcacccctttcttccccctgggatatgatgtgtggtgtttcctgtggtaaaagactgaggcaggccaggggtctgccagtaacatgttcccatgtacagacacggtccccacaccctcccagcctcaggcccaggcagacatgggcgagctggtgagactgccagccacggctttgcttagccacctgtggccgagggctctcagagacccccttaacctcccaaatactaagaagctaaaatattttaatattttgtttttttttttcttggtgccagagtttataccctgggtgctggggtcgcactgtgttatatatatatatatatatatatataatgtgtatatatatatattctattttttttggttgggttcgtttttaattcagtcctacaaaatggtggtaagccccagtctcaggggtcaccctgtcttagagctagagatgaggtggcagggagggaggctgtgtcctcagtggcctggggctgagcagaccttaggaagggnccctccccagtgccgtggctgctctggggctaccccaggtgaacagaggtggtgagatgcgcagggaagaccagctctctccaggacatcgggctgcgtgaagtccagtgaccctgaggggattttggccaaaggaaacagccagggctgggctaggagagctggggtcaaaagctgccccacccactctccctcacatggtgctaggctgggagctgccctgagagctgggatgcccaccaaggcccacagaactgtctccaggcccttgtagacagtgggatctctgggctgatttctggttggggtctgctcctaccccaccccatttaacaatgtgaagtgactgaggctggggtgcctctccctggccccctccaactgccaaattctgcttccctctgaaccccaggaaatactttctggagaggcttgtcttgttcagaagactctagcatcttggggctggaaggtcctttgacgggtatgaaacaggtccagaaaggggaggtggcctgcttggccgacgtcatggagccagctgggagcagggctgagcgttgaacccgaggctcccggttccaagtcccatcgtgctcctcttccaatgccacactgcctctgagcccatccttgggaccctactctgtgccaggttcctgtcccttcctccgtcacagcatggtcattccaggatatggggacaaaccactccttcccagccagggtgcctttgagccttctcattccgaggtctgcgtttgcatccctgtcgtgttctccctcgaggggtccttccccagcctgtgggggcctgggtctgttctgagctgattcccttttctccagttctctgctgggatgaagaaagttggacactcagtgggaccagctgcaggtggtttcactgtgtacacagcagtgtccccatcatgcctctcaatggggcctgcaagcctgggaacttgggcatcgttgggccagcaggatgagcagcaaagggtctgaggacagggtggcatgtctgcttgtgtgctcatgaagacatgcccacgccatggagccaggggcttacagagaggggcagtgacttccagagtcccatccgtcagtgaggggactgggctgcgggatgggtgaggatcttacagctcccaggttcggaaatctaccctctaggcctggaggcctctctcgcagagcatggaaggcaggagaggtgggctggcctagggcaggagctccacttctctctgcctctggctatgggaaggagcaggcggttggaaatcctgtgacagcagagatcttctggatttttgcctggacccttctgcaagcctggagactggacctgccacatgttccaagtctgtctgcctaggtcactgctgccacttctcctcccactaacagacctttcttgaagacccactaggtccagacactgccgggacttgcaggtatggggggtagaaggagaggcagataagctgcctggggggctgttagctaatgggtacaaggacaccccctcccgagaagagaagccacagatgagtgggccagcgaggccagtcttcaatgtccactaattcactctaagcatttggccaaaaaaaggagagagaaataactgaaattgttcaggtggctccatcgtctattctgtggtcccctccatgagcctttgccccagggtgggtgcaggtgcgagtgtcacctgcagctgcctcagtcattcagagttccagagccttctgtggtggagcatcctgctgcttggaggatgagtctgaagtttaaaaatgggccttttctgagcccccctgatgagcagtcagtgcttctgggcccagctaaggaagccatctgttcccagcagaggagagctgctgcgctgacctgcagaggttggtggtcccagcacagagctgtgcccatgggcttgttattgggttgtgttaaaggtgagaccttcctccattaatgtacaatctcgaactaactgctaataaagtggggt

SEQ ID NO: 102615 - DNA, 7974 bp, Homo sapiens
  misc_feature (4306)..(4306): n is a, c, g, or t
gcggccgcgattcggggaggtaggcgctgggccgaggaggtgcagccgtgttaaggagaggacattcgagagggcgtggcgaagtgaagaggaacctcacgccactgcctggagctccgagtctcgctctgtcgcccaggctgcagtgcagtgacgtgatctcggctcactgcaccctccgcctcccaggttcaagtgattcccctgcctcagcctcctgggtagctgggactacagccttagccccgtgggccccacggagtgagcggcatgcagcacccccgggcctgtccagtgtcctctggcctgctgccctgcacccccagaaggccctgacgccctggggcacttctgctctgcacaggaccacgcgggggtttgccatggtgacataaaggggcgcggaggaaggaaggagcgtgaccagcctgtggactgcgcccctggctgggaggaaggactgggggcccagatcctccactcccagtgccccacaagggcgtcgcttcctaagtctctgtgaatttgttggtcagtggacgattctcgtgtctcctcctgtgtggggccttggggtagccagggcaggccgggcctccggtggccaaggtctcggaggccaggatgcctgccctggcatgcctccggaggctgtgtcggcacgtgtccccgcaggctgtccttttcctgctgttcatcttctgcctgttcagcgttttcatctcggcctactacctatatggctggaagcgaggcctggagccctcggcggatgcccccgagcctgactgcggggacccgccgcctgtggcccccagtcgcctgctgccactcaagcctgtgcaggcagccaccccttcccgcacagacccgttggtgctggtctttgtggagagcctctactcgcaactgggccaggaggtggtggccatcctggagtccagccgcttcaaataccgcacagagattgcgccgggcaagggtgacatgcccacgctcactgacaagggccgtggccgcttcgccctcatcatctatgagaacatcctcaagtatgtcaacctggacgcctggaaccgggagctgctggacaagtactgtgtggcctacggcgtgggcatcattggcttcttcaaggccaatgagaacagcctgctgagtgcgcagctcaagggcttccccctgttcctgcactcaaacctgggcctgaaggactgcagcatcaaccccaagtccccgctgctctacgtgacgcgacctagcgaggtggagaaaggtgtgctccccggcgaggactggacggttttccagtcaaatcactccacctatgagccagtgctgctggccaagacgcgctcgtctgagtccatcccacacctgggcgcagacgccggcctgcatgctgcactgcacgccactgtggtccaggacctgggcctgcacgacggcatccagcgcgtgctgtttggcaacaacctgaacttctggctgcacaagcttgtcttcgtggatgccgtggccttcctcacggggaagcgcctctccctgccattggaccgctacatcctggtggacattgatgacatcttcgtgggcaaggagggcacacgcatgaaggtggaggacgtgaaggccctgtttgacacacagaacgaactacgcgcacacatcccaaacttcaccttcaacctgggctactcagggaaattcttccacacaggtaccaatgctgaggacgctggggatgatctgctgctgtcgtatgtgaaggagttctggtggttcccccacatgtggagccacatgcagccccaccttttccacaaccagtccgtgttggccgagcagatggccttgaacaagaagttcgctgtcgagcatggcattcccacagacatggggtatgcagtggcgccccaccactcgggcgtgtaccccgtgcacgtgcagctgtacgaggcttggaagcaggtgtggagcatccgcgtgaccagcacggaggagtacccccacctgaagccagcccgctaccgccgtggcttcatccacaatggcatcatggttctcccacggcagacctgcggcctcttcacacacaccatcttctacaacgagtaccctggcggctccagtgagctggacaagatcatcaacgggggcgagctcttcctcaccgtgctcctcaatcctatcagcatcttcatgacgcacctgtccaactatgggaatgaccgcctgggcctgtacaccttcaagcacctggtgcgcttcctgcactcctggaccaacctccggctgcagacactgccccctgtgcagttggcgcagaagtacttccagatcttctccgaggagaaggacccgctctggcaggacccctgcgaggacaaacgtcacaaagacatctggtccaaggagaagacgtgtgaccgcttcccaaagctcctcatcatcggcccccagaaaacaggcaccactgccctctacctgttcctgggcatgcaccctgacctaagcagcaactaccccagctctgagacctttgaggagatccagttttttaatggccacaactatcacaaaggcatcgactggtacatggagttcttccccatcccttccaacaccacctccgacttctactttgagaaaagcgccaactactttgattcagaagtggcgccccggcgggcagcagccctcttgcccaaagccaaggtcctgaccatcctcatcaaccccgcggaccgggcctattcctggtaccagattctggtcttggatggcaaactgcttcgcacagaacctgccaaagtgatggacatggtgcagaagttccttggggtgaccaacaccattgactaccacaaaaccttggcgtttgatccaaagaaaggattttggtgccaactgcttgaaggaggaaaaaccaagtgtctgggcaaaagcaagggccggaaatatcccgagatggacttggattcccgagccttcctgaaggactattaccgggaccacaacatcgagctctccaagctgctgtataagatgggccagacacttcccacttggctacgagaggacctccagaacaccaggtagccgtggccaccacagccagactgaacgtttgtgaaagctgggacatcccaccacacgctgagccagacctgcagagtgggaagctggaccagggcagctgcgcacttatgagcaatactctgtggaggtctggtggggctgggggagcacccaggcggatctgcaagcacctcggagcacccaccgctgggtctgcggcctaagggacctccctcgccagcagaggtccattccgttcccagctgctcctggggaggccgcttcctggtaggagggagtccacgagactcttttctgtccctcactgtgttccgccgactgtcccctctcgtcacccatcactccctgcttccgcagggcgcccctcagtattcgctgccatatgtccctgtcctccaggctgtaggggaggagagcctggccgggggagacagactggacatttccctgtttcgagccaggctcttccaaggggccagctgggtccccggagtcagtcctaggctggatgggagggtggccccctcaagaggactcccagcctccacatctggttcctaccttcacatctcaccctcccgttctggggaagaatttctggttcctacagtatccactccatcctcaaggcttcccgcagggccttggggcactgccttgccatcgggcccagttctccgggccccacctgcacccctttcttccccctgggatatgatgtgtggtgtttcctgtggtaaaagactgaggcaggccaggggtctgccagtaacatgttcccatgtacagacacggtccccacaccctcccagcctcaggcccaggcagacatgggcgagctggtgagactgccagccacggctttgcttagccacctgtggccgagggctctcagagacccccttaacctcccaaatactaagaagctaaaatattttaatattttgtttttttttttcttggtgccagagtttataccctgggtgctggggtcgcactgtgttatatatatatatatatatatatataatgtgtatatatatatattctattttttttggttgggttcgtttttaattcagtcctacaaaatggtggtaagccccagtctcaggggtcaccctgtcttagagctagagatgaggtggcagggagggaggctgtgtcctcagtggcctggggctgagcagaccttaggaagggnccctccccagtgccgtggctgctctggggctaccccaggtgaacagaggtggtgagatgcgcagggaagaccagctctctccaggacatcgggctgcgtgaagtccagtgaccctgaggggattttggccaaaggaaacagccagggctgggctaggagagctggggtcaaaagctgccccacccactctccctcacatggtgctaggctgggagctgccctgagagctgggatgcccaccaaggcccacagaactgtctccaggcccttgtagacagtgggatctctgggctgatttctggttggggtctgctcctaccccaccccatttaacaatgtgaagtgactgaggctggggtgcctctccctggccccctccaactgccaaattctgcttccctctgaaccccaggaaatactttctggagaggcttgtcttgttcagaagactctagcatcttggggctggaaggtcctttgacgggtatgaaacaggtccagaaaggggaggtggcctgcttggccgacgtcatggagccagctgggagcagggctgagcgttgaacccgaggctcccggttccaagtcccatcgtgctcctcttccaatgccacactgcctctgagcccatccttgggaccctactctgtgccaggttcctgtcccttcctccgtcacagcatggtcattccaggatatggggacaaaccactccttcccagccagggtgcctttgagccttctcattccgaggtctgcgtttgcatccctgtcgtgttctccctcgaggggtccttccccagcctgtgggggcctgggtctgttctgagctgattcccttttctccagttctctgctgggatgaagaaagttggacactcagtgggaccagctgcaggtggtttcactgtgtacacagcagtgtccccatcatgcctctcaatggggcctgcaagcctgggaacttgggcatcgttgggccagcaggatgagcagcaaagggtctgaggacagggtggcatgtctgcttgtgtgctcatgaagacatgcccacgccatggagccaggggcttacagagaggggcagtgacttccagagtcccatccgtcagtgaggggactgggctgcgggatgggtgaggatcttacagctcccaggttcggaaatctaccctctaggcctggaggcctctctcgcagagcatggaaggcaggagaggtgggctggcctagggcaggagctccacttctctctgcctctggctatgggaaggagcaggcggttggaaatcctgtgacagcagagatcttctggatttttgcctggacccttctgcaagcctggagactggacctgccacatgttccaagtctgtctgcctaggtcactgctgccacttctcctcccactaacagacctttcttgaagacccactaggtccagacactgccgggacttgcaggtatggggggtagaaggagaggcagataagctgcctggggggctgttagctaatgggtacaaggacaccccctcccgagaagagaagccacagatgagtgggccagcgaggccagtcttcaatgtccactaattcactctaagcatttggccaaaaaaaggagagagaaataactgaaattgttcaggtggctccatcgtctattctgtggtcccctccatgagcctttgccccagggtgggtgcaggtgcgagtgtcacctgcagctgcctcagtcattcagagttccagagccttctgtggtggagcatcctgctgcttggaggatgagtctgaagtttaaaaatgggccttttctgagcccccctgatgagcagtcagtgcttctgggcccagctaaggaagccatctgttcccagcagaggagagctgctgcgctgacctgcagaggttggtggtcccagcacagagctgtgcccatgggcttgttagtgggaaaagcaaatacaacaatgttttaccaaacatttaattatgaatgcccactccccagcatctagatctaaaattattaacattttgccacattctttttctctctctgtgtatgtatatgttttctctgtcctaatttaaaagtacattgcaaacatcatgaaacttgatccctgaaagcttcagcctgcatctcctaagagttagggcattgtcctacacattggcccagtatcacagccaagacgagaagtcatttcccagcgatgtctgctatctaatctgtattcaaatccccccaattgtctcccaggtaacttatgtgtctggttttggaatcagcatccagtcacggtgcacacattgcattttctaactatgtttttaaaacctctttgaatgctgaaaggtcttccctcagctcactttgagtttttaaatgacattgtttttgaggccctaggcctgctgtctttttgaagccccacattctgaatttgtcagattgtttgctcatggtgtcgcataaccacttcttctatcccctgtactttcaaggataatttaggctacatgagattttgccttttgtgctgacttgacagcttcacttctgcctaagatgcgcctccactgtcacctgtaccaagtgccaaaacagcagaggggccagttagagcaagagctctgggggggcccggaaagtctccctggagaaggccgtaatatctgggccttggaaggaaggacacagggctctggaaggaggaggctgcatgcctgaaggctgggccttcgaccctggggatgggccacagggcaccaaacacatcatatgtctctctctttctattttggggtcccagggttttcatttcctggagacccgtggtctgtgtgcactggagcagagccaggctctcagttgcagcagggaaaagcctacatggggaactgcctcccgcaagctgtggtgtgagaagagccctggctggcagcaggagctgtgaagtttcatcccagccgggtgcatttagtagctgcctgaccatcttcctcccaggccctcagtttcttcatctgtagaatgagcagataggggccacagcagggattttcacacatcaaaggaggcagcctctgctctagttgatgtgaggatgagggggcggcctagaccccctgctgcccaggccgttgaggcaacactgggttcctggcttgacagctgtgggctggctgcccttgccagctcagacggctggcgagttttcagcttccctaagggactggcatagggttttgtggggtcaatgccaggaacctgggggaaactggatgcgttttatcctaagaagttcatccctcctgctcttactgtttccggccctggaggagaatgagggaggagagggttttctatgactgtgttagcttttattattagcaagagggctccttttgtaatttgtgcatgaaattcatgtcatttcctgggagaggagagggccgactggagagggtggggggcacactggggaagcaggcagaggtttccttcccttgtaggggggtggggagagtggggagagggggtgctatccagttcgcctgatgagggctctcgaaccagccgttttgggttgtgttaaaggtgagaccttcctccattaatgtacaatctcgaactaactgctaataaagtggggt

SEQ ID NO: 102616 - DNA, 6899 bp, Homo sapiens
  misc_feature (3231)..(3231): n is a, c, g, or t
tcaacagcttttcctgtgtgaatgtcaaaggtgtgctccccggcgaggactggacggttttccagtcaaatcactccacctatgagccagtgctgctggccaagacgcgctcgtctgagtccatcccacacctgggcgcagacgccggcctgcatgctgcactgcacgccactgtggtccaggacctgggcctgcacgacggcatccagcgcgtgctgtttggcaacaacctgaacttctggctgcacaagcttgtcttcgtggatgccgtggccttcctcacggggaagcgcctctccctgccattggaccgctacatcctggtggacattgatgacatcttcgtgggcaaggagggcacacgcatgaaggtggaggacgtgaaggccctgtttgacacacagaacgaactacgcgcacacatcccaaacttcaccttcaacctgggctactcagggaaattcttccacacaggtaccaatgctgaggacgctggggatgatctgctgctgtcgtatgtgaaggagttctggtggttcccccacatgtggagccacatgcagccccaccttttccacaaccagtccgtgttggccgagcagatggccttgaacaagaagttcgctgtcgagcatggcattcccacagacatggggtatgcagtggcgccccaccactcgggcgtgtaccccgtgcacgtgcagctgtacgaggcttggaagcaggtgtggagcatccgcgtgaccagcacggaggagtacccccacctgaagccagcccgctaccgccgtggcttcatccacaatggcatcatggttctcccacggcagacctgcggcctcttcacacacaccatcttctacaacgagtaccctggcggctccagtgagctggacaagatcatcaacgggggcgagctcttcctcaccgtgctcctcaatcctatcagcatcttcatgacgcacctgtccaactatgggaatgaccgcctgggcctgtacaccttcaagcacctggtgcgcttcctgcactcctggaccaacctccggctgcagacactgccccctgtgcagttggcgcagaagtacttccagatcttctccgaggagaaggacccgctctggcaggacccctgcgaggacaaacgtcacaaagacatctggtccaaggagaagacgtgtgaccgcttcccaaagctcctcatcatcggcccccagaaaacaggcaccactgccctctacctgttcctgggcatgcaccctgacctaagcagcaactaccccagctctgagacctttgaggagatccagttttttaatggccacaactatcacaaaggcatcgactggtacatggagttcttccccatcccttccaacaccacctccgacttctactttgagaaaagcgccaactactttgattcagaagtggcgccccggcgggcagcagccctcttgcccaaagccaaggtcctgaccatcctcatcaaccccgcggaccgggcctattcctggtaccagcaccagcgagcccatgacgacccagtggccctaaagtacaccttccatgaggtgattaccgccggctctgacgcatcctcgaagctgcgtgccctccagaaccgctgcctggtccctggctggtacgccacccacatcgagcgctggctcagtgcctatcacgccaaccagattctggtcttggatggcaaactgcttcgcacagaacctgccaaagtgatggacatggtgcagaagttccttggggtgaccaacaccattgactaccacaaaaccttggcgtttgatccaaagaaaggattttggtgccaactgcttgaaggaggaaaaaccaagtgtctgggcaaaagcaagggccggaaatatcccgagatggacttggattcccgagccttcctgaaggactattaccgggaccacaacatcgagctctccaagctgctgtataagatgggccagacacttcccacttggctacgagaggacctccagaacaccaggtagccgtggccaccacagccagactgaacgtttgtgaaagctgggacatcccaccacacgctgagccagacctgcagagtgggaagctggaccagggcagctgcgcacttatgagcaatactctgtggaggtctggtggggctgggggagcacccaggcggatctgcaagcacctcggagcacccaccgctgggtctgcggcctaagggacctccctcgccagcagaggtccattccgttcccagctgctcctggggaggccgcttcctggtaggagggagtccacgagactcttttctgtccctcactgtgttccgccgactgtcccctctcgtcacccatcactccctgcttccgcagggcgcccctcagtattcgctgccatatgtccctgtcctccaggctgtaggggaggagagcctggccgggggagacagactggacatttccctgtttcgagccaggctcttccaaggggccagctgggtccccggagtcagtcctaggctggatgggagggtggccccctcaagaggactcccagcctccacatctggttcctaccttcacatctcaccctcccgttctggggaagaatttctggttcctacagtatccactccatcctcaaggcttcccgcagggccttggggcactgccttgccatcgggcccagttctccgggccccacctgcacccctttcttccccctgggatatgatgtgtggtgtttcctgtggtaaaagactgaggcaggccaggggtctgccagtaacatgttcccatgtacagacacggtccccacaccctcccagcctcaggcccaggcagacatgggcgagctggtgagactgccagccacggctttgcttagccacctgtggccgagggctctcagagacccccttaacctcccaaatactaagaagctaaaatattttaatattttgtttttttttttcttggtgccagagtttataccctgggtgctggggtcgcactgtgttatatatatatatatatatatatataatgtgtatatatatatattctattttttttggttgggttcgtttttaattcagtcctacaaaatggtggtaagccccagtctcaggggtcaccctgtcttagagctagagatgaggtggcagggagggaggctgtgtcctcagtggcctggggctgagcagaccttaggaagggnccctccccagtgccgtggctgctctggggctaccccaggtgaacagaggtggtgagatgcgcagggaagaccagctctctccaggacatcgggctgcgtgaagtccagtgaccctgaggggattttggccaaaggaaacagccagggctgggctaggagagctggggtcaaaagctgccccacccactctccctcacatggtgctaggctgggagctgccctgagagctgggatgcccaccaaggcccacagaactgtctccaggcccttgtagacagtgggatctctgggctgatttctggttggggtctgctcctaccccaccccatttaacaatgtgaagtgactgaggctggggtgcctctccctggccccctccaactgccaaattctgcttccctctgaaccccaggaaatactttctggagaggcttgtcttgttcagaagactctagcatcttggggctggaaggtcctttgacgggtatgaaacaggtccagaaaggggaggtggcctgcttggccgacgtcatggagccagctgggagcagggctgagcgttgaacccgaggctcccggttccaagtcccatcgtgctcctcttccaatgccacactgcctctgagcccatccttgggaccctactctgtgccaggttcctgtcccttcctccgtcacagcatggtcattccaggatatggggacaaaccactccttcccagccagggtgcctttgagccttctcattccgaggtctgcgtttgcatccctgtcgtgttctccctcgaggggtccttccccagcctgtgggggcctgggtctgttctgagctgattcccttttctccagttctctgctgggatgaagaaagttggacactcagtgggaccagctgcaggtggtttcactgtgtacacagcagtgtccccatcatgcctctcaatggggcctgcaagcctgggaacttgggcatcgttgggccagcaggatgagcagcaaagggtctgaggacagggtggcatgtctgcttgtgtgctcatgaagacatgcccacgccatggagccaggggcttacagagaggggcagtgacttccagagtcccatccgtcagtgaggggactgggctgcgggatgggtgaggatcttacagctcccaggttcggaaatctaccctctaggcctggaggcctctctcgcagagcatggaaggcaggagaggtgggctggcctagggcaggagctccacttctctctgcctctggctatgggaaggagcaggcggttggaaatcctgtgacagcagagatcttctggatttttgcctggacccttctgcaagcctggagactggacctgccacatgttccaagtctgtctgcctaggtcactgctgccacttctcctcccactaacagacctttcttgaagacccactaggtccagacactgccgggacttgcaggtatggggggtagaaggagaggcagataagctgcctggggggctgttagctaatgggtacaaggacaccccctcccgagaagagaagccacagatgagtgggccagcgaggccagtcttcaatgtccactaattcactctaagcatttggccaaaaaaaggagagagaaataactgaaattgttcaggtggctccatcgtctattctgtggtcccctccatgagcctttgccccagggtgggtgcaggtgcgagtgtcacctgcagctgcctcagtcattcagagttccagagccttctgtggtggagcatcctgctgcttggaggatgagtctgaagtttaaaaatgggccttttctgagcccccctgatgagcagtcagtgcttctgggcccagctaaggaagccatctgttcccagcagaggagagctgctgcgctgacctgcagaggttggtggtcccagcacagagctgtgcccatgggcttgttagtgggaaaagcaaatacaacaatgttttaccaaacatttaattatgaatgcccactccccagcatctagatctaaaattattaacattttgccacattctttttctctctctgtgtatgtatatgttttctctgtcctaatttaaaagtacattgcaaacatcatgaaacttgatccctgaaagcttcagcctgcatctcctaagagttagggcattgtcctacacattggcccagtatcacagccaagacgagaagtcatttcccagcgatgtctgctatctaatctgtattcaaatccccccaattgtctcccaggtaacttatgtgtctggttttggaatcagcatccagtcacggtgcacacattgcattttctaactatgtttttaaaacctctttgaatgctgaaaggtcttccctcagctcactttgagtttttaaatgacattgtttttgaggccctaggcctgctgtctttttgaagccccacattctgaatttgtcagattgtttgctcatggtgtcgcataaccacttcttctatcccctgtactttcaaggataatttaggctacatgagattttgccttttgtgctgacttgacagcttcacttctgcctaagatgcgcctccactgtcacctgtaccaagtgccaaaacagcagaggggccagttagagcaagagctctgggggggcccggaaagtctccctggagaaggccgtaatatctgggccttggaaggaaggacacagggctctggaaggaggaggctgcatgcctgaaggctgggccttcgaccctggggatgggccacagggcaccaaacacatcatatgtctctctctttctattttggggtcccagggttttcatttcctggagacccgtggtctgtgtgcactggagcagagccaggctctcagttgcagcagggaaaagcctacatggggaactgcctcccgcaagctgtggtgtgagaagagccctggctggcagcaggagctgtgaagtttcatcccagccgggtgcatttagtagctgcctgaccatcttcctcccaggccctcagtttcttcatctgtagaatgagcagataggggccacagcagggattttcacacatcaaaggaggcagcctctgctctagttgatgtgaggatgagggggcggcctagaccccctgctgcccaggccgttgaggcaacactgggttcctggcttgacagctgtgggctggctgcccttgccagctcagacggctggcgagttttcagcttccctaagggactggcatagggttttgtggggtcaatgccaggaacctgggggaaactggatgcgttttatcctaagaagttcatccctcctgctcttactgtttccggccctggaggagaatgagggaggagagggttttctatgactgtgttagcttttattattagcaagagggctccttttgtaatttgtgcatgaaattcatgtcatttcctgggagaggagagggccgactggagagggtggggggcacactggggaagcaggcagaggtttccttcccttgtaggggggtggggagagtggggagagggggtgctatccagttcgcctgatgagggctctcgaaccagccgttttgggttgtgttaaaggtgagaccttcctccattaatgtacaatctcgaactaactgctaataaagtggggt

SEQ ID NO: 102617 - DNA, 6802 bp, Homo sapiens
  misc_feature (3134)..(3134): n is a, c, g, or t
gcggccgcgattcggggaggtaggcgctgggccgaggaggtgcagccgtgttaaggagaggacattcgagagggcgtggcgaagtgaagaggaacctcacgccactgcctggagctccgagtctcgctctgtcgcccaggctgcagtgcagtgacgtgatctcggctcactgcaccctccgcctcccaggttcaagtgattcccctgcctcagcctcctgggtagctgggactacagccttagccccgtgggccccacggagtgagcggcatgcagcacccccgggcctgtccagtgtcctctggcctgctgccctgcacccccagaaggccctgacgccctggggcacttctgctctgcacaggaccacgcgggggtttgccatggtgacataaaggggcgcggaggaaggaaggagcgtgaccagcctgtggactgcgcccctggctgggaggaaggactgggggcccagatcctccactcccagtgccccacaagggcgtcgcttcctaagtctctgtgaatttgttggtcagtggacgattctcgtgtctcctcctgtgtggggccttggggtagccagggcaggccgggcctccggtggccaaggtctcggaggccaggatgcctgccctggcatgcctccggaggctgtgtcggcacgtgtccccgcaggctgtccttttcctgctgttcatcttctgcctgttcagcgttttcatctcggcctactacctatatggctggaagcgaggcctggagccctcggcggatgcccccgagcctgactgcggggacccgccgcctgtggcccccagtcgcctgctgccactcaagcctgtgcaggcagccaccccttcccgcacagacccgttggtgctggtctttgtggagagcctctactcgcaactgggccaggaggtggtggccatcctggagtccagccgcttcaaataccgcacagagattgcgccgggcaagggtgacatgcccacgctcactgacaagggccgtggccgcttcgccctcatcatctatgagaacatcctcaagtatgtcaacctggacgcctggaaccgggagctgctggacaagtactgtgtggcctacggcgtgggcatcattggcttcttcaaggccaatgagaacagcctgctgagtgcgcagctcaagggcttccccctgttcctgcactcaaacctgggcctgaaggactgcagcatcaaccccaagtccccgctgctctacgtgacgcgacctagcgaggtggagaaaggtgtgctccccggcgaggactggacggttttccagtcaaatcactccacctatgagccagtgctgctggccaagacgcgctcgtctgagtccatcccacacctgggcgcagacgccggcctgcatgctgcactgcacgccactgtggtccaggacctgggcctgcacgacggcatccagcgcgtgctgtttggcaacaacctgaacttctggctgcacaagcttgtcttcgtggatgccgtggccttcctcacggggaagcgcctctccctgccattggaccgctacatcctggtggacattgatgacatcttcgtgggcaaggagggcacacgcatgaaggtggaggacgtgaaggccctgtttgacacacagaacgaactacgcgcacacatcccaaacttcaccttcaacctgggctactcagggaaattcttccacacaggtaccaatgctgaggacgctggggatgatctgctgctgtcgtatgtgaaggagttctggtggttcccccacatgtggagccacatgcagccccaccttttccacaaccagtccgtgttggccgagcagatggccttgaacaagaagttcgctgtcgagcatggcattcccacagacatggggtatgcagtggcgccccaccactcgggcgtgtaccccgtgcacgtgcagctgtacgaggcttggaagcaggtgtggagcatccgcgtgaccagcacggaggagtacccccacctgaagccagcccgctaccgccgtggcttcatccacaatggcatcatggttctcccacggcagacctgcggcctcttcacacacaccatcttctacaacgagtaccctggcggctccagtgagctggacaagatcatcaacgggggcgagctcttcctcaccgtgctcctcaatcctatcagcatcttcatgacgcacctgtccaactatgggaatgaccgcctgggcctgtacaccttcaagcacctggtgcgcttcctgcactcctggaccaacctccggctgcagacactgccccctgtgcagttggcgcagaagtacttccagatcttctccgaggagaaggacccgctctggcaggacccctgcgaggacaaacgtcacaaagacatctggtccaaggagaagacgtgtgaccgcttcccaaagctcctcatcatcggcccccagaaaacaggcaccactgccctctacctgttcctgggcatgcaccctgacctaagcagcaactaccccagctctgagacctttgaggagatccagttttttaatggccacaactatcacaaaggcatcgactggtacatggagttcttccccatcccttccaacaccacctccgacttctactttgagaaaagcgccaactactttgattcagaagtggcgccccggcgggcagcagccctcttgcccaaagccaaggtcctgaccatcctcatcaaccccgcggaccgggcctattcctggtaccagctggtgagactgccagccacggctttgcttagccacctgtggccgagggctctcagagacccccttaacctcccaaatactaagaagctaaaatattttaatattttgtttttttttttcttggtgccagagtttataccctgggtgctggggtcgcactgtgttatatatatatatatatatatatataatgtgtatatatatatattctattttttttggttgggttcgtttttaattcagtcctacaaaatggtggtaagccccagtctcaggggtcaccctgtcttagagctagagatgaggtggcagggagggaggctgtgtcctcagtggcctggggctgagcagaccttaggaagggnccctccccagtgccgtggctgctctggggctaccccaggtgaacagaggtggtgagatgcgcagggaagaccagctctctccaggacatcgggctgcgtgaagtccagtgaccctgaggggattttggccaaaggaaacagccagggctgggctaggagagctggggtcaaaagctgccccacccactctccctcacatggtgctaggctgggagctgccctgagagctgggatgcccaccaaggcccacagaactgtctccaggcccttgtagacagtgggatctctgggctgatttctggttggggtctgctcctaccccaccccatttaacaatgtgaagtgactgaggctggggtgcctctccctggccccctccaactgccaaattctgcttccctctgaaccccaggaaatactttctggagaggcttgtcttgttcagaagactctagcatcttggggctggaaggtcctttgacgggtatgaaacaggtccagaaaggggaggtggcctgcttggccgacgtcatggagccagctgggagcagggctgagcgttgaacccgaggctcccggttccaagtcccatcgtgctcctcttccaatgccacactgcctctgagcccatccttgggaccctactctgtgccaggttcctgtcccttcctccgtcacagcatggtcattccaggatatggggacaaaccactccttcccagccagggtgcctttgagccttctcattccgaggtctgcgtttgcatccctgtcgtgttctccctcgaggggtccttccccagcctgtgggggcctgggtctgttctgagctgattcccttttctccagttctctgctgggatgaagaaagttggacactcagtgggaccagctgcaggtggtttcactgtgtacacagcagtgtccccatcatgcctctcaatggggcctgcaagcctgggaacttgggcatcgttgggccagcaggatgagcagcaaagggtctgaggacagggtggcatgtctgcttgtgtgctcatgaagacatgcccacgccatggagccaggggcttacagagaggggcagtgacttccagagtcccatccgtcagtgaggggactgggctgcgggatgggtgaggatcttacagctcccaggttcggaaatctaccctctaggcctggaggcctctctcgcagagcatggaaggcaggagaggtgggctggcctagggcaggagctccacttctctctgcctctggctatgggaaggagcaggcggttggaaatcctgtgacagcagagatcttctggatttttgcctggacccttctgcaagcctggagactggacctgccacatgttccaagtctgtctgcctaggtcactgctgccacttctcctcccactaacagacctttcttgaagacccactaggtccagacactgccgggacttgcaggtatggggggtagaaggagaggcagataagctgcctggggggctgttagctaatgggtacaaggacaccccctcccgagaagagaagccacagatgagtgggccagcgaggccagtcttcaatgtccactaattcactctaagcatttggccaaaaaaaggagagagaaataactgaaattgttcaggtggctccatcgtctattctgtggtcccctccatgagcctttgccccagggtgggtgcaggtgcgagtgtcacctgcagctgcctcagtcattcagagttccagagccttctgtggtggagcatcctgctgcttggaggatgagtctgaagtttaaaaatgggccttttctgagcccccctgatgagcagtcagtgcttctgggcccagctaaggaagccatctgttcccagcagaggagagctgctgcgctgacctgcagaggttggtggtcccagcacagagctgtgcccatgggcttgttagtgggaaaagcaaatacaacaatgttttaccaaacatttaattatgaatgcccactccccagcatctagatctaaaattattaacattttgccacattctttttctctctctgtgtatgtatatgttttctctgtcctaatttaaaagtacattgcaaacatcatgaaacttgatccctgaaagcttcagcctgcatctcctaagagttagggcattgtcctacacattggcccagtatcacagccaagacgagaagtcatttcccagcgatgtctgctatctaatctgtattcaaatccccccaattgtctcccaggtaacttatgtgtctggttttggaatcagcatccagtcacggtgcacacattgcattttctaactatgtttttaaaacctctttgaatgctgaaaggtcttccctcagctcactttgagtttttaaatgacattgtttttgaggccctaggcctgctgtctttttgaagccccacattctgaatttgtcagattgtttgctcatggtgtcgcataaccacttcttctatcccctgtactttcaaggataatttaggctacatgagattttgccttttgtgctgacttgacagcttcacttctgcctaagatgcgcctccactgtcacctgtaccaagtgccaaaacagcagaggggccagttagagcaagagctctgggggggcccggaaagtctccctggagaaggccgtaatatctgggccttggaaggaaggacacagggctctggaaggaggaggctgcatgcctgaaggctgggccttcgaccctggggatgggccacagggcaccaaacacatcatatgtctctctctttctattttggggtcccagggttttcatttcctggagacccgtggtctgtgtgcactggagcagagccaggctctcagttgcagcagggaaaagcctacatggggaactgcctcccgcaagctgtggtgtgagaagagccctggctggcagcaggagctgtgaagtttcatcccagccgggtgcatttagtagctgcctgaccatcttcctcccaggccctcagtttcttcatctgtagaatgagcagataggggccacagcagggattttcacacatcaaaggaggcagcctctgctctagttgatgtgaggatgagggggcggcctagaccccctgctgcccaggccgttgaggcaacactgggttcctggcttgacagctgtgggctggctgcccttgccagctcagacggctggcgagttttcagcttccctaagggactggcatagggttttgtggggtcaatgccaggaacctgggggaaactggatgcgttttatcctaagaagttcatccctcctgctcttactgtttccggccctggaggagaatgagggaggagagggttttctatgactgtgttagcttttattattagcaagagggctccttttgtaatttgtgcatgaaattcatgtcatttcctgggagaggagagggccgactggagagggtggggggcacactggggaagcaggcagaggtttccttcccttgtaggggggtggggagagtggggagagggggtgctatccagttcgcctgatgagggctctcgaaccagccgttttgggttgtgttaaaggtgagaccttcctccattaatgtacaatctcgaactaactgctaataaagtggggt

SEQ ID NO: 102618 - DNA, 1933 bp, Homo sapiens
ctgcatgcatactagcttggcgtgacggtcgtagcatcccgtcgtgttgctgggatgagtctgaagtttaaaaatgggccttttctgagcccccctgatgagcagtcagtgcttctgggcccagctaaggaagccatctgttcccagcagaggagagctgctgcgctgacctgcagaggttggtggtcccagcacagagctgtgcccatgggcttgttagtgggaaaagcaaatacaacaatgttttaccaaacatttaattatgaatgcccactccccagcatctagatctaaaattattaacattttgccacattctttttctctctctgtgtatgtatatgttttctctgtcctaatttaaaagtacattgcaaacatcatgaaacttgatccctgaaagcttcagcctgcatctcctaagagttagggcattgtcctacacattggcccagtatcacagccaagacgagaagtcatttcccagcgatgtctgctatctaatctgtattcaaatccccccaattgtctcccaggtaacttatgtgtctggttttggaatcagcatccagtcacggtgcacacattgcattttctaactatgtttttaaaacctctttgaatgctgaaaggtcttccctcagctcactttgagtttttaaatgacattgtttttgaggccctaggcctgctgtctttttgaagccccacattctgaatttgtcagattgtttgctcatggtgtcgcataaccacttcttctatcccctgtactttcaaggataatttaggctacatgagattttgccttttgtgctgacttgacagcttcacttctgcctaagatgcgcctccactgtcacctgtaccaagtgccaaaacagcagaggggccagttagagcaagagctctgggggggcccggaaagtctccctggagaaggccgtaatatctgggccttggaaggaaggacacagggctctggaaggaggaggctgcatgcctgaaggctgggccttcgaccctggggatgggccacagggcaccaaacacatcatatgtctctctctttctattttggggtcccagggttttcatttcctggagacccgtggtctgtgtgcactggagcagagccaggctctcagttgcagcagggaaaagcctacatggggaactgcctcccgcaagctgtggtgtgagaagagccctggctggcagcaggagctgtgaagtttcatcccagccgggtgcatttagtagctgcctgaccatcttcctcccaggccctcagtttcttcatctgtagaatgagcagataggggccacagcagggattttcacacatcaaaggaggcagcctctgctctagttgatgtgaggatgagggggcggcctagaccccctgctgcccaggccgttgaggcaacactgggttcctggcttgacagctgtgggctggctgcccttgccagctcagacggctggcgagttttcagcttccctaagggactggcatagggttttgtggggtcaatgccaggaacctgggggaaactggatgcgttttatcctaagaagttcatccctcctgctcttactgtttccggccctggaggagaatgagggaggagagggttttctatgactgtgttagcttttattattagcaagagggctccttttgtaatttgtgcatgaaattcatgtcatttcctgggagaggagagggccgactggagagggtggggggcacactggggaagcaggcagaggtttccttcccttgtaggggggtggggagagtggggagagggggtgctatccagttcgcctgatgagggctctcgaaccagccgttttgggttgtgttaaaggtgagaccttcctccattaatgtacaatctcgaactaactgctaataaagtggggt

SEQ ID NO: 102619 - DNA, 2610 bp, Homo sapiens
gcggccgcgattcggggaggtaggcgctgggccgaggaggtgcagccgtgttaaggagaggacattcgagagggcgtggcgaagtgaagaggaacctcacgccactgcctggagctccgagtctcgctctgtcgcccaggctgcagtgcagtgacgtgatctcggctcactgcaccctccgcctcccaggttcaagtgattcccctgcctcagcctcctgggtagctgggactacagccttagccccgtgggccccacggagtgagcggcatgcagcacccccgggcctgtccagtgtcctctggcctgctgccctgcacccccagaaggccctgacgccctggggcacttctgctctgcacaggaccacgcgggggtttgccatggtgacataaaggggcgcggaggaaggaaggagcgtgaccagcctgtggactgcgcccctggctgggaggaaggactgggggcccagatcctccactcccagtgccccacaagggcgtcgcttcctaagtctctgtgaatttgttggtcagtggacgattctcgtgtctcctcctgtgtggggccttggggtagccagggcaggccgggcctccggtggccaaggtctcggaggccaggatgcctgccctggcatgcctccggaggctgtgtcggcacgtgtccccgcaggctgtccttttcctgctgttcatcttctgcctgttcagcgttttcatctcggcctactacctatatggctggaagcgaggcctggagccctcggcggatgcccccgagcctgactgcggggacccgccgcctgtggcccccagtcgcctgctgccactcaagcctgtgcaggcagccaccccttcccgcacagacccgttggtgctggtctttgtggagagcctctactcgcaactgggccaggaggtggtggccatcctggagtccagccgcttcaaataccgcacagagattgcgccgggcaagggtgacatgcccacgctcactgacaagggccgtggccgcttcgccctcatcatctatgagaacatcctcaagtatgtcaacctggacgcctggaaccgggagctgctggacaagtactgtgtggcctacggcgtgggcatcattggcttcttcaaggccaatgagaacagcctgctgagtgcgcagctcaagggcttccccctgttcctgcactcaaacctgggcctgaaggactgcagcatcaaccccaagtccccgctgctctacgtgacgcgacctagcgaggtggagaaaggtgtgctccccggcgaggactggacggttttccagtcaaatcactccacctatgagccagtgctgctggccaagacgcgctcgtctgagtccatcccacacctgggcgcagacgccggcctgcatgctgcactgcacgccactgtggtccaggacctgggcctgcacgacggcatccagcgcgtgctgtttggcaacaacctgaacttctggctgcacaagcttgtcttcgtggatgccgtggccttcctcacggggaagcgcctctccctgccattggaccgctacatcctggtggacattgatgacatcttcgtgggcaaggagggcacacgcatgaaggtggaggacgtgaaggccctgtttgacacacagaacgaactacgcgcacacatcccaaacttcaccttcaacctgggctactcagggaaattcttccacacaggtaccaatgctgaggacgctggggatgatctgctgctgtcgtatgtgaaggagttctggtggttcccccacatgtggagccacatgcagccccaccttttccacaaccagtccgtgttggccgagcagatggccttgaacaagaagttcgctgtcgagcatggcattcccacagacatggggtatgcagtggcgccccaccactcgggcgtgtaccccgtgcacgtgcagctgtacgaggcttggaagcaggtgtggagcatccgcgtgaccagcacggaggagtacccccacctgaagccagcccgctaccgccgtggcttcatccacaatggcatcatggttctcccacggcagacctgcggcctcttcacacacaccatcttctacaacgagtaccctggcggctccagtgagctggacaagatcatcaacgggggcgagctcttcctcaccgtgctcctcaatcctgtgagtgctccacagcccatggctgctggtgagaaggggctgctgcacagcctgtctgcagctgacacaggcttcctggagccaggaaagggtggagaggcatgagtgagtgcctggcagttgggagacccactctccagcactggccctgcctcggctgtgtgaccttggctaaagaatccgagcatgctttttttttcctttcctaatcatgtactttaatacaaaagtgttggcatttttatgcatgttcccttcagtctttgctcatgtgtgtatacacacatacacagatacacacacatatatgaacaacatttgagttttctaggtctcgctttccttatttgtaaaatgcaaacaattacctctgctttaataatattaaataaacttcaagtggtggttgttattcagctc

SEQ ID NO: 102620 - DNA, 3326 bp, Homo sapiens
gcggccgcgattcggggaggtaggcgctgggccgaggaggtgcagccgtgttaaggagaggacattcgagagggcgtggcgaagtgaagaggaacctcacgccactgcctggagctccgagtctcgctctgtcgcccaggctgcagtgcagtgacgtgatctcggctcactgcaccctccgcctcccaggttcaagtgattcccctgcctcagcctcctgggtagctgggactacagccttagccccgtgggccccacggagtgagcggcatgcagcacccccgggcctgtccagtgtcctctggcctgctgccctgcacccccagaaggccctgacgccctggggcacttctgctctgcacaggaccacgcgggggtttgccatggtgacataaaggggcgcggaggaaggaaggagcgtgaccagcctgtggactgcgcccctggctgggaggaaggactgggggcccagatcctccactcccagtgccccacaagggcgtcgcttcctaagtctctgtgaatttgttggtcagtggacgattctcgtgtctcctcctgtgtggggccttggggtagccagggcaggccgggcctccggtggccaaggtctcggaggccaggatgcctgccctggcatgcctccggaggctgtgtcggcacgtgtccccgcaggctgtccttttcctgctgttcatcttctgcctgttcagcgttttcatctcggcctactacctatatggctggaagcgaggcctggagccctcggcggatgcccccgagcctgactgcggggacccgccgcctgtggcccccagtcgcctgctgccactcaagcctgtgcaggcagccaccccttcccgcacagacccgttggtgctggtctttgtggagagcctctactcgcaactgggccaggaggtggtggccatcctggagtccagccgcttcaaataccgcacagagattgcgccgggcaagggtgacatgcccacgctcactgacaagggccgtggccgcttcgccctcatcatctatgagaacatcctcaagtatgtcaacctggacgcctggaaccgggagctgctggacaagtactgtgtggcctacggcgtgggcatcattggcttcttcaaggccaatgagaacagcctgctgagtgcgcagctcaagggcttccccctgttcctgcactcaaacctgggcctgaaggactgcagcatcaaccccaagtccccgctgctctacgtgacgcgacctagcgaggtggagaaaggtgtgctccccggcgaggactggacggttttccagtcaaatcactccacctatgagccagtgctgctggccaagacgcgctcgtctgagtccatcccacacctgggcgcagacgccggcctgcatgctgcactgcacgccactgtggtccaggacctgggcctgcacgacggcatccagcgcgtgctgtttggcaacaacctgaacttctggctgcacaagcttgtcttcgtggatgccgtggccttcctcacggggaagcgcctctccctgccattggaccgctacatcctggtggacattgatgacatcttcgtgggcaaggagggcacacgcatgaaggtggaggacgtgaaggccctgtttgacacacagaacgaactacgcgcacacatcccaaacttcaccttcaacctgggctactcagggaaattcttccacacaggtaccaatgctgaggacgctggggatgatctgctgctgtcgtatgtgaaggagttctggtggttcccccacatgtggagccacatgcagccccaccttttccacaaccagtccgtgttggccgagcagatggccttgaacaagaagttcgctgtcgagcatggcattcccacagacatggggtatgcagtggcgccccaccactcgggcgtgtaccccgtgcacgtgcagctgtacgaggcttggaagcaggtgtggagcatccgcgtgaccagcacggaggagtacccccacctgaagccagcccgctaccgccgtggcttcatccacaatggcatcatggttctcccacggcagacctgcggcctcttcacacacaccatcttctacaacgagtaccctggcggctccagtgagctggacaagatcatcaacgggggcgagctcttcctcaccgtgctcctcaatcctatcagcatcttcatgacgcacctgtccaactatgggaatgaccgcctgggcctgtacaccttcaagcacctggtgcgcttcctgcactcctggaccaacctccggctgcagacactgccccctgtgcagttggcgcagaagtacttccagatcttctccgaggagaaggacccgctctggcaggacccctgcgaggacaaacgtcacaaagacatctggtccaaggagaagacgtgtgaccgcttcccaaagctcctcatcatcggcccccagaaaacaggcaccactgccctctacctgttcctgggcatgcaccctgacctaagcagcaactaccccagctctgagacctttgaggagatccagttttttaatggccacaactatcacaaaggcatcgactggtacatggagttcttccccatcccttccaacaccacctccgacttctactttgagaaaagcgccaactactttgattcagaagtggcgccccggcgggcagcagccctcttgcccaaagccaaggtcctgaccatcctcatcaaccccgcggaccgggcctattcctggtaccagcaccagcgagcccatgacgacccagtggccctaaagtacaccttccatgaggtgattaccgccggctctgacgcatcctcgaagctgcgtgccctccagaaccgctgcctggtccctggctggtacgccacccacatcgagcgctggctcagtgcctatcacgccaaccagattctggtcttggatggcaaactgcttcgcacagaacctgccaaagtgatggacatggtgcagaagttccttggggtgaccaacaccattgactaccacaaaaccttggcgtttgatccaaagaaaggattttggtgccaactgcttgaaggaggaaaaaccaagtgtctgggcaaaagcaagggccggaaatatcccgagatggacttggatgtaagtggtggacacactacctgtagcacctgcataagggtaaggggtccctgtatggagttgagggggattctctttcctttaccatgcactcagcatgttcatggccttagcatttcttggacagtatttgtaagaggaggaaaatgggggctgggacatggtgggtcaga

SEQ ID NO: 102621 - DNA, 2765 bp, Homo sapiens
gcggccgcgattcggggaggtaggcgctgggccgaggaggtgcagccgtgttaaggagaggacattcgagagggcgtggcgaagtgaagaggaacctcacgccactgcctggagctccgagtctcgctctgtcgcccaggctgcagtgcagtgacgtgatctcggctcactgcaccctccgcctcccaggttcaagtgattcccctgcctcagcctcctgggtagctgggactacagccttagccccgtgggccccacggagtgagcggcatgcagcacccccgggcctgtccagtgtcctctggcctgctgccctgcacccccagaaggccctgacgccctggggcacttctgctctgcacaggaccacgcgggggtttgccatggtgacataaaggggcgcggaggaaggaaggagcgtgaccagcctgtggactgcgcccctggctgggaggaaggactgggggcccagatcctccactcccagtgccccacaagggcgtcgcttcctaagtctctgtgaatttgttggtcagtggacgattctcgtgtctcctcctgtgtggggccttggggtagccagggcaggccgggcctccggtggccaaggtctcggaggccaggatgcctgccctggcatgcctccggaggctgtgtcggcacgtgtccccgcaggctgtccttttcctgctgttcatcttctgcctgttcagcgttttcatctcggcctactacctatatggctggaagcgaggcctggagccctcggcggatgcccccgagcctgactgcggggacccgccgcctgtggcccccagtcgcctgctgccactcaagcctgtgcaggcagccaccccttcccgcacagacccgttggtgctggtctttgtggagagcctctactcgcaactgggccaggaggtggtggccatcctggagtccagccgcttcaaataccgcacagagattgcgccgggcaagggtgacatgcccacgctcactgacaagggccgtggccgcttcgccctcatcatctatgagaacatcctcaagtatgtcaacctggacgcctggaaccgggagctgctggacaagtactgtgtggcctacggcgtgggcatcattggcttcttcaaggccaatgagaacagcctgctgagtgcgcagctcaagggcttccccctgttcctgcactcaaacctgggcctgaaggactgcagcatcaaccccaagtccccgctgctctacgtgacgcgacctagcgaggtggagaaaggtgtgctccccggcgaggactggacggttttccagtcaaatcactccacctatgagccagtgctgctggccaagacgcgctcgtctgagtccatcccacacctgggcgcagacgccggcctgcatgctgcactgcacgccactgtggtccaggacctgggcctgcacgacggcatccagcgcgtgctgtttggcaacaacctgaacttctggctgcacaagcttgtcttcgtggatgccgtggccttcctcacggggaagcgcctctccctgccattggaccgctacatcctggtggacattgatgacatcttcgtgggcaaggagggcacacgcatgaaggtggaggacgtgaaggccctgtttgacacacagaacgaactacgcgcacacatcccaaacttcaccttcaacctgggctactcagggaaattcttccacacaggtaccaatgctgaggacgctggggatgatctgctgctgtcgtatgtgaaggagttctggtggttcccccacatgtggagccacatgcagccccaccttttccacaaccagtccgtgttggccgagcagatggccttgaacaagaagttcgctgtcgagcatggcattcccacagacatggggtatgcagtggcgccccaccactcgggcgtgtaccccgtgcacgtgcagctgtacgaggcttggaagcaggtgtggagcatccgcgtgaccagcacggaggagtacccccacctgaagccagcccgctaccgccgtggcttcatccacaatggcatcatggttctcccacggcagacctgcggcctcttcacacacaccatcttctacaacgagtaccctggcggctccagtgagctggacaagatcatcaacgggggcgagctcttcctcaccgtgctcctcaatcctatcagcatcttcatgacgcacctgtccaactatgggaatgaccgcctgggcctgtacaccttcaagcacctggtgcgcttcctgcactcctggaccaacctccggctgcagacactgccccctgtgcagttggcgcagaagtacttccagatcttctccgaggagaaggacccgctctggcaggacccctgcgaggacaaacgtcacaaagacatctggtccaaggagaagacgtgtgaccgcttcccaaagctcctcatcatcggcccccagaaaacaggcaccactgccctctacctgttcctgggcatgcaccctgacctaagcagcaactaccccagctctgagacctttgaggagatccagttttttaatggccacaactatcacaaaggcatcgactggtacatggagttcttccccatcccttccaacaccacctccgacttctactttgagaaaagcgccaactactttgattcagaagtggcgccccggcgggcagcagccctcttgcccaaagccaaggtcctgaccatccgaagcagtgccgaagatcctgctagatcacgata

SEQ ID NO: 102622 - DNA, 1208 bp, Homo sapiens
gcggccgcgattcggggaggtaggcgctgggccgaggaggtgcagccgtgttaaggagaggacattcgagagggcgtggcgaagtgaagaggaacctcacgccactgcctggagctccgagtctcgctctgtcgcccaggctgcagtgcagtgacgtgatctcggctcactgcaccctccgcctcccaggttcaagtgattcccctgcctcagcctcctgggtagctgggactacagccttagccccgtgggccccacggagtgagcggcatgcagcacccccgggcctgtccagtgtcctctggcctgctgccctgcacccccagaaggccctgacgccctggggcacttctgctctgcacaggaccacgcgggggtttgccatggtgacataaaggggcgcggaggaaggaaggagcgtgaccagcctgtggactgcgcccctggctgggaggaaggactgggggcccagatcctccactcccagtgccccacaagggcgtcgcttcctaagtctctgtgaatttgttggtcagtggacgattctcgtgtctcctcctgtgtggggccttggggtagccagggcaggccgggcctccggtggccaaggtctcggaggccaggatgcctgccctggcatgcctccggaggctgtgtcggcacgtgtccccgcaggctgtccttttcctgctgttcatcttctgcctgttcagcgttttcatctcggcctactacctatatggctggaagcgaggcctggagccctcggcggatgcccccgagcctgactgcggggacccgccgcctgtggcccccagtcgcctgctgccactcaagcctgtgcaggcagccaccccttcccgcacagacccgttggtgctggtctttgtggagagcctctactcgcaactgggccaggaggtggtggccatcctggagtccagccgcttcaaataccgcacagagattgcgccgggcaagggtgacatgcccacgctcactgacaagggccgtggccgcttcgccctcatcatctatgagaacatcctcaagtatgtcaacctggacgcctggaaccgggagctgctggacaagtactgtgtggcctacggcgtgggcatcattggcttcttcaaggtacacaagaagcagggtccccgagcagttcagagccccctctgcagctcagtgcctgaattctcatttgt

SEQ ID NO: 102623 - DNA, 676 bp, Homo sapiens
ccagctcccatccaaagactttcccacctccacaggtttgatccaaagaaaggattttggtgccaactgcttgaaggaggaaaaaccaagtgtctgggcaaaagcaagggccggaaatatcccgagatggacttggatgtaagtggtggacacactacctgtagcacctgcataagggtaaggggtccctgtatggagttgagggggattctctttcctttaccatgcactcagcatgttcatggccttagcatttcttggacagtatttgtaagaggaggaaaatgggggctgggacatggtgggtcagacctgatttcgtcaaacaagtgttggttaccttctactaagggctgagtgctgtggggttttgaggatgagccagacatgttctctgccttcaaggaactcctggtcttggaggggtatgagtcccaacaccactaagtagaatacaggcagagagtgctgcgcgcagtcagagagggcacacaagtgctatgggaattcagaacaaggggatgtcacttgaacctgagaggggtaaaaaaggctccttaaaggagggatgggggtctctggagttgcgcctagaaggatgagatccattttgtaggatttggacatatggaatgggagggtaggtaagaacagcatgtgtaaaaccataggggga

SEQ ID NO: 102624 - DNA, 500 bp, Homo sapiens
tagagggtgcagggtcccatatttataagcaggcccattcctgctgccgtggctgttgcccttgtttgccaccgaagtcaaagcaggtcccgatcccctttctccctttccagattctggtcttggatggcaaactgcttcgcacagaacctgccaaagtgatggacatggtgcagaagttccttggggtgaccaacaccattgactaccacaaaaccttggcgtgagtgttgccttttcctttctgcaggttatttccctgataaggcacctgggccaacaaagccaaagtcttgaataattatgagagagagaagttagttagagtcagaaagtatggaaagttattaatatgacttaagtcatattaataaaggtatcaccttaaaaaaaagggagatgatgaatctgttctactctggtcagaccatcctggggtcttctctttggtctgggctgaacattttcagagtgttttatgtaagtaaattagatcagta

SEQ ID NO: 102625 - DNA, 437 bp, Homo sapiens
cgctggcggcatcacgaaattatcttcatagctgttacctgaaccggaatcacgtcctatgtctgtaaacatttagtggacctcttgttagcgaggcaacctccagattatctaacactgcaatccatgttatttttcactacctaatgatactgcaaattctgttagatcttaaaaatccttttggctgggtacagtggctcattcctgtaatccaacctactcgagaaactgaggcagaagcattacctgaatccaggaggtcaagacttgcagtgagctgtgtttgtgccactacactgcagcctaggtgacagagcatgaccctgtctcaaaaaacaaaaatgaaaaaatccttttatttaccttccttcctcacccccacctcaatagcaatgtgaagcccatactatttgctgaatcaaatgaaataaata

SEQ ID NO: 102626 - DNA, 409 bp, Homo sapiens
agtctcgagctgtggcaggttttcgagggacagttcgttatgcatcaatcaacgcacatcggaacagacaaccagatactgcctcctgatgtgattcaagaggaagcatacaacccacctctgaagtatccttgcaaagtaaaactggaatcttatataatcatcaatttatagaaaatacaggggacagaaatacatattaaagacaaccacagggaaacaaccagcaaaatccagaatatggtaatgtgtgcatgtcaaattcctccatttttatcaacaacaataaacacaatgaaaagaaaattgcaagaaaataaaagacagagggtgaaccaattgattaaaagaggcttaagagataagcaatgtgtgaaccctatttggaactcaattcaaataaaccaaa

SEQ ID NO: 102627 - DNA, 331 bp, Homo sapiens
aactgtaggtggcttgactgtaggtgggcgcctctggaggggtgctggccaaggtcaagggtaaactaagagagggtgaaatttttctcctgagcttaagaggtgatgtccagagcggtgggaggaggagggcacttcctgagaacagggccagggaatgctttattcctagcaaaggaactcaagccccgctgcagccatcccaacccctaagggctggaagagggatgctgaacttagactcctcctcctcttaggagaaggcagtagtcagacacccagatcctcgacagtgactaggaacacacacacacacacacacacacacaca

SEQ ID NO: 102628 - DNA, 359 bp, Homo sapiens
atagagggaagaaatgaaggccaaaggaaatatgtgaaagaataaaaaatagaacaacagaacagaagaagagagaccaaaaacaggtccatgaatacttatgacaaaagtggcactgtaatgtggagtggttgatattttcagtaatttgtgcttgaacaattgagtgtttctgtagaagaaaaaattggaccattatcataaaatcagttatatttggattatagttttaaatgtaaaggcaaaacaataaagcctttagaggataatgttaaaatatcttcttaatggttggatagagggattttttttaacaaggcataaagtgactatattataattaagaactcatgttaagc

SEQ ID NO: 102629 - DNA, 401 bp, Homo sapiens
gtcagagcaaataatgccatgccttgggtagaataaaggtattgctgttcatctcaatgcctacagccagtgtttcttagccatgtgatttccgacgagttattttacctctctgaccctcagtttccatctctctccacagggacttcatgggaattacattaaatgatacttgtaaggagttgggctgtgggagaaacacaacagctagtggctgtaattttgttgttgtgtgtgtcagtaagatgatggatgcagagcatgtcacacagttcctgatacacacaggcctctgtaacattggctgtggcttggactgatacgtagccataggagtgcagttggagaagagaggcatgtattagtccattctcacacgactataaagaactacttgagac

SEQ ID NO: 102630 - DNA, 467 bp, Homo sapiens
ctttccagtatctctgaacactgaaaagcctcagaactcagttttcaaacatctgctcctctctgcacgtgctctagagcgtgctgtccaggctagttgcaacagctcttgataccacggaatactggagacacgtcagctcgtatctccagcctggccctctcctctgaaatccagactcctaatcctgctgcctatccatcatctccactgggaggtctattaacatcttaaacttcacctatccaaaatgaatgcttcatttttctatcaagaatgcttctttcagtgttctacaactcaacaaatggcagtccactacacccagtagctcaggccaaaaaccttgattgaaccttgaattctttctctcacaacccacgtataacatcagcaaatcactttgttctaccttcaaaatattttccaaatccaagtagtgtttcctctccatccagatcaccatt

SEQ ID NO: 102631 - DNA, 291 bp, Homo sapiens
tcatacttaatggtaaaagacgggatgttttttcctccaggctcacccaaacagggtgatgaagtctgcctttactactacttttcaacattgtcctagaggtttcagccagtgcaaaaagagaaaataatgaaataaaaggcatctggattagaaagtaggaagtacaactctctttattcacagaccacatcatcatctgtgtagaaaatggaataaaatctacaaagtagctactagaactaataaattaggctagaaagattgtaatattcactatcaatgtacaaa

SEQ ID NO: 102632 - DNA, 594 bp, Homo sapiens
atgagttttagaagatgcttttattttgaaccacaatttttggaacactgagaagcttccaggccattttaccactattcacctcatttcgggggctcacttgttaacagatttaaataatgcgggatatgggaagtttcggtaaaaaaaggtatttcctcccctgggtctactcctgcctgatgtcttttttctgcaggaggaaagtgtctttcctcctctcttttgaaaaatttaactcaaatgtcccaagccctttggccaatgggtgcaaatttagaatttagccacattctgctgtgttaatagtactccccacagaattgtagagtctcccttcccttacagagttcttccactcatgtaaccccaacacacatgttcacacgtgtgcacacgcatgcacacacacacactactgagcattcacaggagattttagcatacctcatcactgagctgcagttcccaagagatagcctccctacagttaatttgtgatgctgggtgtggtggctcacacctgtaatcccagcactttgggagacagaggcaagtggatggcttgagcccaggagttcgagaccagcctgg

SEQ ID NO: 102633 - DNA, 405 bp, Homo sapiens
gcagcaagtgttgaagcccagaacagactataaccacactaagtctgcttttagctttttcagagaagcttacctttaaagcaactatttagggaacaagcaaactgatccttcggaccaggaggacagtgaaaaaatgtctagttcctttaaattagtaccatccatgtccaaagctcagctaaattgcaccccaggacactgaaaaacttgctgatatggccatggaactgctgtgagtattccctgaggaaccacgaggtatggcagtggcatgagagagccggcgatggaaagagcttttttagttcccttttaaggaaaaaatggtaaattgcagaagttccagatgggagggtgttaatcccttataaaattgttaggcagtttggcacactggtagaa

SEQ ID NO: 102634 - DNA, 248 bp, Homo sapiens
tcaggaatcttccttcccaggggcctttctcagaggttctgccctgagaggccaggccccaccctttcccccactgcatcaccagggcagtggatctgcttgtggctcccaagttcctcctttactcaggaagtcccagcgagaggcaggggagggcgagggttccctgggcctcccctcctcagacctgccttctactcacacggctcactcagggctgaaagggcccacgccacagcctgcagcct

SEQ ID NO: 102635 - DNA, 276 bp, Homo sapiens
tgtccctccctatcagatggctcaacatgctgaagtgtgtcggaagtgattgaagcgcacttccccactctcctgaaacacaggcaaaccagctgtgttggatgctgcagtgggcaagttcctaagcttgcacatgcattcagacaaacaggaaatgagatgtccagagctggcaggtaagaaagctcctctggcagtccttaactccttgctagtaagacttttcacttcctagtagaagcaagaggatgtgctgcccccatttaaactatggaa

SEQ ID NO: 102636 - DNA, 260 bp, Homo sapiens
aatagggaggtagaacaaaaatcaacatatagatgaagtcattctccaggtggaaagaacttttaagaatcattacaattaaatgtctctctgaaatgatgcttttgagtacaactagaaaacatgttacatattttctgattttcagtctcaggaagactaaagaagatgtttcaactatagaggtgggcacaaagtaggaataatcttgtgtcagaagagttcatgtggatattaaatgtattttgaattaaaaatct

SEQ ID NO: 102637 - DNA, 741 bp, Homo sapiens
gccgctggctgggggccaggctcctggagccctgctctctgatctttcttatcatcaaagactcctgtgggtcagtgacagtctaggtctgggctctttgaggatcaaaagagagggaggcctgagccactgggccctcagaggagcaggctggtaggtgagctctttccccaacaacgctgactgaaggctctgtggacaggaggaaggccctagaaggaggtgatgtttgagccaacagctaaaataggggaaagctagccatgcagttctgggtggagggtgtgaagagaagcaggcagccctgagtccagcaccagggctctcggagcaggagggagagggtgtggctgggcggagcaggccaggggagaatggtagggctcaagctggctctggggcagggatcttccaagcctgtggaggccatcataagcagggggcggaggtgggggggtccctgttccaagggcagagagcagcctttgaagggctttagctgccgtggccagacctgccttgacagcgcagactgcttcgtggggagcagttgggtgcggtcagtggcagttgaatgactggctgcaggcacgggtgaataacccagttgcagaaggaaggcaggctcttctgggaaaggcctctcagagcaagaacaattggggtgaatgagctaaggtcggaagtgcctagcacagggcctgtttgccgggaggtgcccagagaggggagttgtgctgt

SEQ ID NO: 102638 - DNA, 699 bp, Homo sapiens
gagtccccacaaagcaggctggtcagtggtcacgctagtgtgagtctttcaaacatcccgtgtaagtagatactgtcattgcacagaggaggaaatggaacctggcccaaggtctcaagaaacaacccagccgggattcagactcggcagcctgcgcacttaacagccgtgagcaaccaggaactccccagccctttctcttgtgccttcaagagtgcaagaaactgaccactgcccctagagagctctctgaagagcattcccatggctacagattgggtttggagccgcttgggctcaccatgggccagcattgttttggatggcctgagggcaaggactgtccctgctcttcatgcatcctgaagattagctcagtacctggcacagagtcgatgttccagagaggtttggtgaatacagaaggtccctgttgcatggaatcctgcaaagcaatgttggtgttaccggaaccataggaaacagctgatatccaaccatttttgaacctacacaggtgtcagtttcatgtggttcagcctaatgagagcaccaccttaatcctgttgggttctccatctcagccccaggggaatgagcaacacaggggagctagctggtggtgccagactggggttcagatccctgccacatttacatgggctttgtgacacacgacgggtcatctaatgtctctga

SEQ ID NO: 102639 - DNA, 258 bp, Homo sapiens
gtacttcactgtttctgagaccatgtatttattttaaagcacatggagggatgggaagaagctaaacttttttgcataaacttgttttttataaagtatactttggaacatgttaatattttacatgactataaaaagttttacacgaataatttctaaaaaattaaaagtaaagggaaatgaggctaatgttactgagttggttgcatgacataccatcataattactcatctactttaatcccataataaacacac

SEQ ID NO: 102640 - DNA, 314 bp, Homo sapiens
cagcagcactgtggggtgggggtcctcatccccttttcaaagacggggaaacggcggcttgtgaaggaaggaggtgtgcagtccacacactagtgagaagtgtgctgagcccacaccgaaagcgtttctctttccatggcaccagctgcctcggagagcggagacctggggcgaggcccagggggctgcagcaggaccttcaggcgctctgggtttcgtgtcacagaggggagaaggcggtgatgctgtgggggtcctgcgggagctgtgcctggaggtgggacagagcctagtacatgtggggtgggacaggg

SEQ ID NO: 102641 - DNA, 368 bp, Homo sapiens
ggtatatgaaaatgctactgatttttatacattgattttgtatcctgaaactataccgacattgtttatcaattctaggagccatttggtggagtctaggtatagaatcttgtcttcaggggatgaggcgcagtggctcatgcctgtaatcccaggactttggaaggccaaggcgggtatatcacttgaggccaggagtttgagaccagcctggccaacacagtgaagccccatctctactaaaaatactgaaaaacaaattagctgagcatgtagtctgtagtcccagctacttgagatggaggttgcagagagccgagatcgtgccactgcactccagcctgggtaacagagtgagattctgtctc

SEQ ID NO: 102642 - DNA, 741 bp, Homo sapiens
tgtttaattagcactttacattttataaagcacgtacacttttgatcagcacaaacagtattctgaagcaagctagaaaaatgctgttaatcctcttttacagatatgaaaacagacttaggttaagtgacatgccaaatttcacttagtagtagaacttgcataataatttaggccttttgatttggttactctttcaccatgccataattatctcttgggaaaagggaatatgaagataactctcaacactaccttttaatattttagtgtattttggctgggcacagtgcctcctgcctgtaatcccagcactttgggatgccaagccagacggattatgaggtcaggagttcgagaccagcctggccaacatggtaaaaccccgtctctactaaaaatacaaaaattagccgggcctggtggtgagtgcctgtaatcccagctacttgggaggcttaggcaggaaaaatgcttgaaaccgaaagtcagaggttgcagtgagccaaggttgcgccaccacaccccagcctgggcaaaagagcgaaactccatctcaaaaaaaaaaaaaaaaaattaatatatttttgtgtctttatctgggcagttgggtccatttttctgtaaacttatgaggaaccagtctccttaccacagaaaagcttctatatagaaaacattttgttggccaggtgcagtggctcacacccgtaatcccagcaatttgggaggccaaggtgg

SEQ ID NO: 102643 - DNA, 997 bp, Homo sapiens
tctgcttgttgataagtacttcagacattcccccagtggctgaagtggcatatgaattatgaagttggatcatttggaatgaatgtaagagaattgccaagggctcctcctactccagagaggaaacctcatccagggccatgaagccacttcctcaccatctgtgtgctgcttaagctaatgctgcgggaaccatggttccttgggaggaatcaagctgactcttggcatgagattcctgccttcctagggttgagagcggcactgccatggcttctctggacgacccaggggaagtgagggagggcttcctctgccctctgtgcctgaaggatctgcagtctttctatcagcttcactcacattacgaggaagaacactcaggggaagaccgtgatgtcaaagggcaaattaaaagtcttgtccagaaggctaaaaaagcaaaggacaggttgttgaaacgagaaggggatgatcgagcagagtcagggaaccaagggatatgagtctttcagctatggaggggttgatccttacatgtgggaacccccaggagcttggtgctgtgagaaggcatctttccgacttcaaaaaacaccgagctgctagaatgaccaactatagtgggaagtcactacaactaactaatcaggtagagaagctcactgcatcgaccgacacaaatactgagtctgagagattcgagcacagaaacgtcgggtgctggtcaacgaccacgatgtcattcgccaatggggataagtcagatccggaccgcgcacactgcgccctgcaggccaaaagtgcacgaagtatgggctacaagacatacaggagcagccacatgctctgagtctgtaccaaccagcccagagcccaatcggcaagcgccagcaacagacaatccgccgaaagaacagacatgacagacacacaaaccatgaccaagccaaaggaggacacagacgctcacggtcaccgcagacacacagagcga

SEQ ID NO: 102644 - DNA, 322 bp, Homo sapiens
cttttagaacagtgccttgcttagtatgttactttgctgaggctgccataacaaaatgccacagaacaggtggcttaaacaacagaagcgtattttctcacagttttagagcatggaaatccaagatcaaggtgtctggctattcttacatggacctttctgtgagcacacacactcctggtttgctgtcttcttcatgtgaggacaatagtcttacagaattaggccccactcttatgtcctcatttaatcttttttttttctttcttttttttttttttttttttgagacagagtctcgctctgtcgcccaggctggagt

SEQ ID NO: 102645 - DNA, 379 bp, Homo sapiens
tagcattatgtctgagaaaacaatatccatgtcttaatttaaaaatattttattgctaaaaaatgcagacacagaaacacaaagtgagcacgcgcatttggacaaatgataccaatagacttgtgtgacatagggttgccacaagccttccagtttgtaaaaaacacgattatctgcaaagttcaataaagccaaacgcaataaaatgaggtgtgcctctacataaatctttgcacaagtgtgtgagtatatctgtaagtaaattctctaagactggaattattatgtcaaagggtatatgcattttaaatattcacagatttctctccaccagaattcatgcagaaaacttaaaaattaaggtagttaaataattgat

SEQ ID NO: 102646 - DNA, 120 bp, Homo sapiens
catagctcctttgacaaatgatttttatgttggaaaatgcaagaaaaataagtagctcagattgactttggaaatgtaatattattcttaattcacaggcttgttggcaacttgagaatt

SEQ ID NO: 102647 - DNA, 534 bp, Homo sapiens
gtattataggatgtttagcagcatacctggcctctacccactaaatgtcagtaacattcctccccacacagttgtgaccatcaaaaatgtccccagacattgccatatatcttctgggaggcgaaatcgccactgttgaaagccactggcatatgccatgtagccagcactcagctcaagatacaggttatttccacatggaggggttggcgtttgagctgacacccaacagctaagaagctgcctccaattcagagaactggggaaggaatgttccaaggggagagagcataggcaaaggccctgaggtgggaatgagcgtggcacatttgaggaagtgtggctggtccgtggtgacaagggaaaggcatctgaggaggttgaagagacaggctgggccctattgagcaggggctttgtgggatacggttaggagtctgacatttcaaagaacgtttgtgagtatgtaatatgtacctggcactatgccagacactggagagttgaagatgaataaattaaatccttggccct

SEQ ID NO: 102648 - DNA, 454 bp, Homo sapiens
aaaggaggactgcagggtagagaagcaagcacagtgggcgcctctttaggaagtgacacttacagcctgcatgtgcagtatggctgtgaaggggcagatatcatagcacacctaactcaacaggatcttacttgaactgctgtgagttggtcaagtcagggcacttctgctcttcaggctcctctaggtcacacctttgaccaccctacatctgtttcctctttcaggctccagtagtagtcttaaaagtgaagtttatctaaggataagcacatgcctatcttgctcactgctgtgtccccactttttagcacagcgcctgctgcttacaggtactcaaatatctgctggacttaattacttataattaagctcttatttcagtcatggacaaatccttgggtttgactcctaaactcttttaagggtacccaatggaggaacgtggtttgtt

SEQ ID NO: 102649 - DNA, 4115 bp, Homo sapiens
atgggcgagaggaaatgctggctctctacgtcaaggagaacaaggtgggtcccggaagagctgcaggacaaggagttcgccgcggtgctgcaggacgagccactgcagcccctggctctggagccgctgactgaggaggaacaggccgcggccgtggtgacagctgcttttaccaaagaagcatcgaagaaggcgatggggcctttggacgaagcccccgggaaatccagcgcagccagagctgggatgacagcacgatgtggctttgaggagggaggggctggcccaaggaaggagcacgcccgctcagacagcgagaactggcgctccctacgggaggaacaggaggaggaggaggagggcagctggaggctcggagcagggccccggcgagacggcgaccgctggcgctccgccagccctgatggtggtccccgctctgctggctggcgggaacatggggaacggcggcgcaagtttgaatttgatttgcgaggggatcgaggagggtgtggtgaagaggaggggcggggagggggaggcagctctcacctgcggcggtgccgagcgcctgaaggctttgaggaggacaaggatgggctcccagagtggtgcctggacgatgaggatgaagaaatgggcacctttgatgcctctggggccttcttgcctctcaagctgttctctgctccccaccccggccccatgcagaagggccccaaggagcccattcctgaggagcaggagctggacttccaagggttggaggaggaggaggaaccttccgaagggctagaggaggaagggcctgaggcagatgatattcgggggatccagctgagtcccggggtgggctcctctgctggcccacccggagatctggaggatgatgaaggcttgaagcacctgcagcagggcatccaggaggcggagaagctggtggcctccctgcaggacagctccttggaggaggagcagttcacggctgccatgcagacccagggcctgcgccactctgcagccgccactgccctcccgctcagccatggggctgcccggaagtggttctacaaggacccacagggcgagatccaaggccccttcacgacacaggagatggcagagtggttccaggccggctacttttccatgtcactgctggtgaagcggggctgcgatgagggcttccagccgctgggcgaggtgatcaagatgtggggccgcgtgccctttgccccagggccctcacctcccccactgctgggaaacatggaccaggagcggctgaagaagcaacaggagctggccgcggcggccttgtaccagcagctgcagcaccagcagtttctccagctggtcagcagccgccagctcccgcagtgcgcgctccgagaaaaggcagctctgggggacctgacaccgccaccaccgccgccgccacagcagcagcagcagcagctcacggcattcctgcagcagctccaggcgctcaaaccccccagttccaggagcgcagagaagtggagctcagggcgaagcgggaggaagaggaacgcaagcgtcgagaggagaagcgccgccagcagcagcaggaggagcagaagcggcggcaggaggaggaagagctgtttcggcgcaagcacgtgggggctgtccatgaagacgctcctggagttgcagctggagggcgagcggcagctgcacaaacagcccccacctcgggagccagctcgggcccaggcccccaaccaccgagtgcagcttgggggcctgggcactgcccccctgaaccagtgggtgtctgaggctgggccactgtggggcgggccagacaagagtgggggcggcagcagcggcctggggctctgggaggacacccccaagagcggcgggagcctggtccgtggcctcggcctgaagaacagccggagcagcccatctctcagtgactcatacagccacctatcgggtcggcccattcgcaaaaagacggaggaagaagagaagctgctgaagctgctgcagggcattcccaggccccaggacggcttcacccagtggtgcgagcagatgctgcacacgctgagcgccacgggcagcctggacgtgcccatggctgtagcgatcctcaaggaggtggaatccccctatgatgtccacgattatatccgttcctgcctgggggacacgctggaagccaaagaatttgccaaacaattcctggagcggagggccaagcagaaagccagccagcagcggcagcagcagcaggaggcatggctgagcagcgcctcgctgcagacggccttccaggccaaccacagcaccaaactcggccccggggagggcagcaaggccaagaggcgggcactgatgctgcactcagaccccagcatcctggggtactccctgcacggatcttctggtgagatcgagagcgtggatgactactgaccagcccggacccccagcccctgggctgtaggccagggcagccacagcggcgtggaccgagggtcccagcctgcaggctccccgcagagagcacaggaagaggcaggggcggggtccccagcacttgttacaaacacacgatgcaccttaactcacccaccacgaggcactttacagactgggggagggggtttttctttttattttttttttaattttaaacgactgaagaaaacattaggagaggcaaaaatattgttaaaaactagactctaaacaccccttcctgctgtgaggatagtgggtgtgacaatggaaggtccacagaggtttttgttttttggtttttttttttttttttaagaaaaaaagatgaaaaatgaaaaaaaaaatggttaggaggctgaaagaaaaaacacactgttattttggggcagtggggacacaggccccgtggacctgtcctgcctggcccccaaggccatacttaccccccagaaggcgggccatggggtaactggaagctgggggccagcagtttgcacaggaggcctgtctgagccccacccgccagacctgttgtgagcagctcctgtcactgaggctggctgaggtgtccggggtggggccaaagtagccccttggcttcgctgctttgggggacagttgcacaaattggacgagcggccccagctctctggctgccatcttgtgctggccgagtagacgggaggggccaagccgtgccaacctctctggctggcagggtggggcagcaggactctggctctggtgaggggcgtctcccactgctgccattttgggggacaccctgggtttgaacctgaaagccccagctctctgccttgccacgtgaatgtattctttgggccacaagcccccgcctcacccctgcctgagctgcctcacccctgtgagcggcgggggtggatgattgctccagaggctgcagagagaaggctgagctgtttctccagtgaagggggcaggaggaggggcctcaaaggcaaggagtgggtggctttgggcttagggttggagtagaggggctgccgcccggggccccaacctgtagccagctcgtaagatgtggaccacccagctctgcacctgacccttccgctgaccaaatgggagaggagcaggtggccttccgggtctgatatgatgcgctttttaccgttgggtaaggttggggtgaagagaagtgtgcggctcctgggtcagaggaggctgccccttctattgctcacccacttcttattcccggtcccctacttgggttcgtctccgcccattttgggttttgtaacagttttgtcttttgggtttctcatccagctcctcccattgacctcattgctcagagtgcagtattagggcaaggcttcgccactgcctccctccatgaatgtatttctccctcctgccctggggacatggggagtggcccgtttctttccccatctagtcccagaaagatggtgtttggttttctgttgttggattttttttttttttttttttttttgcaccaaagtggcaactaggtcagtgttgggggatcaagctggcctcggggtggggggcccccacctgcctctccctggttcccacagtgttagcgtccctgaaaagac

SEQ ID NO: 102650 - DNA, 3629 bp, Homo sapiens
atgggcgagaggaaatgctggctctctacgtcaaggagaacaaggtgggtcccggaagagctgcaggacaaggagttcgccgcggtgctgcaggacgagccactgcagcccctggctctggagccgctgactgaggaggaacaggccgcggccgtggtgacagctgcttttaccaaagaagcatcgaagaaggcgatggggcctttggacgaagcccccgggaaatccagcgcagccagagctgggatgacagcacgatgtggctttgaggagggaggggctggcccaaggaaggagcacgcccgctcagacagcgagaactggcgctccctacgggaggaacaggaggaggaggaggagggcagctggaggctcggagcagggccccggcgagacggcgaccgctggcgctccgccagccctgatggtggtccccgctctgctggctggcgggaacatggggaacggcggcgcaagtttgaatttgatttgcgaggggatcgaggagggtgtggtgaagaggaggggcggggagggggaggcagctctcacctgcggcggtgccgagcgcctgaaggctttgaggaggacaaggatgggctcccagagtggtgcctggacgatgaggatgaagaaatgggcacctttgatgcctctggggccttcttgcctctcaagctgttctctgctccccaccccggccccatgcagaagggccccaaggagcccattcctgaggagcaggagctggacttccaagggttggaggaggaggaggaaccttccgaagggctagaggaggaagggcctgaggcagatgatattcgggggatccagctgagtcccggggtgggctcctctgctggcccacccggagatctggaggatgatgaaggcttgaagcacctgcagcagggcatccaggaggcggagaagctggtggcctccctgcaggacagctccttggaggaggagcagttcacggctgccatgcagacccagggcctgcgccactctgcagccgccactgccctcccgctcagccatggggctgcccggaagtggttctacaaggacccacagggcgagatccaaggccccttcacgacacaggagatggcagagtggttccaggccggctacttttccatgtcactgctggtgaagcggggctgcgatgagggcttccagccgctgggcgaggtgatcaagatgtggggccgcgtgccctttgccccagggccctcacctcccccactgctgggaaacatggaccaggagcggctgaagaagcaacaggagctggccgcggcggccttgtaccagcagctgcagcaccagcagtttctccagctggtcagcagccgccagctcccgcagtgcgcgctccgagaaaaggcagctctgggggacctgacaccgccaccaccgccgccgccacagcagcagcagcagcagctcacggcattcctgcagcagctccaggcgctcaaaccccccagttccaggagcgcagagaagtggagctcagggcgaagcgggaggaagaggaacgcaagcgtcgagaggagaagcgccgccagcagcagcaggaggagcagaagcggcggcaggaggaggaagagctgtttcggcgcaagcacgtgggggctgtccatgaagacgctcctggagttgcagctggagggcgagcggcagctgcacaaacagcccccacctcgggagccagctcgggcccaggcccccaaccaccgagtgcagcttgggggcctgggcactgcccccctgaaccagtgggtgtctgaggctgggccactgtggggcgggccagacaagagtgggggcggcagcagcggcctggggctctgggaggacacccccaagagcggcgggagcctggtccgtggcctcggcctgaagaacagccggagcagcccatctctcagtgactcatacagccacctatcgggtcggcccattcgcaaaaagacggaggaagaagagaagctgctgaagctgctgcagggcattcccaggccccaggacggcttcacccagtggtgcgagcagatgctgcacacgctgagcgccacgggcagcctggacgtgcccatggctgtagcgatcctcaaggaggtggaatccccctatgatgtccacgattatatccgttcctgcctgggggacacgctggaagccaaagaatttgccaaacaattcctggagcggagggccaagcagaaagccagccagcagcggcagcagcagcaggaggcatggctgagcagcgcctcgctgcagacggccttccaggccaaccacagcaccaaactcggccccggggagggcagcaaggccaagaggcgggcactgatgctgcactcagaccccagcatcctggggtactccctgcacggatcttctggtgagatcgagagcgtggatgactactgaccagcccggacccccagcccctgggctgtaggccagggcagccacagcggcgtggaccgagggtcccagcctgcaggctccccgcagagagcacaggaagaggcaggggcggggtccccagcacttgttacaaacacacgatgcaccttaactcacccaccacgaggcactttacagactgggggagggggtttttctttttattttttttttaattttaaacgactgaagaaaacattaggagaggcaaaaatattgttaaaaactagactctaaacaccccttcctgctgtgaggatagtgggtgtgacaatggaaggtccacagaggtttttgttttttggtttttttttttttttttaagaaaaaaagatgaaaaatgaaaaaaaaaatggttaggaggctgaaagaaaaaacacactgttattttggggcagtggggacacaggccccgtggacctgtcctgcctggcccccaaggccatacttaccccccagaaggcgggccatggggtaactggaagctgggggccagcagtttgcacaggaggcctgtctgagccccacccgccagacctgttgtgagcagctcctgtcactgaggctggctgaggtgtccggggtggggccaaagtagccccttggcttcgctgctttgggggacagttgcacaaattggacgagcggccccagctctctggctgccatcttgtgctggccgagtagacgggaggggccaagccgtgccaacctctctggctggcagggtggggcagcaggactctggctctggtgaggggcgtctcccactgctgccattttgggggacaccctgggtttgaacctgaaagccccagctctctgccttgccacgtgaatgtattctttgggccacaagcccccgcctcacccctgcctgagctgcctcacccctgtgagcggcgggggtggatgattgctccagaggctgcagagagaaggctgagctgtttctccagtgaagggggcaggaggaggggcctcaaaggcaaggagtgggtggctttgggcttagggttggagtagaggggctgccgcccggggccccaacctgtagccagctcgtaagatgtggaccaccctagcacaagaacacacgagcacaagaaccagcacaagaagaatcctctagatca

SEQ ID NO: 102651 - DNA, 1731 bp, Homo sapiens
atgggcgagaggaaatgctggctctctacgtcaaggagaacaaggtgggtcccggaagagctgcaggacaaggagttcgccgcggtgctgcaggacgagccactgcagcccctggctctggagccgctgactgaggaggaacaggccgcggccgtggtgacagctgcttttaccaaagaagcatcgaagaaggcgatggggcctttggacgaagcccccgggaaatccagcgcagccagagctgggatgacagcacgatgtggctttgaggagggaggggctggcccaaggaaggagcacgcccgctcagacagcgagaactggcgctccctacgggaggaacaggaggaggaggaggagggcagctggaggctcggagcagggccccggcgagacggcgaccgctggcgctccgccagccctgatggtggtccccgctctgctggctggcgggaacatggggaacggcggcgcaagtttgaatttgatttgcgaggggatcgaggagggtgtggtgaagaggaggggcggggagggggaggcagctctcacctgcggcggtgccgagcgcctgaaggctttgaggaggacaaggatgggctcccagagtggtgcctggacgatgaggatgaagaaatgggcacctttgatgcctctggggccttcttgcctctcaagctgttctctgctccccaccccggccccatgcagaagggccccaaggagcccattcctgaggagcaggagctggacttccaagggttggaggaggaggaggaaccttccgaagggctagaggaggaagggcctgaggcagatgatattcgggggatccagctgagtcccggggtgggctcctctgctggcccacccggagatctggaggatgatgaaggcttgaagcacctgcagcagggcatccaggaggcggagaagctggtggcctccctgcaggacagctccttggaggaggagcagttcacggctgccatgcagacccagggcctgcgccactctgcagccgccactgccctcccgctcagccatggggctgcccggaagtggttctacaaggacccacagggcgagatccaaggccccttcacgacacaggagatggcagagtggttccaggccggctacttttccatgtcactgctggtgaagcggggctgcgatgagggcttccagccgctgggcgaggtgatcaagatgtggggccgcgtgccctttgccccagggccctcacctcccccactgctgggaaacatggaccaggagcggctgaagaagcaacaggagctggccgcggcggccttgtaccagcagctgcagcaccagcagtttctccagctggtcagcagccgccagctcccgcagtgcgcgctccgagaaaaggcagctctgggggacctgacaccgccaccaccgccgccgccacagcagcagcagcagcagctcacggcattcctgcagcagctccaggcgctcaaaccccccagaggcggggaccagaacctgctcccgacgatgagccggtccttgtcggtgccagattcgggccgcctctgggacgtacatacctcagcctcatcacagtcaggtggtgaggccagtctttgggacataccaattaactcttcgactcagggtccaattctagaacaactccagctgcaacataaattccggagcgcagagaagtggagctgcgtctgctgaggagggggt

SEQ ID NO: 102652 - DNA, 412 bp, Homo sapiens
atgataatgacaaagcaactacttttggaaacaaactcatgtaacaaagatggacattttgaaacatatggcggtttaaacacctctgtgatttttttcattgaaataacatgcatcactataaaaaactcttacatcttcacacttaaaaacctggaatcagaaactttaaatatgtttaaaacttatacaagtagttgcagagaatttggaactgattgttaaaagcatataaacacaacaccttctgatttgttcatatgaatatctagaagctggtgtggtggcatatgcctggagtctcagctattgagaggctgaagtgggaggactgcctgaggccaggaacttgcacctgtgactagccactacactttggcttgggcaacatagcaagaccctgtctctaaaa

SEQ ID NO: 102653 - DNA, 837 bp, Homo sapiens
gtgccaggctgaccctccagggacagctctgccacctgcaggagcactggccacagtgcatcggagcgtgcaggtggcttctgtgccatggtgtgggtggcagccccagcacggccggccccggtcggcagctcctgtttcaagggcaggttggaggctggctggccgcttgccccaccctgggcagcctgcacccagagtcgaggggtaggcagtctccatccgaagaatgcgcccctccttatcccgaaacctcagaggcctccttcctcagatgccagctgttttctcagtgcccttggccgtgccctcacccctctctcaccggaagccccaccccagcctgtcgtccccggtctcctgaaagccagcaagcctcgtcggtgccgcccacacccctgacctcacgcagccccacgtcaggctcgatcttttgtccagttgtccctgcgtcgctgccgtctccacgaggctctgaccactgacaccgtgtgtggcggggcgcaggggcagctggagggtgtgctgggggctccgtgccctggcatggctcctccacattttgccaacccagaggcacaggcgtgaggtgtgtggtggttctcagggtcagtgggtcttggccttggctttcaaggtgttgatgggccctgggactgatgtgcccgtgtgtctgagcccacgtcccctgggcgaagctcccattttcactgacctgtccagagcgttctgggtgagcctgccctgcgtgtccatggtgcggcgcgctctaatgagctgcagccgtggccactctgcaccctctgagacagtcacccatggggacggcgaacaccc

SEQ ID NO: 102654 - DNA, 242 bp, Homo sapiens
gttcatgggcagctctacatgtcttcctagagaactgtgattctcataagatgtcctagctagcagcaccttcagtttgcttgtcttactgcctcccgcgtctagaaagaaaactgaatgtctgaatgtagtaccctgctcagacaagcttcctaataaatgtttatttaatgaaaccctccaaggctctgatttatatagtgccttggcagtcaaaagcagtagtagtccaagacccatgt

SEQ ID NO: 102655 - DNA, 365 bp, Homo sapiens
agagccctggcagggcaggcgctcagggagagggtgggagccacagctctgggaggcagggccaaggtggccaagcagcactgagctctcgcccaggttggatcccccctgcaccctccccaagcttcacggcctgggtacaggaaggggtgacaagccatgcagcaggcatcatgggtcagtggacaggggacaggcagttccctccagcacggagggcacgacaaccactgcagggcaggcagagcccaccagcgcccaccaggctctagggcaaccaaactagatctgaagggaaactccacggcccttcttagaccaacccccttcgatatttcacgctgtttggtggctctgaagatgca

SEQ ID NO: 102656 - DNA, 206 bp, Homo sapiens
gggcctggagtataagctgcttctaccttgaaaactctgggaccacccaagtctctgctgccaatcctcaactcccagaagggatctgaccatcccaagcaagacgctagattttactctcttggccagaacttgccaggtcacacagtggccacagagagattcaggaaagctctgcttctctgcaaagcagcacagtgacaaat

SEQ ID NO: 102657 - DNA, 653 bp, Homo sapiens
ggaactccatacctcaggtgatccacccgcctcagcctcccaaagtgctgggattataggcttgagtcactgcgcccggccatgaaaatttcttagaacagccatttagccagtttggattagtttcatcattactttttacactgctactgaatttgccatatctaggccaaagaatgagaaccttcctctgtattcaggaatcaaaggaccagtatatgcaaagagactacgtaaaaagtggtctgaaaaattattttgtggcaaagtaatagagatatgagatcactggatactgtttcaaagacagtattacaaaaacagctttatgtgaggtgcatgttctaaagaactattaaaactattccatacatcaggtaatcaaaagttgaattttgagggatgtgatgatctttaaaaaattgaaattctcaagatacatgatctttacatgtacatgatctttacatgtagtaggttatgttttcctatttattctgttaacctcatgaaaatccagttcaattgtaaatactaaagttattgactacttttggcagctgttttgatgggaggtataacctttgagattaaaagttgacaatgaagaagggtgcaatttaagctccaatatgtagtgaacacaaatagaa

SEQ ID NO: 102658 - DNA, 410 bp, Homo sapiens
caaggaagatttccggtgtatttaatatggatggtagtgcatttctcaaatatagtactgtgtacataagatctgctgtttgttggaaaagctaaataaccgaaaatgtaaatgacaaagcctgggaatatggcagggtcaaacagagcaaggatgaagaagatttaagtatgcagcgtgtcctaagcaaaacacaaagcatgaaaactgagcacagccacctgcaaggcaccttcagcaagcccgacggttaacagggtcagtttctccacaagtggacagagggggttatgcagcagccaactcttcctgatggcaatttgtgacccaatttcatccagtgtttcatgaccaacccccctgaatgtttatgaagcaggaaagaagctcagaatccaggcgaggcctcc

SEQ ID NO: 102659 - DNA, 350 bp, Homo sapiens
gagagggtcttgctctgtcatccaggctgaagtaaagtggcacaactcagctcattgcagcctgaacctcccaatctcaagcaatcctcccacctcagcctactgagtagctgggtctacagacgtttgccaccatgcctgactaatttgtttttattttttgtagagaaggtgtttcgccatgttgcccaggctggtctcaaattcctgggccaagcaattcacctgcctcagcctcccaaagtgttgggattaaggcatgagccaccactaagagcctctgttctttaagtgagagctacacagagtaatttccttctaaagagtacaggatggaaaaaaataagttt

SEQ ID NO: 102660 - DNA, 494 bp, Homo sapiens
ggaaaacaaaaatgcctgtcctcacctagatccgtgggcacaggctgggggtggagccctcaccagggacccgccccttcccagcacttccctactccccttctatgtcactgtgggcaaacaaattctgaagtgtagtaagggtcatatttggtagcagatagtgttttgtgttgccatgtaagcttctcagttggtggatcataggcaggaaggtatgtgctgtgctgtttgagttaaacattctggaggtgggagatgagcagacatgtttcagagagcagagtttctgtggctcagctgagctaatagcatcaacatcaaaagattaaagcaagtgcaaacttaaattgctgggactagggtccatgcagggtttttatttgcacagagctgtgcatataccagagtccctatctttgctgtttatgaatactttgtacttttttaaaggataagtcagtccatgacaaagttaccttattagtaaaaac

SEQ ID NO: 102661 - DNA, 124 bp, Homo sapiens
tcctgggattacaggcatgagccaccatgcccggccaggttaaggtttttaagacaacccttaacaagtctgtttaattcttcctaggcccagggaatgtaatttgggtttgcacagtctagta

SEQ ID NO: 102662 - DNA, 311 bp, Homo sapiens
taggtgtgagtcatttcacctggcctgatttcacattttaaaacctgccacagaatggatgtccaaactgtcgtagaaaaaccagagtttctgtagctgcactgtctggtagggtagccagtggttatgtgtgactgtcaagcccctgaaacctggcgagtccaaactgaggcgtgctattggtgtaaatacacgatgggtttcaaaaacttagtaccaaagagtggaaaatgcctcactaataatttttatattgattacatgttgaaatgatattttggatatattgacataaataaaatattaaaatt

SEQ ID NO: 102663 - DNA, 346 bp, Homo sapiens
taaaactatataactaagttttatacatgtggctttgaaagtaaaataaatttgggcctggcgcaccggctcaagccagtaatcccagcactttgggaggctgaggcgggtggatcgcctaagctcaggagtttgacaccagcctgggcaacacggtgaaactctatctctactaaaaatacaaaaaatcatccgggcgttgcggtgtgtgcctgtagtcccagctactcaggaggctgaggcaggagaatcacttgaacccgggaggcagatgttgcagtgagccaagatcgcaccacttcactcactgcagcctgggcgacagtgagactccagctaaaaaaaa

SEQ ID NO: 102664 - DNA, 475 bp, Homo sapiens
aaggaatataaaggtaatcctttaatcttataaaggtatataaaggtttttgttttgttttgtttttttatactggttattaaatctagattcaccagtgttcttttaaacctgcgtgcttcatttgctgacatttcctctctgaggtcaggaacacaatatagtcatctcagatccgtacttgcccctctcaaatttgatctgtgcttcttcagtgacttgcaagataccaggcattaactcatgcctgatatctacaatgaaccttccaggggcctgggattatagagaagagcaagggacgtccactgctgccccccggtgcgcatgtctaagggaagaacagacctgtaacttcagtacaaggtgtgtgtgactcacgaagcattaacaggcatgtcaaaactggagcagttaattccgacctgaggggcttcaaagggaaggttttatggggaggaagtagcctttgaac

SEQ ID NO: 102665 - DNA, 271 bp, Homo sapiens
tgagatggagtttctctcttgttgcccaggctggagtgcaatggtgcaatctgggctcactgtgacctccaccttctgggttcaagagattctgcaaattgctgggattacaggtgtgagccactataccctgccagaaaattattttctaataccaccgggaaaccaaacaaattccagagaagaaatctttctcctattttcctaccaccagtataaccaatatgaatatctacttttactcaacttaaatttggtttccatgcaattt

SEQ ID NO: 102666 - DNA, 1144 bp, Homo sapiens
ccgccgtagaggggttggcagtggcggtcagcatgggcgatgggggcgccgagcgcgaccggggccccgcgcgccgggcggagtctggtggcggcggtgggcgctgcggagaccgcagcggagcgggggacttgcgagctgatggcggtggccacagcccaacggaggtggccgggacctcagcctccagtcccgcaggctccagggagagtggagccgacagcgacgggcagcccgggcccggcgaggcagaccactgccgccgcatactggtgcgagatgccaaagggacaattcgggaaattgtcctgcctaagggcctggacctggaccggcccaagcggacacgtacatccttcactgccgagcagctgtaccgcctggagatggagttccagcgctgccagtatgtggtgggccgcgagcgcactgagctggcccgccagctgaacctctccgagacccaggtgaaggtctggttccagaaccgccgcaccaagcagaagaaagaccagagcagagacctggagaagcgggcgtcctcctcagcctccgaggcctttgccacctccaacattctgcggctgctggagcagggccggctgctctctgtgcccagggcccctagcctcctggcgctgacccctagcctgccaggcctacctgccagccacaggggcacctccttaggtgaccccaggaactcctccccacgcctcaacccgctgtcctcggcctcagcgtcccccccactgccgccccctctgccagctgtctgcttttcctcggccccgctcctggatctgcctgccggctacgaactgggttcctcggccttcgagccatacagctggctagaacggaaagtgggcagcgccagcagctgcaagaaagctaacacttaagactcccaccctgtgacactgagtcccgagcacagcaccttcccagtctcctgtgccccagcggacagcactgagcaggccccggagaggaggggctgcagccacacactcttccccacctgccccccagctcagagactcgtgaccaaatggccttggtcccgcagcttgtgtgcgtgagtgcagtgtgagtgtgtgtgtctctcactgaaataaaaggaaaacaatgacaagaaggg

SEQ ID NO: 102667 - DNA, 1207 bp, Homo sapiens
ccgccgtagaggggttggcagtggcggtcagcatgggcgatgggggcgccgagcgcgaccggggccccgcgcgccgggcggagtctggtggcggcggtgggcgctgcggagaccgcagcggagcgggggacttgcgagctgatggcggtggccacagcccaacggaggtggccgggacctcagcctccagtcccgcaggctccagggagagtggagccgacagcgacgggcagcccgggcccggcgaggcagaccactgccgccgcatactggtgcgagatgccaaagggacaattcgggaaattgtcctgcctaagggcctggacctggaccggcccaagcggacacgtacatccttcactgccgagcagctgtaccgcctggagatggagttccagcgctgccagtatgtggtgggccgcgagcgcactgagctggcccgccagctgaacctctccgagacccagaaccagccccagtcctgaaactacctagagatccaccctgaatcacctcattagcatacaacagtgaaggtctggttccagaaccgccgcaccaagcagaagaaagaccagagcagagacctggagaagcgggcgtcctcctcagcctccgaggcctttgccacctccaacattctgcggctgctggagcagggccggctgctctctgtgcccagggcccctagcctcctggcgctgacccctagcctgccaggcctacctgccagccacaggggcacctccttaggtgaccccaggaactcctccccacgcctcaacccgctgtcctcggcctcagcgtcccccccactgccgccccctctgccagctgtctgcttttcctcggccccgctcctggatctgcctgccggctacgaactgggttcctcggccttcgagccatacagctggctagaacggaaagtgggcagcgccagcagctgcaagaaagctaacacttaagactcccaccctgtgacactgagtcccgagcacagcaccttcccagtctcctgtgccccagcggacagcactgagcaggccccggagaggaggggctgcagccacacactcttccccacctgccccccagctcagagactcgtgaccaaatggccttggtcccgcagcttgtgtgcgtgagtgcagtgtgagtgtgtgtgtctctcactgaaataaaaggaaaacaatgacaagaaggg

SEQ ID NO: 102668 - DNA, 1505 bp, Homo sapiens
gcggaaggaccgctagagccttggagttcgaagccagcctgatctttacaaaagtaaaataactaaccgtgcctggcgtctcatagcctgtagtcctagctactcgggaggctgagaccagaaggatcacttgagcccaggagttcgaggctgcaatgagctatgattgcaccactgcagtccagcttgtgtgacagagcaagagtgtttcaaatgaacctagtgtcagatatttactttctgtattacagaggactgaaagctagctaaataatacttttcagtgtacctgggttccagagataaaattggtaaactaacctttgctccttacttgggcttttagtttatacttcataagaccatggaagcaaaatttaggtatctgacccttctgcacaatttaggaccccgtgtgtgtttggcctacctattcgagttcaattgaatctttctgagcatctatggtgtgccaggcactctcctaaatgggaatacaatattaatccagatacataaagtctctatccaaaaggagcttcaagttggcttgggcaaagaatacatgtcataatggactgtttatataaatgatgggaaagggttggggttagggtgtgagattactttagaacgtgttatttaaaaacagtatgaatgaaggacattgtaagtcaggttttttattatatcatggtcatatactcctgttcctgtcagtttttcctgcttcctttctttcaccaagatcactcctttccttctcagatcaccaagtcctcctagctatagagagggccttctattcctctccacctaaacttatataagctactgttttcctcatacagacatgttaatgaaaatgaatttctacaggatctccagtccattgaaatacattaatttttgagtctcttcacacatttttatttcctagatttaagtcttgattgcaatcacatacaactagtatttcttggaataaaacagcaatcacaaaaatcataaatatcacattgtttaaaaaaatttattatttgatgttgaggactccatcctgatttcaatgaattaattcatttgttcccttttaaaatgtcatctgtgttatttatgtgtataaattttcaataattgtttctcaatatagagtaaatgatacagctccatagaaggcctgtaagatttttgaaattaaaataagtttttaaataaaatatgctgttatgatcattgaagttgataataaaattattccattgattctgtttctcccaagaaccaccatttaatcatgaaagctagctaagtaatatttttcagagttcgtgagttccagaagtaaaattctttaagctaaacagcttgtaaagtaacttttgctttataattattataattttgggtgttatttatgcaaactcaaatcaatgtactcataatcaaaacattgacatgcaaacttatgtattaagcaaaataaaatatacaagtgtgatata

SEQ ID NO: 102669 - DNA, 398 bp, Homo sapiens
cttttcttccctctctctgccgaggcagaagcacctcatctctctgaatggaattttgtccttactaatcttttccgtggattgtaccactccaatttttgtgtgtacaacctgcaacattgccctgtactattaaatgttaacgtgttgttgttctctgcttccttagtagtagtcatccctgtttagtaagctcatttattttacagatttttactgacttcataggatagtgccagggactttaccaagtgctggggaaacatgagtaagacagcacttagccttgatgaacttacagttggtgggaggtggtaggaatgacagtatttccagtgcggttttggtaatgatggaaaaggaggtgttgtagagacaatggtgaggagagagccttc

SEQ ID NO: 102670 - DNA, 446 bp, Homo sapiens
gcactttgggaggctaaggcaggcatatcacctgaggtcgggagtttgagacgagcctggcccacgtctactaaaaatacaaaaattagccaggtctggtggcatacgcctgtagtcccagctacttggagtctgaggcaacagaattgcttgaacctgggaggtggaggtttcagtgagccgagatcccaccattgctctccagcctgggcaacaaaagcgaaactacatctcaaaaaaaaaaaaaaaaaaagaaagaaagaaaatttaatggattatggagctctacttcacattagtacacctcggtctctctgtttttctgtctcaattcaagatagagttctttgtagcggtatggtttagaggtggtatgtattttacaagtatgtcagttggctctgtatatcctgatgataccgaagccaggaccagacccctacgtc

SEQ ID NO: 102671 - DNA, 181 bp, Homo sapiens
aggcttctgtttcttctgaatgcaacagaggagaaatgttttaaggtatgcagaataggagtctgagaaatgagggaaaagcaaacctgagggacaagtaagtggcttagagaacgaagtgaaacattttattttgggcctcacatctgaaaactgaagcttgatattccaactaggctta

SEQ ID NO: 102672 - DNA, 186 bp, Homo sapiens
cccaagtcgtttctgaaaggcaagacgttagactaaaaccaacttctatacttaagattatccttgaaatagttacgaatatgttcaggaaacaaagccttgctcattatgtgctagaacaatgggtaaactttgctttcttgtagagaagaaaatgttttcttcaataagatatcggaaactatt

SEQ ID NO: 102673 - DNA, 235 bp, Homo sapiens
ggactgtgctgaggattgaatgagaatacattcaggccacggaacacagtgtgtatatattacacatgctccaaaaaggctagctgctactatgaagttggataaattgactcaggaaagggcagaatgaacttgatattgtgactgtacatttcagagaggccccaaagagcaaatattcagatcacagcattcactcccggaataagcatattcgaaaaccctttctttgtca

SEQ ID NO: 102674 - DNA, 602 bp, Homo sapiens
atttaacttagggtcccttcctcccttgtctgccctgaatactgtggggaaaattactcctgccttcctacgagcgcttgaacttgtgcatgcatgtaccattgcactgttgtaattgtagtgtaattgctttgcttgtctgtctgacctccctttagaatgtgagtgtcctgaggatgaggattctgtcccatgtctttgcagcctgaataattttaacaaaggcctgacacattgtagttatctaacagcagttcattaaatgaataaagtattattgaaatattaatcttgtatagggaccacaagatgcaaactcaaatgccctcaagggccacgtacatacacagacctaagtagttaccatttctggcacccttcattcctatgtacacatccctttccacttgaaggacttttaaaaagcacctgtggcagtacagttcagattttgtgtgtctgaaaaagtctttgtttcgtcttcatttttgaaagatatttttgcctagtattgaactctaggttgacaatatttttcttttgctattttactttcgagaaagctgttgtgatccttgcatttgttcctctgtatgtaatat

SEQ ID NO: 102675 - DNA, 574 bp, Homo sapiens
ggaatgagatggtgtttgtccagcccaggaagcggtgcccaggcccctgccttccagcgagctctttgcagcaccagctccagcgccatcgcctcggttctggcctgtgtgccccgtggcttacgccacttccagctgtaggcgaacagtggtcgaactttgggattggaaatttccagatggaaggagcagtccacgccttcattccctgcttcagtcccctctctggctgtccaccttggctttagctccttcctgaattgggacctctggaggtggcctgttcttccagagagccatttaaagctgcactgcctggttgagtagcccctggctacaggcaacacataaaacaagaattgcccaaacccacgagagcataggcgcaataatgccattgtagatttcaaaggcttaagacggaaacagtgtgaaacattcattcatttttcatactggttgtacgttgaaaatgataacatttttgatgggttaaatcaaatgtgttattaaaattaatttcagccaggtgcagtggcttatgtctgtaatcccagcactttgggaggccaag

SEQ ID NO: 102676 - DNA, 141 bp, Homo sapiens
actccccttgcagatatggcaagaacatataagtctgcacaggccagtagggctaaagaagaagtttcaggatgtttctgggaagaatttcttctctaatgaagagagaagcacttaggatgcctcattgtcacatagctg

SEQ ID NO: 102677 - DNA, 424 bp, Homo sapiens
gcgctcgcctgcatgcgttttggcaaatatctaaacccgcaaaaccatcactagctctggtttcccaagatccttgaagcccctccgttcagcattccacgcccctctctgccctgctttcaaaccaccgccaatctgctttctgttatatatacagattagtttggattttctaacagttgtatataaatgcagtgacacatttgagtgtactcttttgtgatctggtttattttactcagcataattattttgagattatccattttgttgcatatgtaagtagctcattccttctattgctgagtggtgttccatctcatggatgcaccaccattgtttatcacgcatctgtccatggacatgtaaactgttttctatttgcggctgttaaaaataaacttctgtgaacattcgtgtacaa

SEQ ID NO: 102678 - DNA, 446 bp, Homo sapiens
tcttgtatggcttctgcactccatgggctctggcatccactggactgtcccgcatgctaatttttgaagtcttacactgttgctatccagcaagcagccaacaattatgctatttttctgtatttaacttgcataaacaactatactagaattgtgacactgagtcttgtaattctttctttgtaaaaataaggatttattaatacttctcaaagtgaatgaagaagtataaaaatatactgtcctaggctgggcgtggtggctcataactgtaattccagcattttgggaggccaaggtgggtgaggtcaagagtttgagaccagactggccaacgtggtgaaaccccgtttctactaaaatagaaaaatcagccgggcgtggtggcggacacctttaatcctagctactcgggaggctgaggaacaagaatcgcttgaaccctg

SEQ ID NO: 102679 - DNA, 352 bp, Homo sapiens
agagaaaaaggaacttgaaggaaacagagacaatatcaccagtatgctcagagatataaaagacaggctgggtgtggtggctcacacttggaatcccgacactttggaaggccgagaaaggaggatttcttgagcccaggagcttaagaccagcatggacaacacagtaacacccctgtctttacaaaaaatacaaaaattagcctggcatggtagcttgtgcctgtagtcctaactacttgggaggctgaggtgggaagattgcctgagcccaaggggttaaagttgcagtgagccgagatcatgccactgcactccagcctgggacagagtaagaccctgtcacacacac

SEQ ID NO: 102680 - DNA, 310 bp, Homo sapiens
tggagtgttgcccaagagacagttacagaatgagaagaaatgacatttcagcatcaagccttgaaatactcagaccttttagaaagttgcatgaatcaagaaagataaggtatatgaatatcttttataaaccgtaaagcattataaaaatattagttactttaaaagatgaaagggcatggaaattaatatttctctgacattaaaagctatagatcaaactcaacaaggccatcagttgtacagaactcaggaggagtttaatccatatcaaagctccaaaagtccaggagaacagattgaatttgct

SEQ ID NO: 102681 - DNA, 517 bp, Homo sapiens
tcacgagaccattgttttgaaaagccgttctgagagaccgtttgctggtgttagacctaggaatatactattgatttaaaacttatcggttgataggggtttcacatgaaactgtcaaacttttatgaccaggatgattccaagagctttgctgttttgacacattttaccttaggtttgctctggctcgtttttgaatcccttgccacatcttctcacattggtccagaaatgtctggatcttaattgatagttttgattgcaacacaaacggattctgttgaggtgttggtcatttctgcacaacaagataaatcattattttgcttttctaaaaacccaactcttacttgcaatagtaagttaacatggctttttcctttcatgggttcttggccattggttaacattaccttaattagattggtctttttgttttgctactggcagggtcagttaggtaagattgttttgatttactgcaccatcagtccaattacaaagctcatgttatagg

SEQ ID NO: 102682 - DNA, 817 bp, Homo sapiens
cattggcaaaacaggagtgccaaggtatctagctggagttcagcgcaaggcagtcagaactggccaaagatgtcttcagaagggaagtcttttgtaattcccatgctttctttgtttacatgcctactttagagcttaagaagaaattacaataaatgggcctttgtgaattttctgtaagttaactcttgttaggagtaagccaagccaaaaccttttgaattaaacaatttttggtattctttctcttgagggtaaaaactcatgactcagctagctttatttaatctccatagttaaggaggctatacatattgaaaggtatgtttttaatatgaaataattattttatggcagctttcactttgcagtgtgactttttctgatttgctcctggtagtagcccatgagttaggcaggtgtatcatttccttttaaatgtaagggaattaatatgcaaagagtttaatggatttgccaaaggctacacagcttgaacttaagaccccggagattaaattctgcacaaaatcaactatgccttagctgtctcttacctatttatacatgttactggaattgttagtacacaccatgtgataatctagaacttcctccccattttctctgtaacccaagttaaagagaaatggagtagtactctttcaaaggtgtatgtttttgatggtaggggaaagctgtaacgagggtgagctggggaaggattaaatgatactacattttttttgctgatcaataaggtgggttgaaaaaatgatactacattttgaagaaatgttttttagttttttgtaaa

SEQ ID NO: 102683 - DNA, 673 bp, Homo sapiens
gagaaaaccctaagtgacttacctcttggatctcatatgctgttccttcccttactcatactgctccagggtactgggcttggctgcccctcgaacacttgctgtatgcttgtcctcagggcccttgcataggatgttatcccttgctttgaaagctctgtctacagatccatgtggcttgcactgtctccttcaggtctttgctcagacttcaccttcttggaatgggctttcatcctttatccctgagaggtctcagaaaataaaaaataaaatggcaaccccttcccttccactgttggcctccctatctccctttcctgctttatttttatctatagcacatacctgctgacatagctgtgtattttgctttttatttgtttattatctcttcacactagaatataaatttcctaagcacaggaatttgaggctcttttatttactgttaaatcctcaggatccaggatgaccagctcatggtagtcactcaataaatctttgttgaataaatgaatgaacatgttgtctttcacctccagagagagtaaaaagaaaattcaattgcaggtagacttctcagtggtactgggatgggttaacctgggtaccattccatcttcattagcattttgaaagatgaattttctttcttgatataggctggaga

SEQ ID NO: 102684 - DNA, 423 bp, Homo sapiens
tttttttttttctgagacagggtctcactctgttgcccaggctggggtgcagtggtgtgatcacagctcactgcagactcaacctccctggctcaagtgatcctcccacctcagcctctcgagtaggtgggactgcaagcctgcgccatcacatcctgctaattttgtattttttgtagagatggggtttcaccacattgcccaggctggtctcaaactaccagactcaagctgtcctcccacctcagcctcccaaaatgctgggattacagctgtaagccaccatgcccagctgcccttgttattaatttcatccttctatgtcttaaaatattcaaaagcaaggtaagtgagtggcaagtaaaagtagtacttttattttaaagactgcaatgtaatgtaacagatggcattttcctgact

SEQ ID NO: 102685 - DNA, 604 bp, Homo sapiens
atttgtggttattgaggtttcaataatagtaatggaagcagacctcattagtccctttaacaactggcgtaaaagagttttggaacaagcagaagtgacccttggtaagcagactgctcagctggtaggggcaaaagtgttgggggaggattagaaaaaggcctccacattgtgggctttccgggtgccctggatgtgggtcagcaaatgttttagaggaagtagttaacctggagggagattcaaaggaggctggataagagaatgtctatttttctccttccctatcaccttacatgtacctattctccccaaagagaaggaagaccttaggctttcaatgtggtgttctttcttaagtttaagtaactggctgccaatgaaaaccttcccttcgagccgcaggcatgtggacagaatccaccaccctccttagacactcctcagactactacaggctatccccagctggtggctctcaaattcatgagggtccagaagttgttcctctggattcaggttgttaaagggactaatgaggtctgcttccattactattattgaaacctcaataaccacaaataaaagaacaaaaagtttgaga

SEQ ID NO: 102686 - DNA, 784 bp, Homo sapiens
gtatttttattagagactaggtttcactatgttgcccagaatggtcttgaactcctgacctcgtgatccactcgccttggcctcccaaagtgctgggattacagacatgagccactgtgcctggctgccaaacttttgatgtgggtccaagctgtgcttttttgtgacctatatgttttgtctggtgggagttctacacttaagttttcttggtttgcactttaatcataacaataagaacaactggcgtaaaagagttttggaacaagcagaagtgacccttggtaagcagactgctcagctggtaggggcaaaagtgttgggggaggattagaaaaaggcctccacattgtgggctttccgggtgccctggatgtgggtcagcaaatgttttagaggaagtagttaacctggagggagattcaaaggaggctggataagagaatgtctatttttctccttccctatcaccttacatgtacctattctccccaaagagaaggaagaccttaggctttcaatgtggtgttctttcttaagtttaagtaactggctgccaatgaaaaccttcccttcgagccgcaggcatgtggacagaatccaccaccctccttagacactcctcagactactacaggctatccccagctggtggctctcaaattcatgagggtccagaagttgttcctctggattcaggttgttaaagggactaatgaggtctgcttccattactattattgaaacctcaataaccacaaataaaagaacaaaaagtttgaga

SEQ ID NO: 102687 - DNA, 429 bp, Homo sapiens
tcaatgcagcagctcagcagcatacccaagacccagggtcgttccgtctgtctgctccaccagcctcggtatcttggcttccatcttcacttttccccgcatggttacagagtggctgctaaagctccaggcattaccgtcctacatagcatgtccaaaaacaggaaggatgcttgctcctcatgtaacaccttctattagcaacaaaagcctttcccaaagctccgagcagacttcccctcaaatctcattggcaggaaccaggtcacatgcccacagcccaccctaacacccatggcaaaggggaatggaattgggtaattgatagggcctctcttcactgagcacattgatcctgacacctgagaaacggagggctctgctggcaagacaaagaggcgggggtaggaggcaggcagtgtctgcaca

SEQ ID NO: 102688 - DNA, 188 bp, Homo sapiens
ggcactgacaggacttgacacattctaatctcctgagggccgctaacaacatagatgacagtctggacaacacaaagggtcaacaggtgctccgagtgtccggcagggctaattgttccctgactgtggtggaataagcttggaggagatgccttcacttactctactgagaggcagagaaaggttag

SEQ ID NO: 102689 - DNA, 741 bp, Homo sapiens
acttgctggtattcccccggtatcagcagaggtgtgtacgggcactgctttaaaactgggaaggaggaagacgaggccaggagccggagggtcaccaaggtagatttccagcagcgctagtccagctgaacactttccagccttgtttttcagcagctttgaggaaaagtatagtgatccgtatgtgaaactttcatgtacgtagcggatgagaatagagaacttgcttggtccagacaaaaacaattaaaaagacactgaacccaaaatggaatgaagaattttatttcagggtaaacccatctaatcacagactcctatttgaagtatttgacgaaaatagactgacacgagacgacttcctgggccaggtggacgtgccccttagtcaccttccgacagaagaatccaaccatgggaaggggaccttttaacttttagggctcttctctctctcgagaccaagagtgtcataagtctcgagttaagggatttttgcgattgaaaatggcctatatgccaaaaaatggaggtcaagatgaagaaaacagtgaccagagggatgacatggagcatggatgggaagttgttgactcaaatgactcggcttctcagcaccaagaggaacttcctcctcctcctctgcctcccgggtgggaagaaaaagtggacaatttaggccgaacttactatgtcaaccacaacaaccggaccactcagtggcacagaccaagcctgatg

SEQ ID NO: 102690 - DNA, 436 bp, Homo sapiens
ggagtcaaaagttgcagtgagccaagattgcgctactgagctccatccagcctgggtttccagtgaaaccctgtctccaaaataaataaattaattaattaaatgcactttacaatctagataacttttacattgtaaacctcaaaactaaacaacaacaacaaaaaattatagaactttggaactgcaccagtaaagagcataaaaagatgacctcgggattctagcaccttacacttaacttcatggcagtcggcatctttctctttgacaatattttgttacactttcagcgtgtaacacttttagctgtggaaagtgatattgataatcatccagtttctttctgtgggacttagtcattcgcatactagaggccccataattatgttaattcccatgcatactcctccctgggtgttctttgggacctatg

SEQ ID NO: 102691 - DNA, 233 bp, Homo sapiens
ctacctcggcctcccaaatttctggtatcacaggcatgagccaccacacccagccctgattgtggagttatgataccattctctgcataaaattttcataacactaacagagcaatctagtagcaaaatgaggtacttcttgtctactttgtgatatacatcattccaaaaattatcataaagcttccctttctgtttcaaaatgcatactacaaagttgaacgatttaattt

SEQ ID NO: 102692 - DNA, 350 bp, Homo sapiens
aattgggctctttaattcattccagacagcagtttttcaaggtgttttggtagagattaagtgcattatttgtttgacctgaggttcttgtttctctttgggaaactttaattttgttttttctcttataaatgggtacagactgttttcttcctttgtgactaattcacgttcttttctcttccactcttgaacaatcagagtgactcagttcagatgatcaagagagtttgaaatcattcttgagaagaacagcatcaagacattgttcctgttaatgtttaacccacctaattaccatagtaacttctgtaatttcacataaaatatagtaaacatggctatgcttg

SEQ ID NO: 102693 - DNA, 227 bp, Homo sapiens
attgggcagtgtggtctttggaggtgatcaagtcatgagggctctgcccttatgaatgggatggataactttataaaagggctgaaggttgaaggggccactatcttaccctttctccatgggaggacacagcagcaaggtgccacgatggaagcagagagcagccctcaccagacacaaatggtactgacttcaccgtggaattcccagacaccagaactatataa

SEQ ID NO: 102694 - DNA, 737 bp, Homo sapiens
attttcccaaatcaactataatgtagatagggtgtagacttcagaatacagttaatgcagcagaactgtttctttacagcacttgtatgtgacgtgtcaaggaaacaatagaaaaatacagcatattttattaaaaaaaaaaaaaaaaaaaaaaaaaaaaaaaaaaacaaaaaaaaaaaaaaaaaagaaaaaaaaaaaaaaaaaaaaagaaagaaaaaaaaagaaaagaacgaagagcaagaacacaaaaacagataaagacgagatgaggcacagaagcaagctgactgagagaggacgaacaaccatcagaacggagcaacacgaacaagttgagacgcaaagcgacgacgaagagaagaaagaccgagtaccaaaccagaaaggcataaggggaacagaaaacagcagagagaagagaagaagagagagagaaaacgaaagagaaaaaaaaaagagaagaagcaaaaaaaagaggagagaaaggcagcacacccacagagcgaggatcagccaaacaccaacaaagcgagagagaagtaagaccagaagacaaagagagagacaacaaaaggagggacgcagcaaagagacaaacaaggcctacgaggcgccacaacgaaagagaaagaacgaagagcagaaacaagaagaacagggaaaggaagggaggaaaagaacgaagaagaaaacccaacaaacaagcacaggaaagcagaaaaaagaaaggggcaagc

SEQ ID NO: 102695 - DNA, 331 bp, Homo sapiens
cggctgaccaccctggaacacctgaggtgaggacaaggtaggctcgggtctggctcttcccttacagcagtctactcatcccaaggattcaggggccatctttccatgggactataaagctgcccaggttccctcgggccatgtcctctcttaaccactttagctgaagaaggtggtaaggcctctgctttgaaaggaaattgaagctgggttgagggtggagattggctatagtttgaccctcagatctcactgagtttaagctctatatcggggatgtccaatcttttggcttcctgggccacattggaagaagaaaaattgtcttggg

SEQ ID NO: 102696 - DNA, 128 bp, Homo sapiens
aattcaagcttctaacgatgtacggggacatgaagagggttggcgtgacctgtggatgctgaggaagtgtcggtgacaggaagcggggtggcgtgaccggtggatgctgaggaagggctggtgacatg

SEQ ID NO: 102697 - DNA, 1784 bp, Homo sapiens
gggcgcccgtgtggagcagaggctggccgccgtgtccaaggcttggcaaaatctctgcgtcactgagcagcattttaacctcttgaatgagatgcctccgaccttttggatcctctttctgcacctctcaggggacaggtcccgtctgtacggcgctgcctacgagaaacccaagttcattactgcagccaaaggaaaggtgcaggcggtgggaggctcctgcaaggtgatgcgtctggccataagtcccactgccttctcccacctgctggcctgtgcccagcagttccggaagcagacccaggcccaggtgtacagtgaggacatggccctgaacataggctcggaaccagaaggcctgcaggtggaagagaaggagcgccctgtgcagaggctcagtagcgtcctggggcccctggaggagcttctgcagccgctattccccctgctcagcctctccaaggccagagtgcagacacctgcggttgttgccgattcagggaagtcgaagggcaaagacaaggagaggaaaacgtccacaggacaacacagcacagtccagcctgaggttgccgataagatagtcctggtcacagacagacatctcctggagctgccactggaaggtctctctgtgttcgatgaagggacaatttcctctgtgtcacgagaattttctcttcaaatgctgtggaatcgcctccataaagaagagacagaaggtggcgtgaaaaaggagggaagaagcagagaccccaaaaagagaagcctagcgaagaagggcaggaagggcagcatcccccggaccatcccccctgactgcatcatagtcgactcagacaacttcaagttcgtcgtggacccatacgaggaggcccagggcccagaaatgctaactcctgtctccatcacccaagacattttggaaagattccaagacacattcacgtcgcgatgggcgggacatctgggaagcaagcactttcccagccaggcccagtgggagcaggccctgggcagctgcagcggtttcttcttctatggaatggagagcttcctgtcccatatattagtggagagattggtcgccatgaacttgcaagagtgccaggtggcagtcctgctggacctggcacggtcctaccagagcttgaagaggcacatggagagcgtggagcacaggagatctgttggccgttgggaagccaattggagaaacggtgcgtctccttcagaagatgagtggcgacgaggcggtgaaccaaggcgaggcttctcagaccttgaaggacaagctgctgctgctccaaagctccgagctccttcccaccacgctcaacttggtcctgtatgggctgccgcaccaagccatcgggtagtgcaggcctggacctgcctcccatcagctgctggggccccagcacttgcctctgcccttggctctgcccctctgccaacccatccccacctcccggctcccatccccagctcccagctcgctctccccttcctgggcctctccccagcccttggtgcagcctcagccagggaccctcccccagcgacttcccgcaaggcagccgcctggacctcgagctctgcctgcctgtgtgcgccatggggtctgcgtcggggctggagctgcgtctcttcccggggccaggacaagggcggcctccccttggcggcgctggtgctgagttgcttagaccagaagactattcagaccgtgagcctgtttttgatttgagtgttccactaaacaaacaacaaaagccaaaaaa

SEQ ID NO: 102698 - DNA, 873 bp, Homo sapiens
gtgaggccctccaggctccaagccacccagccgggaccctctgctccccacccctgggagccaggaccctggcgaggtggggggaggggcggggcgctaggccaggctgctgaagggcttgggccatcccaacacccgggcactgcccaactcccaggccaagctccatgtggggggagaacttgctccttgggctccttggccatgtctgatccctgaagcacaaacaggaggggcctggtccactctgctccgcagagctcagggtcacctgggcccggctgtccccacaggcaggaccctccgtggtgcgggcagaggagatgggtgggggctggggtctcagggtgaccctccagaggatgggccaggtgctatggggccctcgttgccgagccaggtgcccttgtccaccatgctgtttgcagaaggggcaggagctcggcctttctgcaggggcctggccctcgcggggtctgggccatgcgccctgtttgctacgggggcctcttttttggattgcggtaggaaccagaaggcctgcaggtggaagagaaggagcgccctgtgcagaggctcagtagcgtcctggggcccctggaggagcttctgcagccgctattccccctgctcagcctctccaaggccaggtactggggatgacgttgaggctggcaccccaccacgctcacgcatggacacgtgtgtccagtgctgtggccaaccacgtgtgcttgctgtgccttctcggccgcctttgttcaggactcggcgccgcctgcctgctcccaggaagcaattcttctggttctgcctccattcctgcctggaggagtactgcccactgcccactgcccacggtccctccagccc

SEQ ID NO: 102699 - DNA, 337 bp, Homo sapiens
gagcaggacttgcagtgggaaggagtaggacaggatattgttggattttattaggcatctcttagcactgttttatttttttaagtatgtatatatattcctttgataaaaaataaaaattaggccatgtgtggtcgctcacacctgtaatcccagcactttgggaggccaaagcgagcggatcacctgaggtcaggagttcgagaccagcctggccaacatggtgaaaccctgtctctattaaaaatacaaaacttagccaggcatggtgacacacatctgtaatcccagctactccaaagactgaggcaggagaattgcttgaacccaggaggcc

SEQ ID NO: 102700 - DNA, 362 bp, Homo sapiens
ctagaggatctccgggagccttaacctgagggactgtagtatcagccctggatatacccagatggtcacatgggtgagaaataaacatctcttccagcataagtcattgctattttgggcctttcttacagcatctgaactaactaaggagccatcccacccttactttccctccttctcttccccgtctccgtacccgatgagcattgccactgctcagagccacaaaaggaaaccacatctaaaataggtatctcaaaatacgaacaggagactatctcatcagagtcaccgagtgatgcctgagcccagctttggacaaatgtcaagggtagaagtgaccaggcttggggactgtttgt

SEQ ID NO: 102701 - DNA, 801 bp, Homo sapiens
tggctcccacacatccctcctggctctctggcttcatctgggagagatagaacccagatagcaggagggctgagtagactgtctgcccttacaacctctcagcacctctgggcctgcccagggccctgggaaagggcagggtgagcccaggcatttgcagaacccctgcataccaggcactgccacaggaagtggctgcctgtacaggcgtcaggctcacccaggccttgagcctccctccttgagagaaggctctctcccacccaccatctgagagtagagtttgttttccttgggctagacttggacctgcacccactactttgttgtcagatgcctttcccctgcagctggagctcagccccttcccacagaactgggaggcagtctgggtaggagttcacaacctcgccttccagtctgtagcagggttactggcaacctagagaccaattttcagggcttctgagaggtagaaccagaaggaagggcactgcaacctagaagctggctgacaggagccagaggggaggccatggactggctgcagggcccaggctgccctttcacagagcttcctgggagaggagggcctgctctgctctggccagcgtcaccctctgaaatccctgccccacccctggtgggtcaaataggtaagaatccaggatgagattcctaggaagacccctccccaactctcagaggtccctgaggatggagagtccatggaagccagtggaaaagcaatctaaggccattatctcagtatgggctgctctgctccctggcttctgggac

SEQ ID NO: 102702 - DNA, 344 bp, Homo sapiens
cactgcaacctccacctcccaggttcaagcgatactcctgcctcggctttgcaagtagccaggactacaggcatgtgccaccacgcccagctaatttttgtctttttagtacagatggggttttgttatgttggccaggctggtctcgggctcctgacctcaggtgatccacctgccttggccgcctcccaaagtgctgggattacaggcaggagccaccacacccagcctcaattatttttttaatgcctcctgtgtgccagtcactgtcctgatgtcattttggacattcaaagctgtgttagattggacccctccctgtcttcagattttatagtccaatt

SEQ ID NO: 102703 - DNA, 702 bp, Homo sapiens
agccccggagacaccccagcaccaagctcagcatggtggggcctgggtctggggcagagacgccccccagcaagaaagcaggctcacagaagccaaccccagagggccgagagtccagccggaaggttcctccgcagaagcccaggcgaagccctaacacccagctctctgtctccttcgatgagtcctgccccccaggcccctctcctcgaggggggaacctgcctcttcagcgcctcactagggggtcccgagtagctggggaccctgatgtgggtgcccaggaagagcctgtgtacattgagatggtgggggacgtctttaggggaggaggacgaagtggaggaggcctggctgggccccctcttgggggtgggggcccgacccctccagcgggcgccgactcggactctgaagagagtgaggccatctatgaagagatgaagtacccgctgccggaagaggctggggaaggccgggccaatggccctccaccattgacggcaacatccccgccacaacagcctcacgcccttccgccccatgcccaccgccgcccagcttcagccctcccgagccggagggacgggacgcccaccaagaccactccttgtgaaatccccccgcccttccccaacctccttcagcaccggcctccactcctggccttcccccaagccaagtctgcttcccgaacccctg

SEQ ID NO: 102704 - DNA, 440 bp, Homo sapiens
gctcaagcaatcctctcacctcggcctctcaaagtgctgggattataggtgtgagccactgcaccaggcttattattgttatttttaaatgaatcaataaaaatattttttaaaatttctcagatttaatttctattgtaataaatatcaatagttataacccatgtaaataaaagctctttaggattctcaacaattttttagggtaatggggtcctgatgcctaaaattttgagaaccactaatctaattcagaatccaaagggggattttgagaactagtaatgctggcctaagacagtaaatctgctcattggataagtgactctataacattaaaataataataaggatggtgaaggccaggagcggtggctcacacctctaatctcagcactttgggaggctgaggcagtggatcacttgaggtcaggagttcg

SEQ ID NO: 102705 - DNA, 369 bp, Homo sapiens
cacaccaattttaatgctatctcaactatcatcaaggtttttccttaatcatataaacatcaaattgtggcttcttcaggatctatccccgaagttcttctggggtaaaatcaaagcatctattctttttataatttaaacttttattttagattcagtggtacacatgcagatttgttacatgggtttattgcacgatgctgaggtttgggatacgattggtcccgtcactcaggtagtgagcatagtatccatagttagtttttccaccctcccttcctcctgcctctagtagtccccgttgtctatagttgccatctttttgtccatgagtacccagtgtttagctcccacttgtaaatgagaatg

SEQ ID NO: 102706 - DNA, 840 bp, Homo sapiens
agagctgagcccccacgcagggagttccaatctttcaactgatgacatgggagatgatgtgggattcagagtggaatacaatagttttgctcaaacctaatgatataaaggaaatagattcttgaaagcccctagtactgacctaatttgtttttattataccatttgttaaatatataaacatgatataggtagaaactccttgtttttatagcagatgtatacttctaaagtcaaaagaaaattacaaattaaataggaatatttacaaaaaggaataatcacaagaagaatacaactcacattaatttaacctaataacacggcattgccccagtgaaactgctgctggaaacatgactataaagtgactccaatgacacaagtgctgtgagtttggtgacccaatcctacagataaatgccttgtgacactcaatgctattttttctctatttgctctactaagaagttttcatttataagaaatggtctgatctcatttagcttttacttaaacatcgaagcttacatctgtttttgtctcattcacttacaatcattagaatgaagctaacacaaaatcagaaacacaaatgcaaatgcagccaatgaaagcatgcagtagcacatcttggtaactggccaccccagtgatccagaatatgcccatataaatgatttacattgtcaacaaaatacaaactgaatgaaccaattctggtagagaattggctggattgtgataggaaaaggcagagttctaagtccttagttatgtaaagacttaattagtaggcttataatttgaaaacaacacatgggtttgtctctctgtatt

SEQ ID NO: 102707 - DNA, 676 bp, Homo sapiens
tttccttgtgttttgctctgcattgcatgcaaactattgttctttgagtagttactttaataaactccacccagtctcccaccttattttaaggtcgcagagttggagatgaacatccaagcagatatttggaaaaaaaattatacttgtatggaagattgcaacttgaaaaatatgtggggctggacttagtggctcacgaggcctgtaatccctgtgctttaggaggccaaagctggaggatcgcttgagcccaggagttttagaccagcctgggcaacatagcaaggcccccgtctctccaaaaatactttaaaaatattagctgggcgcagtggcatgcacctgtagtcccagctactcaagaggttgaggcaggctgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcaagactccgtctcaaaaaaaaaaaaaaaaaa

SEQ ID NO: 102708 - DNA, 92 bp, Homo sapiens
gttgtgctgctttgggtgatgacaaggcctagaatgtgaacctggttaatgtgaagtggcagatattttggatgggcattttcatcatggaa

SEQ ID NO: 102709 - DNA, 537 bp, Homo sapiens
cacctaaactccctccctctccactgtcacacagttcacttcggtagttatttgttggtgaaatgcacacaggatgcatactgtgtcctctggcatccatatagcaatgggctcctccagaacaatccataacatggtggcttcacactgcctgcctgttggcttgttgtcaccaccccagtgctcaagaaaggaatactaaatgccatagcaaattcaaaactctgctgaaccctgacaactaggaaggtttgtattaggattaataaaacaatgatcaaaaatcttgatactagtacaactctgactcatttactgtttgatgccttgaatatttaataggtatcttgatgttgctcaaaacaaagcccttgattttcccatcagcctccttttctctccacaaacctattgagtcctacaaaactcctgcccctgccccctccttgccttcccagctccgtgtacagcattaccatttttcaaggggttctagtagctgctgtagagccatccttgactttctgctctcactcc

SEQ ID NO: 102710 - DNA, 178 bp, Homo sapiens
ccataaaactaagatctaatttcatgaagtcaaagttcttattagaaataatattacttgatcttttaaaaataataaaagaatgtacactgttaacgttgtagtcctgttactgaaatttgaatacaggtgtgaggttgcagtaacctaataagaccaaaatcatttgatttttgtt

SEQ ID NO: 102711 - DNA, 355 bp, Homo sapiens
aaaaaacatttatcgttgacttcaaacagcaatgaagagcatgttaacagaagttacttattttatgaaaaataaccatataaccccaaacaaacaaacaaaaatatttagtgagaagagtgtcactgtttaagatttttacaaatctctttgcatgcctggtttaatagaagacagctaatgttcctatctgcgtcttattcaatttgttgtctctagaaaactccactgtacactcacagaagaatacagacaagagtggaaaaggcaaatcatatcgtagcatcattataaaaagttttgacctggtgtacacccaagtgggtcttgaggacctctaggagtccacagaaca

SEQ ID NO: 102712 - DNA, 1158 bp, Homo sapiens
cgcgggaaagagtgccgcctcagctgagggcaagcgaggagatggctgtgaggcaggcggcgacggcgggcactcccgggcccaggagagaggaagaggcggcgcttctattcgagagggcccattaccggcacgacccgcgctggctgctgcccgtgaccccccgcctgtgcctggcctgcgcgctggagctgctgccggaccccggcgtgtcgttagtgcgcaagaagcacatgttgtcctgcttccaagatgcccttgtgaggcatacctccctggtcacgcaactggtgtctcaggatcagagagtctgcatccacttcataagtgtgctttttggactattatgcagcatggaagatgggagtgtgacagacctctgtattgaagtccttattcagatcacaacgcagctgaagctggagcagactatccgttgcctgctggatgagtgccacaaagagctgtgtaacatgccctccatgcgaggcagcctggccaccctgacccttcttggcaagttggtggatgccatccctgctctggcagacgagcttgtaatggagcatggcaacctgatggagcatctgttgagaggcttagtataccccagtgagggcatacaagcttctgtctgttacctttatgggaagctatactcctcaccagtggcagctgagatgctttcaggacacttccgtgagaagctttttcccctcttcctttccatcctggatggtgcccagacaaaggagctgcagattaactgcttgggtttgctgaggcagctgttgaagtatgatctctttgtgtccatgatcatgaaccaggatggactgggagaaagtgctaagaatatcgaagggtcatcaggaaatacctcactgcctttggtgctcaaaaagcttctcctctctagagatgaaaccctgcaggtggccagtgctcactgtataactgcggtgcttgtccactccccagcaaagcatgcgtcagccttcatccacgctgacatcccagagttcctctttgagcatctttcttcttccagtgaagtgctcgtctggtccagctgtaactgcttgacactcctggtagaagagccactctttttttccaagtgccacacggtgtatggttggtagtaagggtcctgta

SEQ ID NO: 102713 - DNA, 719 bp, Homo sapiens
aatggagcatattcactttctgtagctgtgtaacatgccctccatgcgaggcagcctggccaccctgacccttcttggcaagttggtggatgccatccctgctctggcagacgagcttgtaatggagcatggcaacctgatggagcatctgttgagaggcttagtataccccagtgagggcatacaagcttctgtctgttacctttatgggaagctatactcctcaccagtggcagctgagatgctttcaggacacttccgtgagaagctttttcccctcttcctttccatcctggatggtgcccagacaaaggagctgcagattaactgcttgggtttgctgaggcagctgttgaagtatgatctctttgtgtccatgatcatgaaccaggatggactgggagaaagtgctaagaatatcgaagggtcatcaggaaatacctcactgcctttggtgctcaaaaagcttctcctctctagagatgaaaccctgcaggtggccagtgctcactgtataactgcggtgcttgtccactccccagcaaagcatgcgtcagccttcatccacgctgacatcccagagttcctctttgagcatctttcttcttccagtgaagtgctcgtctggtccagctgtaactgcttgacactcctggtagaagagccactctttttttccaagtgccacacggtgtatggttggtagtaagggtcctgta

SEQ ID NO: 102714 - DNA, 767 bp, Homo sapiens
gtacagccattttggaagacagtttggccgtttctcacaaaactaaatatactcttaccataccatgcagcaattatactccttggtgtttacccaagacttgaaaacttgtgtctacacaaaaatctgcacgagtgtttaaagcagctttatttttatttataattgccaaagcttggaggcaagtaagatgtcctttggtaagtgaatgggtaaactatggttcatccagataatgagatactattcaatgttaaaaataaataagctatcaagccatggggagagatggaggaaactgacatgcatactattaagtgaaagaagcccatctgaaaacgctacgtactatatggttccaactgtatgacgtcctggaaaaggcaaaactttggaaacagtaaaaagatcaatggttagcaggatttgggcaggggaagggatgaataggcagatcacagatgatttttaggagagtaaaaaatgcacggtattagaatgatggatacatattatccatttgtccaaacccacagaaagtgcaacatcaagagggagccctcatggaaactgtggctctgggtgacaatgatgtgtcatgtaggctcatccgtggtaacaaatgcaccactctgtggggatgttgacagtgcaggggactgtgcatatgtgaggacagagggtacatgtaaatctctatatcttcagcagaattttgctgtgaccctaagactgcttgaagaaaaataaagtcttcgttaaaacaa

SEQ ID NO: 102715 - DNA, 449 bp, Homo sapiens
cgccgacgccgctgctgtggccgctgctgctgctgctgctcctggaaaccggagcccaggatgtgcgagttcaagtgctacccgaggtgcgaggccagctcgggggcaccgtggagctgccgtgccacctgctgccacctgttcctggactgtacatctccctggtgacctggcagcgcccagatgcacctgcgaaccaccagaatgtggccgccttccaccctaagatgggtcccagcttccccagcccgaagcctggcagcgagcggctgtccttcgtctctgccaagcagagcactgggcaagacacagaggcagagctccaggacgccacgctgcgcctccacgggctcacggtggaggacgagggcaactacacttgcgagtttgccaccttccccaaggggtccgtccgagggatgacctggctcagagtcataggtgagcag

SEQ ID NO: 102716 - DNA, 299 bp, Homo sapiens
atgaatcctgacccctacctcacaccatacaggaaaagtaattcaaaacagatcataaacttaaaatctaaaactataaagctgtcagaagaaaatatataaaaacatctctcagactaagaaggtagacatagatttcttaggacacagaaagcaataacagaaaataaaaatccagtaaatcagacttcatcaaatccaaaacatctgctcaccaaaatgaatacacaagccgtcgtctgggagaaaagattcacagaatgtatatctgacaggaatttgtaccgtgatgaggaagt

SEQ ID NO: 102717 - DNA, 422 bp, Homo sapiens
gctgagctttgtaaacccagaggctgaaacttagtgtttcaaatgcatatcttagcaatgcttttttgttttgtttttttaaaacaacaacaacaacaacaaaagctctgatctcctcattgttttctattttgctagggatacaaatataagtacctctagcccctatggcatgcaaaaaaatgagtgtaacaacaaatatcagataatagaaaatggtgggtactgaggaacaggtgatcgtatggttaacatctgtgctataagggctacttctagaatactataatgaacattctagtcaaatgttctgacaaattgtgtgttccagtggctaccacttctgaagatttaggaagttgagtatcggaatttttatgtaaaatttcatgattttgaatgttggctcaaagatagaaagg

SEQ ID NO: 102718 - DNA, 139 bp, Homo sapiens
tagtcatggaaatgtaaataatgggtcaggaatgggaaaaaaggacagttggaataatagaagaaataaagctaaagtcgaattatgaaattttaccattataagttgcagaatattaaaaaatcgaaggcaagaaata

SEQ ID NO: 102719 - DNA, 874 bp, Homo sapiens
agaaaagacaaggtccccataagagtggcgagaggaacagagccaggacatcggaaagcaagcccctgtgttcccaaaccgcagaagagggagctctgatgttagacaagccaccctcctacaagcgaagggaaagtaactttgagcaaaaatgagcaacagaaaatgagatcaaggtcagatctcatacaaagttgcaagatgaaagaatgagcagcagaataacctccctgtgatgtggaaagtgtgccaggaaaacagacccaaactgtaacctctttcagaatgaggcaaggcagtgaggaaactatgtgaaaacacgaaagcagccgatcagagttgtaagcccgggcagtctgggttggaatgggtgccccgagccacgggaccatgatgcctctctagaaagacaggaccaggcattccaccagggttctagtcccaacagcaccactaacttgcttgtggccctaaaggattcattgtccctctctgggtctcaactatttagagctctactgtccagtatgggatcaaccagccatatttggcaatttaaattaaaattagctgggtacggtagcgtacccctgtaatctcagcactttaggaggctgaagcgggaggattgcttgagcccaggagttcgagaccagcctaggcaacatagcaggaccttgtctctgcaaaaaaaatgaaaaaattagctaggcgtggtggcacatgcctgtaatcccagatagctgggattacaggcacgtgccaccatgcccagctaatttttgtatttttagtagagacagggtttctgcatgttggccaggctggtctcaaactcctgaccttgtgatctgccgacctcagcctcccaaag

SEQ ID NO: 102720 - DNA, 884 bp, Homo sapiens
gcctaaaagactgaaagacattttatattagttagaatacttgaggataataacataaaaactttcctttccaacttgtttataaaaggaaatcttcactgttttgaacatcagttattttaaacttttaagttgttagcacagcaaaagcaacaaaattctaagtgcagtaatcactttactgcgtggtcatatgaaatcaaggcaatgttatgagtattactggaaagctggacagagtaacgggaaaagtgactaaaactatgcaaaactatgcaaaactaagcagattgtgtctctagagtatttcccatctcaagtttagttatttactaatttggcaacatctgacctatctttaattgtgagaaaataaacaaacacataagccaactctcagaatatggttatacataggtgtagcctatgactttgaatgtatttgtttgaatagcgtaaaacaaaataaaaataaaatcttgttacagtgcaagaaacggcagtcatcaaactaagatgaggcaagtgtcatgaagtatgaaaatatggtacctgaattctatttattagaaagtcttcactgagctgagcatgttttttttaacaaattcaattactgatttgaatatttattatacttaattattgcagccatgaaaagaggtgctggctgaggctgcatttaataaaaacatttaatcagcttgaggttagtaaaccatttaatttgttttttcatgaagatttaacttctagaataatttcatttatgtatttttaggtatagccctagattctggtctacatagtatacaaatcattttagaatgacactaggttatttcaactgcttttctacagaagtgttaaataagggagtaaag

SEQ ID NO: 102721 - DNA, 350 bp, Homo sapiens
tcatttttgtatttttagtagagacagggtttcgccacttcagccaggctggtctcgagctcctggcctcaagtgatccgcctgcctcgacctcccaaagtactgggattacagatgtgagccactgtgcccagcccagcctctgtgccttttcactttcctgatggtgtccttatagttttcatatgttcctatcttgatttgtatttttcttaggaatggctcttgaattatgtcagatgcctttttgatgtaatagcctaatggtgttattttcctaaattggttgttgtaatgaatgatattgatatataatgtggatccatccttgccttcctgggataattctg

SEQ ID NO: 102722 - DNA, 316 bp, Homo sapiens
ttcgtgttaggctgaattgtgactccctccaccccctgcacattcctatgttgaatgatgccttaacccgaaccccaggatgtgagtgtttggagaaagggcctttacagtggtgactggtgaaagtgggtcccttagggtgagccctcatccaacatgacttgtgtccctgtagaagggggcgatcaggacacagacacacagagggaagaccatgtgaggacacagggagaagatggccatctgtgcaccgcagagagaagcctcgggagaaaccagccctgccaatgccttgatcttggacttccagctgcta

SEQ ID NO: 102723 - DNA, 199 bp, Homo sapiens
tatggtgagtattcagtaaatattagctattatcctgacacattaaactttaaaataattagtgataccataatgccccatacagatttgcttcttgatgctatattgtgtcatcatctctttgtgtcagtcctttcccttatccttctggattgtggatttcttaaaaggtgggggctggaccttaaccatttttctt

SEQ ID NO: 102724 - DNA, 393 bp, Homo sapiens
atacataataacagagtcatcacattagaaatatgaaactaatgctcattaaaagttacaatttaagctgagcatggtggagcatgcctgtaatcacagctaatcaggaggctgaggcaggaggatcatttcagttcaggaatttgaggttgcagtgagctgtgatcacatcactgcactccagcttagacagcagaatgagactgtgtcactaggaaaaaaaagaaagtttaaaatacaaagttttagtttttttaaaaaaatttgcttagcttgttttacaagctacgtaatgacctcatctgggggttaaatcattctatgtgattgtagcatttgatacttgcttaaaattctaaaactatggagtattactctttcctcattttgaaa

SEQ ID NO: 102725 - DNA, 377 bp, Homo sapiens
ggtggcattgctgggatgctgatgtgacttccctgcacttaagagcatgcattgctttggccccactttcagagggtggtggaagactggtttaaaatattgcttcctactaaacatgcagatacgggcttggaaaaaaatagttgcacaagctaatcactcacaaatctggatatatttcaggatgttttgacagttttccccacataacatctgtacttaagaagcctcacgctattggtaaagtattaacttgatttatctgctcacatccagggcactgcatggttctgccctgctatccccagatcccctgccaggcgctcccctacaggcctctccatcctccatgagtatgagcttacacggccattcat

SEQ ID NO: 102726 - DNA, 191 bp, Homo sapiens
gtttcaagtcctcgtctgtctacaggagggagtcaatcatgacattcacaagactgctgtgggcacaaatgaaatcaggggcatgagacatgttgtaaactggagagatttagggcgtttccacacacatttcccagctgattctcacagagaggcagggaagaagacgtcaccaccgtcagcgttgttta

SEQ ID NO: 102727 - DNA, 160 bp, Homo sapiens
acagatagcagggctgggagaaagggatggggagagtccctcctgccactgacccaggatggataaaagtacccctttcatagaaggaagaaaatgggaacaaaggtgctgctgatcatctgaggttgcctgcatggcagtgaagaacatggacctttgg

SEQ ID NO: 102728 - DNA, 368 bp, Homo sapiens
gggcccctctttcctgccaggcagggtgtgccgtgagtgatctgggcgaaagcgggccacacagaggaccccggcagcctgagaccatggcatcgccaccagacaccccgtggctcacctgggacagcgtctggagcccagcctggcctgtgccggctttaaaggaagggcagattcaggagagcaggaaggaaacgggaggggctggatgagctggttgctgggtcgagcccacgttgccccctccactgctgcctctgagaaggattaacgcggccttgagaacatctccagctcacgctggcctcagtcccagggaagccgagatgtctgaagaaagggagctggtggctgggttctctgggctc

SEQ ID NO: 102729 - DNA, 614 bp, Homo sapiens
tgagacggagtttcccaggctggagtgcagtggcgcgatctcggctcactgcaagctccgcctcccgggttcacgccattttcctgcctcagcctcccgagtagctgggactacaggcgcccgccacccctcccggctaattttttgtatttttttagtagagacggggtttcaccatgttagtcaggatggtctcgatctcctgaccttgtgatccgcccgcctcagcctcccaaagtgctgggattacaggcgtgagccaccgcgcccggcccctgatggtctaatgtttttagcacagttgaacactttaaataagagccacaaccataaggaggacctctccccagtatggcatttagaatcagcttccttatcagatactttctccttgtaacattgttattcttcagcatattggataaattggcaaatggctcttatacacatgaaaagatactcaactttatgaataggaataaatattcaaattaaaactcactgatgccagttgtgatctagtgggttagcagaaacccaaatgtttgatactagtactggtgagaatatggggaaacagtctctctcatacattgcttacaggaacgtgaatt

SEQ ID NO: 102730 - DNA, 210 bp, Homo sapiens
aggttggtctcgaacacctgacctcaggtgatccactggcctcccaaagtgctgaggttacaggtgtgagctcctgcgcccagccgttcacaagtattgagacggctttgagatgaagaaaaaatgtcttaatatctatagctaaagttcagtgcctgtgctgtagattgtgattcgcatcatgtcagatttgtagtcataacagactgc

SEQ ID NO: 102731 - DNA, 340 bp, Homo sapiens
gagacttcaccatgttggccaggctgctcttgaactcctgacctcaaatgattctctcaccttggcctttcaaagtgctgagattacaggcatgagccactgcaccctgccttcaaggcactttttactgcttataattctgtcatttttctgtttgcttattttttgtcacccactagaatataagctcactgagaccagtgagcttgtctggtttgttcactgctacattcccacgcctacatgagtttctgactcatggtcaatatgtaattatttgttgaatgaatgaatgacttcatttttatgtgtataaatttggtgactactgaatttataa

SEQ ID NO: 102732 - DNA, 835 bp, Homo sapiens
ttcctggggaggtgggcaaaggagactgtccctaccaagagggtgacgtaagccaagaaagaggggctgtctgctctggccattgcttatgagttgtgtggagggccagtgaagggtggagaggcaagatggtgtagagctgataagagcacagcctcatgaccctgaacttccttccaggtccctcatcaatgtaatgtggatacattagtaccagctttgaggggtgactaggattggattggatgatgattgtaaagttcctggtgcaggcctggcacataggaagtgttgattagaggcgtgagccaccgtgccttctggcccattttacctgatttaagagtaaaaataatctcttctcatttaaaatgcttccatcttttcagtaaagttccatattgggaggcagggatgtaaaaatataccaataactgaagccattatagttgtgaggggtccctaagtctaactctaaactggtggcagtacttggaaaaacaggtgcttttacttcctctgttgtttctgagaaacattacgtattttttaatttatattaggctattttctctgttaatttctggccagcctttaaattgatctgtgtatttcagcgcataattttaggtatattctttcaggggaaagttccctaagtggttgttgctgtcatttgtcttgctatgtcatctagcctgaagtgcagtggtgcaatcctagttaactgtcaccttgaattcctgggctcaagcagtcttcccacctcagcctcctgaataactgggactacaggcatgcaccaccacacctagctgattttttatttttctta

SEQ ID NO: 102733 - DNA, 463 bp, Homo sapiens
ttcctggggaggtgggcaaaggagactgtccctaccaagagggtgacgtaagccaagaaagaggggctgtctgctctggccattgcttatgagttgtgtggagggccagtgaagggtggagaggcaagatggtgtagagctgataagagcacagcctcatgaccctgaacttccttccaggtccctcatcaatgtaatgtggatacattagtaccagctttgaggggtgactaggattggattggatgatgattgtaaagttcctggtgcaggcctggcacataggaagtgttgattaggccaggcgcagtggctcacgcctgtaatcccagcactttgggaggccaaggcaggtggatcacctgaggtcaggagtttgagaccagcctggccaacatggtgaaaccctgtctctactaaaaataccaaaaacaaacaaacaaacaaaaacaaaaaacaaaaa

SEQ ID NO: 102734 - DNA, 422 bp, Homo sapiens
tgttttgttttgttttaagagataaggtctcactacgttgtccaggctggtctcgataccctggcttcagtgatcttcctgccttggtctcccagtgttgagattacaggcgtgacacacttgcccagcccccagagtagtttaaatgtgaatttttcttaggagtaagactcagcatcttttcagatttttaataatcatctgtgtgtctcttcctgtgaacaatcttgttcttatctccttgcccatttttctgtggggcagttggcctttttcttaacttttagaagttttttttaatattaggaatatgaaccctgtatctgctctatggaattgcaaatattgtttccctctgtcacttttttttttttcttgagacagtttcattctgccaccgaggctggagtgcagtggtgtga

SEQ ID NO: 102735 - DNA, 372 bp, Homo sapiens
ctgaaaatatagagtgattgcagcaagtatgtaaagggtgaagatgtgggagagaaattttgaagatagaatttacagaatttgtcaactaaagacatatggggttaaaagaaagaggaaaggtgaagattccttaaagaactaaaagtagatctaccatttaatccagcaatcccacttctgggtatctacccaaaggaaaagaagtcatatacaaaaaagatctttgcacatgcatgtttatagcagcacaattcacaatttcaaaaatgtggaaccagcccaaatgcccatcaatcaacaagtggataaagaaattgtggtgtgtgtgtgtatatatatatatatgtacaccatggaatactactcagc

SEQ ID NO: 102736 - DNA, 230 bp, Homo sapiens
acagtcacaaacgcatcctccagcagcctccagctacaggttccaggaggagccacagatcagagccactgagccttttccctcaaggtaactaacacgtagggggccacattctctgaggcccaggtggaagcggccctgagggaaggtgcatctccagtgcctgggcctctctcccaccacagtgaccctctgcacagacggtgccctccaactgcccttcacgaacc

SEQ ID NO: 102737 - DNA, 728 bp, Homo sapiens
gaaaagaaaaaatccatagggaagagttggcagttggggcttatagttgggcctcctccagattctctaatattttatctgagtccacatgcaaccattaaaattaagttcgttatttggctggtttctccttaatcctgtcagtggattcctggttctgccactttgccaggaatgagaatagccatggtctcttcccttctaaagggtttgactttttctctgatttagcttatttattatttagatttctttacatgcttagctctctgattttttttttccttaaactatgatttttgtagcttatccagcttgttgcagtttatagagtgaggcttggtatcttgcaactttgagcattctagtcagaagtggaaatcctgagccttttgttagaattacaaaatttgagagctggaagagaccatagaaatcaagtagtttaagccaggtggggtggtgtgcgcctgtactcctaactactacctggctctgcctgggtgacagggcaagaccttgtctcttaaaaaagaagaaatcctgtagcttagccactttgttttcctgatgaggaactgagacataaaaatgtgaaattctttgactacacagctgatgtagccacagatcctggagtagaccccagatctttaaacttatggtttatttcctttaatataagctgtccctcttggtttcatgttgctaaaacaacacctgagact

SEQ ID NO: 102738 - DNA, 373 bp, Homo sapiens
aatctagatctttttcacatatatcataacaagttagttcaagtttattttgaaaaagtgtaaaattcatgcataggttttcgtaacattcattttccaacagctttttgaagatcccttatatatgttttggctcaattaaaaaaataaatatttcaagttgtgtgtctcaaattatgaaataaatgcatagaacacagaataatttgttcaacgaagtcagtatgatcatagcaacaatggaaaaataattttgaaatagaaaggagaaaacagaaaagtgaacaactgcaaatatgttggaatgtagttcagttttaatttaaaaggtggattacaggcatgagccaccacacctggctatatgtgggta

SEQ ID NO: 102739 - DNA, 346 bp, Homo sapiens
gaggatccagaaatccacatggattgtgacttcttgatggggactggtagcctccccaggtggaggacatggtggagatggggcatccccgcaggtggagaggagctggcccagatgggagctcatttgagagaggagccctcaccccagccaggggtgcagcccttcctggatagtgggtggggttggcatttgagggcagcctcttcagccctgcgagggcaggtaccactccccatgtatattcagtcattcactcattcatctccctcccttttcacttgttggacccttggatttatttgttcatccaacaagcatttattaggcacttagtgtgtgcctg

SEQ ID NO: 102740 - DNA, 332 bp, Homo sapiens
catgttacccaggctggtctcgaactcctgggctcaagcaatccgcccaccttggccacccaaagtgatgagtgctaagattacaggcatgagcctctgtgcccagcttggatatttcaaagacattagccatggccttcatgtttatctggacttgagggcttcatatctttgaccatagatgatgcttaagttggtctttcacgtggtttcagatccacagacattttgattaggtcaaataacaatcgtcttcataatgccaccatgtatgtatgtagtcctttggagactattttgacatcatttataactgacaacactgtgacttt

SEQ ID NO: 102741 - DNA, 401 bp, Homo sapiens
tttttgtaatatagtaccgattaagcttacaaataagttatttcaagtataataaaaagacttatggtaaatacctaaataacagtaatagttctcgtattgaaaaaaatggaagcaccaatcaaacaacatttaaaataagagaaattattactctttaaaaaggcatttaaaaacaagaaaatctcagttctcagagaatttgattagtcagaaaggagaaaggggtaaatgtgagttgattattttggtgattatttttgctatcctagctatctggagcattttcataatagaatcatagctggagaaaataaaaaatttatataatgtgattgaaaatatatattcatagtactatattaataatagggtaatgcaaagaaaattatatccacttt

SEQ ID NO: 102742 - DNA, 395 bp, Homo sapiens
gccagagactcgagtccttccccaccccactgctcccccgcaggggtggctcctcgggccccgctttgttcatcgtatccgggatcctttctgcaccctgcctgcctctcctttctgctgttcctcaccttcactaacaattcacccctccacacctgcagataggctccccaggctgccaggcttggctacagtcatcctctcggctcacccttagctcactcacaacttccacctctcggattcaaaggattctcctacctcagccacccgagtagctgcaaatacaagtgaccaccaccatgcccagctaagttttgtgtttttagtagaaacagagtttcaccatgttggccaggctggtctcgaactcctgacctcaagttatccaccag

SEQ ID NO: 102743 - DNA, 804 bp, Homo sapiens
ggtgagacgtgggcacaggggttgctgggcttgggagttggtggctgcgtgtgtgggctgaacagagctccccaggcacggccttgtggaccttgagggatgcctgccttcaccactagtgtgacttgaaggggaggagaatgtcctgaatcagtgatgggcattttgatatggaagagaactcccttgaatcctggtggtgaacttagaccagtcactgaggcctctccagctcctcagggtctccgtgttctaggtatccatgtgtccttccatccatttatccatccatttatgcatccatgcatccatccagccatgcatcctccttttatccatccatccatcaacccatcctcccattcatttacccatccatccgttcgtccatccatccatccatcaacccatcctcccattcatttacccatccatccattcatccatgcatccatccatccatgcgtgcatccatccatccatttatccatccatccatccatccatccgtcgtcccattcctttatccatccgttaatgcacctgtccatccatccatccattctccattcatctttccatccatgcatcatccatgcatccatccttttagttcatccagccactcatcaattgatacatccatctgtccaccatccactcatctatccatccattcacccatcctttcatcaatttacccatctaccatccatccatttatccgttcacccattcatctatccatctgtccatccatccacctatctgttcatccatccatccattcatctatccatccat

SEQ ID NO: 102744 - DNA, 313 bp, Homo sapiens
ccatctcggcctctcaaagtgctggtattacaggcatgagcgcctggccacagcatatgatttggctggacttgatttggtttcatccaggaatcctcaatgtcagtgtctttccagcttttctctttatatctcttccctggtcagatttccagtagagttctctactgtccagcctagagggtaatgacctggcactgttctgggcaccaagtggtatatgagggctaaggtctcaaaacccttcacttactcgtgctttcaggatagtacactctggctctgaatttgcttgtgtcctagagtccagaga

SEQ ID NO: 102745 - DNA, 118 bp, Homo sapiens
cactttgacgatgaattgtcttgtggcttccactgtcactgaaaagtcagctatcagtctgcagtctgctttttctctcaggactgtactaggatcttgaatttgccaatgtatccag

SEQ ID NO: 102746 - DNA, 500 bp, Homo sapiens [sequence omitted]

SEQ ID NO: 102747 - DNA, 466 bp, Homo sapiens
accttgaagccttttccacacgtatcagcacctaaggatgtactttattcatttaagtggctgcatcatcacgataataatcagcacttattgaacatttgctgtgtgccagcactgttctaactgctgtggacacattgtcgtcattgttaatcttcaccacagccctctaagggaggtgctaccattgccccattttacggaacagagggaacagagggaacagagggagcggagggaacggaagtgcagggacacccaggaagagatttaagttctgtgtgtctgattccagagcccaggctctcaccaacacaaaattctactcctctacacagttagtttgtgggagagctgggatttattgtaatttatagtttacatagcttctatgttttgctgttttctggtccagttccctaaggtgtgtgtgccctacgtttcacatttcggtctcccaggggct

SEQ ID NO: 102748 - DNA, 601 bp, Homo sapiens
agtgaataaagaaactataattcaaaactaaaaaataattgaaattgatttaaaaaagggagaaggagagtctccaaaagcaactgagaaggaatagaaagatctttaggaagagatcaaggggagaagtacgccaaatctggacttactgagaaggatcagtaagtttatagggagtagagcattctttagttgcaactaatatttagctttaaattcatggtgatgatgttgttgtgaaaaaaaaatcattcatatttggaaaatccaattcaatgagctttatagagcatatccttagcttgtaccaaggtctgagacatacagacactaataggcacaatctcagtctaataattttctagtttagccaggaagatatgttagcattgaaacaactaagttagagtgagaatgagatagtccctaggataagtgtgcaatcagacaagggaggggaaaatccccactggaaactaagaggaaatgcttttggatgcaaataaagagcatcttgaagaatgaccacaatttcagtggtcagttgaaatggaaagcacaaaactcttccaattcctgaggtgcctggatgtatgtagat

SEQ ID NO: 102749 - DNA, 432 bp, Homo sapiens
gcggccgcctactactactaaattcgcggccgcgtcggatgctagggcaaatgctctacctctccgatagtaatatagtcaagttttttgtagagtaaatgaggcaaaattaatttattctttcataaatatgttcttgagtacttttactctgtgcttgggcccattcacatagaagacataaaaacgtttggcagaaggaaatacatgagctaatgtatttttgaattatattgaccatagaattttcttcataagtagttggtatttctcttacaaatgttctactctagaaaagaataaatttctattaagaaaatgaaagaacaaataaaaaagaattagaccagtttggatgatttactagcatgttactttttaaaatacatagttgggtgtccctaaccccgctacccatgatcctccagtctt

SEQ ID NO: 102750 - DNA, 916 bp, Homo sapiens
ccacaggtcacagggctcattctcccactggaaggctcgcaaagaaagaacgcgttcccacacacccagaaaacgggacacccactcatttccaagcccgttcccagtaggagcagcttaaaaaatgtttcattttaaatgacttcatttggtggcaaacacaaaagcatggtaatttattcgtgctttaaggaaaagaatgtctctttttaaaaaatatcgttatttaagttcaggaactttctatttggaatcttgagatacgtttaaaaaatacccccttcctttcgaccttccttaaagaccttgtcaaaagctctgcatgatttgtaatctgctagtctccatgttaatatttgcagctgtgaagcttagaaaactctctcaggttcgcgttagtgaaatcttttgcaggagaagaaagtttctcagagcactgtggctttaggttaaaaggataaaataaacaaagtgaaaattaagtgtttccttttgggaacttgataccttggtataggcaccatctttgtgtacaggttatagcaacggtattaatcactaacacatgtctaaaagtctctttcccaaagtgttcacaatcggacgcagaggtggcagggcgggtgtggaatccttaccctttcccctaaaagcctcccacagaagcagatggtgcttgcctggcccttcctgccctttccctccaacccacaggcagcctcgctctgctcctcagaccccagggttcactcacctctggcagacacaggagccacagccttcgctctcctcgctctgcagttctctttcttcaaacaaaaattcaccttcactctccacagttgattttcgttacatttaggaggtcaagtaacttgccaagtgtctgcatggttcattcatccagagtagggtg

SEQ ID NO: 102751 - DNA, 788 bp, Homo sapiens
  misc_feature (650)..(650): n is a, c, g, or t
tttttagtagagacggggtttcaccgtgttagccaggatggtctcgatctcctgacctcgtgatccgcccgcctcggcctcccaaagtgctgggattacaggcgtgagccaccgcgcccggcctcccccatttctttctcttcataattctcatcactatctgtccatttctctgggccggtggtgctgtccacgtggctgttgaagtctcccacaggttgcaggagctgaggtgggcagcctgcggtgaatgctgtgccgtacctgcagggcatgaaggaaaccgcctgagatgcaggcagatggataaccccgcagaggaggagaaggcaggggttttgcaaagtgaagaagaaagagaatgttgcaatcagatggcttgaatctaaagaaatctacgatcagttggggatgttctggtgttcctggacagccactgtgaggtgaacagagtatggctggagcccctgctgcatgccattgccaaggaccccaaaatggtggtgtgccccctgatagatgtcattgatgatagaactctggagtataagccctctcctcttgtaaggggaacttttgattggaacctacaatttaaatgggataatgttttctcttatgagatggatggaccagaaggatctactaanacaatccggtcacctgcaatgtctggaggaatttttgctatacgtcggcattattttaatgaaattggacagtatgacaggatatggatcttggggaacgagaaacattggaactttcactaaggatctggatgtgtg

SEQ ID NO: 102752 - DNA, 303 bp, Homo sapiens
aggctttttacccagcctgtgagctctcccaaggctcttacctgcgcccatggctttgagctctttaggtactcattgtagatttaactctctcgctctgacctttgcaatctggtggcctgcctattacagcctcttgctgaaaaatgcctgctcactaatatctcagccacccaaactgcccattcatataacataattcaccacttcctcttgacccttctctaactacctgctctttgtccacacttccctctctctatccttgagaaacttttctgcccttcacccagactttttcat

SEQ ID NO: 102753 - DNA, 344 bp, Homo sapiens
taatctgatgggtgaacattatttatttttgtcttaatttgcattttcctgattaatagtatgactgcacttctttaaatatactttttagttcttcacacttaactcttctcagactggcagttcctatcctttgctcataattttattaaactttttgaaaattgatttagaggaactctatgtgctcttatatcaataatttttccattaaatgtgttttaaatatttctccaattctgtttcttggctcttaactttatttgcattatatttagccgcacataaatgtggaaacatttatgttttcattgttgttattagttttgatgttagttttcttt

SEQ ID NO: 102754 - DNA, 520 bp, Homo sapiens
gtttttcaaatgccaatgcagctcagttatggttttcagtctgtatggatcactagaccttggcatttattgaatattaatgcctcagatattacacatttggcactttggaaaacataggtggcattgaggtacaactgctgatacatttttatagacttcatacgtgattaagtaatgaagagtatttttaaaagcagccaaagaaacaatttttttttgcttggttttcaacacacctaactttttacttcagagtattagacttacaggtcgtctgggaggtttccattttggaagaaaaatttgttcactgtttcctgtattcaaaacatagtgctgagcactgtggaggatacagaggatgttagaggactttaggtgctgagtacttatacagagtaatgttaaaagaaacagctcaaacgttctgagaatttagaaaatgaaattctctactgagagtgtcattaaatagtcttggtacttttgtgtgtgtatatgtctgtgtttataaaat

SEQ ID NO: 102755 - DNA, 291 bp, Homo sapiens
  misc_feature (277)..(277): n is a, c, g, or t
gtttttcaaatgccaatgcagctcagttatggttttcagtctgtatggatcactagaccttggcatttattgaatattaatgcctcagatattacacatttggcactttggaaaacataggtggcattgaggtacaactgctgatacatttttatagacttcatacgtgattaagtaatgaagagtatttttaaaatgtatcagcagttgtacctcaatcctcctgcctctgcctcccaacgtgctgggattacaggtgtgagccactgcacctggncctttttatgttca

SEQ ID NO: 102756 - DNA, 868 bp, Homo sapiens
cctctcttgttgagacagacagacactataaataaggagaatacatagtatatagtttttagaatacatagcatttttggtagtgaaaattaccatggaggaaaggagtaccagggtaaggtggggttatgaagaagatcttactgctaatatgacatcaaattaaggcttgaagagagcaatcaagtcttatagcaactggggggaaaaggttctgaggtaggaatatgtctgataggtttcaggaatgtaaagcagctagtgaagctagaaaagaaggaagaggaagagaagtagcagttgagatcaaagagctaaagggaggccttgtaaactattgtaatgactgctttttattctgagtaacacaccactggagggttttagatgaagtgatctgatttttttcaaactaacaatttaattttaatattaccatatagttaatatacagtaaattcactcctgttagcacacagtcctgagcatgcacagttgtgtaaccaccaatacaaagtataaaacagtatcattatttcagaaaatcttcccatccccatttgtagccaactttattccattctctgcccaaccacggtcttctgtcttttttgattgttgcagaatgtcatataaatggaattgtatcgtacgtagcatttccatctggcttctttcactagcagagtacgttggatgttcatccatgttgtgtgtatcagtagtttgtctctattgctgaggagtattccattgtatgaatgtaccactgtgtgtttatgcatttcttgttcagttgagggacatttgaattgtttcaaaacttggtgattattaataaagccactataaatgtccacatatagat

SEQ ID NO: 102757 - DNA, 349 bp, Homo sapiens
ggctgcttgtgtcttttggctaaatatgcagcatattttaggggctataacaagatacgtttgaaaggccaataatttgttattaccatatggtagaaagaataaagaagttttctcaagattcccattcccaaattgtgtaatcaaacactcacccagatacttatgtgaagggactttggagacagaattaagtttaataattctgaccttaaattagataaggaacctgaatgtttctaggggagggggcaatatttaatgtaatcacacaaacccttaaaagcaaagcaggaaaacagaaaagttagagagaagctgttgaagatggaggcagaagaaagatgag

SEQ ID NO: 102758 - DNA, 667 bp, Homo sapiens
ctgttccaattgtttggcattttcctctaggttcacatgtagtttttatgttagatacttgttctcggtcttcactaactattctctctctttgctgtcatgtttttgtcctatgtctctgcactctgggaacacttatcacatttacccttgacattactcatttagtttaccataatgttaattcttctcttttctggcatattttaattctgtcattacattattagttattggtgttctttaaaaaaaattaatcccacctccaatgtttatcttcatagtactacttttctgggtagtttttgctcttgtttcataaaaattttatcttcttgtaaattatgaagactggctgttttattaaatttttcttctgttctctgcagtaattcactttctgggttctattcttctaacaaatcttcaagagggtattccactcttaatttctttttaatgtttagagacagagtctttctatgttgcccaggctattttcaaactcctgggctcgaacaattctcccacttcagcctcctgagtagctaggacttacaggtacacaccactgtgcctgtctaatttcgttttgatgtttttttcttaatgactcatttactctctaaatttccccagctccatgtactatccattttttgatgag

SEQ ID NO: 102759 - DNA, 177 bp, Homo sapiens
gttggctggcgggcaggctgggtatgggttgggtgctgcgtgggagaggcctcttacgcccaagggcctgggacaggtacctcccgcagttcctgccatctgcctcgcccttccccttctggggcagaggccagcacttactgagcacctacgatcttccaggcacagggtcttcta

SEQ ID NO: 102760 - DNA, 438 bp, Homo sapiens
agtggataacggcactacatttttaaaagacagggtttttaaagaaaaccatttaacatccattccaatataacatgtttaccatatctaaaaatttgaatgtcatattgcatttttcataattcattagaaatgtcaggtatgtgcctgaaaatttgtgcaaataagcattagataacagatttctctactcatgtgttattagccatttctatatatataataatataaacactgatgttttaatgtctcttaatttttgtacttgatttttttaggtaacatgtaattataaatgtactttgatactactaaagtaaccagatgttgtttgaaaataaattgttttctttagtgcattgacaatattttacaatactttttgtgattatttatttgtgctcccgtgtaattataataaaagcaatagtttaaatt

SEQ ID NO: 102761 - DNA, 686 bp, Homo sapiens
tcacaaatttcaaactttattcattttttttcttctcttgaatttaactctgtctctttgtaacctcatttattggtcctagttttgtcctctgcaggtacatagcagagtgtgcatgcctttccataggatatataaagaaagaatgtgttatcttaataataaggaatacttattaagtacgaaccatgtgctcggctctattctctgcttacaaacatggcctcatccaatcactgtaatcctattggataattcctattaatgtcctgattaatttaatattagaggcagccgagtcaggctctgaactctggaggttccatgccagagcccatactgtaccacttctcctaccttacctcttctttttctttttaaccctctgagatctagacatcccccgctgtcagtaagttatccaacaacagagtcttcatcactttctcttgttcatccatggtcattgttatttgtctggcttgaggtcctcctattccaggtggtcacactggtgatgcactcagtcaggttgtagatgagcaggtaggccaagcatgtcactcctactatgcataacattgagtcattagtcagccttctttgggcttttcattcactgtctcccttggtgagtgagcctttgtcaaatgtttgcagattcaaaaacatagttttcttcttcc

SEQ ID NO: 102762 - DNA, 762 bp, Homo sapiens
cccggagtctatcccgccctcctgtggggcagggcgtgctgggccctctgcaggtcggcgggtgacagcttgcgccctttcgcgcagggactcggccaccatgaggaggggtcaggggctcaggattcggagaccaggcagcctcattagccttaagcgcctgccctgagacagcctgagaggagcaagagcttctccaaggatctcctcgtgaattcagacctcggaaataatgaaaacatttatatttccagtttttatctagaattctcaaaagtatcgaagctattgcaattcataatctgcctcgacataatttcgaaatcaaaggaacaaaaacaacttacctgaaaaagtaggtctcggcccgctggtaatgtccaggtgtgagtctgaggggagggtactcggtggccaggggtctcaccatgaacaagcccatggccaaggccacgaagaggactggcagcagcaggtcggcgagggtgctcttcccggcgcgcagcgtgcggcggagcctccgggccaggatcgcggccacttgtgcgcggagcagctggacgccctgcacagttgcgggccgtgctagggagccacctgcaggacgggcgggaggaagggcggctgggtcagctctgcggaggtgacagcgctttgcctcgtttgccctctcggtgaccctgcggcatctcgcagccatgggaatgcgacgcaggcccaccccatgaggactcccttgagtgtcccctttatgcacctaaa

SEQ ID NO: 102763 - DNA, 328 bp, Homo sapiens
ccagccagaggctgaagctgtccttggctctaggtttagaaatctttcaaaaacattgacaatcttgttttagcaggtgggagaggacagtagggagcagacaaagctaagaagagaggagtctgagaagtgtccagctagtgggagagaagggaatgataactgattaaaaatacccacctcatggggttggtttgattattagaaatatgcatgacatggaggaatataattttaattgtaaatagttacaaatgcactgaataaattgccattattcaaaagacagcagagccctggtgagatgttaaatacaaaacatgacaaa

SEQ ID NO: 102764 - DNA, 731 bp, Homo sapiens
agtggcaacctgctcgggtcccattccacactatgggagctttgttccttcactctttgcaataaatcttgctgctgctcactctttgggtccacactgcctttatgagctgtaacactcactgcgaaggtctgcagcttcaccacgaacccaccgggaggaacgaacaactccagatgcgccgccttaggagctgtaacactcgccgcgaaggtccgtggcttcactcctgagccagcgagaccacgaagcccaccagaaggaagaaattccgaacacatccgaacatcagaaggaacaaactctggacacgccacctttaggaactgtaacactcaccgcgaggatccgcggcttcattcttgaagtcagtgagaccaagaacccactaattccggacacacagggacagcaatccactgcttgccttgatgtacgattgaagcctatcaccccttctgcagcagtggctccagtaagtctttcaaactttgtggttttgatggagacaaatgagacatcaattcccccaatttcctttgagggaaaagaagtttcctttgtaagttttccttcaaaagccagccacagggtctggtttaaggaatctgcctaataggagttctgttttactggccacttgttacataatctagcaatcagaagctaaaagaaaagactgtgtgtatgggtcttaagaagataacacatgctgggtgtgatggctcatg

SEQ ID NO: 102765 - DNA, 472 bp, Homo sapiens
tcccctctcccacctcttcacactggaatgccataggcctccatccttgctcctcctctttttctctgttgaagctgaaaaaactcaaactgctctcacaccacacagcaacaatcaatacagaagacttctgtgaccagaagtgtggagatttcttcccaccaacaagcaagcaatcaactctgcagcagactgcagctgggtgtcctcccaactaaattcaaacactatctacctggagatagcatcagatcccacagattgagggctcagtcccacaaccctcacctcttcagacaccagtcataagtccaggccgctgaaacttctgccaaccaactacaaattggggacaccacagcctcttcctctttggggttggttaatttgctacagcagctcacagaattcagggaaacatttacttatgtttaccggtttgttacaagagatattacaaagaatatagata

SEQ ID NO: 102766 - DNA, 131 bp, Homo sapiens
tgctggtgatctagaggatcccgagaagatatcagaaggaaaaagcaaaacaaaaggaaatcaagatgagactagccaaaaaagtacagtacttgagttacatctggaccagagtaagtctttttgatgat

SEQ ID NO: 102767 - DNA, 886 bp, Homo sapiens
ccatgtctgtcctgtctgaacttcggtgactcttcacaaaatagtacggtaagaaaattatttccatccatttcaggcttttgcagactttctgcattaacagagttaggggtaacaggcttagcatcctttgcatatgagagcctttctagccgccatggctggcaggttgtgaagggtgcctactgcaccctggcctgtcctggggagcctagacacgagctctgtgacagccatgctcctggggctgctccctactcctgtttttagaaacaagcatataattacttcattgataacagtcacagtggagcctagcaaccgatgaaaggaaatagagaaagaaaaagagaaagcaggaaaagaagggtgggatgattttttcctgtagggtggagttcatttccatggcttgattttcacacaggagatggtgttgtataattctgttggaactttcttttcagcacaattaagaattataatcaagtaaaatgttttccatttaatccaacatatgttaatttctttttgaattttaataaagttccttatttttctcaaaattgactgctgaatatctgacagcataaatcaattgtattctaaaaaagggaagagagaactagaatattgtactagatagaaaagatgcattataaactttctaaggttaggtattttagtaaactagtgttaaaatgatttttacctttcgtgttcttcttaagaaacatattttcagtatagctcaacacttacagtcataagtgtatgtatagttcttaacttgcagaactgtttcctataacctaacactcatcacacttaaactttttatttttttaattttttttcttttttgagatggagtcttgctctgttg

SEQ ID NO: 102768 - DNA, 695 bp, Homo sapiens
gcattgacttactagttgtgtacctttgcattgtgtcatcatgtagaaacctcacagcagccctatgagcttgagcattgctaccccttatctacttcgcaggtgataaaactgacaataaatatcaattttatattttgcacaggaaaaaaattggagtggttcttaaaagccacgctgggcttaaatgccatgctagatccctctctgtgatgacctggcttcaggtttcttcctctgttcagtccttagcacaggcagctgtttcatgctgcccttaaagaactgagggcttgtggtttcaaagtggtctaggctctaagggccatcctcaactatatcatggcacatgcgcaacattgcccagctgctccagagcaaagggacaactccttctaagggcagggggtgcccacttccaggagaggtgccttcccaaatgggaagccacttgtggccacacatcattgagctccaagggtagcctgttgagggtccttaactgacgaccgttgtgcactggaggtggccaaagaaaggcatttgcagaatgtggacgtgtaagtgggatggcttggaaatgatcttaggtaaaggtaaatgcatgctttggatatttggatgtttagtaacctcttgaaggatgattccgctagctggccctaatatgtcactttagttcttgcttatattta

SEQ ID NO: 102769 - DNA, 370 bp, Homo sapiens
tcgttggcccaggagcagttattgcaacccctctgggtgccaggcagtcagttggcactacagatgcaaagatggtgagatacagcctctgtccttagggagaccagggcaaggggtctgagagcccacaggccagggcattccccatcatttttacagagagagctgtggaatagttaagagcacaacacgctggtggctgaggctgggggctggtgtgctggcttctccacctagccatcatgtgacttggggccaagttctgtgattttctgtgcctcagtttcctctgaaatgaagtcatcgtgttacctccctcacagggttgggatcaggcttcattgagttgctgtaagtacagcactcgaag

SEQ ID NO: 102770 - DNA, 385 bp, Homo sapiens
aaatgtctttaggaaaccacaagagaagtataacagaaaatgaaagtgtagacaaagtagacaacaagacaaagatgggatgaaaggaactttagtgctaataaacatgaatgacgagagtttctctttatctagcacctatcatgctgcatatacattttctataatattcacagttttctgaggctggtaggaacacatctgtctcataggtgaagaaattgaggttgagtggagttaaagaactggtccaggctgggcacagtggctcacgcctgtaatcccagcactttggaaggctgaggcgggcagatcacttgaggtcaggagttcaagaccagcctggccaatgtggcaaaaccctgtctctactaaaagtacaaaa

SEQ ID NO: 102771 - DNA, 317 bp, Homo sapiens
taagacggagtcttgttctgtcccctaggctggagtgcagtggcgagatctcagctcactgtaaactccgcctccagggttcacgccattctcctgcctcagcctcctgagtagcggggactacaggtgcccaccaccacgcccggctaattttttgtatttttagtagagatacattattttttgtaccctatgggggattgaggggttgttgctacatagccccctcaatttgtgctgtagcaatatgcagttaagatccttattctaatgttaaatgtctcttctgtggcttatcctaactttaaaaaaaaaaa

SEQ ID NO: 102772 - DNA, 429 bp, Homo sapiens
gctgtggtgggctctgcccagttcgagcttccccagccgctttgtttacctactcaagcttcagcagtggcagacgcctctccccctactaggctgctgcctcaccggttgatctcagactgctgcgctagcagtgagcaaggcttcttaggtgtgggacctgctaagccaggtgccatttgctaaggccattggaaaagcgcagtatttgggcgggagtgtcctgattttccaggtacaatctgccatggattcccttggctgggaaagggaattccccgaccccttgcgcttcccaggtgaggcaatgccccaccctgcttcggctcgccctctttgggctgcactcactgtccaaccagtcccaatgagatgaaccaggtacctcagttcgaaatgcagaaatcactgtcttctgcatcaatccca

SEQ ID NO: 102773 - DNA, 398 bp, Homo sapiens
gccacaaccctgcacagagatgtctgcattccacaggcagatgtcaacgcccaggagtacgtgcagacataaatatgcactatacgcgtgtgcagagatctatatatacaccacagattcacagctcatcccaaatcatccttagtgggcttatcctaaatatagataataaattcatgttaataatagctgagacctttaaaatgctctgaaggaaaacacacacacacggatgaacacacacacacacgtatgtacatgcacacacacacacacacagagccacccttatgcattcctgcacgctgatccactgtggttttctggtttccttatccctggggggaaaattttgtcaaaaagatacacccaagaaatgtaagctaaacactgacaga

SEQ ID NO: 102774 - DNA, 815 bp, Homo sapiens
aaggatggaaatgtatttgaaataatgaaagagtagcatttatcatagaacaataattgattgcactatttcataaatttgctatttgttctcctctaccatgaacaggagtttctggctgtacacacataacatgtatctctttgaagctgataccatcatgcatatattttttgctggtttatcacttgagtttttctgtatcaccgtacatattttccacctcttcattatggcaagggtccatatctcctccaattttatccttggtattcaggatattgttctagtcaaaaatctctacttcatgactattgtgaactataaaaaaaactactgtgaatttttgtgtgaaaaatcagaaaactaagttttaaggtctaatttcacttggatttgaatctgtgtgaatcacagattccataaatatcgcgtggaaagtatagctgactctggccttcctcaccttccaggctgatggaagagcaaagtgagtcatagattagaacgcagtttggaagtcaaaactttttataacccatgtacgggctgatactttcatgagtctggttgagtttcctagaacctcttggggtaggcacgtctcaatttctgtctttatagtgattgtctactacagaatccccaaagggagagaccctctgggcaactcatggtcctgaagtagactacacagtgttgcacagttgcaatagaggcataatagatgaatatttattggaattccctccctcctccttactgtgtatttcaatcctatttgcccttcaaaaccattccaagagcaccctttt

SEQ ID NO: 102775 - DNA, 357 bp, Homo sapiens
tctattgtcagaaggcctggattcaggttcaaggcctggttcttagtaattttgtgaccaagcaatcgctgaggtggctgggcgtggtggctcgcacctgtaatcccagcactttgggaggccaaggcgggcagatcacgaggtcaggagatagagaccatcctggctaacacagtgaaacctcgtctccactgaaaaatagaaaaaattagccaggcctggtggccggcgcctgtagtcccagctacttgggaggctgaggcagtagaatggcgtgaacccgggaggtggagcttgcagtgagccaaggtcgcgccactgcactgcagcctgggtgacagagcaagactgggtctc

SEQ ID NO: 102776 - DNA, 367 bp, Homo sapiens
catagtatcattttagtaggtgttacctccttttaactcctgaggaaatggtctcagaaagatgtagcaattagctttaggtcatagctagtaagtagaagggcagaccctcaacctgaggcttcctgaagcctgagcctaggctccaaccggcagctgcattcctgcacacctggcccagcaggagaagggcagctctgcatgcctccctccacagcagcctggagctggctttgtggccctgtgagaacacaaagctctgcccagcgcctcgctgtgcctgctctgggccctgtagtgtctgtctccccagtccctgcccctctcacctcccagctcaccagaggccccctttacttagcctccc

SEQ ID NO: 102777 - DNA, 141 bp, Homo sapiens
acagagattttgttcatgtgtttaatttttttgtatcaatatgaggatcgaaggattttagaactccttatagaaaatattcttcaaagaatatccagggctgaaagcataaaaagttatcacatagtgttaagtggctgg

SEQ ID NO: 102778 - DNA, 2345 bp, Homo sapiens
ggaagtggatcgtgcggagcaagcatcacaccatggcgtatgagtgttcctctgtgtagactcaacctgcgcctcgccgtcccccattcgcacacccgatgcccgggggtcgctacggacttaaaatctccgcaccgcaccctccacctcagatatctcttgtaaatgtgtaaacacggatttgccaccaaaggggaagaacaatatgggagaagcgttctacacggtgaagttggagagacttgaaagctgtgacactgcaggcttgtccttccaggaagttcagaaaaatacatacgactttgagtgtcagtggaaagatgatgaaggaaattataaaacagtacttatgttgcaaaaagaaaatctccctggtagaagagctcaacgtgatagaagggctgcaggaaacaggcatattgaaaatcagcttggagtaagctttcagtcacatctccctgaactgcagcaatttcaacgtgaagggaaaatttatgaatacaatcaagttgagaagtctcctaataatcgaggaaaacattataaatgtgatgaatgtggcaaggtcttcagtcaaaactcacggctaacaagtcataagagaattcatactggagagaagccttaccagtgtaataagtgtggcaaagcctttactgttcgttcaaacctaacaatccatcaggtcatccatactggagaaaaaccttacaaatgtaatgaatgtggaaaggtcttcagtcaaccttcaaaccttgcaggtcatcagagaattcatactggagagaaaccttacaagtgtaatgagtgtggcaaagcctttagagcacattcaaaactaactacacatcaggtcatccatactggagaaaaaccttacaaatgtaaggaatgtggcaagtgcttcactcaaaattcacaccttgcaagtcatcgaagaattcatactggggagaagccttacaagtgtaatgagtgtggcaaagcctttagtgttcgctcaagcctgactacccatcagacaatccacactggagaaaaaccttacaaatgtaatgaatgtggcaaggtcttcaggcacaattcataccttgcaaagcatcggcgaattcatactggtgagaaaccttacaagtgtaatgagtgtgggaaagccttcagtatgcattcaaacttaactaagcatcagatcatccataccggagaaaagcctttcaaatgtaatgaatgcgtcaaggttttcactcagtattcacacttagcaaatcatcgaagaattcatactggagagaaaccttacaggtgtgatgagtgtggcaaagcctttagtgtgcgatcaagcctaactacccatcaggcaattcatactggagaaaagccttacaaatgtaatgactgcggtaaggtcttcacacaaaattcacaccttgcaagtcatcggggaattcattctggagagaaaccttacaagtgtgatgaatgtggtaaagccttcagtcaaacatcacaacttgcaaggcattggagagttcatactggagaaaaaccttacaagtgtaatgagtgtggcaaagcctttagtgttcattcaagcctaactatacatcagacaatacatactggacaaaaaccatacaaatgtaatgattgcggcaaggtcttcagacacaattcgtaccttgcaattcatcagagaattcacactggtgagaaaccttataagtgtaatgagtgcggcaaagcatttagtgtacattcaaacctagctacccatcaggtcatccatactggagaaaaaccttacaaatgtaacgaatgtggcaaggtcttcactcaaaactcacatcttgcaaatcatagaagaattcacactggagaaaaaccttataggtgtaatgagtgtgggaaagccttcagtgttcgttcaaccctaactacccatatggcaatccatactggagacaaaccttacaaatgtaaccaatgtggcaaggtctttactcaaaattcaaaccttgcaaaacatcgaagaattcatagtggatagaaaccttacaaaggacgccgggcgtggtggctcacgcctgtaatcccagcactttgggaggccgaggcagggggatcacctgaggtctcgagttcgagaccaggctggccaacacggtgaaacgctgtctctactaaaaatacaaaaattagctgggtgtggtggtgcacgcctgtaatcccagctactcgggaggctgaggcaggagaatcacttgaacctgggaggcggaggttgcagtgagcgagatcatgccattgcactccagcctgggcaacaagagtgaaactccatctcc

SEQ ID NO: 102779 - DNA, 622 bp, Homo sapiens
cataaccctctgatattatatacttcagcataatcagaagtccaaatgtgttaaaactcattacatgatacatatcaaaggttgtaggatgtttggaaatggccaattactttcagcttataaaatgttttgttgaagtatttaagatttattgaaaaggctactatttataacttccaaccagaactttgcaatgtgctgattttatacatgattatacgcctaacatggtgttgttcgggaaagaatcaaaggatggaagggctcactcacttcattaggtgaggattatttctctccaagctcctgaagaaaaaagactctgccttttaaaattaaatatagtctgaattagagagcacttggaaagggcagaggatgatgaactatgatgtcactcatcatccttattgcactgcaggtgcccttcttctgacagaagagcaccgtgcccggccggccgagcataagaagtttaatcaaagtaaccagaatcccatgtttgttactaggatttacattaactgctggaatcacattttgctactatttaagaatgcatcatagatttaatgttttaactaataaaatttgatgtattttataagtatgaatgaatcat

SEQ ID NO: 102780 - DNA, 727 bp, Homo sapiens
cataaccctctgatattatatacttcagcataatcagaagtccaaatgtgttaaaactcattacatgatacatatcaaaggttgtaggatgtttggaaatggccaattactttcagcttataaaatgttttgttgaagtatttaagatttattgaaaaggctactatttataacttccaaccagaactttgcaatgtgctgattttatacatgattatacgcctaacatggtgttgttcgggaaagaatcaaaggatggaagggctcactcacttcattaggtgaggattatttctctccaagctcctgaagaaaaaagactctgccttttaaaattaaatatagtctgaattagagagcacttggaaagggcagaggatgatgaactatgatgtcactcatcatccttattgcactgcaggtgcccttcttctgacagaagagcacgtgggtatgggaagaaattctctactggccgggcacagtggctcacgcctgtaatgccagcacaccttggcctgccaaagtgctgggattacgggctggagccaccgtgcccggccggccgagcataagaagtttaatcaaagtaaccagaatcccatgtttgttactaggatttacattaactgctggaatcacattttgctactatttaagaatgcatcatagatttaatgttttaactaataaaatttgatgtattttataagtatgaatgaatcat

SEQ ID NO: 102781 - DNA, 2260 bp, Homo sapiens
ggaagtggatcgtgcggagcaagcatcacaccatggcgtatgagtgttcctctgtgtagactcaacctgcgcctcgccgtcccccattcgcacacccgatgcccgggggtcgctacggacttaaaatctccgcaccgcaccctccacctcagatatctcttgtaaatgtgtaaacacggatttgccaccaaaggggaagaacaatatgggagaagcgttctacacggtgaagttggagagacttgaaagctgtgacactgcaggcttgtccttccaggaagttcagaaaaatacatacgactttgagtgtcagtggaaagatgatgaaggaaattataaaacagtacttatgttgcaaaaagaaaatctccctggtagaagagctcaacgtgatagaagggctgcaggaaacaggcatattgaaaatcagcttggagtaagctttcagtcacatctccctgaactgcagcaatttcaacgtgaagggaaaatttatgaatacaatcaagttgagaagtctcctaataatcgaggaaaacattataaatgtgatgaatgtggcaaggtcttcagtcaaaactcacggctaacaagtcataagagaattcatactggagagaagccttaccagtgtaataagtgtggcaaagcctttactgttcgttcaaacctaacaatccatcaggtcatccatactggagaaaaaccttacaaatgtaatgaatgtggaaaggtcttcagtcaaccttcaaaccttgcaggtcatcagagaattcatactggagagaaaccttacaagtgtaatgagtgtggcaaagcctttagagcacattcaaaactaactacacatcaggtcatccatactggagaaaaaccttacaaatgtaaggaatgtggcaagtgcttcactcaaaattcacaccttgcaagtcatcgaagaattcatactggggagaagccttacaagtgtaatgagtgtggcaaagcctttagtgttcgctcaagcctgactacccatcagacaatccacactggagaaaaaccttacaaatgtaatgaatgtggcaaggtcttcaggcacaattcataccttgcaaagcatcggcgaattcatactggtgagaaaccttacaagtgtaatgagtgtgggaaagccttcagtatgcattcaaacttaactaagcatcagatcatccataccggagaaaagcctttcaaatgtaatgaatgcgtcaaggttttcactcagtattcacacttagcaaatcatcgaagaattcatactggagagaaaccttacaggtgtgatgagtgtggcaaagcctttagtgtgcgatcaagcctaactacccatcaggcaattcatactggagaaaagccttacaaatgtaatgactgcggtaaggtcttcacacaaaattcacaccttgcaagtcatcggggaattcattctggagagaaaccttacaagtgtgatgaatgtggtaaagccttcagtcaaacatcacaacttgcaaggcattggagagttcatactggagaaaaaccttacaagtgtaatgagtgtggcaaagcctttagtgttcattcaagcctaactatacatcagacaatacatactggacaaaaaccatacaaatgtaatgattgcggcaaggtcttcagacacaattcgtaccttgcaattcatcagagaattcacactggtgagaaaccttataagtgtaatgagtgcggcaaagcatttagtgtacattcaaacctagctacccatcaggtcatccatactggagaaaaaccttacaaatgtaacgaatgtggcaaggtcttcactcaaaactcacatcttgcaaatcatagaagaattcacactggagaaaaaccttataggtgtaatgagtgtgggaaagccttcagtgttcgttcaaccctaactacccatatggcaatccatactggagacaaaccttacaaatgtaaccaatgtggcaaggtctttactcaaaattcaaaccttgcaaaacatcgaagaattcatagtggatagaaaccttacaaagtgctgggattacgggctggagccaccgtgcccggccggccgagcataagaagtttaatcaaagtaaccagaatcccatgtttgttactaggatttacattaactgctggaatcacattttgctactatttaagaatgcatcatagatttaatgttttaactaataaaatttgatgtattttataagtatgaatgaatcat

SEQ ID NO: 102782 - DNA, 393 bp, Homo sapiens
ccaaggtctagcctgcagagttccatgtcacatcttcagagaataaataccacaagacagacacagacataatacatgcctgataaaaaacaaaggaagttcaactcccacaaatagccctgttgacttgtaccagaaaagcatctacttccttctcctttcaccataaatgcaaataggtgtttgtcactaagagtaggacacaataaaagaaagtaacaccagagggtgcggtggctcatgcctgtaatcccaacactttgggaggccaaggcaggcggatctcctgaggtcaagagtttgagaccagcctggccaacatggtgaaaccctgtctctactaaaaatacaaaaattagccagtgtggtggcgggctcctgtaatcccaacta

SEQ ID NO: 102783 - DNA, 587 bp, Homo sapiens
ctaagcaattctgtcctctgattcccacccctacccaccaaaaaatggtagacatgaaaggcaggtgaggaaacagaaaaggtctctttgcagatatatattttttaaatggcactatgtagtaattaagagctaaggagacagaaagacagtagatgagaatagaagagtacctgtacctacaaggggaaaaatgaatgcaattctttatttgataagagtgaactgaaagagaatattattttccctacaataaagcaagctgtcctctcacaggataaagtggaattctgacatggattatggacttcttctaactcccattgacattgcttcttaccagacatggggaaaagctacctttcctgaaaggggaggagggcactgtcctttcagacaaagcttgtacaaattcctgaaccgcaaatttgctgaagtgaccgtatatattatattcataatttaaatgattatttatggtcagatacatattgttaaacttgaaaatgttttattacattacatcaaataaagtttatttgtagctgaaataaagcaacgtaagtaacaatttttaaaaaaaaaaa

SEQ ID NO: 102784 - DNA, 726 bp, Homo sapiens
caaaacttctcagacaccgagttgtagaaggaagggctttattcagctgggagcatcggcaagctactgccttaaaatccgagctccccaaatgcacaatttctgtcccttttaagggctcacagcactaaagatttcacatgaaagggtcgtgattgatttgagcaagcagggggacaagagaatgattcaacgaagaatgaaataaaaattgaaacagaatcgcagagctcatatatggaaacagaagaactttcatcaaaccaagaagatgccgtgattgtggagcaaccagaagtgattccattaacagaggaccaagaagaaaaagaaggtgaaaaagctccaggcgaggacacacctaggatgcctgggaaaagtgaaggctccagtgacctagaaaatactccaggtcctgatgttgaaatgaatagtcaggttgacaaggtaaatgacccaacagagagtcaacaagaagatcaactaataggggcacaagatgaagcgaaggaacaaagaaatggaactaaatgacaatcctcagcatcgcaaggcctctcctggctctgggggagctcgggaagatagcagcacacgctgtggaggagggtgggggtggggggaaggcaagtcccatggaaggacggggaatcctttactctaatttctccagctgcattttgttccgtttatctgcagaaaaagaaagaaaaaaaagaaaaaaaa

SEQ ID NO: 102785 - DNA, 340 bp, Homo sapiens
aggtggtctgtactctggtgttttcttctgacctcaaatcccaacaggttcagagacagagcaccaaagggaaaggaaaggactgggggtcttgatagcaatgtccctgactgattacctgaatcagcaaaaaagctggacagattctattatgaggagttactcattgggggtggcacctgtcaggctggaaggaatggggctctgaattgtccccagcgccacgtgcaccaggtgcgcccatgctgccgcgctgccaccgaccctggagcaattccacctcccagcctactccagccttccgcagcagccctgggtcttccttgtgagtccaaggcta

SEQ ID NO: 102786 - DNA, 255 bp, Homo sapiens
gtcactaactcctgcttcggatgggcaaagcccaggctgtgtacctgtgctctgactgcaagggagcctgagaaggcgagtgtctggctgtttagcttcggaagtgggaggcaaactcttaaaagtagggattctccaacataggaagagggttcaagtactaggaagtcaaaaatatgatttgtattccagggacctatgtgattgtgagggttgagaaagaagatattgagattctctgagataccaatcaag

SEQ ID NO: 102787 - DNA, 690 bp, Homo sapiens
cttcccagtctagggtatatttttatcagcaacatgaaaacagactaatacagtaaattggaaccagcagagtggggcgttgctgaaaagatactcgaaaatgtggcaactcaacactctttatcaagagcaatctgtgaattttgaagaaagaacagacatcagaaaaaggaaatctccatctaaagataaattcacctaaaattgcctagaacatgatgaaaactcatgctttgctccctggctataagcatttctcttggggtggttgcacattttactttctggcttcccaccgctaggatgcatgccacactgaacttaaattccgtgactaactgccatgcacagatgtcctggagacgaatacacaccagaaaatatgccaagtatcaaattcacacaaaacattatagaactagcaaatatttgctgcttttggctgtgttggaaattatcttctgtgagataaatcttttggctaaaatatgatttttaaagattctcaaatgttcgagtcttcatttctgcattaattaaattaagatggagccagcgtctctgagaaagctcacaagctcttaactcacgaggttgctccgaagtatctcactctgtttttactcatcctcctgcgtggcaaggaagagaaagagccaataaataaatgaaataaacgaacagtccttc

SEQ ID NO: 102788 - DNA, 365 bp, Homo sapiens
ggtccgtcatgggcatgatcaaaatggcactacagttgctgagagccagggtggctgcagtaacggcagcgacccctgctcccatgcctctccctatgtcctgagggttttccacacttcaaggcttgacactgcagccctaagcctccagagacctggagcttctgcccacttctgctcaaattactgtgtgatctggaggaaatcacttaagatccagggcctctagttcatctgtctgatgaagttgttgaaataattggtccctatgggtctaaaattaaatagtctaggccaaggctttagtgagttttctgcaatttttcagaccccagggagaagccaaagaaagcaagtccaggggc

SEQ ID NO: 102789 - DNA, 389 bp, Homo sapiens
ctcctgcctcagcctcctgagtaactgggactacgggcacatgacaccatgcccggctaatattgtatttttttattttttatatttttaacgatggagactctctatgttgcccatgctggtcttgaactcctggcctcaagcaatcctcccacctcagccacctaatggcttatggattacaggtatgggccactgtgcccatccctgatatcttcttttaaaatgctacctctgggaggaggtaagaaattaactgaatagctttactaaatgtcttttgtcaaatatagtagagccgaaaaatataccagaacctaagtcaaaaagttcattgtaaaggaggaaatatttttccccaaaattaaagccataactggcaattctta

SEQ ID NO: 102790 - DNA, 260 bp, Homo sapiens
gtgaggagtgcctctgcccggccgccacgtctgggaggtggtgggcacctctgccgggccgccccgtctgggaggtggggggggcgcctctgcccggccgcccctcctgggaggtggggggcgcctctgcccgaccacccggtctgggaggtgaggggcacctctgcctggaggagcgcctctgcccggccgccccgtctgggaggtgaggagcgcctctgcccggccaccccgtctgggatgtggggggcgcctctgcc

SEQ ID NO: 102791 - DNA, 377 bp, Homo sapiens
gtacatgattaaccctggtttgacaattgatgttgatagctaaaagtacttattcaggatatgaggaaacatgaataaggattgaaattaaatatggatgaatgaatgaatgaacgtttttagtacaacgtgtaccttaatttttagaatagtaaacatgaaaagccataaacttgaatgcatgcactttttgtttttcttttattttaggctcgagggtacatgtgcagatttgttacatgggtaaatcatgtgtgacgggtttggtgtacagattatttcatcacgcaggtaatgagcgtagtactcaataggtagtttttccatcctcatcctcctccctggtcctaccctcaggcaggtgttggtgtgttatt

SEQ ID NO: 102792 - DNA, 158 bp, Homo sapiens
tagagtgcagagagcccaatcttgttatcaggtcagcagcggccatgggggtttttctccatcctccctatcttcacccccattttttgtttgtttgtttgtttttgagatggagtttcactcttgtcgcccaggttggagtgcaatggcgtgatctc

SEQ ID NO: 102793 - DNA, 410 bp, Homo sapiens
tagacattctgaagtaatttatcttttgaggaataccgtgactcagggaagagacatgggggtgcatatgctctaccttgttttgtcttcgaagcatctttctagaaagctgcatatcatcacagagtcaggggccttgtgaaattatgcaggcaagcagaaatgaggaaaaaacagcttctaacatttgttactttgtctcacacttcctatttcattgagaaaatagaaaaaggtcagcccatccacctgccccctccaccacctacctgctattgtgctcatatacttggccttccacctgccaccacgggacaggtgtctgggttcctatcgaggccacctgtgcgctagctcacagtcatcagcagtcattcagccttgacacatccaaaactgtgggttgagtt

SEQ ID NO: 102794 - DNA, 357 bp, Homo sapiens
agaaaagttgctaatattcaacagtcaggtgcctatatttagaccactcaatcagtccagtcgatttgttcattcaaacaaaagatctttgattatctgaaaaaatccatttctcctcactgccccccagaacagcacggtgctgtttgtttctagcttcagagcctagttgagtagaggacaaaaaaggcatggagacattgaaatagcaactggaactttgagaaattgtttctcactggtgtcactcgattctcagtttattttaagcctgaagaacttctgtagtgtgtttttggtgataaaaatagactatctttaactatctgccttagcttacagcatacctgttcttaa

SEQ ID NO: 102795 - DNA, 153 bp, Homo sapiens
tggaggcaagttggtcccacatggaaaggaggaagcaggtgtgtgggtaaggtggggaccgggtctgaagccaggctggccctagcccttccctgggcagacactttcctgtcttatctctctgtaaaatgaggagccattcattccttcttc

SEQ ID NO: 102796 - DNA, 573 bp, Homo sapiens
tgttgagaaccagggaaacacgctctgacagactgttaggggaaagctgagatgcaacagccaggaagaccaaggaggagcaccaagtctgaggggtcagatacaggcttgagcaaggagtgatgcatttgaaaatttgcagttggaaggagcttgaagagaaagaatgaggaacaggaacagcagtgacatccattaacatccattaaagtctgttggcttctttgattgcagcactcagtttcgggtaatgaggagggtctggggatattttgcccttatcttatagtgggagaggaagggatgagggaatggggctgggttataggacccaaaactgtacaaacagatggttggatctggtcatggtgggatagagctgaggcttgcagccacaggagaaacagcacagtcagaaagacccattccatctagctagtgatacttaatactcatttcccttgtgtattaaaggtgttaacgtcaggatactagctctacttcttggggctgttaaaagccattgaagtaaagtgtgtaaaatcttggcaccatgcaggcataatacatgtc

SEQ ID NO: 102797 - DNA, 191 bp, Homo sapiens
gtgcagcaccgttttgaatttgaataccagaccaaagtggatggtgacataatccttcatctttatgacaaaggaggaattgagcaaacaatttgtatattggatagtgtgtttgcatttgttttactggattctgccaataagaaagtgtccctggacagagatacataaagagtcagacctttgtttaa

SEQ ID NO: 102798 - DNA, 167 bp, Homo sapiens
ggagatgtttgaaaaacaaacatctgttttgctcctagtgggcctagtaacactatgtcaagcttgattgagaagtaagttatttttaccaaaaaaaagtcctataaaataaaaaatttacataggtaattttctacataattgaagcttttagagcctttttcctg

SEQ ID NO: 102799 - DNA, 213 bp, Homo sapiens
tggtagagatgaggtctcgctctgttttccaggttggtattgaactccttcccacaaacgatcctcctacctcagcctcccaaagtgctaagattacaggcgtgagccaccgtgcctggccctagaatcttctcagaatagattgggccaatacttgccttggattttatttaaacttatgaagtacataaagaagatcgatagggacatatt

SEQ ID NO: 102800 - DNA, 323 bp, Homo sapiens
gtaacggagtgatggggtgggggctctgcctaacttcagggctggatgaggggagtctcagttccccaggggtccttgggaaagataagggacttgacattttagggtttttaggtgattattctgctgatgggggtttgtgtgaagtgacctgggagctaactgaagttactctaacctcccaatacctttacccaacccccaagctggctgtatctgggaatatcagtttccaaaattggaggcttaggactccgtttcggggctccccagaagggtagggcctgttctgcctccttctcacaatcaccaggggcaggggc

SEQ ID NO: 102801 - DNA, 412 bp, Homo sapiens
agttatggagattacagtctcagtgtaggcatctgcaggagcacatgtcgggagtaatgtctgtcagagggagacattgctccacctgttccttcgaggcaacggagaggcaaagccaccgccagcacacacagtgactggagcaaaaaaggatttcaaaaaaaagaactaaccacaaaccaatgactcatcagccaaaacaataggctagcgacacactagtgtccacaggagtccactactaacaacagtatacactatcaaacgggtacagagaacaaactaagacttaaggacacccaagacatctgtgtgctgtgtatgcagtggagagatacaaagacataccaggtactaagacacaaaagcccagcctaaattctcccctcacaacatcctaatgctcagcatc

SEQ ID NO: 102802 - DNA, 939 bp, Homo sapiens
ctagaagatggattttaccatctagacctctctggctaatagctagtcttcaaccatctgacataggaatttacttcttttccttgaatggagaacactttaaaaataataacaaacattattataaactaatatatgtgagagtacttagttgaaacaaaaaggagttttagtagacagtattatactacatttgaaaatcaaggagcagtttatgcaacgtaaaatgtttacaaactgcagcgcaatctactgtttgtgactgtcaaagtgtcatgaggaaagtgtctatacaatcacagagttatatttcctcacaaagttctttacgaagagtgaaatatgtttttatacctctcagtttcagttagaggcatattttgtgtaatatttatggcttaaaatggactaaaggtcctgttcttgccttttctgaacttgccgcttttgcattctttgagttcagtttaaagacacttactttaactccattttaaaccctcgggctagaaatcgtaccactgttaattagccacgttatttggtctaacagtttttgtttatcattctgaaactgagcttatctaatacattgataaattatttcaaaggtatttttatagttcaaatcgcttcacttttaccctgacacgtataaatgaataggaatgaccttcagatagcgtttagcaactgtaaccaatctgacaataatgtgttcatcaggtacctgtggattaaatcacatactggcatatttaagatgaatgtcagtctgaaaaataaatatactatattaattcaaatacgactctttgtgtaggtattttgtcatatgtttaagaaaaagctaaagagaatggaaatcctatgacaataactcaagtctttcttcaaagtgcatgcagtcttttgcagtacctcattcagccaagtatt

SEQ ID NO: 102803 - DNA, 236 bp, Homo sapiens
ctggtggagcagatacacaaaggagaaagaggaaagaatcaagacttaggctacagaaaaccaccaaactgcaatgatagaaaaagaggaagaaaggaacgaaaggaggaagaaaggaacaaaggataaatagctaatatgtgcagggcttaatacctaggtgatgggctgacaggtgcagcaaaccacccatggcatatgtttatctgtgtaacaaacctgcatgtcttgcacgt

SEQ ID NO: 102804 - DNA, 287 bp, Homo sapiens
ggctctgatcctgtcacagtgctggcagtgggtgaggcacactgctggcatctgcaaaaccttccccatttccccaagttcacaaagcaaagagatgcaaaggaggaagccccacctgtgcgatcagattcccatcctggttccctgggacatggggcctgggagaccagtgacttaggttcgatttctacccttgtccctggcaggtcatctaactgctctgagccttgagttcctcgctctgcaaagtaggaggagtggctgtgagagcccaccagattctctcc

SEQ ID NO: 102805 - DNA, 2928 bp, Homo sapiens
  misc_feature (1001)..(1001): n is a, c, g, or t
aggtagatccatttattttttaaatacaagtataattttggaaggggtatttgacaaattcagcattaactgccaactctatagacatgttttaacaaaaagcaaaacaaaacaaaacaaaaaaacaaaacaaggcatttactcttggccctttcagtacaggcgaagtgttctattgcatcacaagtgctagtgatgcagtaacagatccaagggcataatattaaatatgtttttttccaactgcgatttagttgaaaaataacataatacaaacatatattaatggctatcaagaccagcagtgatctgcagaatacctagaggcctacctaattagaaggttgaaacttagtaaaaccgtattaaagtcagtgtttttattcttagattaacaatgacagagtgagatatctttgattacaattttataaggtgtggtggggaattgagaggagacagatattggggaagactggcagtgtgtgctgagttagagttgggaatgtggctcaaattagtcaatattgattaggatattgttttagaaaattttaaatgtgtcctaaattgtggcatattgaaaacgatattaaggaacaatgactcattagccctaaatacaatttaatgagtgccatcaatgggcttaagaaataagcagggatgggggatagagaggcaaaatgaggtgaaagagaaaatggaaagtggaaaatatgtttgaacattggagaatgtgaaaaggccaccaaactgctttagttatcactcagaagtgctcttcccattggctacctgcttctgatcacccaaacaccaattttagagcagaggagcagtaatcccctttatctgcaatttcactttctgtagtttgttacctgaggcaaccttggtccaaaaatattatgtggaaaattccagaaataaacaattcatgttttaaatcataagccggccgggcatggtggcgcatgcctataatcccagcactttgngggattacaggcgcccgccagcacgcctggctaatttttgtatttttagtacagacgggggtttcatcatgttggcggccggactgttctctaactcctgacctcaagtaatcggcccgcctcggcctcccaaagtgctggaactacaggcgtgagccaccgcgcccggccccatttcctttattttattttactatgttcagacggagtttcgctcttgctgtccaagctggaatgcagtggcgcgatctcggctcaccgcaacctctacctcccaggttcaagcgattctcctgcatcaacctccggagtagctgggattacaggcgcacgccaccacgcccgactacatttcctttattttatttttatactttactagcctgtttgttgatcacaagactggcggtgcacaaggttgggtctcggtgttcaccgggcggtgggcgtgggcgaggtgggagggtctccagcgcctggtgctaatctccaagaaagtgcaggaaacagcaccaaacgtgattgcaaagttttggtttggcgcggcgggtaggcgttccagcgcagaaatgcgcaggaaagtttctgctgtgcttgtaggaaggtcggccacaagcacttcttttgttttttgaaaccgagtttcgctctgtcgcccaggcaggagtgcagtggcgtgatatccgctcactgcaagctccgcctcccgggttcacgccattctgcggcctcagcttcccgagtagctgggactataggcgcccgccaccacgtctggttaatttttcgtatttttagtagagacggggtttcaccgtgttagccaggatggtctcgatcttctgacctcgtgatccgcccgcctcggcctcccaaagtgctgggattacaggcgtgagccgccgcgctcggccggccccaaacacttcttattggctaatctggagcaaacctgcatatccattggctgaaagctccgtctattttagggtgactgagagcgtctcttccttctgtgttgcctggaaacggactgttcgcctagtaacatctgatcacgtttcccattggtcaccgtttccggaagcccgctctcccgtttccggaatccccgcaggcgctgggtctgcagatggcgtctaggtacacagtggcgagtgtgattccgcagtcttgggctgtttggccaagcgcccgccggacatggtacgccgaagggtcatcggcgtggagtcctcgctttcagcgtccgcggctgggaaatcggccatcgctacggcgggaactgggactcgggctgcgtcccggcccttccacatcggtccaccgcactcgtgggcgcccgcattggtgctgacataatttcctgacctctgacccgtattgtctcgcgattaaagagctgcgcctggatccctcagcagtgaggagacctgaagaccagaggaaacacagcaagggctcaccagagaagacagggcaaggtgagggggatctcctagcagaggaaacaacatgcgccaatcaagcaaagatatttttgtgcattcaaggaacacagagaggaaagacagtggcagatggagacgtataaagcagggatcctgttatgaaaagccctaaaaaatagggtatagagtttgggccatatttcagaggtaataagaaagcattctgcatttttaaagtaaggtttaaaaatgtttctaattagagatacagcaaagttggtgtgagaggataaagactgatatacataatctgaggagttcatgaaaattccatgtaaagcctgtagtatgaattggtcctaggagacagacagcttcaggggcatagagaactttaagcacttttccaagaagagtgaagggctggagaataaattgtgaactaaaatatattttgtgtttgagaacatgaagta

SEQ ID NO: 102806 - DNA, 2966 bp, Homo sapiens
  misc_feature (1001)..(1001): n is a, c, g, or t
aggtagatccatttattttttaaatacaagtataattttggaaggggtatttgacaaattcagcattaactgccaactctatagacatgttttaacaaaaagcaaaacaaaacaaaacaaaaaaacaaaacaaggcatttactcttggccctttcagtacaggcgaagtgttctattgcatcacaagtgctagtgatgcagtaacagatccaagggcataatattaaatatgtttttttccaactgcgatttagttgaaaaataacataatacaaacatatattaatggctatcaagaccagcagtgatctgcagaatacctagaggcctacctaattagaaggttgaaacttagtaaaaccgtattaaagtcagtgtttttattcttagattaacaatgacagagtgagatatctttgattacaattttataaggtgtggtggggaattgagaggagacagatattggggaagactggcagtgtgtgctgagttagagttgggaatgtggctcaaattagtcaatattgattaggatattgttttagaaaattttaaatgtgtcctaaattgtggcatattgaaaacgatattaaggaacaatgactcattagccctaaatacaatttaatgagtgccatcaatgggcttaagaaataagcagggatgggggatagagaggcaaaatgaggtgaaagagaaaatggaaagtggaaaatatgtttgaacattggagaatgtgaaaaggccaccaaactgctttagttatcactcagaagtgctcttcccattggctacctgcttctgatcacccaaacaccaattttagagcagaggagcagtaatcccctttatctgcaatttcactttctgtagtttgttacctgaggcaaccttggtccaaaaatattatgtggaaaattccagaaataaacaattcatgttttaaatcataagccggccgggcatggtggcgcatgcctataatcccagcactttgngggattacaggcgcccgccagcacgcctggctaatttttgtatttttagtacagacgggggtttcatcatgttggcggccggactgttctctaactcctgacctcaagtaatcggcccgcctcggcctcccaaagtgctggaactacaggcgtgagccaccgcgcccggccccatttcctttattttattttactatgttcagacggagtttcgctcttgctgtccaagctggaatgcagtggcgcgatctcggctcaccgcaacctctacctcccaggttcaagcgattctcctgcatcaacctccggagtagctgggattacaggcgcacgccaccacgcccgactacatttcctttattttatttttatactttactagcctgtttgttgatcacaagactggcggtgcacaaggttgggtctcggtgttcaccgggcggtgggcgtgggcgaggtgggagggtctccagcgcctggtgctaatctccaagaaagtgcaggaaacagcaccaaacgtgattgcaaagttttggtttggcgcggcgggtaggcgttccagcgcagaaatgcgcaggaaagtttctgctgtgcttgtaggaaggtcggccacaagcacttcttttgttttttgaaaccgagtttcgctctgtcgcccaggcaggagtgcagtggcgtgatatccgctcactgcaagctccgcctcccgggttcacgccattctgcggcctcagcttcccgagtagctgggactataggcgcccgccaccacgtctggttaatttttcgtatttttagtagagacggggtttcaccgtgttagccaggatggtctcgatcttctgacctcgtgatccgcccgcctcggcctcccaaagtgctgggattacaggcgtgagccgccgcgctcggccggccccaaacacttcttattggctaatctggagcaaacctgcatatccattggctgaaagctccgtctattttagggtgactgagagcgtctcttccttctgtgttgcctggaaacggactgttcgcctagtaacatctgatcacgtttcccattggtcaccgtttccggaagcccgctctcccgtttccggaatccccgcaggcgctgggtctgcagatggcgtctaggtacacagtggcgagtgtgattccgcagtcttgggctgtttggccaagcgcccgccggacatggtacgccgaagggtcatcggcgtggagtcctcgctttcagcgtccgcggctgggaaatcggccatcgctacggcgggaactgggactcgggctgcgtcccggcccttccacatcggtccaccgcactcgtgggcgcccgcattggtgctgacataatttcctgacctctgacccgtattgtctcgcgattaaaggtccagatttggaacaaatctctctagagattgaacagagctgcgcctggatccctcagcagtgaggagacctgaagaccagaggaaacacagcaagggctcaccagagaagacagggcaaggtgagggggatctcctagcagaggaaacaacatgcgccaatcaagcaaagatatttttgtgcattcaaggaacacagagaggaaagacagtggcagatggagacgtataaagcagggatcctgttatgaaaagccctaaaaaatagggtatagagtttgggccatatttcagaggtaataagaaagcattctgcatttttaaagtaaggtttaaaaatgtttctaattagagatacagcaaagttggtgtgagaggataaagactgatatacataatctgaggagttcatgaaaattccatgtaaagcctgtagtatgaattggtcctaggagacagacagcttcaggggcatagagaactttaagcacttttccaagaagagtgaagggctggagaataaattgtgaactaaaatatattttgtgtttgagaacatgaagta

SEQ ID NO: 102807 - DNA, 2764 bp, Homo sapiens
  misc_feature (1001)..(1001): n is a, c, g, or t
aggtagatccatttattttttaaatacaagtataattttggaaggggtatttgacaaattcagcattaactgccaactctatagacatgttttaacaaaaagcaaaacaaaacaaaacaaaaaaacaaaacaaggcatttactcttggccctttcagtacaggcgaagtgttctattgcatcacaagtgctagtgatgcagtaacagatccaagggcataatattaaatatgtttttttccaactgcgatttagttgaaaaataacataatacaaacatatattaatggctatcaagaccagcagtgatctgcagaatacctagaggcctacctaattagaaggttgaaacttagtaaaaccgtattaaagtcagtgtttttattcttagattaacaatgacagagtgagatatctttgattacaattttataaggtgtggtggggaattgagaggagacagatattggggaagactggcagtgtgtgctgagttagagttgggaatgtggctcaaattagtcaatattgattaggatattgttttagaaaattttaaatgtgtcctaaattgtggcatattgaaaacgatattaaggaacaatgactcattagccctaaatacaatttaatgagtgccatcaatgggcttaagaaataagcagggatgggggatagagaggcaaaatgaggtgaaagagaaaatggaaagtggaaaatatgtttgaacattggagaatgtgaaaaggccaccaaactgctttagttatcactcagaagtgctcttcccattggctacctgcttctgatcacccaaacaccaattttagagcagaggagcagtaatcccctttatctgcaatttcactttctgtagtttgttacctgaggcaaccttggtccaaaaatattatgtggaaaattccagaaataaacaattcatgttttaaatcataagccggccgggcatggtggcgcatgcctataatcccagcactttgngggattacaggcgcccgccagcacgcctggctaatttttgtatttttagtacagacgggggtttcatcatgttggcggccggactgttctctaactcctgacctcaagtaatcggcccgcctcggcctcccaaagtgctggaactacaggcgtgagccaccgcgcccggccccatttcctttattttattttactatgttcagacggagtttcgctcttgctgtccaagctggaatgcagtggcgcgatctcggctcaccgcaacctctacctcccaggttcaagcgattctcctgcatcaacctccggagtagctgggattacaggcgcacgccaccacgcccgactacatttcctttattttatttttatactttactagcctgtttgttgatcacaagactggcggtgcacaaggttgggtctcggtgttcaccgggcggtgggcgtgggcgaggtgggagggtctccagcgcctggtgctaatctccaagaaagtgcaggaaacagcaccaaacgtgattgcaaagttttggtttggcgcggcgggtaggcgttccagcgcagaaatgcgcaggaaagtttctgctgtgcttgtaggaaggtcggccacaagcacttcttttgttttttgaaaccgagtttcgctctgtcgcccaggcaggagtgcagtggcgtgatatccgctcactgcaagctccgcctcccgggttcacgccattctgcggcctcagcttcccgagtagctgggactataggcgcccgccaccacgtctggttaatttttcgtatttttagtagagacggggtttcaccgtgttagccaggatggtctcgatcttctgacctcgtgatccgcccgcctcggcctcccaaagtgctgggattacaggcgtgagccgccgcgctcggccggccccaaacacttcttattggctaatctggagcaaacctgcatatccattggctgaaagctccgtctattttagggtgactgagagcgtctcttccttctgtgttgcctggaaacggactgttcgcctagtaacatctgatcacgtttcccattggtcaccgtttccggaagcccgctctcccgtttccggaatccccgcaggcgctgggtctgcagatggcgtctaggtacacagtggcgagtgtgattccgcagtcttgggctgtttggccaagcgcccgccggacatggtacgccgaagggtcatcggcgtggagtcctcgctttcagcgtccgcggctgggaaatcggccatcgctacggcgggaactgggactcgggctgcgtcccggcccttccacatcggtccaccgcactcgtgggcgcccgcattggtgctgacataatttcctgacctctgacccgtattgtctcgcgattaaaggtccagatttggaacaaatctctctagagattgaacagagctgcgcctggatccctcagcagtgaggagacctgaagaccagaggaaacacagcaagtaggccctttaaaccactcacctgtgttgtcttccaatttattctgttttattttgtttccatcattttaaggggttaaaatcatcttgttcagacctcagcatataaaatgacccatctgtagacctcaggctccaaccataccccaagagttgtctggttttgtttaaattactgccaggtttcaactgcagatatccctggaaggaatattccagattccctgagtagtttccaggttaaagtcttataggcttcttctgttt

SEQ ID NO: 102808 - DNA, 632 bp, Homo sapiens
tcaaggactaatgtataggaatagattgaaataaaaaattctccgaaacagcactggatgaacgcttcaaggggctcacacaacctgttccaggacttggtgaccattgtttgtgtccatgttcaattgagttcaaatttaatatttaacttttcctccacaggggctcaccagagaagacagggcaaggtgagggggatctcctagcagaggaaacaacatgcgccaatcaagcaaagatatttttgtgcattcaaggaacacagagaggaaagacagtggcagatggagacgtataaagcagggatcctgttatgaaaagccctaaaaaatagggtatagagtttgggccatatttcagaggtaataagaaagcattctgcatttttaaagtaaggtttaaaaatgtttctaattagagatacagcaaagttggtgtgagaggataaagactgatatacataatctgaggagttcatgaaaattccatgtaaagcctgtagtatgaattggtcctaggagacagacagcttcaggggcatagagaactttaagcacttttccaagaagagtgaagggctggagaataaattgtgaactaaaatatattttgtgtttgagaacatgaagta

SEQ ID NO: 102809 - DNA, 376 bp, Homo sapiens
atttttctcacaatataacagacagcatgaagctaggaggcagatacacttgggatgacagaaccaggaatccaaaagatagtgtaaagtaagggtaaaatgctgactaaaagaagaaatttatgaatagcaggaacagatatggtcttggactttagtcaacaatgaaacaaaaccaaccaaaggacactgctcagatttagcttcttgtcactgttaccctgggcacaaaacataatcttgtgaggccccacttcctcacttgtaaaactgggataacaacagcccctacaacatggagttgttatgagaattaaatcagtaaatgtaggcaaagcacttacttaagatagtgatgatgttgatgatgatgatg

SEQ ID NO: 102810 - DNA, 668 bp, Homo sapiens
tgtgatcacccaggaggagggtgtagagcggatggacgggaggaagcggctgcagctggagggaagagaggggccgtccagcctcacccgctgcagtcagctctcctatgggcaaggaaacagctaggtggccctgacccctgcggtcctgagagccggtggccttcagcccctcttggacaggtcatggtctggaagcgcccagcgcaggatggattccagaccagcatccctgcaaccttttcagccccactggctgctgctttaaactggcatggagacatttgatcagcttcccagccagttttctctccagctcagccaggagtgggtgcctgtggcctgtgtcaccaagagctggtgtctcctgcatgaggggcatgcacccctggaatgagggtctgtgcctcgagctcaaagtgtcccggctctgtcatctgcctgaagttgcctggcttttccagtggggcctccttgagtgctgcagcatctgggagcatcctagcctgtcccgtgggtgtggctgggtgagggctaggaggtgagccaggaaggaagcactccactccagagtgaggtgccgcctgagccatcctgtgccccctcagtgtcttcaggtctctgcaggtgtcaggatctcaaaatacttggttcagatcaaacacatt

SEQ ID NO: 102811 - DNA, 281 bp, Homo sapiens
agcagactccacatagacagtggccctggccaggaatttttttgtcaccaacgttgaatgaaactatgttattgaggcactgctgtatgtagagccaggtatgcccgtttctggaacggagtgctgcagattgccaggtcagagggtgtgggtttgggcgtggctctgccacttagtggctgtctcacatttggcaaattctctaaaccctctaaggctcagtttcctcacctgtaaaatagagataacaatgggacctacttaacgaaattcctgtaaga

SEQ ID NO: 102812 - DNA, 469 bp, Homo sapiens
tctttagtagagacggagtttcaccgtgttagccaggatggtctcggtctcctgaccttgtgatccgcccgcctcggcctccgaaagtgctgggattacagacgtgagccaccgcgcacggccagaatttctaaactaggcgaatcataggtttattcagtggaacttagctgctggaacatgaagatctgcgcagagttgctggatccgtttggctttggtcttatcttggatcatcgggtctgagtaagctggtgttaaaacaatttgagcttagtgtggtatggcagggtttgtagactcgtcctgtgctgtaagtcacagggcttttgcaacttctgtgtttgttcatttctcaatttgccctctttcctcaccaacagaactgcccaagaaatcaacttacagtatagctactggaacttagctccgaaaaggtcctctgcaaatctagaacacttgttttttt

SEQ ID NO: 102813 - DNA, 354 bp, Homo sapiens
tggagacagagtctcgctctgtcactcaggcatagagtgcagtggcatgatctcagctcactgcaacctccacctctcagattcaagcgatttccatgcctcagcctcccaagtagctcggactacaggcatgtaccaccactcccggctaatttttgtagttttagtagagatggggttttgccatgttagccaggctggtcttgaactcctggcctcaagtgatctgccctcctcggcctcccaaagtgctgggattacaggtgccaaaccacatgctcagccatgtgaagtccttttgacttaatggtgcttctttgctaatttttgttttacttttaaggcagaaccttt

SEQ ID NO: 102814 - DNA, 785 bp, Homo sapiens
agagaatactagtctgatgactagtgttgcttgttcctctcttgctcatctctagaacaaacagaaacacacgtcctctctgccaagtattctgtgacgtcacaaggcagctcctacagtgcagcagctttttcttacacttttcttttctggctgcaggagaattaatctcttccttcatacttttacccattttttttaatcagttggaggatacatgatattatttagaacatctagaaggtatacttttttaaaaaatagactttaatttttagggcaattttatgttcacagcaaaattgagcagaaagtacagagagttccatatacccctgtccccacaaccagcctctcccactgtcaccatccccactagagtggtacatttgttaccatcgatgaacctgcattgacacatcatcacccaaagtccatagttgacagggttcactcttggtgttgtacgttctgtgggttttgacaaatgtataatgacatgtatccaccattatagggccatacggagtagtttcactgccctgaaaatcctgcatgctctgcctgctcatgcctgcttaccccctaacccctggcaaccactgatcctttttctatctccgtagttttatcttttccagaatgttataccgttggataaattcttttaaaaagggatctagcaggataaaggaattttgaaactgtaagggatcttagagatttttcattctgtggccttttttcatgcttaccaaaggtacatatttttcgacagtttgaat

SEQ ID NO: 102815 - DNA, 291 bp, Homo sapiens
tagctattttttaaattttttttgtagagatggagtctcactatgttgcttaggctggttttaactcctggtctcaacaagcaatcctcccacctcaacctcccaaagtgctgggattacagatgtgagccatgtaattccagcactttggaattccaaagcactttggagttccagagtgctggaattacccagcccattttactaataaatttaaagggtgaggggatgataactcaatagatactgaaaaatctctaatcctaatacaatttcctagaaagatagaaa

SEQ ID NO: 102816 - DNA, 310 bp, Homo sapiens
aatgtgctttccccagggaagaaaatgagtagccgcaatgagtatacctggaattacatgtaaccctgaaatgtccatgggactatgtggtttgtgactgtttgtacaatgcctatcaaatcaagaaaaaggctgagactcatcgtttgtgtttttcatttgaaatcctaatggttaaacttgaacctggtggtcaaactaacaccccaaaatatcaaccccacataaatcagagacctgcaagggcacagtagattctgtatcttccggccttcaaatcggggcagcttgtctgatcatgagtgctcta

SEQ ID NO: 102817 - DNA, 229 bp, Homo sapiens
cccactccagccccaaccccaccctataacaaactccacttcagttttatgagaccagaggtaattccctgctgctgttcagcgttgctgtggctaacagttccaaccttctgaagtgccggctggttggggctgtctctctggcaactgattagcccataaaccctgccttgctggtcctgcagcgttctccagtgcaagtgactgaaagcatgcctttcccagcagg

SEQ ID NO: 102818 - DNA, 647 bp, Homo sapiens
attctttgagcagtaccatgggcactaaggacctaaccacagagtagcggatgtgtcaacagaactgcactcggcaggatgaagacagggactccggcatgtggtcgtttagcatgtgcagtttccactcttcaagagggatccctatggcccacgacaggcaacgtgagccacaatgcaaggccagtgtgggagagatgagcccaggtgacagtgactgtccgggaggatgctcttggggttttggtgggatggttctttattgtgtggtctgtcttgtgcattgcattcttggccttcactactaacagcccacagcatccccccgtcactgtgacaaccagcagcgccccacacatttccccggggatggaaggctagttttcaccactgcccgggggatccaactgccaggatctgctgcaagtctgccgcttgaggcagctgggagttctctctcctggccacttgagcattcattctggtgaggtggtggtggtggaggaaaacggggagaagcagagggagagcacaggtcctggatgcagacccacagccaactggagggagcatgtgctgtttttagctgcccagcgtccattcccatctcttttggtaacaggttacccacactgcagttggagaat

SEQ ID NO: 102819 - DNA, 312 bp, Homo sapiens
tcctctaatgtttgttagttactatatgcaagctgatgtttatcctaaaacatattaaccattatcctctcaaactttaaagaacattatatttacctttgcaggattacacataacaaaaatactatgatacaaaataatccttgttctattcaaagatttaactttttaatatttcagcccaaatattcattatcttttaaaataaaacaatggaacatatttttaaacaaaatttaaatggtttctatagtaacagacacaattcagtatcttattttttgtttacatatcctataggtgtaactaaca

SEQ ID NO: 102820 - DNA, 818 bp, Homo sapiens
  misc_feature (748)..(748): n is a, c, g, or t
  misc_feature (776)..(776): n is a, c, g, or t
  misc_feature (784)..(784): n is a, c, g, or t
  misc_feature (790)..(790): n is a, c, g, or t
  misc_feature (795)..(795): n is a, c, g, or t
  misc_feature (797)..(797): n is a, c, g, or t
tccggtaggttgcccgggagacgcgggtacacagagaagcggctcccgtcggaggccgagtcgtcgccacgatcgcccccttggtggactcgcaggccgagcggcttccccgcagagctcgaggagggcagacggcggcgggggcgccatgagtcagaggcaggtgctgcaagtgttcgagcaataccagaaggccaggacccagttcgtgcagatggtggcggagctggcgactagaccccaaaacatcgagacgctgcagaacgcgggtgtaatgtctttgctgagaactcttcttctggacgtggtcccaacaattcaacagactgctgctttggctcttgggagactggccaattataatgatgacctagcagaagctgttgtgaagtgcgacattcttccacagcttgtttattcattggcagaacagaatcgcttctacaagaaagcagctgcctttgtgttacgagcagttggtaaacattctccccagctagctcaggcaatagtcgattgtggagcactggatacgctggtcatatgcttggaagattttgaccctggagtcaaggaggctgcagcctgggcacttagcatatatcgcaagacataatgcagaactgtcacaacgctgttggtggatgcagggagctgttcctctttttagatactctgtatccaggagccagaaattggctttgacaagggatggctggcttcggccctcaatggatattggcaaagnattctccagagttagcacagaacagaantggatgcnggagcngtgtncntttagcacaatgatctgaaac

SEQ ID NO: 102821 - DNA, 329 bp, Homo sapiens
ggtggatcacatgaggtcacaagttcaagaccagcctggccaacatggtgaatctccgtctctactaaaaatacaaaaattagctgggcatggtggcacatgcctgtaatcccagccacacaggaggctgaggcacgagaatcacttgaacctgggaggcagaagtcagagtgagctgagattgtgccactgcactctagcctgggtaacacagtgagactctgtctaaataaataaataaataaaatgaaacaaaaagctggatctttgaaaaggtaaacaaaattgatagaccatggttgagattaaacaagaaaagaagagagaag

SEQ ID NO: 102822 - DNA, 682 bp, Homo sapiens
attttgaggccaagaagaattactcgctcttgctttcagcaaggcaggaccccctccttccttctccacctgcctccaactccctcctcctttctctctccctacttaatatggcttcttatgttgatttctaaagcacagatttggcacaagacattatcaccagaaagacttaaaacagaagtgtgcataaccatgagtgggttttaaattaagaagcagttcaaaggtcagggattaggaatcatgttgcatgacgcaagggacaggcagaagttcttcagcgatgttcagtatctgcgggacatgcagcataaggtggactctgagtatcaggcttgtctgagacgacaggaatatagaagagacccaaatgagaagaaacgcgatcagttttgggggcaagagacaagttttgagagatcccggttttctagcaggtcatcttccaaacagagttctagtgaggaggatgctctaactgaaccaaggtcatctatcaagatatctgcatttaagtgtgactccaaacttccagcaattgaccaaacatcagtcaagcagaaacataaaagtaccatgactgtaaggaaagcagagaaagtggaccccagcgaaccctctccagcagaccaagcaccaatggttttattaagaaagaggaagccaaacctgaggagat

SEQ ID NO: 102823 - DNA, 279 bp, Homo sapiens
gaagggtgcccagtgcagcgaaagggaggagaaagcaaaaatgtcatgtcgccatggtgagtgtggggaccaggtgtgttcaggcactctgggtacggggaggcgtgcagcccggggcaatgagtcccagaaaggctgcctggaggggctgacacatgatctgggtcctgcatggtagaccggggctggaggggctggtggttgtgccagacagaaaggacagcaagagcgaagacatagagggacccaatagaggatgagttcaaggaagacgaaggg

SEQ ID NO: 102824 - DNA, 403 bp, Homo sapiens
ctactttttctccacctccacccaaatgcatccttgtacctcctccactgggatactcataaggtgcaatgtgatttatgctgctgtggaagtggaggttcttgtttctcaaagtcactatggctggagtgtgccacaaacagaggtggctgtggttgcctcctaattcctccagttttaagtcattgtggtgatcatcattttgaaaacccatcctctcttctctccctgccaccttcctttcccttatcactgcctcccagtcaaagtttctctggctcttcctcctagatctactccttaaatcatggggttcctccaaattcttcccttgacactcttttcaagtcactttctacatctgccagggtgaattaatctgctacctggccttctgccccac

SEQ ID NO: 102825 - DNA, 171 bp, Homo sapiens
cctcagtgtgaatgctcacctcgggctgagccaacccctccagacacgttctgcagctcgaggaaggaactgccctttgcagctgggatctgcccgagtttcagcagcagccttgaattgtaatcccgagcggctggcgaataacacagcacacagcactcgagagcccag

SEQ ID NO: 102826 - DNA, 794 bp, Homo sapiens
caaaatgttttttcttttttaaataagtaacatccatatagttcaacatttaaaaattgtgtaagctgcctggtgaaaaatctttcttcccttcctggacccagccacctgttcctttcactcatagactactggcataaatagtttgtatttacttccaaggaatttttgtgcatacacaagtataagatatatttgttttactagctaacagacttctatacttttttttccacttaagcataaatcagggaaacaatttgagtttccattgtatatgtaaatacatcgtagtttatttaaccaaattgttcttttacattttttctcatcattatttctaggtattttaatatttctgttgctgttgtaaatgagatatttttttctatcatatattctaaactagttgtttgtatgtatgaaagccattgatttctgtatgataattttataccctgtcaatttgctgacatacgttggttttcttctgggttttcatgtgtgcaatattagctgcaaatggaattaattttacctttttttctaatttttatatgtttacttttttctaattatatggcctaatatatatagaacagtgttacataatgaaaatgataatagatattcttagttttttcttgaacttgagaatatttcaattcgcttttaagcatgatacttacttttatcatggtaaagaattatacaacccttccacttaagcaaatttatcaagaatggccacagaccttttttagcaaaaatgaaaaagacaaaaacagaaataa

SEQ ID NO: 102827 - DNA, 861 bp, Homo sapiens
gagagaaggcaatatccaatatttatttctggagtactgtagtggaggagagcttttgacagaatagagccagacataggcatgcctgaaccagatgctcagagattcttccatcaactcatggcaggggtggtttatctgcatggtatggaataactcacagggatattaaaccagaaaatcttctgttggatgaaagggataacctcaaaatctcagactttggcttggcaacagtatttcggtataataatcgtgagcgtttgttgaacaagatgtgtggtactttaccatatgttgctccagaacttctgaagagaagagaatttcatgcagaaccagttgatgtttggtcctgtggaatagtacttactgcaatgctcgctggagaattgccatgggaccaacccagtgacagctgtcaggagtattctgactggaaagaaaaaaaaacatacctcaacccttggaaaaaaatcgattctgctcctctagctctgctgcataaaatcttagttgagaatccatcaggcaagaattaccattccagacatcaaaaaagatagatggtacaacaaacccctcaagaaaggggcaaaaaggccccgagtcacttcaggtggtgtgtcagagtctcccagtggattttctaagcacattcaatccaatttggacttctctccagtaaacagtgcttctagtgaagaaaatgtgaagtactccagttctcagccagaaccccgcacaggtctttccttatgggataccagcccctcatacattgataaattggtacaagggatcagcttttcccagcccacatgtcctgatcatatgcttttgaatagtcagttacttggc

SEQ ID NO: 102828 - DNA, 390 bp, Homo sapiens
gggatggagggaggacaagacaggacaggaagggaagcagaggcatgggaaggatgggatatggatctagatggtagaatgctattttccacatagcagtcttaattttaatttcatctctcactcaacatctatcaacaaccacacagactttttcttactactctcaaactattttctaaattaagctcaaagactttgagttattccaaataattagtgaataaagtaattaagtaactcgtggttaactggtttttcattatttaatagacatctgttaaaatgtgattatagtctgcttaattgtgacactaaagaagaaaagatgtatcaaaactgaaaagggaaaatgaatagttctatttctaattgttagcaatctgaact

SEQ ID NO: 102829 - DNA, 126 bp, Homo sapiens
caaagctattcatcagctccagggctacctgcgatctgtgtttgctctgacgaatggaatttatcctcacaaattggtgttctaaatgtcttaagaacctaattaaatagctgactacaaaaaaaa

SEQ ID NO: 102830 - DNA, 680 bp, Homo sapiens
agcagggaagagcagatgaggtggaggcagaggctggagggacgtagctgcaagcgcaggagcaccaagggccggtggaaccgcagaaaccgcagcgagggagccagccctgctgacactttgattccggacttccatcgcagaactgagagagagaatcaacccctgtcgtcctgagcccccagcgtgtggtgctgtggtgcagccgcaggaaacacgtgctttccagaatgacagctggtgtccgcaagaacagcaggaactcatcagcatttggaagtgagactgggtggatgtgcagtcccggaaaaagaggcggagatttatgtctggtggcggggagcccgtgtgttcagcagcttctggaaggaattgatagatggaagctgctagaggcgttgctgacagcctctccttgaggccagactccagagctggaacctggtagaagccttagtctcctcatttaccgcagcggtgacgggtggggcagtgtgagatctgagccgagggcccgcatcaaagtcccctttcggcttctccatctgtgacatgggttgcacctgctctgactgctgcttacgagagatggtgagcagtgttctgtgctgcgtggccgtgactgccgaggttctgtgaagacgggaaccacgggctgaaagcaatagagaccccagacc

SEQ ID NO: 102831 - DNA, 655 bp, Homo sapiens
tggaagataaagttggaaaagctgaaggattgattttcttccatcaactctcaagatcccattcgccattcaatctctgtgctgcagtaagagcaatcttaaacagtataaatcacacacacacacacacacacacacacacacacacacacacacaagtccctcaggaaaaattccaagctcttgagaagatcacatgagccccttcatgacctggcgcttgcttatttcttccaggacttctctcacttctatccagctattcccgtcagcaaatgaacctccaaagcagcacatggagcactgcatagactatttcctcagtgcgtaactcctccctgtctcctctttacctgagtaacttgtactcatccttcaatactccaactgaattttacttaccctgaaaagatttccatggctatccaccacccccctgcctgtgagactgagttaggtgccctttttcatgtctttcccccatcacggcacttaccatactgcgttgtaattgcctgtgtactcgtctgtataactactagactgtaagctccttgagggcagggactgtgtctatcttgttcacagttgtatccccagcacccagcacagtgcctggcatattgtaggtgcttaataaatatttgttgaatga

SEQ ID NO: 102832 - DNA, 410 bp, Homo sapiens
actattattatcactcctggcaaaatcaaaagtaattctttatgttatttagtagttagtctacattaaatttttgataaaaagtgtctgttttatagttcatttgttcaaatggggatccagacaaggctcacatttgctttccattgtagctcttaagtctcactttatgtaaaagcttcatcttactccctgtttttttcttttgaatgttatagacttttgaagaaacaaggttatttgtagtatagaatgtcatattttgaatttatctgttgctgcttcttgtcatttaactctttatctaagccctgtatgtccactaaattagaagttccatataaagtctagttagattcaggcattgcctttttttggttttgtttttacagcaagaatccctcatagat

SEQ ID NO: 102833 - DNA, 603 bp, Homo sapiens
caacatgtttctggtttcttaagactttagtatattgttcttaacatttatttgggatgtatttgcatttttggaagctgaccagtttctacacatatctaaatgcctccttacatttgacagtacatttaacatgctaaagtacttttcttagatatgatcaattttatccttgaaataagcctattgggagccatggacaccagctcattgtggtgaggacgctgaactcaatggtgcagatacagtggtgaaggagacacacaccctgtggtatggtggagtagactcctaacagaccaaccctgccacaaatatagcaactataaactggacaaactaccaaaagtaactacttaagagacctgggaagtgagcaaatgcaggcagaggggagttgaatcttggaggagagtgtgagtttcctgtttttcagccttgtccaaaagatgggccctggtcacaaagtgtctgggggtggctaaaactcccatagaaagactgccatgtttctggtctagggaaccaggggctggagcctggggcaatcatggccacgagagtgagggagaaatcccagagaggacagagccagagaagggg

SEQ ID NO: 102834 - DNA, 91 bp, Homo sapiens
gatgagatgtagttgtctgcccagtgacactgtgcaaactgttgagtcctctgcatagaagaaagagctgaagacatctgtgccggacatg

SEQ ID NO: 102835 - DNA, 671 bp, Homo sapiens
atactgcagatcttacactataatactgtgtatgcctctgctgagtaattcactgaattagcatttctcctcttgcagcaagttaagataagctttttgtgagtctgtgtcttttaaaatcttgccctaggttatgctttgtctacttgattttgtatctgtttcactaagatacagtttttcaaaatactaccttgttctagcaagagctcagtgaggttggcattctctttcactgcttgggtaagtgtataactctttctgggaacatatattaagaaatttatatatttacatcctctgatttcatatgtaggaatctaactcaaggaaatttttgtatgttgatgtgtatatataaatgtcttttggtggtagaaattatgagggttttcagcttctcattcttttctatttcttccacacttctttaatgatcatctcttactttcttacttttctttctacttacctcccctctttttctctgttcctcccagtacttcattgcttgatttctctgagtattaaaatggtaggccaggcgtggtggttcatgcctgtaatcccagcactctgagagccaaagccagaggatcacttgaggccaggagtttgacacagcctggtcaacattgtgagatcctgtctctacaaggaagaaaatattg

SEQ ID NO: 102836 - DNA, 321 bp, Homo sapiens
agtctctatttactgagaaggaaaccaaggctccaaggaaagccacttcttcaaggtcagagtttagtgggaacatctagtgttttgtttccattcacagtagagtttcagttgtcaagttacgtctaatccaactttcaggctcctatggcatggcaagtcctgtgtctggggattcctgctcatttggggtgggtggaggatggcacagacaggcatgtggagaagaaagcatctttaaaaaaaaacacagctaggccaggcgcggtggctcacacctgtaatcccagcactttgggaggccgaggtgggcggatcacc

SEQ ID NO: 102837 - DNA, 431 bp, Homo sapiens
atggcagtaattatgtgagatgtgagaaattgttgaatattagagtttcaaagtgttgagaatattgcgaatattgagaatattgagaattatgtgagaaattgttgtaattatgtgagatgtgagaaattgttgaatattagagtctcaaagtgttgagaatatttttcagggaaaatctgaagattaaaaagttctttgaactggatgatgttaaggttttttcccagccttaagaaaaaaagcactctgatgctacatttatgtagactctcactcatttctctacaattaattgatgttagtcatattaaattttaaggcattttatggctagaaaagctgtctttgtcagaaaagcaacaccaaagttatgagtgcagttttgcagtgagtatttttattctatataattcattcataaagagaag

SEQ ID NO: 102838 - DNA, 824 bp, Homo sapiens
tcattcactttcccttgtgaagaacatgagccttgtgtcattgtagggatgcttatgcctgcagtcataaagtcagtgtgggtttaggcgtgtttgttatacctgatgatgcctccttccccagccccaagcaatatcaaattagccctggacctaggatcctctgtggtgaaactatcaagtatttactaagcacctactatgtactagcactgtcctaagatgatctaaatgatttataggatagatcagtccctatccccaaggagagaattggtactattacatgtaaaattatgtgctacgtatgcagtcacaagaatatttctaaaaaatatatgcaaatatgcaaagcgttacattcagatggagtgctgcccttcaaagctgcccttcaaagcaacctggccgtggtcccaaaggttcccggtcatggtcctttacgaatggtgcaattttattttcaacttttgagttgcgtaattgtagaaaaaccagaaaatatcaaatatttcttttaaagaagaaaaatcaggccaggcacagtggctcatgcctgtaatcccaacacactaggctgagtcaggaggctcacttgagtccaggagtttgagaccagcctgggcaacacagtgagactctgtctttacaaaaaataaaaaaaattagctgggcatggtggcaggtgcctgtagtcccagctacttgggaggctgaggtaggaggatctcttgggcctgtgaggccaaggctgcagtgagccatgatcacaccactgcactccagtctgggagacagagcaaggctctgtctcaaaggaaaaa

SEQ ID NO: 102839 - DNA, 319 bp, Homo sapiens
gcaagtttgagtttaaatactctaaaaatgctaacattataaaaatcctctgggcaagagatgcacaagtctttcagttaacatttgcaatccttcacaattataatgagaatttattaatcctggtgtctaatctaaatcctactaacattccagcatgtatttttaaagattataaattccaccctcccttgaaatgagacaagccgaagaaagctttgatcaaaagatttaaagtacgactctcagctttaggtaacagtaacctgaattatttttttaaatggatactaaggccgggcacaatggctccatgcct

SEQ ID NO: 102840 - DNA, 249 bp, Homo sapiens
cctcccaaagtgctgggattacaggcgtgaaccactgtgcccggccctggttattcttttaactgctaaatttactaactttaggtaccgggttaaaaatgtttgcacttttcatgtggagaaaaactgagttgggtagtatctttaaggacttttctctctgttgctcttttttttttggctttgttttcacttcatcaaatcaacaaacatgttgaggatttaatatagataaaaatcttatttctt

SEQ ID NO: 102841 - DNA, 235 bp, Homo sapiens
tataatactgccactgagcaagtgcagtgatattttaggctaaagcacatttgtgacatttgtgtgtgtgtgtgtgtgtatgtgggtgggtgggtaatatactcatgtttacctgcatcactccattttaaagtaaggtttgtaattagttgtttccagagctttgaaaaggagaaatattgcaatatagaccaacaaaccttattgaagaaatacatctgtgctctatacagtc

SEQ ID NO: 102842 - DNA, 296 bp, Homo sapiens
catttatttgtgttgggaacaacaattaggttattatcttattgttgaactttaagagttctttttatattttgggtacaagtcctttaccaggtatgtgtttgcaaatattttttgccagtctgtggcttgtcatttcatttccttagcagtatctttcacatagcacgaattttattttatttattttgttttattttattttatatattttttgagacagagtttcactcttgttgcccaggctggagtgcagtggcacgacctcagctctctgcaacctctgtctcctggat

SEQ ID NO: 102843 - DNA, 477 bp, Homo sapiens
gtgatcctcccaactccagcttcccaaggtgttgggattacaggcctgagccaccatacctggcctggatacagtttcaagagaaattctcacctaggtccacatgggaacacgatgaggacatcagtcgtcatgttaattgtgatagttgttggcaacaacctgagttcattattaggggaaataaactgtgatggatacacaccattgaatactgtgcagcagttcatagcaacaaaccagataaacaaatagcaatgtaacaatccattgtaacaaatagcaatacaaatagctctaaaaaatttcttgttgagtgaaaaagatcagaaacaaatgagatatatgaaagttctgtgtatgtaaatacagaacagatagacatgcaaaccccatcacatattttataagggtacctacatatttagtaatatatattgtttcagctatctaccgatgcataataaaccaccccaa

SEQ ID NO: 102844 - DNA, 578 bp, Homo sapiens
gctgactcagccaaattgtattcctccttcaagacccaactgactctttctctaggaagtcttctctaactttcccctcccactacaaggcagaactaatgttcccatagcacttagtacagatctctattacagcacttattgtactgactcagaactatttatgtgttggtctctaattaaaatgtggctggtccgagtgcagtagtgtttacaagtaattgatataagaagttacaaatttctttgttgcctcttcattcccactgcttcacttggctagccttaaaaaaaaagaaaaaaagaaaaaaaaaaagtcaattttttttttttttccctgagatggaatctcaccctgttgcccaggctggagtgcaatggcgtgacctcagctcactgcaacctatgcctcccaggttgaaacgattctcctgcctcagcctgctgagcagctgggattacaggcgcccaccactacactcagctaattttgtgtgtgtgtgtgtgtgtgtgtgtgtgtgtgtgtgtgtgtgatggagtcacgctctatcgcccaggctagagtgcagtggcgtgat

SEQ ID NO: 102845 - DNA, 401 bp, Homo sapiens
tgaaagaagccagatgcaaaagaccaaatattatctgattccatttctacgcagaataagcaaatccacagaaacagaaaaagatagtggttgccagggaggggaataagtagtctgcagatgaatgttgggtttcttttggggatgttgaacatattctggaattaagacagtggtaatagttgaacaactctgtaaataaactaactactgaactgtatactttaaaagagtgaagtttttggtatgtgaattatatctctataagtacagtagttccccatcaaccacagttttgctttctgtggattcagttaccaccatcaaaaaataggtgagtacagaacaagaatatattttgagagagagatcacattcacataacttttattacagtatgt

SEQ ID NO: 102846 - DNA, 379 bp, Homo sapiens
catgtcctaatatagtcaaagtttggggctctgcactgtgcaactctgttttacacatgagggaatggagactcagaatccttagccacacagcttgcaggaggcaggatggtgcctcagcctcaggccttcagagtcttcctctggtgggcttctccccaagcaagacagagtcctggagacttcataaaagtgttatgctggcaggagattgctggtgtgcccgtggggtggaggtagactggactccagggaacaggaacggctttcagaattatccctggtagagctgaccttttcacacattggtggcaagactcatttcaatctgcaaagtgggaagatttcagagaatgagaaaggcgagatgaagttctgt

SEQ ID NO: 102847 - DNA, 403 bp, Homo sapiens
ttcattttccttcacctctctgcagcattcagaactgctgaccaccttcaccttcctggttcctgggacagcactttcttttcctcctctcatagttctctgcatcctccacttgttcctgtgactgttcccccaggactccccagggctcctttgttctctctgtcatgtcctctgtggcaatcttattacatggcttccacaatcacctccattgagaagacaccttcaaacggaaatcccaatggaacttccaactcaaatgcgtcctaatgaactcctgatcttccctgcaaaccaggccccctccagttcccaccagtttcagaaaaggtactaccatcctcctattcatactgcctcaaatccttccagttgtcttcccccttctgttttgccttcc

SEQ ID NO: 102848 - DNA, 354 bp, Homo sapiens
tgagatggggtcttgctatgttgcccaggctggtcttgaactcctgggctcaagcagtcctcccacctcggcctcccaacgttctgggattacaggcgtgagccaccacccccggccaaccagtacaatcctaaagacgaagcacaatcaaagcaatagctaccaagaggtggaagtgctccagctaaaacacaagccaactggtcaagagcaaaggtcatggctgttttgggggatgttattaaacaaaaataatgctattaaattctagctaaaaactgttatttgataatgactctgaacatgggtattgctcccatttagttaaaaggggacacaaataactcataggga

SEQ ID NO: 102849 - DNA, 376 bp, Homo sapiens
gtgttcttattttttactaccttttttttgccttcccatgcctttttacatgttattggctctgactagaaagcctctctctcctacctctgacctcccaaattcttcctgtactctgaagctgagcctatatgcttcttcttccatgcagtttcccttgatattacagtcagaagttttcctatgagctgcttttctattttatttatttcctcccccttgctttcatattttatatctctcttaagatgcctaggatatgctacttcataataagatcatttgcatatggatctatttccctcactagtttgcaagccccctgtaggcaggtatctgctgtgttgtcaccaatgccttgcaacccaaaaagtac

SEQ ID NO: 102850 - DNA, 294 bp, Homo sapiens
tcctcctcagcattcccagtaactaagacaacagctaccacacctagctaatgtttttttaaaaaaaatcttgtagagatgggaatgatgttgacccactatgttgtcccagcaagagcattttatttaaagaatttttagaattgaaaaatcgctttttaaaatgtctcatctcaaaaacataacactgctagaggcctatatgtgggtattcatcttttataaaagggttcgataaatcaggttttcagaatggaaaaaggggcatttcctctgttgcaaagatgaccctct

SEQ ID NO: 102851 - DNA, 932 bp, Homo sapiens
accctccctgagacactcctcttcactcctgcctggcttcctttcacctccctgcccactctgccttggcccccttcataagcaattcttcccctgccaccccttacctagtggtactccaggttgctgtattgtcctctcccaggttacagcatcctttcccataattcccagactgccaccccagcctggacctctttcctgagctccagacccaacattccaggggctgctgaactcctcgcttagagtcccatggacatcccaaatcaacaggcaaaactaaattcatcttctccctgtccccacacctgcaccccataattgatgctcccctagattcaaaactctgtaaatggccggagtgcaaatccccatttgctagttgtggaaccttgttcctcattctcttcatctgcaaaatggggataatgctggttcctacctcacagggggaccggaaaactaagtgggttcatacatgtaatacccatagaacagttggcataccgtaagtgcccaaatgatgctagctgttattatcccccaccccagacactactttagttcagttccttatgtttttttcacccagataagaacaacaactgcctcactggcctccccagtgctcactctgtccctccccaacccattctctgcaacaacatgaccgttctaaaatacagccctgctcatctccctccctcatgaaccacaggatgaagtccaagaatctcttcacagacctctccagtctggctcctgcctctctttcagtggcctctcactctactcccccagcctcccacacaacaccccagccacattaaacagagccctcctcccagcatcgcacactctctcctttctccctctgccagcaacacccttcccaccctttcatcacctcacttgtatgtgtccttcct

SEQ ID NO: 102852 - DNA, 278 bp, Homo sapiens
ggcagaggcagggccataccatcatcttgggtgcacctattatgggaggctggagtgcaatggtgccatcttggctcactgcaacctccgccccccaggttcaagcgattctgcctcagcctcctgagtaactgggatcataggcgcacgctaccacgcccggctaatttttctatttttagtagacatggggtttcgccacccccggcagcatgggtagacatggccctcccgcctgatctcttaaaaaaactttaaataattcgtggggggggtta

SEQ ID NO: 102853 - DNA, 803 bp, Homo sapiens
agccttagatttttaagactttgatcaaagaggttcaacttacttagtggaagtttccatttgaaaaattcacatcttttgaacatttcactcatgagccggaaagaagaaaatctgcatggatggtatcccagggactttaccttatcaacatctgttactttaatcataatatttcctagtggtatgtggggcatatctcactcctcctcctctggtattcatatgggaggattttcctaaatactcctggcccctgggccctcccctcatccacttcttcccatgggaagagagtgtctcatataattggttggttttgggtatttggctcagcccgtagagcaggggcactctggtctgtcttccatgctctgaggttttcgggctgggccctatgtggggagcctgtaattgcccagtgctccctggggcggaggaggtaaaattggggatgatattggaaagctctattctccaacagctttatcatcagtaaggtggatcacttcctcttcccctgccagcttgtctgcccccagctggcgtagcacttgtgtggggaaagaggtgttttttattgccctcccatcccaacattttacttatacttttgattctaaattttaattttcccttaatcaaattgatggagccataaataagatagatcatctgttatcagtttctttatcattgacttccatataagaatagaaaactggccatcaactgatcttttacccttactcctcacagtttgctatcgacgttgctgtggagctgggttggcattcttaaga

SEQ ID NO: 102854 - DNA, 993 bp, Homo sapiens
attctgccttacagcaatggttcagcatgtataaacctatcacctacaacacaaacctgctcacagaagagaccgactcctttgtgaataagctagatcccagcaaagtgtttaagagcaagaacaagatcgtaatcccaaaaaagaaagggcctgtgcagcctgcaggtggccagaaagggccctcaggaccctccggtccctccacttcctccacttctaaatcctcctctggctctggaaaccccacccggaagtgagcacccctccctccaactccctaccagctccagagtggtggtttccatgcacagatggccctaggggtgacctccagttttgcgtgtggaccgtaggcctctttctagttgaatgaccaaaattgtaaggcttttagtcccaccgacattagccaggctcgtagtgaggcctccagagcaggttgtgctgtcccctgcctctggaagcaatggggaatttggaatcttgtgtaagtgcccaaataagtctgagtgctttcctcttcttcaacactcaaccctcaatcccttagcactgattgattagagaggtcccccaaagaaaccactggtttgacccatgaagcattagaactgcattgttcattcaggagccactagtcacatatgactatttaaatttaaagtaaattgtatgaaaaattcatttcttcaattgcattagccacattttgagtattcatgtggctggtagattctgtattagcacaaagatatggaacatttccatcaccacagaaagttctgttggacagcactgcattagaatattttcatactgctcttcctcaattaatttttgttgttaatgttgatgtcttcattggatgggtcataatgttccatgaaacctctcaagtacacaattgtatgttctttgtatcccttaccacaaatatctcgctctgctcatttcttttgcagcttcctataaagtttgtcttcctcatca

SEQ ID NO: 102855 - DNA, 462 bp, Homo sapiens
tttgtatttttttttctggtgacggggtttcaccatgttggtcaggctggttttgaactcctgacctcgtgatcagcctgccttggcctcccaaagtgctgggattacaggcgtgagtcactgcgcctggccccccacctttttttttttttaacttgataccactgataggatctaactggactttagatataacttttgaaattcagttacaaactgttgtctccaaagctaccaaaactttgaactgtgatttgattcttccttgaattcctcccagttatctctctagtaaacttcctttcctaaactgtctatccaaacaaatttttctggcaaaagtggccctatcttaggcctctctaagagaccaggcttgcttagctagtgtgttttcccagcagatgttgctaccaagatcaattatttcttcctgatccttcagtatttttctttcttttt

SEQ ID NO: 102856 - DNA, 748 bp, Homo sapiens
atgatttatctataagctatgtaacaaattaccccaacacctagcagcttcaaaccaaagcgaacaaacaaaacaagtcctgttacctcctatcttacagtttctgtgatcaggaatccaggaggggcttagctgggagtctctgactcagggtctctcacaagctgtatcaacaatcaaggtattgactgggcctcagtcatctcaaggctaggcgtagggtcgaggacctctcccaggcttactcacatgactgctggcaggccgattggcctcactgaccctggctgtacacatcagttctttgccacatgggcctctgtataaagaatggttgcaacatggcagcttactccccccagagagaaggctcccacagagaaaaagagaaagacagaagtcagattctttctgtaacctcagaagcgacatcccattatttttgccattttatattcattagaagtgagtccctaggcccaactcacactgaagggaagggggtgacacaaggacatgaacacctggaggcagggattatcggggccactttaaagcctgcccatgtcctctaatattcaagtacacttgtgtgggagcttccctagagtatatagctgggagtagaattgcggagttataagatttatgtgtattcaattttattgggtcatttctaaactttccaaagtgttaaaccagtttgcactccctccagcagtggatgagcattcttgttgctctacat

SEQ ID NO: 102857 - DNA, 84 bp, Homo sapiens
gtccactttggagaaattccatcacccaaggccttctaagtcagtgatgacaggctaatttcaatgaatcatttcccaacaatg

SEQ ID NO: 102858 - DNA, 135 bp, Homo sapiens
gatttttttgttagttattgtaaatcggattattttcttgataattacttgttcatgtattaactaacatttactgtatctgaatattcagaaattgaatagtaggacagcttgattaattttatttcttcaata

SEQ ID NO: 102859 - DNA, 602 bp, Homo sapiens
  misc_feature (64)..(64): n is a, c, g, or t
aacaggactcctctttcttaacacagatctgcataaggtattaccaaccaaatcctcttgatgngcaacacatttttcagctgccagtcagaccaactgctgtaaagaacttatatcaaagtgagaagccacagaaatggagagtggaaatatatagtgtcaaaagaagattaagacagtttggcaactgagtgacagctcacccatagaccatctgaatttcacaaacctgatttttcggaattaacactaaacggtagcctggaagaaaggatattctttactaacatggttacctgcagccaggtgcatttcaagtgaagtgtgctgatgaagtcctctataaggttcctgggaggcgggaggcggccagcctggttcatcagcatccagtcctctagtgctgccacctaatggacgcttaataatctctggatacttggaaattctgagatgcatttgtggccagtctccagcatgcacacaggacttggattatgcatttgtgtgtgacgtcttactctccctcccagctgctccttttgtctattattctaagacctgtctgaggtatgcatacacttctgcaagctggttctcaa

SEQ ID NO: 102860 - DNA, 731 bp, Homo sapiens
gccaccgcgcccggccgcaaaggccctatttctaaataaagtcccattcacaagtttcaggggccaggatgtgaacagatcttccaggagacaccaagcagcctcagtgtccattgatggatccgggccctcccttcaagccttttcccatcccccctccacctcctgcaccgagaccccagcatgaagcttcctcgggcctcaccgacctctgctaagtccaggagacgctgtgagcacccgagggtagggcctgaggctccctgcccccacctgggctggcacctgggagaggagggttcccctcagcagttagctgtgggctggctgtgcgccccttgccaagctcctgggacacgggctgagcagagcccagggtgccccagccccttcccgagtccctgctgggcccgtgtcgcccactgatggggagatgcccaagttctgtgaccccgggggcaggatggtgaggcggcccctggggacccagagtcctgccctgccagggcctcctgcaccctcaaccccaaacccagaaaagtcaggcggagcccaaggccagagcaggccagtcacagctgggaggcggggggcccaggggccaggaaggccgggatggagccctcggcccatcgccctgcacagccgcccctgcgctgcctctgtctccccatgtctctctgtctctctccgacttgctgtatctctgtatccctctgtctctctgtgtc

SEQ ID NO: 102861 - DNA, 332 bp, Homo sapiens
ggctgaggtgcctaaggaagtttagaagcagcacatctttgcattctcttagaaatcctgggtcacagccaggcacggtggctcacacctataatcccaacactttgggaggccaaggtgggtggatcacttgaggtcaggagttcgagaccagcctggccaattggggaaaccccatctctactaaaaatacaaaaatgtggcaggcgtctgtaatcctagctacgcaggaggctgaggcaggagaatcgcttgaacccaggaggcagaggtcacagtgagctgagatatgccactgcactccagcctgggcaacagagtgagactgtttg

SEQ ID NO: 102862 - DNA, 533 bp, Homo sapiens
tgtttgattttagcagccagagaaatctgtccagtgaagtaaacttgtttaaaactattaacctttcagcgagaacagttgctctgagttgaggatattgacagcatgttgatctggggagagattgaaagtgcccccaacccgttatcaaacactgaatggctctggaagttaacttttgcagcagacttgataatgtttcttagtttgtgccatctaaaattgcaaaacaaaagtgtttatatgtagaatttatattgcagtaaagtcatttcagtgacaacatggtatgaatcataagtaataaaaagccagctgctttacacattttgtgttctgtcagaagttaaaacacaaagggagaccttcattgctaaataggattgtagcagatgcatttccaagttcaaattatagttgcagaaagttttagacctcattgcaagtatgaaggaaatttctatatttcaaaatttaactacagttgaattgaaagtgattaatctgcaatgtgatgacacgctaaaagataa

SEQ ID NO: 102863 - DNA, 170 bp, Homo sapiens
aagaaagcgccttgcggggagcagggaggaggggccaaggttgaaaacccatgtattgggtactgtgtgctcacttcctgagtgacaggtttagtcatactccagacctcagcataacacaatatagctatgtgttgttgttgtttgttgttgttgttgctgtttttgag

SEQ ID NO: 102864 - DNA, 640 bp, Homo sapiens
gtgcctccaagatcccttctctctgccttcatcgatgccaggaaagcagtcaccttttgcctttctttgcttctcagcaagtggcatgtctccatgtcactttaagcatcaagcacacggagcccaataagatgctgaaaagtgtctgcctacaaggttacaaggcggtggagacattctgagccggtaactgcagggctcagtaaaaccgctacaggaaatctcaagttcaaaatgctgaagtgaaaaatgggtgatcacaacgaagggaaacacaaaccccttcttttaaaaacattatggtgataaggcacaacataaaatttaccatattagccacttgtaagtatacagtgcagtagtgttaaaaatatacatgttgagtaacgagtttctagaacttgcttctcttggagaactgaaactatagccactatacaacaactccccatttctctatcccctggcttatggaaacaaccgctctattttctgtttctatgagtttgactaatttcgaacctaatgtaagagaaattgtacagcatttgtctttgtgtgatgggctgatttcaattagtgtaatgttttcaaggttcatctatattgcagcatgtgacagggcttctttcttttttaa

SEQ ID NO: 102865 - DNA, 386 bp, Homo sapiens
aaaaaaaaaaaaaaaaaaacaaaaaaatgtggtagaaggggagagagcctcaaaatgaccagagtagatggactcgtgtagtaaaactttacccaaagttggtttcctaatgatataatgtgaaacagtctatgtgctatacaaataattatatctcttttgttaagccttacgtcattttgacaaaggctttacttgattgagtattgacggcttttccaaaataaaatccagctcttaattgagatttgtggctgggcatggtagctcatgcttgtaatcccagcactttgggacacttagcagggaggattgctggaggccaggagttcaaaaccagaatgggcaacatagtgagattccatgtctccccccgccaaaaaaaa

SEQ ID NO: 102866 - DNA, 443 bp, Homo sapiens
gagcgtatttctgtttcttatgccttgctaagaatacttatttggcttccaataaaattactctagaaaaccctaagagatttgtttaaattgcttttataacatatgcttatagtatatgttataaaattgacagggcagtgactaaaaaagattagaagttcacaaactgtgggatttaattttcttttgggtaagcttagcaaaaacagtaggaaataccccagtggcatagagagcagaattctacatagggtacactccctgccccagccttgttcaaatttactgtttttggaggccttatttacgtctggccccaccctggagtcttgcctcacagaactgattagaagagatgagagtactgggtggtgaatcctgcagcctttctagagccagtgctcacaatattctgaaacctaaaagcagataaatggaaa

SEQ ID NO: 102867 - DNA, 1948 bp, Homo sapiens
tggggcgcagcttgatggcgtcgggctggagagccgcagtcccggctgcagcacctgggagaaggcagaccgtgtgagggggcctgtggccccagcgtgctgtggcctcggggagtgggaagtggaggcaggagccttccttacacttcgccatgagtttcctcatcgactccagcatcatgattacctcccagatactattttttggatttgggtggcttttcttcatgcgccaattgtttaaagactatgagatacgtcagtatgttgtacaggtgatcttctccgtgacgtttgcattttcttgcaccatgtttgagctcatcatctttgaaatcttaggagtattgaatagcagctcccgttattttcactggaaaatgaacctgtgtgtaattctgctgatcctggttttcatggtgcctttttacattggctattttattgtgagcaatatccgactactgcataaacaacgactgcttttttcctgtctcttatggctgacctttatgtatttcttctggaaactaggagatccctttcccattctcagcccaaaacatgggatcttatccatagaacagctcatcagccgggttggtgtgattggagtgactctcatggctcttctttctggatttggtgctgtcaactgcccatacacttacatgtcttacttcctcaggaatgtgactgacacggatattctagccctggaacggcgactgctgcaaaccatggatatgatcataagcaaaaagaaaaggatggcaatggcacggagaacaatgttccagaagggggaagtgcataacaaaccatcaggtttctggggaatgataaaaagtgttaccacttcagcatcaggaagtgaaaatcttactcttattcaacaggaagtggatgctttggaagaattaagcaggcagctttttctggaaacagctgatctatatgctaccaaggagagaatagaatactccaaaaccttcaaggggaaatattttaattttcttggttactttttctctatttactgtgtttggaaaattttcatggctaccatcaatattgtttttgatcgagttgggaaaacggatcctgtcacaagaggcattgagatcactgtgaattatctgggaatccaatttgatgtgaagttttggtcccaacacatttccttcattcttgttggaataatcatcgtcacatccatcagaggattgctgatcactcttaccaagttcttttatgccatctctagcagtaagtcctccaatgtcattgtcctgctattagcacagataatgggcatgtactttgtctcctctgtgctgctgatccgaatgagtatgcctttagaataccgcaccataatcactgaagtccttggagaactgcagttcaacttctatcaccgttggtttgatgtgatcttcctggtcagcgctctctctagcatactcttcctctatttggctcacaaacaggcaccagagaagcaaatggcaccttgaacttaagcctactacagactgttagaggccagtggtttcaaaatttagatataagaggggggaaaaatggaaccagggcctgacattttataaacaaacaaaatgctatggtagcatttttcaccttcatagcatactccttccccgtcaggtgatactatgaccatgagtagcatcagccagaacatgagagggagaactaactcaagacaatactcagcagagagcatcccgtgtggatatgaggctggtgtagaggcggagaggagccaagaaactaaaggtgaaaaatacactggaactctggggcaagacatgtctatggtagctgagccaaacacgtaggatttccgttttaaggttcacatggaaaaggttatagctttgccttgagattgactcattaaaatcagagactgtaacacttt

SEQ ID NO: 102868 - DNA, 2716 bp, Homo sapiens
tggggcgcagcttgatggcgtcgggctggagagccgcagtcccggctgcagcacctgggagaaggcagaccgtgtgagggggcctgtggccccagcgtgctgtggcctcggggagtgggaagtggaggcaggagccttccttacacttcgccatgagtttcctcatcgactccagcatcatgattacctcccagatactattttttggatttgggtggcttttcttcatgcgccaattgtttaaagactatgagatacgtcagtatgttgtacaggtgatcttctccgtgacgtttgcattttcttgcaccatgtttgagctcatcatctttgaaatcttaggagtattgaatagcagctcccgttattttcactggaaaatgaacctgtgtgtaattctgctgatcctggttttcatggtgcctttttacattggctattttattgtgagcaatatccgactactgcataaacaacgactgcttttttcctgtctcttatggctgacctttatgtatttcttctggaaactaggagatccctttcccattctcagcccaaaacatgggatcttatccatagaacagctcatcagccgggttggtgtgattggagtgactctcatggctcttctttctggatttggtgctgtcaactgcccatacacttacatgtcttacttcctcaggaatgtgactgacacggatattctagccctggaacggcgactgctgcaaaccatggatatgatcataagcaaaaagaaaaggatggcaatggcacggagaacaatgttccagaagggggaagtgcataacaaaccatcaggtttctggggaatgataaaaagtgttaccacttcagcatcaggaagtgaaaataacaccatggcataagacaatcccatgaagataagatataaaagaagataatgtttgaaaagaaataaggtaatgtctgtaaatcctagcctatattagaacacagtaaagtattagttcccttttctaacattatattcagataatgtaggagaaagctatgctttattatagttattattctgtaactatttacaatcttgaacattacatttgacttaatctaactagataaatcaaaaaacaaatgaaactatctgtttgagctgcttgacttaagagaaactgagtggtaattgtttggtggcgatgctcttgatggagaagcttttacacacctgcgtcagaggttgggaaagttgctctgaagtagtgttgctggctatgaaacaggaaattgagaatataggcaactccgggaatccactgtaggaaaaactaaaagtatatgctttctcattgccatttcttgaaattcctatgtgattaaaaccttgatgcccattctgtgccagatcttactcttattcaacaggaagtggatgctttggaagaattaagcaggcagctttttctggaaacagctgatctatatgctaccaaggagagaatagaatactccaaaaccttcaaggggaaatattttaattttcttggttactttttctctatttactgtgtttggaaaattttcatggctaccatcaatattgtttttgatcgagttgggaaaacggatcctgtcacaagaggcattgagatcactgtgaattatctgggaatccaatttgatgtgaagttttggtcccaacacatttccttcattcttgttggaataatcatcgtcacatccatcagaggattgctgatcactcttaccaagttcttttatgccatctctagcagtaagtcctccaatgtcattgtcctgctattagcacagataatgggcatgtactttgtctcctctgtgctgctgatccgaatgagtatgcctttagaataccgcaccataatcactgaagtccttggagaactgcagttcaacttctatcaccgttggtttgatgtgatcttcctggtcagcgctctctctagcatactcttcctctatttggctcacaaacaggcaccagagaagcaaatggcaccttgaacttaagcctactacagactgttagaggccagtggtttcaaaatttagatataagaggggggaaaaatggaaccagggcctgacattttataaacaaacaaaatgctatggtagcatttttcaccttcatagcatactccttccccgtcaggtgatactatgaccatgagtagcatcagccagaacatgagagggagaactaactcaagacaatactcagcagagagcatcccgtgtggatatgaggctggtgtagaggcggagaggagccaagaaactaaaggtgaaaaatacactggaactctggggcaagacatgtctatggtagctgagccaaacacgtaggatttccgttttaaggttcacatggaaaaggttatagctttgccttgagattgactcattaaaatcagagactgtaacacttttgccttacgttcattttatcaagcatagcttggtatttattatgcttgtgtgatctaacatgagttagcatcccacacctcctcttctgatcctgccccattaaaataaccaagaggttatctgttcttttccgggaaaggggtggtatgcacctgaaatagattttaccaaaagagagatttcagttatgtcattttttcttgatttcctgtgaacttagtattataccctactttcaattcggtagtga

SEQ ID NO: 102869 - DNA, 833 bp, Homo sapiens
attaggaagacagtatgcgacgcgcgagttccaaagatgtgcattttcggctaccatcaatattgtttttgatcgagttgggaaaacggatcctgtcacaagaggcattgagatcactgtgaattatctgggaatccaatttgatgtgaagttttggtcccaacacatttccttcattcttgttggaataatcatcgtcacatccatcagaggattgctgatcactcttaccaagttcttttatgccatctctagcagtaagtcctccaatgtcattgtcctgctattagcacagataatgggcatgtactttgtctcctctgtgctgctgatccgaatgagtatgcctttagaataccgcaccataatcactgaagtccttggagaactgcagttcaacttctatcaccgttggtttgatgtgatcttcctggtcagcgctctctctagcatactctttatcataaatggagaacaaacagggcacaataaaaacagatgggaatcagtgaaagaaagcactttactaacatttacgatgacatcggtttttaaattaggatgaaagaagggctattaatagaaacataagctgtcaatttgttaacattcaatatgcgtatgcgtattatattcaccttctaattgtctgacttacttgttcgagattgcgttttacaaatagtaggtaccagacgagcttatttatgagcttatatttgatttattcattctcatttatcaacatacgtcgatttgtcagtcgtataatgagtgaatggaatcaaaatattatgatatagaataattgcaatacggtggaggggttaggt

SEQ ID NO: 102870 - DNA, 855 bp, Homo sapiens
tggggcgcagcttgatggcgtcgggctggagagccgcagtcccggctgcagcacctgggagaaggcagaccgtgtgagggggcctgtggccccagcgtgctgtggcctcggggagtgggaagtggaggcaggagccttccttacacttcgccatgagtttcctcatcgactccagcatcatgattacctcccagcagataaccttgccctcgtacttactcaacaaaagtgaagccaaaagatactattttttggatttgggtggcttttcttcatgcgccaattgtttaaagactatgagatacgtcagtatgttgtacaggtgatcttctccgtgacgtttgcattttcttgcaccatgtttgagctcatcatctttgaaatcttaggagtattgaatagcagctcccgttattttcactggaaaatgaacctgtgtgtaattctgctgatcctggttttcatggtgcctttttacattggctattttattgtgagcaatatccgactactgcataaacaacgactgcttttttcctgtctcttatggctgacctttatgtatttcttctggaaactaggagatccctttcccattctcagcccaaaacatgggatcttatccatagaacagctcatcagccgggttggtgtgattggagtgactctcatggctcttctttctggatttggtgctgtcaactgcccatacacttacatgtcttacttcctcaggaattgttgactggaccaccggatatttcaagccctgtgaacggggaactgctggaaaccatggcatattgatccattaagcaaaaacgcacaacgggcttggcaatgggcccggagaaa

SEQ ID NO: 102871 - DNA, 3694 bp, Homo sapiens
  misc_feature (1695)..(1695): n is a, c, g, or t
  misc_feature (2014)..(2014): n is a, c, g, or t
tggggcgcagcttgatggcgtcgggctggagagccgcagtcccggctgcagcacctgggagaaggcagaccgtgtgagggggcctgtggccccagcgtgctgtggcctcggggagtgggaagtggaggcaggagccttccttacacttcgccatgagtttcctcatcgactccagcatcatgattacctcccagatactattttttggatttgggtggcttttcttcatgcgccaattgtttaaagactatgagatacgtcagtatgttgtacaggtgatcttctccgtgacgtttgcattttcttgcaccatgtttgagctcatcatctttgaaatcttaggagtattgaatagcagctcccgttattttcactggaaaatgaacctgtgtgtaattctgctgatcctggttttcatggtgcctttttacattggctattttattgtgagcaatatccgactactgcataaacaacgactgcttttttcctgtctcttatggctgacctttatgtatttcttctggaaactaggagatccctttcccattctcagcccaaaacatgggatcttatccatagaacagctcatcagccgggttggtgtgattggagtgactctcatggctcttctttctggatttggtgctgtcaactgcccatacacttacatgtcttacttcctcaggaatgtgactgacacggatattctagccctggaacggcgactgctgcaaaccatggatatgatcataagcaaaaagaaaaggatggcaatggcacggagaacaatgttccagaagggggaagtgcataacaaaccatcaggtttctggggaatgataaaaagtgttaccacttcagcatcaggaagtgaaagtatcctttgtccctctgcttgattctttttctcaactctggaccaagagcaaaagaaaaaaagtagtgttgggatagtcccttctaaggtacctgactacatcagaggtccaaactcctaagagctaggcttcggaaataccatgtgtacagtcatctttccagcacctgcacaatatcataaaatcattgtctttgagctgaagtggtcctaaaaagtcagcctttccattttacagatgagaaaatagacccagagaggttaagtcacacggtggtttgtggcaaagctagaaacataactgtggtctcctcttcatagttctttccactacactattacatttctcaactctgaaaaaccaccataaagcataatggctacctaaaataaatggcccatttctaaagtaattagtattcctaaacaaattttaagtagctctgcttctccagtgacattttggtttaaagaatcaaggggaggctgggtgcagtggctcatccctgtaatcccagcactttgcaaggccgaggtgggcagatcacttgaacccaggagttcaagacaagcctcggcaacatgacaaaacctcatctctacaaaaaatacaaaaattagccaggcccagtggcatgtgcctgtaatcccaactactcaggaggctgaggtgggaggattgtttgaacttgggaggctgaggtaggagtgagcccagatcacgccactgcactcctgcctaggcaacagagctagaccctgtctcaaaataaaaaagaaaggataaaggagatttgattaatagattaataaantgttctttcctgattggttatgatgttgaactacttcccaaattatgtaaccaaatttctgtgtggctctggtgctattaggtcaaaactttggggaactaagcatgagatagcatactcctgtttccttctctgtcccagggaaatacaaattcccttttgcctcaattagagaaggatgtctattcttgctacaaattatgatttatgtcctggtgtcaaatgaagataagaataagatcaaagaaaggcaagatgattgtggaagagaaagaaaaaggattaatttagatttatttaaccaagaaacatttatttngtatctcctatttccaggctgagtgctaagaaataaaatgatgagtagagtatagcctttctcctcaaggagcttaccctctaatcatgggagagacagacatgtaactagttaaaccatattgtttggtggcttgaaccatgccagtagtagccactattaaggaaggaactgaagggcacttactgatttgggtaatagtgggaaaaatcagagaggagggaggatttagattgaagtatgtgcttctattttagaaggggctatatttactatgtttattacttaaaagttcataaaagccaataatatgggtttgagctgtgttagtgatgagttaacaaacatatcaggactatttaacctccctgagcccctgttctctaaatgggagaataataactctacctgattgagttcttggaaaataacatagtgtaacggaaagagcaggctttggaggaaaagaggatttgactttgcatctctatcaattaattgtgtgactttgagcaagttatttaactctctgagcttcactttccttatgtgcaaaatggataacaccatggcataagacaatcccatgaagataagatataaaagaagataatgtttgaaaagaaataaggaagtggatgctttggaagaattaagcaggcagctttttctggaaacagctgatctatatgctaccaaggagagaatagaatactccaaaaccttcaaggggaaatattttaattttcttggttactttttctctatttactgtgtttggaaaattttcatggctaccatcaatattgtttttgatcgagttgggaaaacggatcctgtcacaagaggcattgagatcactgtgaattatctgggaatccaatttgatgtgaagttttggtcccaacacatttccttcattcttgttggaataatcatcgtcacatccatcagaggattgctgatcactcttaccaagttcttttatgccatctctagcagtaagtcctccaatgtcattgtcctgctattagcacagataatgggcatgtactttgtctcctctgtgctgctgatccgaatgagtatgcctttagaataccgcaccataatcactgaagtccttggagaactgcagttcaacttctatcaccgttggtttgatgtgatcttcctggtcagcgctctctctagcatactcttcctctatttggctcacaaacaggcaccagagaagcaaatggcaccttgaacttaagcctactacagactgttagaggccagtggtttcaaaatttagatataagaggggggaaaaatggaaccagggcctgacattttataaacaaacaaaatgctatggtagcatttttcaccttcatagcatactccttccccgtcaggtgatactatgaccatgagtagcatcagccagaacatgagagggagaactaactcaagacaatactcagcagagagcatcccgtgtggatatgaggctggtgtagaggcggagaggagccaagaaactaaaggtgaaaaatacactggaactctggggcaagacatgtctatggtagctgagccaaacacgtaggatttccgttttaaggttcacatggaaaaggttatagctttgccttgagattgactcattaaaatcagagactgtaacacttt

SEQ ID NO: 102872 - DNA, 3714 bp, Homo sapiens
  misc_feature (1715)..(1715): n is a, c, g, or t
  misc_feature (2034)..(2034): n is a, c, g, or t
tggggcgcagcttgatggcgtcgggctggagagccgcagtcccggctgcagcacctgggagaaggcagaccgtgtgagggggcctgtggccccagcgtgctgtggcctcggggagtgggaagtggaggcaggagccttccttacacttcgccatgagtttcctcatcgactccagcatcatgattacctcccagatactattttttggatttgggtggcttttcttcatgcgccaattgtttaaagactatgagatacgtcagtatgttgtacaggtgatcttctccgtgacgtttgcattttcttgcaccatgtttgagctcatcatctttgaaatcttaggagtattgaatagcagctcccgttattttcactggaaaatgaacctgtgtgtaattctgctgatcctggttttcatggtgcctttttacattggctattttattgtgagcaatatccgactacttttgtctcctctgtctcagtgcataaacaacgactgcttttttcctgtctcttatggctgacctttatgtatttcttctggaaactaggagatccctttcccattctcagcccaaaacatgggatcttatccatagaacagctcatcagccgggttggtgtgattggagtgactctcatggctcttctttctggatttggtgctgtcaactgcccatacacttacatgtcttacttcctcaggaatgtgactgacacggatattctagccctggaacggcgactgctgcaaaccatggatatgatcataagcaaaaagaaaaggatggcaatggcacggagaacaatgttccagaagggggaagtgcataacaaaccatcaggtttctggggaatgataaaaagtgttaccacttcagcatcaggaagtgaaagtatcctttgtccctctgcttgattctttttctcaactctggaccaagagcaaaagaaaaaaagtagtgttgggatagtcccttctaaggtacctgactacatcagaggtccaaactcctaagagctaggcttcggaaataccatgtgtacagtcatctttccagcacctgcacaatatcataaaatcattgtctttgagctgaagtggtcctaaaaagtcagcctttccattttacagatgagaaaatagacccagagaggttaagtcacacggtggtttgtggcaaagctagaaacataactgtggtctcctcttcatagttctttccactacactattacatttctcaactctgaaaaaccaccataaagcataatggctacctaaaataaatggcccatttctaaagtaattagtattcctaaacaaattttaagtagctctgcttctccagtgacattttggtttaaagaatcaaggggaggctgggtgcagtggctcatccctgtaatcccagcactttgcaaggccgaggtgggcagatcacttgaacccaggagttcaagacaagcctcggcaacatgacaaaacctcatctctacaaaaaatacaaaaattagccaggcccagtggcatgtgcctgtaatcccaactactcaggaggctgaggtgggaggattgtttgaacttgggaggctgaggtaggagtgagcccagatcacgccactgcactcctgcctaggcaacagagctagaccctgtctcaaaataaaaaagaaaggataaaggagatttgattaatagattaataaantgttctttcctgattggttatgatgttgaactacttcccaaattatgtaaccaaatttctgtgtggctctggtgctattaggtcaaaactttggggaactaagcatgagatagcatactcctgtttccttctctgtcccagggaaatacaaattcccttttgcctcaattagagaaggatgtctattcttgctacaaattatgatttatgtcctggtgtcaaatgaagataagaataagatcaaagaaaggcaagatgattgtggaagagaaagaaaaaggattaatttagatttatttaaccaagaaacatttatttngtatctcctatttccaggctgagtgctaagaaataaaatgatgagtagagtatagcctttctcctcaaggagcttaccctctaatcatgggagagacagacatgtaactagttaaaccatattgtttggtggcttgaaccatgccagtagtagccactattaaggaaggaactgaagggcacttactgatttgggtaatagtgggaaaaatcagagaggagggaggatttagattgaagtatgtgcttctattttagaaggggctatatttactatgtttattacttaaaagttcataaaagccaataatatgggtttgagctgtgttagtgatgagttaacaaacatatcaggactatttaacctccctgagcccctgttctctaaatgggagaataataactctacctgattgagttcttggaaaataacatagtgtaacggaaagagcaggctttggaggaaaagaggatttgactttgcatctctatcaattaattgtgtgactttgagcaagttatttaactctctgagcttcactttccttatgtgcaaaatggataacaccatggcataagacaatcccatgaagataagatataaaagaagataatgtttgaaaagaaataaggaagtggatgctttggaagaattaagcaggcagctttttctggaaacagctgatctatatgctaccaaggagagaatagaatactccaaaaccttcaaggggaaatattttaattttcttggttactttttctctatttactgtgtttggaaaattttcatggctaccatcaatattgtttttgatcgagttgggaaaacggatcctgtcacaagaggcattgagatcactgtgaattatctgggaatccaatttgatgtgaagttttggtcccaacacatttccttcattcttgttggaataatcatcgtcacatccatcagaggattgctgatcactcttaccaagttcttttatgccatctctagcagtaagtcctccaatgtcattgtcctgctattagcacagataatgggcatgtactttgtctcctctgtgctgctgatccgaatgagtatgcctttagaataccgcaccataatcactgaagtccttggagaactgcagttcaacttctatcaccgttggtttgatgtgatcttcctggtcagcgctctctctagcatactcttcctctatttggctcacaaacaggcaccagagaagcaaatggcaccttgaacttaagcctactacagactgttagaggccagtggtttcaaaatttagatataagaggggggaaaaatggaaccagggcctgacattttataaacaaacaaaatgctatggtagcatttttcaccttcatagcatactccttccccgtcaggtgatactatgaccatgagtagcatcagccagaacatgagagggagaactaactcaagacaatactcagcagagagcatcccgtgtggatatgaggctggtgtagaggcggagaggagccaagaaactaaaggtgaaaaatacactggaactctggggcaagacatgtctatggtagctgagccaaacacgtaggatttccgttttaaggttcacatggaaaaggttatagctttgccttgagattgactcattaaaatcagagactgtaacacttt

SEQ ID NO: 102873 - DNA, 3666 bp, Homo sapiens
  misc_feature (1667)..(1667): n is a, c, g, or t
  misc_feature (1986)..(1986): n is a, c, g, or t
tggggcgcagcttgatggcgtcgggctggagagccgcagtcccggctgcagcacctgggagaaggcagaccgtgtgagggggcctgtggccccagcgtgctgtggcctcggggagtgggaagtggaggcaggagccttccttacacttcgccatgagtttcctcatcgactccagcatcatgattacctcccagatactattttttggatttgggtggcttttcttcatgcgccaattgtttaaagactatgagatacgtcagtatgttgtacaggtgatcttctccgtgacgtttgcattttcttgcaccatgtttgagctcatcatctttgaaatcttaggagtattgaatagcagctcccgttattttcactggaaaatgaacctgtgtgtaattctgctgatcctggttttcatggtgcctttttacattggctattttattgtgagcaatatccgactacttttgtctcctctgtctcagtgcataaacaacgactgcttttttcctgtctcttatggctgacctttatgtatttcttctggaaactaggagatccctttcccattctcagcccaaaacatgtgactctcatggctcttctttctggatttggtgctgtcaactgcccatacacttacatgtcttacttcctcaggaatgtgactgacacggatattctagccctggaacggcgactgctgcaaaccatggatatgatcataagcaaaaagaaaaggatggcaatggcacggagaacaatgttccagaagggggaagtgcataacaaaccatcaggtttctggggaatgataaaaagtgttaccacttcagcatcaggaagtgaaagtatcctttgtccctctgcttgattctttttctcaactctggaccaagagcaaaagaaaaaaagtagtgttgggatagtcccttctaaggtacctgactacatcagaggtccaaactcctaagagctaggcttcggaaataccatgtgtacagtcatctttccagcacctgcacaatatcataaaatcattgtctttgagctgaagtggtcctaaaaagtcagcctttccattttacagatgagaaaatagacccagagaggttaagtcacacggtggtttgtggcaaagctagaaacataactgtggtctcctcttcatagttctttccactacactattacatttctcaactctgaaaaaccaccataaagcataatggctacctaaaataaatggcccatttctaaagtaattagtattcctaaacaaattttaagtagctctgcttctccagtgacattttggtttaaagaatcaaggggaggctgggtgcagtggctcatccctgtaatcccagcactttgcaaggccgaggtgggcagatcacttgaacccaggagttcaagacaagcctcggcaacatgacaaaacctcatctctacaaaaaatacaaaaattagccaggcccagtggcatgtgcctgtaatcccaactactcaggaggctgaggtgggaggattgtttgaacttgggaggctgaggtaggagtgagcccagatcacgccactgcactcctgcctaggcaacagagctagaccctgtctcaaaataaaaaagaaaggataaaggagatttgattaatagattaataaantgttctttcctgattggttatgatgttgaactacttcccaaattatgtaaccaaatttctgtgtggctctggtgctattaggtcaaaactttggggaactaagcatgagatagcatactcctgtttccttctctgtcccagggaaatacaaattcccttttgcctcaattagagaaggatgtctattcttgctacaaattatgatttatgtcctggtgtcaaatgaagataagaataagatcaaagaaaggcaagatgattgtggaagagaaagaaaaaggattaatttagatttatttaaccaagaaacatttatttngtatctcctatttccaggctgagtgctaagaaataaaatgatgagtagagtatagcctttctcctcaaggagcttaccctctaatcatgggagagacagacatgtaactagttaaaccatattgtttggtggcttgaaccatgccagtagtagccactattaaggaaggaactgaagggcacttactgatttgggtaatagtgggaaaaatcagagaggagggaggatttagattgaagtatgtgcttctattttagaaggggctatatttactatgtttattacttaaaagttcataaaagccaataatatgggtttgagctgtgttagtgatgagttaacaaacatatcaggactatttaacctccctgagcccctgttctctaaatgggagaataataactctacctgattgagttcttggaaaataacatagtgtaacggaaagagcaggctttggaggaaaagaggatttgactttgcatctctatcaattaattgtgtgactttgagcaagttatttaactctctgagcttcactttccttatgtgcaaaatggataacaccatggcataagacaatcccatgaagataagatataaaagaagataatgtttgaaaagaaataaggaagtggatgctttggaagaattaagcaggcagctttttctggaaacagctgatctatatgctaccaaggagagaatagaatactccaaaaccttcaaggggaaatattttaattttcttggttactttttctctatttactgtgtttggaaaattttcatggctaccatcaatattgtttttgatcgagttgggaaaacggatcctgtcacaagaggcattgagatcactgtgaattatctgggaatccaatttgatgtgaagttttggtcccaacacatttccttcattcttgttggaataatcatcgtcacatccatcagaggattgctgatcactcttaccaagttcttttatgccatctctagcagtaagtcctccaatgtcattgtcctgctattagcacagataatgggcatgtactttgtctcctctgtgctgctgatccgaatgagtatgcctttagaataccgcaccataatcactgaagtccttggagaactgcagttcaacttctatcaccgttggtttgatgtgatcttcctggtcagcgctctctctagcatactcttcctctatttggctcacaaacaggcaccagagaagcaaatggcaccttgaacttaagcctactacagactgttagaggccagtggtttcaaaatttagatataagaggggggaaaaatggaaccagggcctgacattttataaacaaacaaaatgctatggtagcatttttcaccttcatagcatactccttccccgtcaggtgatactatgaccatgagtagcatcagccagaacatgagagggagaactaactcaagacaatactcagcagagagcatcccgtgtggatatgaggctggtgtagaggcggagaggagccaagaaactaaaggtgaaaaatacactggaactctggggcaagacatgtctatggtagctgagccaaacacgtaggatttccgttttaaggttcacatggaaaaggttatagctttgccttgagattgactcattaaaatcagagactgtaacacttt

SEQ ID NO: 102874 - DNA, 3634 bp, Homo sapiens
  misc_feature (1635)..(1635): n is a, c, g, or t
  misc_feature (1954)..(1954): n is a, c, g, or t
tggggcgcagcttgatggcgtcgggctggagagccgcagtcccggctgcagcacctgggagaaggcagaccgtgtgagggggcctgtggccccagcgtgctgtggcctcggggagtgggaagtggaggcaggagccttccttacacttcgccatgagtttcctcatcgactccagcatcatgattacctcccagatacgtcagtatgttgtacaggtgatcttctccgtgacgtttgcattttcttgcaccatgtttgagctcatcatctttgaaatcttaggagtattgaatagcagctcccgttattttcactggaaaatgaacctgtgtgtaattctgctgatcctggttttcatggtgcctttttacattggctattttattgtgagcaatatccgactactgcataaacaacgactgcttttttcctgtctcttatggctgacctttatgtatttcttctggaaactaggagatccctttcccattctcagcccaaaacatgggatcttatccatagaacagctcatcagccgggttggtgtgattggagtgactctcatggctcttctttctggatttggtgctgtcaactgcccatacacttacatgtcttacttcctcaggaatgtgactgacacggatattctagccctggaacggcgactgctgcaaaccatggatatgatcataagcaaaaagaaaaggatggcaatggcacggagaacaatgttccagaagggggaagtgcataacaaaccatcaggtttctggggaatgataaaaagtgttaccacttcagcatcaggaagtgaaagtatcctttgtccctctgcttgattctttttctcaactctggaccaagagcaaaagaaaaaaagtagtgttgggatagtcccttctaaggtacctgactacatcagaggtccaaactcctaagagctaggcttcggaaataccatgtgtacagtcatctttccagcacctgcacaatatcataaaatcattgtctttgagctgaagtggtcctaaaaagtcagcctttccattttacagatgagaaaatagacccagagaggttaagtcacacggtggtttgtggcaaagctagaaacataactgtggtctcctcttcatagttctttccactacactattacatttctcaactctgaaaaaccaccataaagcataatggctacctaaaataaatggcccatttctaaagtaattagtattcctaaacaaattttaagtagctctgcttctccagtgacattttggtttaaagaatcaaggggaggctgggtgcagtggctcatccctgtaatcccagcactttgcaaggccgaggtgggcagatcacttgaacccaggagttcaagacaagcctcggcaacatgacaaaacctcatctctacaaaaaatacaaaaattagccaggcccagtggcatgtgcctgtaatcccaactactcaggaggctgaggtgggaggattgtttgaacttgggaggctgaggtaggagtgagcccagatcacgccactgcactcctgcctaggcaacagagctagaccctgtctcaaaataaaaaagaaaggataaaggagatttgattaatagattaataaantgttctttcctgattggttatgatgttgaactacttcccaaattatgtaaccaaatttctgtgtggctctggtgctattaggtcaaaactttggggaactaagcatgagatagcatactcctgtttccttctctgtcccagggaaatacaaattcccttttgcctcaattagagaaggatgtctattcttgctacaaattatgatttatgtcctggtgtcaaatgaagataagaataagatcaaagaaaggcaagatgattgtggaagagaaagaaaaaggattaatttagatttatttaaccaagaaacatttatttngtatctcctatttccaggctgagtgctaagaaataaaatgatgagtagagtatagcctttctcctcaaggagcttaccctctaatcatgggagagacagacatgtaactagttaaaccatattgtttggtggcttgaaccatgccagtagtagccactattaaggaaggaactgaagggcacttactgatttgggtaatagtgggaaaaatcagagaggagggaggatttagattgaagtatgtgcttctattttagaaggggctatatttactatgtttattacttaaaagttcataaaagccaataatatgggtttgagctgtgttagtgatgagttaacaaacatatcaggactatttaacctccctgagcccctgttctctaaatgggagaataataactctacctgattgagttcttggaaaataacatagtgtaacggaaagagcaggctttggaggaaaagaggatttgactttgcatctctatcaattaattgtgtgactttgagcaagttatttaactctctgagcttcactttccttatgtgcaaaatggataacaccatggcataagacaatcccatgaagataagatataaaagaagataatgtttgaaaagaaataaggaagtggatgctttggaagaattaagcaggcagctttttctggaaacagctgatctatatgctaccaaggagagaatagaatactccaaaaccttcaaggggaaatattttaattttcttggttactttttctctatttactgtgtttggaaaattttcatggctaccatcaatattgtttttgatcgagttgggaaaacggatcctgtcacaagaggcattgagatcactgtgaattatctgggaatccaatttgatgtgaagttttggtcccaacacatttccttcattcttgttggaataatcatcgtcacatccatcagaggattgctgatcactcttaccaagttcttttatgccatctctagcagtaagtcctccaatgtcattgtcctgctattagcacagataatgggcatgtactttgtctcctctgtgctgctgatccgaatgagtatgcctttagaataccgcaccataatcactgaagtccttggagaactgcagttcaacttctatcaccgttggtttgatgtgatcttcctggtcagcgctctctctagcatactcttcctctatttggctcacaaacaggcaccagagaagcaaatggcaccttgaacttaagcctactacagactgttagaggccagtggtttcaaaatttagatataagaggggggaaaaatggaaccagggcctgacattttataaacaaacaaaatgctatggtagcatttttcaccttcatagcatactccttccccgtcaggtgatactatgaccatgagtagcatcagccagaacatgagagggagaactaactcaagacaatactcagcagagagcatcccgtgtggatatgaggctggtgtagaggcggagaggagccaagaaactaaaggtgaaaaatacactggaactctggggcaagacatgtctatggtagctgagccaaacacgtaggatttccgttttaaggttcacatggaaaaggttatagctttgccttgagattgactcattaaaatcagagactgtaacacttt

SEQ ID NO: 102875 - DNA, 3625 bp, Homo sapiens
  misc_feature (1626)..(1626): n is a, c, g, or t
  misc_feature (1945)..(1945): n is a, c, g, or t
tggggcgcagcttgatggcgtcgggctggagagccgcagtcccggctgcagcacctgggagaaggcagaccgtgtgagggggcctgtggccccagcgtgctgtggcctcggggagtgggaagtggaggcaggagccttccttacacttcgccatgagtttcctcatcgactccagcatcatgattacctcccagatactattttttggatttgggtggcttttcttcatgcgccaattgtttaaagactatgagatacgtcagtatgttgtacaggtgatcttctccgtgacgtttgcattttcttgcaccatgtttgagctcatcatctttgaaatcttaggagtattgaatagcagctcccgttattttcactggaaaatgaacctgtgtgtaattctgctgatcctggttttcatggtgcctttttacattggctattttattgtgagcaatatccgactacgagatccctttcccattctcagcccaaaacatgggatcttatccatagaacagctcatcagccgggttggtgtgattggagtgactctcatggctcttctttctggatttggtgctgtcaactgcccatacacttacatgtcttacttcctcaggaatgtgactgacacggatattctagccctggaacggcgactgctgcaaaccatggatatgatcataagcaaaaagaaaaggatggcaatggcacggagaacaatgttccagaagggggaagtgcataacaaaccatcaggtttctggggaatgataaaaagtgttaccacttcagcatcaggaagtgaaagtatcctttgtccctctgcttgattctttttctcaactctggaccaagagcaaaagaaaaaaagtagtgttgggatagtcccttctaaggtacctgactacatcagaggtccaaactcctaagagctaggcttcggaaataccatgtgtacagtcatctttccagcacctgcacaatatcataaaatcattgtctttgagctgaagtggtcctaaaaagtcagcctttccattttacagatgagaaaatagacccagagaggttaagtcacacggtggtttgtggcaaagctagaaacataactgtggtctcctcttcatagttctttccactacactattacatttctcaactctgaaaaaccaccataaagcataatggctacctaaaataaatggcccatttctaaagtaattagtattcctaaacaaattttaagtagctctgcttctccagtgacattttggtttaaagaatcaaggggaggctgggtgcagtggctcatccctgtaatcccagcactttgcaaggccgaggtgggcagatcacttgaacccaggagttcaagacaagcctcggcaacatgacaaaacctcatctctacaaaaaatacaaaaattagccaggcccagtggcatgtgcctgtaatcccaactactcaggaggctgaggtgggaggattgtttgaacttgggaggctgaggtaggagtgagcccagatcacgccactgcactcctgcctaggcaacagagctagaccctgtctcaaaataaaaaagaaaggataaaggagatttgattaatagattaataaantgttctttcctgattggttatgatgttgaactacttcccaaattatgtaaccaaatttctgtgtggctctggtgctattaggtcaaaactttggggaactaagcatgagatagcatactcctgtttccttctctgtcccagggaaatacaaattcccttttgcctcaattagagaaggatgtctattcttgctacaaattatgatttatgtcctggtgtcaaatgaagataagaataagatcaaagaaaggcaagatgattgtggaagagaaagaaaaaggattaatttagatttatttaaccaagaaacatttatttngtatctcctatttccaggctgagtgctaagaaataaaatgatgagtagagtatagcctttctcctcaaggagcttaccctctaatcatgggagagacagacatgtaactagttaaaccatattgtttggtggcttgaaccatgccagtagtagccactattaaggaaggaactgaagggcacttactgatttgggtaatagtgggaaaaatcagagaggagggaggatttagattgaagtatgtgcttctattttagaaggggctatatttactatgtttattacttaaaagttcataaaagccaataatatgggtttgagctgtgttagtgatgagttaacaaacatatcaggactatttaacctccctgagcccctgttctctaaatgggagaataataactctacctgattgagttcttggaaaataacatagtgtaacggaaagagcaggctttggaggaaaagaggatttgactttgcatctctatcaattaattgtgtgactttgagcaagttatttaactctctgagcttcactttccttatgtgcaaaatggataacaccatggcataagacaatcccatgaagataagatataaaagaagataatgtttgaaaagaaataaggaagtggatgctttggaagaattaagcaggcagctttttctggaaacagctgatctatatgctaccaaggagagaatagaatactccaaaaccttcaaggggaaatattttaattttcttggttactttttctctatttactgtgtttggaaaattttcatggctaccatcaatattgtttttgatcgagttgggaaaacggatcctgtcacaagaggcattgagatcactgtgaattatctgggaatccaatttgatgtgaagttttggtcccaacacatttccttcattcttgttggaataatcatcgtcacatccatcagaggattgctgatcactcttaccaagttcttttatgccatctctagcagtaagtcctccaatgtcattgtcctgctattagcacagataatgggcatgtactttgtctcctctgtgctgctgatccgaatgagtatgcctttagaataccgcaccataatcactgaagtccttggagaactgcagttcaacttctatcaccgttggtttgatgtgatcttcctggtcagcgctctctctagcatactcttcctctatttggctcacaaacaggcaccagagaagcaaatggcaccttgaacttaagcctactacagactgttagaggccagtggtttcaaaatttagatataagaggggggaaaaatggaaccagggcctgacattttataaacaaacaaaatgctatggtagcatttttcaccttcatagcatactccttccccgtcaggtgatactatgaccatgagtagcatcagccagaacatgagagggagaactaactcaagacaatactcagcagagagcatcccgtgtggatatgaggctggtgtagaggcggagaggagccaagaaactaaaggtgaaaaatacactggaactctggggcaagacatgtctatggtagctgagccaaacacgtaggatttccgttttaaggttcacatggaaaaggttatagctttgccttgagattgactcattaaaatcagagactgtaacacttt

SEQ ID NO: 102876 - DNA, 2025 bp, Homo sapiens
tggggcgcagcttgatggcgtcgggctggagagccgcagtcccggctgcagcacctgggagaaggcagaccgtgtgagggggcctgtggccccagcgtgctgtggcctcggggagtgggaagtggaggcaggagccttccttacacttcgccatgagtttcctcatcgactccagcatcatgattacctcccagatactattttttggatttgggtggcttttcttcatgcgccaattgtttaaagactatgagatacgtcagtatgttgtacaggtgatcttctccgtgacgtttgcattttcttgcaccatgtttgagctcatcatctttgaaatcttaggagtattgaatagcagctcccgttattttcactggaaaatgaacctgtgtgtaattctgctgatcctggttttcatggtgcctttttacattggctattttattgtgagcaatatccgactactgcataaacaacgactgcttttttcctgtctcttatggctgacctttatgtatttcttctggaaactaggagatccctttcccattctcagcccaaaacatgggatcttatccatagaacagctcatcagccgggttggtgtgattggagtgactctcatggctcttctttctggatttggtgctgtcaactgcccatacacttacatgtcttacttcctcaggaatgtgactgacacggatattctagccctggaacggcgactgctgcaaaccatggatatgatcataagcaaaaagaaaaggatggcaatggcacggagaacaatgttccagaagggggaagtgcataacaaaccatcaggtttctggggaatgataaaaagtgttaccacttcagcatcaggaagtgaaacttcactttccttatgtgcaaaatggataacaccatggcataagacaatcccatgaagataagatataaaagaagataatgtttgaaaagaaataaggaagtggatgctttggaagaattaagcaggcagctttttctggaaacagctgatctatatgctaccaaggagagaatagaatactccaaaaccttcaaggggaaatattttaattttcttggttactttttctctatttactgtgtttggaaaattttcatggctaccatcaatattgtttttgatcgagttgggaaaacggatcctgtcacaagaggcattgagatcactgtgaattatctgggaatccaatttgatgtgaagttttggtcccaacacatttccttcattcttgttggaataatcatcgtcacatccatcagaggattgctgatcactcttaccaagttcttttatgccatctctagcagtaagtcctccaatgtcattgtcctgctattagcacagataatgggcatgtactttgtctcctctgtgctgctgatccgaatgagtatgcctttagaataccgcaccataatcactgaagtccttggagaactgcagttcaacttctatcaccgttggtttgatgtgatcttcctggtcagcgctctctctagcatactcttcctctatttggctcacaaacaggcaccagagaagcaaatggcaccttgaacttaagcctactacagactgttagaggccagtggtttcaaaatttagatataagaggggggaaaaatggaaccagggcctgacattttataaacaaacaaaatgctatggtagcatttttcaccttcatagcatactccttccccgtcaggtgatactatgaccatgagtagcatcagccagaacatgagagggagaactaactcaagacaatactcagcagagagcatcccgtgtggatatgaggctggtgtagaggcggagaggagccaagaaactaaaggtgaaaaatacactggaactctggggcaagacatgtctatggtagctgagccaaacacgtaggatttccgttttaaggttcacatggaaaaggttatagctttgccttgagattgactcattaaaatcagagactgtaacacttt

SEQ ID NO: 102877 - DNA, 2491 bp, Homo sapiens
tggggcgcagcttgatggcgtcgggctggagagccgcagtcccggctgcagcacctgggagaaggcagaccgtgtgagggggcctgtggccccagcgtgctgtggcctcggggagtgggaagtggaggcaggagccttccttacacttcgccatgagtttcctcatcgactccagcatcatgattacctcccagatactattttttggatttgggtggcttttcttcatgcgccaattgtttaaagactatgagatacgtcagtatgttgtacaggtgatcttctccgtgacgtttgcattttcttgcaccatgtttgagctcatcatctttgaaatcttaggagtattgaatagcagctcccgttattttcactggaaaatgaacctgtgtgtaattctgctgatcctggttttcatggtgcctttttacattggctattttattgtgagcaatatccgactactgcataaacaacgactgcttttttcctgtctcttatggctgacctttatgtatttcttctggaaactaggagatccctttcccattctcagcccaaaacatgggatcttatccatagaacagctcatcagccgggttggtgtgattggagtgactctcatggctcttctttctggatttggtgctgtcaactgcccatacacttacatgtcttacttcctcaggaatgtgactgacacggatattctagccctggaacggcgactgctgcaaaccatggatatgatcataagcaaaaagaaaaggatggcaatggcacggagaacaatgttccagaagggggaagtgcataacaaaccatcaggtttctggggaatgataaaaagtgttaccacttcagcatcaggaagtgaaacttcactttccttatgtgcaaaatggataacaccatggcataagacaatcccatgaagataagatataaaagaagataatgtttgaaaagaaataaggtaatgtctgtaaatcctagcctatattagaacacagtaaagtattagttcccttttctaacattatattcagataatgtaggagaaagctatgctttattatagttattattctgtaactatttacaatcttgaacattacatttgacttaatctaactagataaatcaaaaaacaaatgaaactatctgtttgagctgcttgacttaagagaaactgagtggtaattgtttggtggcgatgctcttgatggagaagcttttacacacctgcgtcagaggttgggaaagttgctctgaagtagtgttgctggctatgaaacaggaaattgagaatataggcaactccgggaatccactgtaggaaaaactaaaagtatatgctttctcattgccatttcttgaaattcctatgtgattaaaaccttgatgcccattctgtgccagatcttactcttattcaacaggaagtggatgctttggaagaattaagcaggcagctttttctggaaacagctgatctatatgctaccaaggagagaatagaatactccaaaaccttcaaggggaaatattttaattttcttggttactttttctctatttactgtgtttggaaaattttcatggctaccatcaatattgtttttgatcgagttgggaaaacggatcctgtcacaagaggcattgagatcactgtgaattatctgggaatccaatttgatgtgaagttttggtcccaacacatttccttcattcttgttggaataatcatcgtcacatccatcagaggattgctgatcactcttaccaagttcttttatgccatctctagcagtaagtcctccaatgtcattgtcctgctattagcacagataatgggcatgtactttgtctcctctgtgctgctgatccgaatgagtatgcctttagaataccgcaccataatcactgaagtccttggagaactgcagttcaacttctatcaccgttggtttgatgtgatcttcctggtcagcgctctctctagcatactcttcctctatttggctcacaaacaggcaccagagaagcaaatggcaccttgaacttaagcctactacagactgttagaggccagtggtttcaaaatttagatataagaggggggaaaaatggaaccagggcctgacattttataaacaaacaaaatgctatggtagcatttttcaccttcatagcatactccttccccgtcaggtgatactatgaccatgagtagcatcagccagaacatgagagggagaactaactcaagacaatactcagcagagagcatcccgtgtggatatgaggctggtgtagaggcggagaggagccaagaaactaaaggtgaaaaatacactggaactctggggcaagacatgtctatggtagctgagccaaacacgtaggatttccgttttaaggttcacatggaaaaggttatagctttgccttgagattgactcattaaaatcagagactgtaacacttt

SEQ ID NO: 102878 - DNA, 2092 bp, Homo sapiens
tggggcgcagcttgatggcgtcgggctggagagccgcagtcccggctgcagcacctgggagaaggcagaccgtgtgagggggcctgtggccccagcgtgctgtggcctcggggagtgggaagtggaggcaggagccttccttacacttcgccatgagtttcctcatcgactccagcatcatgattacctcccagatactattttttggatttgggtggcttttcttcatgcgccaattgtttaaagactatgagatacgtcagtatgttgtacaggtgatcttctccgtgacgtttgcattttcttgcaccatgtttgagctcatcatctttgaaatcttaggagtattgaatagcagctcccgttattttcactggaaaatgaacctgtgtgtaattctgctgatcctggttttcatggtgcctttttacattggctattttattgtgagcaatatccgactactgcataaacaacgactgcttttttcctgtctcttatggctgacctttatgtatttcttctggaaactaggagatccctttcccattctcagcccaaaacatgggatcttatccatagaacagctcatcagccgggttggtgtgattggagtgactctcatggctcttctttctggatttggtgctgtcaactgcccatacacttacatgtcttacttcctcaggaatgtgactgacacggatattctagccctggaacggcgactgctgcaaaccatggatatgatcataagcaaaaagaaaaggatggcaatggcacggagaacaatgttccagaagggggaagtgcataacaaaccatcaggtttctggggaatgataaaaagtgttaccacttcagcatcaggaagtgaaaatcttactcttattcaacaggaagtggatgctttggaagaattaagcaggcagctttttctggaaacagctgatctatatgctaccaaggagagaatagaatactccaaaaccttcaaggggaaatattttaattttcttggttactttttctctatttactgtgtttggaaaattttcatggctaccatcaatattgtttttgatcgagttgggaaaacggatcctgtcacaagaggcattgagatcactgtgaattatctgggaatccaatttgatgtgaagttttggtcccaacacatttccttcattcttgttggaataatcatcgtcacatccatcagaggattgctgatcactcttaccaagttcttttatgccatctctagcagtaagtcctccaatgtcattgtcctgctattagcacagataatgggtaagtttaattagttacctttatgttgacagctgtaaaatatcagaaatgtgcttgatacttttaagaattttaataatttcctttgtcctgttcctcactacattcagagtcacttctggattaattcatttgacttacagggcatgtactttgtctcctctgtgctgctgatccgaatgagtatgcctttagaataccgcaccataatcactgaagtccttggagaactgcagttcaacttctatcaccgttggtttgatgtgatcttcctggtcagcgctctctctagcatactcttcctctatttggctcacaaacaggcaccagagaagcaaatggcaccttgaacttaagcctactacagactgttagaggccagtggtttcaaaatttagatataagaggggggaaaaatggaaccagggcctgacattttataaacaaacaaaatgctatggtagcatttttcaccttcatagcatactccttccccgtcaggtgatactatgaccatgagtagcatcagccagaacatgagagggagaactaactcaagacaatactcagcagagagcatcccgtgtggatatgaggctggtgtagaggcggagaggagccaagaaactaaaggtgaaaaatacactggaactctggggcaagacatgtctatggtagctgagccaaacacgtaggatttccgttttaaggttcacatggaaaaggttatagctttgccttgagattgactcattaaaatcagagactgtaacacttt

SEQ ID NO: 102879 - DNA, 1879 bp, Homo sapiens
tggggcgcagcttgatggcgtcgggctggagagccgcagtcccggctgcagcacctgggagaaggcagaccgtgtgagggggcctgtggccccagcgtgctgtggcctcggggagtgggaagtggaggcaggagccttccttacacttcgccatgagtttcctcatcgactccagcatcatgattacctcccagatactattttttggatttgggtggcttttcttcatgcgccaattgtttaaagactatgagatacgtcagtatgttgtacaggtgatcttctccgtgacgtttgcattttcttgcaccatgtttgagctcatcatctttgaaatcttaggagtattgaatagcagctcccgttattttcactggaaaatgaacctgtgtgtaattctgctgatcctggttttcatggtgcctttttacattggctattttattgtgagcaatatccgactacgagatccctttcccattctcagcccaaaacatgggatcttatccatagaacagctcatcagccgggttggtgtgattggagtgactctcatggctcttctttctggatttggtgctgtcaactgcccatacacttacatgtcttacttcctcaggaatgtgactgacacggatattctagccctggaacggcgactgctgcaaaccatggatatgatcataagcaaaaagaaaaggatggcaatggcacggagaacaatgttccagaagggggaagtgcataacaaaccatcaggtttctggggaatgataaaaagtgttaccacttcagcatcaggaagtgaaaatcttactcttattcaacaggaagtggatgctttggaagaattaagcaggcagctttttctggaaacagctgatctatatgctaccaaggagagaatagaatactccaaaaccttcaaggggaaatattttaattttcttggttactttttctctatttactgtgtttggaaaattttcatggctaccatcaatattgtttttgatcgagttgggaaaacggatcctgtcacaagaggcattgagatcactgtgaattatctgggaatccaatttgatgtgaagttttggtcccaacacatttccttcattcttgttggaataatcatcgtcacatccatcagaggattgctgatcactcttaccaagttcttttatgccatctctagcagtaagtcctccaatgtcattgtcctgctattagcacagataatgggcatgtactttgtctcctctgtgctgctgatccgaatgagtatgcctttagaataccgcaccataatcactgaagtccttggagaactgcagttcaacttctatcaccgttggtttgatgtgatcttcctggtcagcgctctctctagcatactcttcctctatttggctcacaaacaggcaccagagaagcaaatggcaccttgaacttaagcctactacagactgttagaggccagtggtttcaaaatttagatataagaggggggaaaaatggaaccagggcctgacattttataaacaaacaaaatgctatggtagcatttttcaccttcatagcatactccttccccgtcaggtgatactatgaccatgagtagcatcagccagaacatgagagggagaactaactcaagacaatactcagcagagagcatcccgtgtggatatgaggctggtgtagaggcggagaggagccaagaaactaaaggtgaaaaatacactggaactctggggcaagacatgtctatggtagctgagccaaacacgtaggatttccgttttaaggttcacatggaaaaggttatagctttgccttgagattgactcattaaaatcagagactgtaacacttt

SEQ ID NO: 102880 - DNA, 1514 bp, Homo sapiens
cggacgcgtgggtcgacccacgcgtcgcaaaacatgggatcttatccatagaacagctcatcagccgggttggtgtgattggagtgactctcatggctcttctttctggatttggtgctgtcaactgcccatacacttacatgtcttacttcctcaggaatgtgactgacacggatattctagccctggaacggcgactgctgcaaaccatggatatgatcataagcaaaaagaaaaggatggcaatggcacggagaacaatgttccagaagggggaagtgcataacaaaccatcaggtttctggggaatgataaaaagtgttaccacttcagcatcaggaagtgaaacttcactttccttatgtgcaaaatggataacaccatggcataagacaatcccatgaagataagatataaaagaagataatgtttgaaaagaaataagatcttactcttattcaacaggaagtggatgctttggaagaattaagcaggcagctttttctggaaacagctgatctatatgctaccaaggagagaatagaatactccaaaaccttcaaggggaaatattttaattttcttggttactttttctctatttactgtgtttggaaaattttcatggctaccatcaatattgtttttgatcgagttgggaaaacggatcctgtcacaagaggcattgagatcactgtgaattatctgggaatccaatttgatgtgaagttttggtcccaacacatttccttcattcttgttggaataatcatcgtcacatccatcagaggattgctgatcactcttaccaagttcttttatgccatctctagcagtaagtcctccaatgtcattgtcctgctattagcacagataatgggcatgtactttgtctcctctgtgctgctgatccgaatgagtatgcctttagaataccgcaccataatcactgaagtccttggagaactgcagttcaacttctatcaccgttggtttgatgtgatcttcctggtcagcgctctctctagcatactcttcctctatttggctcacaaacaggcaccagagaagcaaatggcaccttgaacttaagcctactacagactgttagaggccagtggtttcaaaatttagatataagaggggggaaaaatggaaccagggcctgacattttataaacaaacaaaatgctatggtagcatttttcaccttcatagcatactccttccccgtcaggtgatactatgaccatgagtagcatcagccagaacatgagagggagaactaactcaagacaatactcagcagagagcatcccgtgtggatatgaggctggtgtagaggcggagaggagccaagaaactaaaggtgaaaaatacactggaactctggggcaagacatgtctatggtagctgagccaaacacgtaggatttccgttttaaggttcacatggaaaaggttatagctttgccttgagattgactcattaaaatcagagactgtaacacttt

SEQ ID NO: 102881 - DNA, 1263 bp, Homo sapiens
  misc_feature (2)..(2): n is a, c, g, or t
gnccactctagagtatccccacgttgacacttcagcatcaggaagtgaaaatcttactcttattcaacaggaagtggatgctttggaagaattaagcaggcagctttttctggaaacagctgatctatatgctaccaaggagagaatagaatactccaaaaccttcaaggggaaatattttaattttcttggttactttttctctatttactgtgtttggaaaattttcatggctaccatcaatattgtttttgatcgagttgggaaaacggatcctgtcacaagaggcattgagatcactgtgaattatctgggaatccaatttgatgtgaagttttggtcccaacacatttccttcattcttgttggaataatcatcgtcacatccatcagaggattgctgatcactcttaccaagttcttttatgccatctctagcagtaagtcctccaatgtcattgtcctgctattagcacagataatgggtaagtttaattagttacctttatgttgacagctgtaaaatatcagaaatgtgcttgatacttttaagaattttaataatttcctttgtcctgttcctcactacattcagagtcacttctggattaattcatttgacttacagggcatgtactttgtctcctctgtgctgctgatccgaatgagtatgcctttagaataccgcaccataatcactgaagtccttggagaactgcagttcaacttctatcaccgttggtttgatgtgatcttcctggtcagcgctctctctagcatactcttcctctatttggctcacaaacaggcaccagagaagcaaatggcaccttgaacttaagcctactacagactgttagaggccagtggtttcaaaatttagatataagaggggggaaaaatggaaccagggcctgacattttataaacaaacaaaatgctatggtagcatttttcaccttcatagcatactccttccccgtcaggtgatactatgaccatgagtagcatcagccagaacatgagagggagaactaactcaagacaatactcagcagagagcatcccgtgtggatatgaggctggtgtagaggcggagaggagccaagaaactaaaggtgaaaaatacactggaactctggggcaagacatgtctatggtagctgagccaaacacgtaggatttccgttttaaggttcacatggaaaaggttatagctttgccttgagattgactcattaaaatcagagactgtaacacttt

SEQ ID NO: 102882 - DNA, 2231 bp, Homo sapiens
  misc_feature (1967)..(1967): n is a, c, g, or t
tggggcgcagcttgatggcgtcgggctggagagccgcagtcccggctgcagcacctgggagaaggcagaccgtgtgagggggcctgtggccccagcgtgctgtggcctcggggagtgggaagtggaggcaggagccttccttacacttcgccatgagtttcctcatcgactccagcatcatgattacctcccagatactattttttggatttgggtggcttttcttcatgcgccaattgtttaaagactatgagatacgtcagtatgttgtacaggtgatcttctccgtgacgtttgcattttcttgcaccatgtttgagctcatcatctttgaaatcttaggagtattgaatagcagctcccgttattttcactggaaaatgaacctgtgtgtaattctgctgatcctggttttcatggtgcctttttacattggctattttattgtgagcaatatccgactactgcataaacaacgactgcttttttcctgtctcttatggctgacctttatgtatttcttctggaaactaggagatccctttcccattctcagcccaaaacatgggatcttatccatagaacagctcatcagccgggttggtgtgattggagtgactctcatggctcttctttctggatttggtgctgtcaactgcccatacacttacatgtcttacttcctcaggaatgtgactgacacggatattctagccctggaacggcgactgctgcaaaccatggatatgatcataagcaaaaagaaaaggatggcaatggcacggagaacaatgttccagaagggggaagtgcataacaaaccatcaggtttctggggaatgataaaaagtgttaccacttcagcatcaggaagtgaaaatcttactcttattcaacaggaagtggatgctttggaagaattaagcaggcagctttttctggaaacagctgatctatatgctaccaaggagagaatagaatactccaaaaccttcaaggggaaatattttaattttcttggttactttttctctatttactgtgtttggaaaattttcatggctaccatcaatattgtttttgatcgagttgggaaaacggatcctgtcacaagaggcattgagatcactgtgaattatctgggaatccaatttgatgtgaagttttggtcccaacacatttccttcattcttgttggaataatcatcgtcacatccatcagaggattgctgatcactcttaccaagttcttttatgccatctctagcagtaagtcctccaatgtcattgtcctgctattagcacagataatgggcatgtactttgtctcctctgtgctgctgatccgaatgagtatgcctttagaataccgcaccataatcactgaagtccttggagaactgcagttcaacttctatcaccgttggtttgatgtgatcttcctggtcagcgctctctctagcatactcttcctctatttggctcacaaacaggcaccagagaagcaaatggcaccttgaacttaagcctactacagactgttagaggccagtggtttcaaaatttagatataagaggggggaaaaatggaaccagggcctgacattttataaacaaacaaaatgctatggtagcatttttcaccttcatagcatactccttccccgtcaggtgatactatgaccatgagtagcatcagccagaacatgagagggagaactaactcaagacaatactcagcagagagcatcccgtgtggatatgaggctggtgtagaggcggagaggagccaagaaactaaaggtgaaaaatacactggaactctggggcaagacatgtctatggtagctgagccaaacacgtaggatttccgttttaaggttcacatggaaaaggttatagctttgccttgagattgactcattaaaatcagagactgtaacactttaaaaaaataaaaaaaaaanaaaaaaaaaagaaaaaaaaaaagaaaaaaaaaaacaaaaaggagacactagaacaagaaatacaagaaagagaaaaaaataaaaaaaaaaacctcgggggggggcccggtccccaatggcccctatggggggtcgtatcaaaatccatgggccggcttttacaaaggtcgaaccgggaaaaccctggtgtgcccaacttaagtcgcttggaatccccttttcgcaagttggcttattaccaggaaattgtggccggtttttggt

SEQ ID NO: 102883 - DNA, 2227 bp, Homo sapiens
  misc_feature (1967)..(1967): n is a, c, g, or t
tggggcgcagcttgatggcgtcgggctggagagccgcagtcccggctgcagcacctgggagaaggcagaccgtgtgagggggcctgtggccccagcgtgctgtggcctcggggagtgggaagtggaggcaggagccttccttacacttcgccatgagtttcctcatcgactccagcatcatgattacctcccagatactattttttggatttgggtggcttttcttcatgcgccaattgtttaaagactatgagatacgtcagtatgttgtacaggtgatcttctccgtgacgtttgcattttcttgcaccatgtttgagctcatcatctttgaaatcttaggagtattgaatagcagctcccgttattttcactggaaaatgaacctgtgtgtaattctgctgatcctggttttcatggtgcctttttacattggctattttattgtgagcaatatccgactactgcataaacaacgactgcttttttcctgtctcttatggctgacctttatgtatttcttctggaaactaggagatccctttcccattctcagcccaaaacatgggatcttatccatagaacagctcatcagccgggttggtgtgattggagtgactctcatggctcttctttctggatttggtgctgtcaactgcccatacacttacatgtcttacttcctcaggaatgtgactgacacggatattctagccctggaacggcgactgctgcaaaccatggatatgatcataagcaaaaagaaaaggatggcaatggcacggagaacaatgttccagaagggggaagtgcataacaaaccatcaggtttctggggaatgataaaaagtgttaccacttcagcatcaggaagtgaaaatcttactcttattcaacaggaagtggatgctttggaagaattaagcaggcagctttttctggaaacagctgatctatatgctaccaaggagagaatagaatactccaaaaccttcaaggggaaatattttaattttcttggttactttttctctatttactgtgtttggaaaattttcatggctaccatcaatattgtttttgatcgagttgggaaaacggatcctgtcacaagaggcattgagatcactgtgaattatctgggaatccaatttgatgtgaagttttggtcccaacacatttccttcattcttgttggaataatcatcgtcacatccatcagaggattgctgatcactcttaccaagttcttttatgccatctctagcagtaagtcctccaatgtcattgtcctgctattagcacagataatgggcatgtactttgtctcctctgtgctgctgatccgaatgagtatgcctttagaataccgcaccataatcactgaagtccttggagaactgcagttcaacttctatcaccgttggtttgatgtgatcttcctggtcagcgctctctctagcatactcttcctctatttggctcacaaacaggcaccagagaagcaaatggcaccttgaacttaagcctactacagactgttagaggccagtggtttcaaaatttagatataagaggggggaaaaatggaaccagggcctgacattttataaacaaacaaaatgctatggtagcatttttcaccttcatagcatactccttccccgtcaggtgatactatgaccatgagtagcatcagccagaacatgagagggagaactaactcaagacaatactcagcagagagcatcccgtgtggatatgaggctggtgtagaggcggagaggagccaagaaactaaaggtgaaaaatacactggaactctggggcaagacatgtctatggtagctgagccaaacacgtaggatttccgttttaaggttcacatggaaaaggttatagctttgccttgagattgactcattaaaatcagagactgtaacactttaaaaaaataaaaaaaaaanaaaaaaaattataaaagataatgcttattataaaacaattagtaaaaccctcaaccttatttgataagctaaacaaaaaaggttaaccttgggggggggcccgggccccaatttccccattagggagggggtttaaaatatcactgggccggcgtttaacacagcggggattggaaaaccccggggtttcccaacttttattccccgggaattcccttttttccaggttggggtaacaggcattttgccctttttttttt

SEQ ID NO: 102884 - DNA, 1824 bp, Homo sapiens
tggggcgcagcttgatggcgtcgggctggagagccgcagtcccggctgcagcacctgggagaaggcagaccgtgtgagggggcctgtggccccagcgtgctgtggcctcggggagtgggaagtggaggcaggagccttccttacacttcgccatgagtttcctcatcgactccagcatcatgattacctcccagatactattttttggatttgggtggcttttcttcatgcgccaattgtttaaagactatgagatacgtcagtatgttgtacaggtgatcttctccgtgacgtttgcattttcttgcaccatgtttgagctcatcatctttgaaatcttaggagtattgaatagcagctcccgttattttcactggaaaatgaacctgtgtgtaattctgctgatcctggttttcatggtgcctttttacattggctattttattgtgagcaatatccgactactgcataaacaacgactgcttttttcctgtctcttatggctgacctttatgtatttcttctggaaactaggagatccctttcccattctcagcccaaaacatgggatcttatccatagaacagctcatcagccgggttggtgtgattggagtgactctcatggctcttctttctggatttggtgctgtcaactgcccatacacttacatgtcttacttcctcaggaatgtgactgacacggatattctagccctggaacggcgactgctgcaaaccatggatatgatcataagcaaaaagaaaaggatggcaatggcacggagaacaatgttccagaagggggaagtgcataacaaaccatcaggtttctggggaatgataaaaagtgttaccacttcagcatcaggaagtgaaaatcttactcttattcaacaggaagtggatgctttggaagaattaagcaggcagctttttctggaaacagctgatctatatgctaccaaggagagaatagaatactccaaaaccttcaaggggaaatattttaattttcttggttactttttctctatttactgtgtttggaaaattttcatggctaccatcaatattgtttttgatcgagttgggaaaacggatcctgtcacaagaggcattgagatcactgtgaattatctgggaatccaatttgatgtgaagttttggtcccaacacatttccttcattcttgttggaataatcatcgtcacatccatcagaggattgctgatcactcttaccaagttcttttatgccatctctagcagtaagtcctccaatgtcattgtcctgctattagcacagataatgggcatgtactttgtctcctctgtgctgctgatccgaatgagtatgcctttagaataccgcaccataatcactgaagtccttggagaactgcagttcaacttctatcaccgttggtttgatgtgatcttcctggtcagcgctctctctagcatactcttcctctatttggctcacaaacaggcaccagagaagcaaatggcaccttgaacttaagcctactacagactgttagaggtgatactatgaccatgagtagcatcagccagaacatgagagggagaactaactcaagacaatactcagcagagagcatcccgtgtggatatgaggctggtgtagaggcggagaggagccaagaaactaaaggtgaaaaatacactggaactctggggcaagacatgtctatggtagctgagccaaacacgtaggatttccgttttaaggttcacatggaaaaggttatagctttgccttgagattgactcattaaaatcagagactgtaacacttt

SEQ ID NO: 102885 - DNA, 1758 bp, Homo sapiens
tggggcgcagcttgatggcgtcgggctggagagccgcagtcccggctgcagcacctgggagaaggcagaccgtgtgagggggcctgtggccccagcgtgctgtggcctcggggagtgggaagtggaggcaggagccttccttacacttcgccatgagtttcctcatcgactccagcatcatgattacctcccagatactattttttggatttgggtggcttttcttcatgcgccaattgtttaaagactatgagatacgtcagtatgttgtacaggtgatcttctccgtgacgtttgcattttcttgcaccatgtttgagctcatcatctttgaaatcttaggagtattgaatagcagctcccgttattttcactggaaaatgaacctgtgtgtaattctgctgatcctggttttcatggtgcctttttacattggctattttattgtgagcaatatccgactactgcataaacaacgactgcttttttcctgtctcttatggctgacctttatgtatttcttctggaaactaggagatccctttcccattctcagcccaaaacatgggatcttatccatagaacagctcatcagccgggttggtgtgattggagtgactctcatggctcttctttctggatttggtgctgtcaactgcccatacacttacatgtcttacttcctcaggaatgtgactgacacggatattctagccctggaacggcgactgctgcaaaccatggatatgatcataagcaaaaagaaaaggatggcaatggcacggagaacaatgttccagaagggggaagtgcataacaaaccatcaggtttctggggaatgataaaaagtgttaccacttcagcatcaggaagtgaaaatcttactcttattcaacaggaagtggatgctttggaagaattaagcaggcagctttttctggaaacagctgatctatatgctaccaaggagagaatagaatactccaaaaccttcaaggggaaatattttaattttcttggttactttttctctatttactgtgtttggaaaattttcatggctaccatcaatattgtttttgatcgagttgggaaaacggatcctgtcacaagaggcattgagatcactgtgaattatctgggaatccaatttgatgtgaagttttggtcccaacacatttccttcattcttgttggaataatcatcgtcacatccatcagaggattgctgatcactcttaccaagttcttttatgccatctctagcagtaagtcctccaatgtcattgtcctgctattagcacagataatgggacttgattggccaacacaaggtacagcaataaaggtgtcctgccttgccagtggcagccaggaaagaaccaaactctaccaacccccaaaattataatcagcagagaagatgtgggggctgaagagatcctggaagaaaagccccaaatgtctcattcacctgcatatgttcttctttgtccacaaagacaccattgatcctaagaactctgtctccatcttgaaggccagccttctctgctgggctacacttctcaaccacccggaccaggtggccctcggtgtccttctcaattcgcaggaagaagccatagttttgcccttcttgcttggacagtttacattctcgggggttgaaggtggaggtcattttctgtgatgacaacaccataaatttcactaacaacccatgacaccaccgaaaccataacaattagaacctt

SEQ ID NO: 102886 - DNA, 1584 bp, Homo sapiens
tggggcgcagcttgatggcgtcgggctggagagccgcagtcccggctgcagcacctgggagaaggcagaccgtgtgagggggcctgtggccccagcgtgctgtggcctcggggagtgggaagtggaggcaggagccttccttacacttcgccatgagtttcctcatcgactccagcatcatgattacctcccagatactattttttggatttgggtggcttttcttcatgcgccaattgtttaaagactatgagatacgtcagtatgttgtacaggtgatcttctccgtgacgtttgcattttcttgcaccatgtttgagctcatcatctttgaaatcttaggagtattgaatagcagctcccgttattttcactggaaaatgaacctgtgtgtaattctgctgatcctggttttcatggtgcctttttacattggctattttattgtgagcaatatccgactactgcataaacaacgactgcttttttcctgtctcttatggctgacctttatgtatttcttctggaaactaggagatccctttcccattctcagcccaaaacatgggatcttatccatagaacagctcatcagccgggttggtgtgattggagtgactctcatggctcttctttctggatttggtgctgtcaactgcccatacacttacatgtcttacttcctcaggaatgtgactgacacggatattctagccctggaacggcgactgctgcaaaccatggatatgatcataagcaaaaagaaaaggatggcaatggcacggagaacaatgttccagaagggggaagtgcataacaaaccatcaggtttctggggaatgataaaaagtgttaccacttcagcatcaggaagtgaaaatcttactcttattcaacaggaagtggatgctttggaagaattaagcaggcagctttttctggaaacagctgatctatatgctaccaaggagagaatagaatactccaaaaccttcaaggggaaatattttaattttcttggttactttttctctatttactgtgtttggaaaattttcatggctaccatcaatattgtttttgatcgagttgggaaaacggatcctgtcacaagaggcattgagatcactgtgaattatctgggaatccaatttgatgtgaagttttggtcccaacacatttccttcattcttgttggaataatcatcgtcacatccatcagaggattgctgatcactcttaccaagttcttttatgccatctctagcagtaagtcctccaatgtcattgtcctgctattagcacagataatgaatggcgcattgtaaccttttggtcttccctcctgtggcctggccttggaattcccggaaattggaaggttaattgccccttttttaagaaaattaaccccggcaaacccaatttaaaattccaaccttgggacaaggttccccttttggcggcgcgaaaaccttgtgccaaaggttttcccaaaacctttttccttaaattcccaaaccccggtcctcgggcggtcttctccgcgactctgggtctggacattctcctttttcccctttg

SEQ ID NO: 102887 - DNA, 1112 bp, Homo sapiens
tggggcgcagcttgatggcgtcgggctggagagccgcagtcccggctgcagcacctgggagaaggcagaccgtgtgagggggcctgtggccccagcgtgctgtggcctcggggagtgggaagtggaggcaggagccttccttacacttcgccatgagtttcctcatcgactccagcatcatgattacctcccagatactattttttggatttgggtggcttttcttcatgcgccaattgtttaaagactatgagatacgtcagtatgttgtacaggtgatcttctccgtgacgtttgcattttcttgcaccatgtttgagctcatcatctttgaaatcttaggagtattgaatagcagctcccgttattttcactggaaaatgaacctgtgtgtaattctgctgatcctggttttcatggtgcctttttacattggctattttattgtgagcaatatccgactactgcataaacaacgactgcttttttcctgtctcttatggctgacctttatgtatttcttctggaaactaggagatccctttcccattctcagcccaaaacatgggatcttatccatagaacagctcatcagccgggttggtgtgattggagtgactctcatggctcttctttctggatttggtgctgtcaactgcccatacacttacatgtcttacttcctcaggaatgtgactgacacggatattctagccctggaacggcgactgctgcaaaccatggatatgatcataagcaaaaagaaaaggatggcaatggcacggagaacaatgttccagaagggggaagtgcataacaaaccatcaggtttctggggaatgataaaaagtgttaccacttcagcatcaggaagtgaaaatcttactcttattcaacaggaagtggatgctttggaagaattaagcaggcagctttttctggaaacagctgatctatatgctaccaaggagagaatagaatactccaaaaccttcaaggggaaatattttaattttcttggttactttttctctatttactgtgtttggaaaattttcatggctaccatcatattgttttgatcgagtagtcacctgggccagctcactcat

SEQ ID NO: 102888 - DNA, 2878 bp, Homo sapiens
  misc_feature (1695)..(1695): n is a, c, g, or t
  misc_feature (2014)..(2014): n is a, c, g, or t
tggggcgcagcttgatggcgtcgggctggagagccgcagtcccggctgcagcacctgggagaaggcagaccgtgtgagggggcctgtggccccagcgtgctgtggcctcggggagtgggaagtggaggcaggagccttccttacacttcgccatgagtttcctcatcgactccagcatcatgattacctcccagatactattttttggatttgggtggcttttcttcatgcgccaattgtttaaagactatgagatacgtcagtatgttgtacaggtgatcttctccgtgacgtttgcattttcttgcaccatgtttgagctcatcatctttgaaatcttaggagtattgaatagcagctcccgttattttcactggaaaatgaacctgtgtgtaattctgctgatcctggttttcatggtgcctttttacattggctattttattgtgagcaatatccgactactgcataaacaacgactgcttttttcctgtctcttatggctgacctttatgtatttcttctggaaactaggagatccctttcccattctcagcccaaaacatgggatcttatccatagaacagctcatcagccgggttggtgtgattggagtgactctcatggctcttctttctggatttggtgctgtcaactgcccatacacttacatgtcttacttcctcaggaatgtgactgacacggatattctagccctggaacggcgactgctgcaaaccatggatatgatcataagcaaaaagaaaaggatggcaatggcacggagaacaatgttccagaagggggaagtgcataacaaaccatcaggtttctggggaatgataaaaagtgttaccacttcagcatcaggaagtgaaagtatcctttgtccctctgcttgattctttttctcaactctggaccaagagcaaaagaaaaaaagtagtgttgggatagtcccttctaaggtacctgactacatcagaggtccaaactcctaagagctaggcttcggaaataccatgtgtacagtcatctttccagcacctgcacaatatcataaaatcattgtctttgagctgaagtggtcctaaaaagtcagcctttccattttacagatgagaaaatagacccagagaggttaagtcacacggtggtttgtggcaaagctagaaacataactgtggtctcctcttcatagttctttccactacactattacatttctcaactctgaaaaaccaccataaagcataatggctacctaaaataaatggcccatttctaaagtaattagtattcctaaacaaattttaagtagctctgcttctccagtgacattttggtttaaagaatcaaggggaggctgggtgcagtggctcatccctgtaatcccagcactttgcaaggccgaggtgggcagatcacttgaacccaggagttcaagacaagcctcggcaacatgacaaaacctcatctctacaaaaaatacaaaaattagccaggcccagtggcatgtgcctgtaatcccaactactcaggaggctgaggtgggaggattgtttgaacttgggaggctgaggtaggagtgagcccagatcacgccactgcactcctgcctaggcaacagagctagaccctgtctcaaaataaaaaagaaaggataaaggagatttgattaatagattaataaantgttctttcctgattggttatgatgttgaactacttcccaaattatgtaaccaaatttctgtgtggctctggtgctattaggtcaaaactttggggaactaagcatgagatagcatactcctgtttccttctctgtcccagggaaatacaaattcccttttgcctcaattagagaaggatgtctattcttgctacaaattatgatttatgtcctggtgtcaaatgaagataagaataagatcaaagaaaggcaagatgattgtggaagagaaagaaaaaggattaatttagatttatttaaccaagaaacatttatttngtatctcctatttccaggctgagtgctaagaaataaaatgatgagtagagtatagcctttctcctcaaggagcttaccctctaatcatgggagagacagacatgtaactagttaaaccatattgtttggtggcttgaaccatgccagtagtagccactattaaggaaggaactgaagggcacttactgatttgggtaatagtgggaaaaatcagagaggagggaggatttagattgaagtatgtgcttctattttagaaggggctatatttactatgtttattacttaaaagttcataaaagccaataatatgggtttgagctgtgttagtgatgagttaacaaacatatcaggactatttaacctccctgagcccctgttctctaaatgggagaataataactctacctgattgagttcttggaaaataacatagtgtaacggaaagagcaggctttggaggaaaagaggatttgactttgcatctctatcaattaattgtgtgactttgagcaagttatttaactctctgagcttcactttccttatgtgcaaaatggataacaccatggcataagacaatcccatgaagataagatataaaagaagataatgtttgaaaagaaataagatcttactcttattcaacaggaagtggatgctttggaagaattaagcaggcagctttttctggaaacagctgatctatatgctaccaaggagagaatagaatactccaaaaccttcaaggggaaatattttaattttcttggttactttttctctatttactgtgtttggaaaattttcatggctaccatcatattgttttgatcgagtagtcacctgggccagctcactcat

SEQ ID NO: 102889 - DNA, 924 bp, Homo sapiens
atcagtccaaggatgaataggcagttgctgggcagatgtcgttgcagagagattctttgggctaccatcaatattgtttttgatcgagttgggaaaacggatcctgtcacaagaggcattgagatcactgtgaattatctgggaatccaatttgatgtgaagttttggtcccaacacatttccttcattcttgttggaataatcatcgtcacatccatcagaggattgctgatcactcttaccaagttcttttatgccatctctagcagtaagtcctccaatgtcattgtcctgctattagcacagataatgagtcacttctggattaattcatttgacttacagggcatgtactttgtctcctctgtgctgctgatccgaatgagtatgcctttagaataccgcaccataatcactgaagtccttggagaactgcagttcaacttctatcaccgttggtttgatgtgatcttcctggtcagcgctctctctagcatactcttcctctatttggctcacaaacaggcaccagagaagcaaatggcaccttgaacttaagcctactacagactgttagaggccagtggtttcaaaatttagatataagaggggggattcaccttcatagcatactccttccccgtcaggtgatactatgaccatgagtagcatcagccagaacatgagagggagaactaactcaagacaatactcagcagagagcatcccgtgtggatatgaggctggtgtagaggcggagaggagccaagaaactaaaggtgaaaaatacactggaactctggggcaagacatgtctatggtagctgagccaaacacgtaggatttccgttttaaggttcacatggaaaaggttatagctttgccttgagattgactcattaaaatcagagactgtaacacttt

SEQ ID NO: 102890 - DNA, 1968 bp, Homo sapiens
tggggcgcagcttgatggcgtcgggctggagagccgcagtcccggctgcagcacctgggagaaggcagaccgtgtgagggggcctgtggccccagcgtgctgtggcctcggggagtgggaagtggaggcaggagccttccttacacttcgccatgagtttcctcatcgactccagcatcatgattacctcccagatactattttttggatttgggtggcttttcttcatgcgccaattgtttaaagactatgagatacgtcagtatgttgtacaggtgatcttctccgtgacgtttgcattttcttgcaccatgtttgagctcatcatctttgaaatcttaggagtattgaatagcagctcccgttattttcactggaaaatgaacctgtgtgtaattctgctgatcctggttttcatggtgcctttttacattggctattttattgtgagcaatatccgactacttttgtctcctctgtctcagtgcataaacaacgactgcttttttcctgtctcttatggctgacctttatgtatttcttctggaaactaggagatccctttcccattctcagcccaaaacatgggatcttatccatagaacagctcatcagccgggttggtgtgattggagtgactctcatggctcttctttctggatttggtgctgtcaactgcccatacacttacatgtcttacttcctcaggaatgtgactgacacggatattctagccctggaacggcgactgctgcaaaccatggatatgatcataagcaaaaagaaaaggatggcaatggcacggagaacaatgttccagaagggggaagtgcataacaaaccatcaggtttctggggaatgataaaaagtgttaccacttcagcatcaggaagtgaaaatcttactcttattcaacaggaagtggatgctttggaagaattaagcaggcagctttttctggaaacagctgatctatatgctaccaaggagagaatagaatactccaaaaccttcaaggggaaatattttaattttcttggttactttttctctatttactgtgtttggaaaattttcatggctaccatcaatattgtttttgatcgagttgggaaaacggatcctgtcacaagaggcattgagatcactgtgaattatctgggaatccaatttgatgtgaagttttggtcccaacacatttccttcattcttgttggaataatcatcgtcacatccatcagaggattgctgatcactcttaccaagttcttttatgccatctctagcagtaagtcctccaatgtcattgtcctgctattagcacagataatgggcatgtactttgtctcctctgtgctgctgatccgaatgagtatgcctttagaataccgcaccataatcactgaagtccttggagaactgcagttcaacttctatcaccgttggtttgatgtgatcttcctggtcagcgctctctctagcatactcttcctctatttggctcacaaacaggcaccagagaagcaaatggcaccttgaacttaagcctactacagactgttagaggccagtggtttcaaaatttagatataagaggggggaaaaatggaaccagggcctgacattttataaacaaacaaaatgctatggtagcatttttcaccttcatagcatactccttccccgtcaggtgatactatgaccatgagtagcatcagccagaacatgagagggagaactaactcaagacaatactcagcagagagcatcccgtgtggatatgaggctggtgtagaggcggagaggagccaagaaactaaaggtgaaaaatacactggaactctggggcaagacatgtctatggtagctgagccaaacacgtaggatttccgttttaaggttcacatggaaaaggttatagctttgccttgagattgactcattaaaatcagagactgtaacacttt

SEQ ID NO: 102891 - DNA, 738 bp, Homo sapiens
  misc_feature (686)..(686): n is a, c, g, or t
  misc_feature (708)..(708): n is a, c, g, or t
  misc_feature (711)..(711): n is a, c, g, or t
tggggcgcagcttgatggcgtcgggctggagagccgcagtcccggctgcagcacctgggagaaggcagaccgtgtgagggggcctgtggccccagcgtgctgtggcctcggggagtgggaagtggaggcaggagccttccttacacttcgccatgagtttcctcatcgactccagcatcatgattacctcccagatactattttttggatttgggtggcttttcttcatgcgccaattgtttaaagactatgagatacgtcagtatgttgtacaggtgatcttctccgtgacgtttgcattttcttgcaccatgtttgagctcatcatctttgaaatcttaggagtattgaatagcagctcccgttattttcactggaaaatgaacctgtgtgtaattctgctgatcctggttttcatggtgcctttttacattggctattttattgtgagcaatatccgactacttttgtctcctctgtctcagtgcataaacaacgactgcttttttcctgtctcttatggctgacctttatgtatttcttctggaaactaggagatccctttcccattctcagcccaaaacatgggatcttatccatagaacagctcatcagccgggttggtgtgattggagtgactctcatggctcttctttctggatttggtgccttgtccaaacctgggncccccccccaaattaaaccccnaancccttttttttaaaacccccaaatttt

SEQ ID NO: 102892 - DNA, 127 bp, Homo sapiens
gacccagtttctctggctgctggaccaaggccccagctctcggctgtctctcggctggaggccgacttttgttccttgctgcataagccttccatagtggcagcttcctgcaccaaagccagcaagg

SEQ ID NO: 102893 - DNA, 306 bp, Homo sapiens
gtctcttaagggaggctccagaagctactgagacactctcactttcatctctggccagagcttggtcacatgcctgcatccgactataggggaggctggaaatggaatctttattctgggaggcctgagttcacctaaaaattggagcattgattagtttattaggacaaaggggaaatggatattgtgggatacagctgtgtcagctgcgcctgccttttctcctagtgcctggcctaatgtatatttaattagccatttgtttaccatctgtctctcccgatcagaatgtgggctgtgtaaaac

SEQ ID NO: 102894 - DNA, 520 bp, Homo sapiens
tgcatgcttactctggctgagactttgagaagtatcattttcattatcagaaatttttaagtaaataaacttaaaacatcaactactattctagatataattattaagaatcgatagagccagagaatgcaacagaatgatgatcgtagatattggctgagtgactaaaatcttctttcttcctacactagagatcaagttgaactcaggtcatcagtttcaagcctttactctcagctttggaccaaatccacctgctagtgtgactctaattcattagtaatgcagttgtcattaatatactaagagaacagtgcttctggtgttacgtgttgctgttgtggttagctctagaaagtagacagtctccaccagaattagtgatttgttggctcctccattacagttgtctgttgtaaagtagtgactcctgattgcaagaagattggacggtgaccactggggcgatacaccctgaggatgtgtttgggaactcaaggggagctaaactcccaaggct

SEQ ID NO: 102895 - DNA, 506 bp, Homo sapiens
tacccaggttatggtgagttttctgttttcggattacagaagccatatatattctttactccttttctcattcccgaaattgctggttaaatttgttcttgcttactaaataataagttaacggtaaggtagtcagcaaatgaaaagaaaactctaaatagtttatttgctgactataattgagtataaagtttgatgagaataaacaagatcctaatatcatccatgtctctctgtcatataggaacttccattagaagaaatggtcaggctgggcaaggtagatcatgcttgtaatcctagcactttgggaggctgatgcagaaggatggcttgagcccaggagttcaagaccagcctaagcaacacagacctcatctctattaaactttttttttaaaagaaagaaaaaaaggctgggtgcggtggctcacacctataatcccagcactttgggaggccaaggcgggtggatcacctgaggtcaggagtttgagaccagcctg

SEQ ID NO: 102896 - DNA, 396 bp, Homo sapiens
caattccataatttcctatatttgtcttctcccccaaaagttgggccttttatcctaaaccagttactatgttgggacagagctttcaccatgtaatattccagtctgtggtaggttacttcatcttggacccttgttcttacctacaaattagtaagtgggtgaaaattttacataaggttatacattaggccaacttgttcccagttggctaaatccaggatgttcaaaacatacatggagctgaaccacttctaaacaaacagctacatcgtcttggggatggtgaagatgctgaaatggttggtcatgagtggaagaccatcataagcatcggctctaagtgaagcagatcaatctaatcttaacccattactgcttaaaggggtttaattg

SEQ ID NO: 102897 - DNA, 362 bp, Homo sapiens
ccaggagctcgataccagcctgggcaacatggcaagaccttgactctacaaaaaataaaagattagccgggcatggtggttgtgcctgtagtcccggctctggaggctgaggggggaggatcgcctgagcccgggaggttgaggctgtagtgagctgtgactgcaccactgcagtccggcctgcggaacagagccagaccctgtctccaataataataataacaataatcatctaagttcacgtaattgatgtaaatctttggcaaatgagactaataatttgggttttaaaaagctatgtcttttcttcagtttctttttattattatactttaagttttagggtacatgtgcacaacgtg

SEQ ID NO: 102898 - DNA, 716 bp, Homo sapiens
ctatttccctaattttatcatttcacatttccggagtctagctggacgaggtattgaggaaacttttctgatctgctgaaacctcaggatggacattcatgttaatggcaaagtgcatttgaggaagaaagtgaggaaaggagggggcaacatagccagccccatctatacaaaaatacaaaaattagccaggtgtggcggtgtgcacctgtggtcccagctactcaggacgctgaggcaagaggatcacttgagcccagggaggtcaaggctgcagtgacccgagattgcaccactcaaatgatcctcctgcctcagtctcccaagtagctgggactacaggcacactccatcatgcccagataatttttttttggagaccgagttgctcttgtaacccaggctggagtgcagtgacactatctctacctcccaggttcaagcaattctcatgcctcagcctcccgagtagctaggattacaggcgcctgccaccacacccggctaattttttatatttttagtatttaggtttttgccatgttggccaggctggtcttgaactcctgacctcaggtgatctgcccgcctcggcctcccaaagtgctgggattacgggtatgagccactgcacccagcccatacccagctaatttttaaaattatttttgatagagatggaatctcactatgttgcccacactgatttcaaactc

SEQ ID NO: 102899 - DNA, 692 bp, Homo sapiens
gtgttacaggggaggggaggctgtgtgctgcagggtccagagcagtggtcctgcggggatggagtctcatctctctcctgctctcctctgtggctatccactgtgtccctcttgtcagcgcatctgtcccaagtcactttgcaggtttttgtcactggctgatgaagagcaggtggtcatggggaaggaagggaggctgagaagtatggggtgtgcagagagcaggagccctttctggacactgtgcccaccctgtggccttcccactggaagagaaacacctcattggggagatcagaacaaatatctaaccatcatctcgcacttcaccttcagcccacagtggctctgggcgggcaggggatgcgggctcccggccacctcctcgcctgtgtggggagctgctatggtgtttaagcaggcttccctccctgaccctctccctgtgatcagatgtcacaggtctccaaattccaccatgagaggttcattcttttagttgcctcctcccatttgatacattgctttttataattaaataaaaataaatgttgttcatgtataatttcatgattttaaccatggaactatattctatgtgtggcaaccaccaccacaatcagggtacagaacagttccaccgcccccaaaactacatcatgctgctctttgaagtcacacctactacccac

SEQ ID NO: 102900 - DNA, 387 bp, Homo sapiens
tggcaggagcccctgagcctgacttataccccttttactctcacctcttggttcctggatttgtgcattctctacagcagagatgacaccatatacttggctgcccaacctatgaacagaactccaacctctcagggtgttatctcttggcttgcaccctggctgaggcttcatcaggacatttcatcattctgtcaaactggttgctactagagggtgcaggtgatgtgatccatgaattatatgtattgagcccactgtctcacttcctttgctaaaaaatggttaggagatagttttcacaggaaaccttggctatatatcagttgcactataagtccatgaatgatggtgcttgcagaggcactgaaggcagggaagacatat

SEQ ID NO: 102901 - DNA, 356 bp, Homo sapiens
gattccaaagcctttattatttctgctataccacactattattcatctattataaatctctcattacacagaagagaaaattgcacccccttaaatgcttttgaactagcagacttggaaaacagtaacttttatgacagtttcactggttaaatatttgctctggtccaatatttcataagttaattttgagcaaaatccatactctacgatatggagttccctattaggtgggaaaggatgctttcaaccaggacctcatcaagggagctttcctggaacccagaaggagatcctatcacccatcagattgccagaggatgaaatttcttagaagcccctctcacatcatgctc

SEQ ID NO: 102902 - DNA, 461 bp, Homo sapiens
agaaggggtcccacagtaggccgtctgcaggctgaggagcaaggaagctaatccaagtcccaaaacggaagaacttggagtccgatgttcaagggcaggaagcatccagcacaggagaaagatggaggccacaagactagtctagtctttccacattctcctgcctgcttttattccggccacgctggcagctgattagatggtgcccacccagattgagggtgggtctgcctttcccagcccactgacacaaatgttaatctcctttggcaacaccctcacagacacacccagaaacaatactttgcatccttcaatccaatcaagttgacactccgtattaaccatcgcaagttgagtgcaaaatctcaagaacagctaacagggacagacccaaaattcactggcaccctagaaaatgtctggatttgctagaatcacctaattctgtatccctgggc

SEQ ID NO: 102903 - DNA, 246 bp, Homo sapiens
aaatggaggatccctttctctgatcgctcagggcacagccttcctcaagagggaccctcagaagtctctcagctccttgtccctgtcacctcctggcctcttacctttcatcacatctccagtttcagaagggctgtcgcctctactctcagattccagctccacctcctctgggtcacattccctcttttcttttttcttttctttttttttggacagagtcttgctctgtcgcccaggctggag

SEQ ID NO: 102904 - DNA, 156 bp, Homo sapiens
gagatcgcgccattgcactccaacctgggcgacagtgagactccatctcaaaaacaacaacaaacaaacaaaaataatactgcgatttcctagcaatgcccagtgacttaccctaaattcagtgaaagttgaaaaaaaaaaagaagtggcatttga

SEQ ID NO: 102905 - DNA, 377 bp, Homo sapiens
ccccccaaagtcttactttttaaattatgtttgccttgggggcattttataaattggcttgcatttctgagtacaaacctatggggaaacctgataaaatgcaaattgttgatttgtgtgaaggtaatcctgttaatcccacagtatctcttattttattagctcttcccatgagagagcaaggaacccatgctaaggcacaagagttaagcatttggatggcaattaaaatcaacagggctgggcgtggtggctcatgcctgtaatcccagcactttggaaggccgaggtgggtggatcacctgaggtcaggatttcaagaccagcctggccaacatggtgaaaccctgtctctactaaaaatacaaaaattagcc

SEQ ID NO: 102906 - DNA, 400 bp, Homo sapiens
actcctgagtaatgatcagaatggaaggggtgggaggttatatagccctattttgagaattcaggattccaccctgaccaattttaggcatgatgtttctttttaccccctagtaacaacccaaggccagcctggttggtatctatcttctatgtggcagctaggccaaaagatggcttaaggaattcagacttaattcttgttcagttacctagattctcttgttgaattgatattattctaggtcatcaggatagtgactatttggttgagtatactgcttgctgagtctctgtatggtagacagtggggaccataatgggtttctgtaggttttatgcaaattcccttgaccctcttgcgcctgacatttccagatgaaaggtctgggtgttgtgag

SEQ ID NO: 102907 - DNA, 555 bp, Homo sapiens
ctaatttttgtatttttagtagacacggagtttcgccatggctggtctcgaattcctgacctcaagtgatctgcccacctcggcctctgaaagtgctgggattacagatgtgaaccaccactctcggcctattacttaattctgaaaacaatcatgcaaggtaggaattcgagaccagccatggcgaaactccgtgtctactaaaaatacaaaaattagccaggtgtggtggtgcatgcctgtaatcccagctactcggggctgaggcacaagaatcacttgaacgtgggaggtggaggttgcagtgagccaagatcacaccattgcactccagcctgggcgacaaagcgagacccccccatcctcaagaaaaaagaaaaaacaagaagaaacaaaaaaaacaaacacaaacaaaaaaaacaaagaaggggggggggccgcgccctatagaaaaaatatatcctccgctggaggggccccccaggtgtatgtcgcgcgcggtcacccgcgagcttttttcgtggtgccaacaagggggggcccccccataaggag

SEQ ID NO: 102908 - DNA, 269 bp, Homo sapiens
ttatagtaaaaagtcagttctcgaagaatatacatgtttaatgcaattcctatcataatcccagcaaaatttttaatgaatataaacaaggttattttaaaatttatattgaaaggtgaaggaactagaatcgttcaaagaatcttgtagactgagtgtggtagctcacatttgtaatcccagtgcattgggaggtcacagtgggagggtggcttaaggccgggagttcaagaccagcctgggcaacatggagagattccttctctacc

SEQ ID NO: 102909 - DNA, 529 bp, Homo sapiens
gtaaaagaagaagagattttacttgaaactttgctttttctaatacaaacagagaaaacagctgaggtgtgaatgtgttgttaatttgggatttcagaatatatttatcatgtatatacattttaatagtttacaagtatttagctttttgactcatttgaatacgttgctaaaattgtatgtatctaaaaccgtggcatcccatcacatgatctttaaaaacaattcagcctttggtattacttggttcaaagaagtaatgataacatttcagatattgaggtatttttgttaaaatggactgaaattgattcaaaattgactttataggtcatttagttttgtttatgaaaatcatcttgggagatgttgatacgtacacaatatttactgttggactgaggaaagaaagtgagccacagaggagtttttgccaattaatttgaataagcagctgccctggatttgagtagctgattgttaaaggaaaaagttggattaaaatcagtgtttcttaaactagtggtta

SEQ ID NO: 102910 - DNA, 399 bp, Homo sapiens
tggcacatacctgtaattccagctactttggagactgaggcagaacaattgcttgaacctgggaggcggagcttgcagtgggctgagatggtgccactgtgctctagcctgggcaacagagtgagtgagactctgtttcaaaaaaatatatagtaataatccacctagtaacagtgaagttttgtgtgaaggaaaggtgatattttggaattttgatttacatggtttgatttgtagtgttataaaattaaatttgggatagagcagttttggaatatatctgaaggagttacaaaagtaccagtgggagagaattaaacattggttttatgttaatagtttttccccatactgtgggaacccaccaagagaattgcttggagccaggagtttgagacc

SEQ ID NO: 102911 - DNA, 409 bp, Homo sapiens
tctaattttcacatgtcaggaagtggtattctttttatttttttcccaaccatttaaaaatggaaaaaccactctgaggtcataggccatgtaaaaacaaacagcaggccagatatgacccatgggctgtggcttgctgaccctgttttagatgatacattcacagcaatgcagcctgtgattgtactgcacagctacaaacaacccaaaagctactgactcacattcaacctgctgtcagcttaaagccctttggacctgtgctggggtgtgtttccccatcttctgaagggaagagagggccaggggtttcactcactctcaagtttcccggtggagaggccttcctggaggtggggttctggctcccctactaccgcctttactccttcctgaaggtgagagattg

SEQ ID NO: 102912 - DNA, 187 bp, Homo sapiens
ggttcccacagaacctggcactgcctggggcatagtgaatgcttagtgagtgtcagccaccaccatcgctgttgacctcatcaccaggggtagtggtgggttggataccattgtgttggaatttctcgaatttccacagaacagaccgcctagaatcgaatccctgggaagtctgaggaccacacac

SEQ ID NO: 102913 - DNA, 310 bp, Homo sapiens
tgagaaatttctctggcttacggtgcctccctcttcctggccttgacttgatttttagatcttttattggacatttatagcataatcactaacacttctgagatatttagaagtctattactaaattatgtttcacaattttatttagttgctttattagcttgtgataatgaagtttaagtgtttgaaggaggaacagtatatttactgggtctgaagcaggagtggcttaaattgtgtattagacaatttgattattatctattgacatctaccatttgccagaagcttctggggatacaatggtgaa

SEQ ID NO: 102914 - DNA, 325 bp, Homo sapiens
gcttatgagagacccagcgcccagggctttttctgggggctggccacatacgcaccctctgtgtagcgtatgccaaaattccgactcccagaaggaaaacagatgttcctcataaagaaaacacattgtgcaaacagtgtagggacggtaagccaccttaccagtttgggaatgggagggataaacttgaaatccaaattcccaggctgggcgcggtggcttacgcctgtaatcccagcactttgggaggccgaggcaggcagatcacttgaggtcaggggttcgagacaggcctggctagcatggtgaaaacccatctctacta

SEQ ID NO: 102915 - DNA, 334 bp, Homo sapiens
ttgtatcatgcggatgaggcctccaggcagcaggcttgagagagaacagactgtaaatgcttcgtatcagacttaaggtctgtgttgatgttaatgttacaggctacgataaggcatgtcagacggaccgccacttcccgtcatggcctgaaccagtctttcaggggaaattttagagtgccctggccaaggagggagtccatccccatggttcagggggcctttgaattttatttttgatttacaggtctttacttcaggtggcacaattttcctaggagacagttgatttttgattccttataaaacgtgctggttttgtttttagctgaca

SEQ ID NO: 102916 - DNA, 770 bp, Homo sapiens
atgctttccatttttttctttacttatctctcaaaacaatattactttgtcttttcaatcttctacttttaactaataaaataagtggattttgtattttaagatccagaaatacttaacacgtgaatattttgctaaaaaagcatatataactattttaaatatccatttatcttttgtatatctaagactcatcctgatttttactatcacacatgaataaagcctttgtatctttctttctctaatgttgtatcatactcttctaaaacttgagtggctgtcttaaaagatataaggggaaagataatattgtctgtctctatattgcttagtatttccatagtcaatgatggtttaataggtaaaccaaaccctataaacctgacctcctttatggttaatactattaagcaagaatgcagtacagaattggatacagtacggatttgtccaaataaattcaataaaaaccttaaagctgacttcgtttgttatgtaggctgtatgcatatattgaaaacagaagtgaaactttcgattgcttttaaataaataccaactaatgaatttactgctaagctcaaaaccgtctacgcttaaggtgagaatctttgccaacagaaaggcgttgctctaaatcgcgaatggtattacgaagaattgcaatctccttgtttttttcttcttgaaaatgctgaagtttctaaacgaaacaaaaaatttgttattagaattcagaaataataaaatttagtacaaggaacaac

SEQ ID NO: 102917 - DNA, 345 bp, Homo sapiens
tcataatggcaataatgtgtagatagtcatgcaatctacaaatagtgatagctttacttcttcctttccaatctgtgggccctttttttcttgccttattgcactagctaagacctccagtacaatgttgaatagaagtggtaagagtcaacacccttgccttatcccactcttatgggaaaagagtttaacattttaccactaaatatgttacctgtagatttttcatagctgacctcataacaggttgaagaaatccccatctagtcctggtttactgagagtgttgagttttgccaagtgcattttctctacatatttagatgattacatatgttccccata

SEQ ID NO: 102918 - DNA, 85 bp, Homo sapiens
gtaattacttccccttcaatgttctcatctgtgaaatggacaacagcacctaccaagagctgggctgttgggaggaacagaggag

SEQ ID NO: 102919 - DNA, 318 bp, Homo sapiens
gtaatttcttctttgactcattgattattgaggggtttgtggtctaatttccacatattcatgaattttcgaaatttccttctagtatagattttctactttaattctatttaggtcaaataacatactttgtgtgattttaatccttttacttttatcgaggcatgttttagggcatagcacatagtctgtcctatcctggggaaatgttccatgtgtgcatgagaagaattctcctcttgttgaatggagtgttccatagatatctgttaaatctagttggtttatagcatttttcaagctgtttcctgattgaac

SEQ ID NO: 102920 - DNA, 409 bp, Homo sapiens
ttcttggagccctcattatatctaaagtgaagaaaatacctcagttactgcagggtctctttggtaaattcagggatttcccacttgccttcacttggattgcttttatgacttaggtgactcaggtagggatgagtcaagggagaaattggcgatttgtctggtcctcagtgttcatttcctccccatgacttttggtgtctgtgtatggtccctactggcaggtagtagggactgctcttcctacactgcatccacagagatgtccccattcccaaatccacagggttacctgctgtcccatgtctctgtccctttgtgggcattgctttctctgccagctctttcttctctgttgagctctgtaccttttttggggacaaggaaaatgttggctgttgcaaaaagc

SEQ ID NO: 102921 - DNA, 188 bp, Homo sapiens
aaaccagataaaacatctttgacgtgggagctgcagtactgagcccacagcccacactccctgctcatcaccccagctcatcacaccatcacagtcctcactctgcagacagggacactgaggcccaggggtgagtagctcccaggctcacctggctggaacctggaggaggaatgtttcagcaccag

SEQ ID NO: 102922 - DNA, 525 bp, Homo sapiens
taagatgtttgttcttgaaaggttcttttgttgtgagatcagcaacactagcacttcactattatagttttttaaaaagtgtattattcttatctgtagttatgtctgagaagtcctttacaagctgtttataaggagagtagcttctttgtgtgtgtgatgtttgtgcgtgtgatgaatttagcaaattaagttattttcctaaaaaaaaaagaaaaaaagaattcagaactactttcctctgtgacaccaaaaagaaaagtctataacctgaaaatgtttcatgttctctgctgtgaaactcttaaaacaaggagtgtattttagagacaagggaaaaaaaccacatctgctatccaaagattttagtctttttcagggtttttttgtgtctctgttgctttatataatgcaatattttgtagtgaaaatagatataatctggtttctatctgacgagtttttcatatctcatgaatggtgcgctgttttgcatataaataaaggtatcaaataaagtcctct

SEQ ID NO: 102923 - DNA, 387 bp, Homo sapiens
tggaaaccgagtcttgctcagtctcccaggctggagtgcagtggcgcaatctcagctcactgcaagctccgcctcctgggttcacgccattctcctgcctcagcctcccgagtagctgggactacaggtgcctgccaccacgcccggctaattttttgtatttttagtagagacggggtttcaccgtgttagccaggatggtctagatctcctgacctcgtgatccgcccgcctcggcctcccaaagtgctgagattataggcgtgagccaccgcaccccgcctgtatttggatttttctatcctaacttttctttaataatttgatccactgttcaacagcaatcagcaaacatctatttactcagtaacattcatcaagcctttc

SEQ ID NO: 102924 - DNA, 397 bp, Homo sapiens
aagatggtggtgtgtgtctgtagtcccagattctcaggaggctaaggtgggtggttcttctgagcccgggaggttgaggctacagtgagccatgatcgcaccactgcacttcagcctaggcaacaaagctagaccttgtctcaaaataaaatattatgtaagtgatattatgtccttctcagtgccttacatcagaaggataataatgttctgttatgactgatgttaatgttgattccttggttaaagtactgtctgccagctttcctcactgtaaaagctctccttttataatttgtggggagatactttgagattttgcatacatactgtttctcatcaaatttttacccaatagttttagcatgttttgatgttcataagtattttaatacaa

SEQ ID NO: 102925 - DNA, 213 bp, Homo sapiens
ctgctgccttccccaggctcccaggctgcaccacacggggcctgcatgttccttctgactggcacaaggtactctccatgccactgctccttgctcatctcctgtgcctctggcgagtcccccaccgggccaccacttccctcaggaaggcctctccgactgcccagaccagcaaggggcttctcagagttctccagtctctggcctcccact

SEQ ID NO: 102926 - DNA, 440 bp, Homo sapiens
agatttaacactgttattcctgcaaaatttccacactgcctttcttccctacttaaacactctctgatctttgactccaaacttatgaaatcccatttcatgtataaagacttcctgaagcaatcagaatacatagagccaatttcaactctacctccatcattaaggcaaatcacttagtctgtaacatctacttggcacctatcttggagagactgcacatccataaaatcatatggagagcaaccctaaactgagaataaattaagacaggatgaattaagtaccaaaatcctgagagcctggtgggaaatacagttaggcataatcagttgctaaggaagcatttatgagtgagggtggtaatcagaatgaaaaggcaaggagaaagaggaggaggaggaggaggaggaggaggaacaggtattgcagcaaattta

SEQ ID NO: 102927 - DNA, 3830 bp, Homo sapiens
aaaaggcaggcattctctttccttttccttctctcctgagcgctcctgcagttcctggggcgtagtaggggatccacaagcgtttgtgaccagtgaagttctttacaagggtgagatctgcacgggaggacccgagcgagggtctcggcttgccaggaagccggggttccccgggaagcgtggagttcacccgcgcactcgaagtgcctttgcaaaattatatctgggtgttggcacccagccactattctgccaatgaagtacatcctggtcacgggtggggtcatctcaggcattggtaaagggatcattgccagcagcattggaacgattctaaaatcatgtggactccgagttactgccataaaaatcgacccctatattaacatcgatgctggcactttttcaccttatgaacacggtgaagtcttcgtcttaaatgatggtggagaagttgatttagaccttggaaattatgaaagatttttggatattaatctttataaagacaacaatatcaccacggggaagatatatcagcatgtgatcaataaagagaggcgtggtgattacctggggaaaacagtgcaagttgtccctcacattactgatgctgtccaggagtgggttatgaatcaagccaaggtgccggtggatggtaataaggaagagccccaaatatgcgttattgagctgggaggcaccattggagacatcgaaggaatgccgtttgtggaggcgtttagacaattccagtttaaggcgaaaagagagaatttctgtaatatccacgttagccttgtcccacagctcagtgctaccggagaacaaaaaaccaaacccacccaaaacagcgtccgcgcactgaggggtttaggcctgtctccagatctgattgtctgccgaagttcaacgcccattgagatggccgtgaaggagaagatttctatgttttgtcacgtgaaccctgaacaggtcatatgtatccatgatgtttcttccacataccgagttcctgtgcttttagaggaacaaagcattgtgaaatattttaaggagagattgcacctgcccatcggtgattctgcaagtaatttgctttttaagtggagaaatatggctgacaggtatgaaaggttacagaaaatatgctccatagccctggttggcaaatacaccaagctcagagactgctacgcctctgtgttcaaagccctggaacactcagccctggccatcaaccacaagttgaatctgatgtacatagactccattgatctggagaagatcactgaaaccgaggaccctgtgaaatttcatgaagcttggcagaagctatgcaaagctgatggtattcttgtgcctggaggctttggaatcagaggaacattgggaaaactccaggcgatttcttgggcaaggacaaagaagattccttttctgggagtttgtcttgggatgcaactagcagtgatagagtttgcaagaaactgccttaacttgaaagatgctgattccacagagtttaggccaaatgccccagttcctctggtgattgatatgcccgagcacaaccctggcaatttgggaggaacaatgagactgggaataagaagaactgttttcaaaactgaaaattcaatattaaggaaactttatggtgatgttccttttatagaagaaagacacagacatcggttcgaggtaaaccctaacctgatcaaacaatttgagcagaatgacttaagttttgtaggtcaggatgttgatggagacaggatggaaatcattgaactggcaaatcatccttattttgttggtgtccagttccatcctgagttttcttctaggccgatgaagccttcccctccgtatctggggctgttacttgcagcaactgggaacctgaatgcctacttgcaacagggttgcaaactgtcttccagtgatagatacagtgatgccagtgatgacagcttttcagagccaaggatagctgagttggaaataagctgaaatgaatacatgactgggaataatggggactgcctgtgaggcctctgaaataattgaaggcaagatgaaggaactatctgaagaaatcactacactcttagagaatccctctgttctccagcaaacatgggatgtaaagcctcacagggaatctgataatacatacttctgtcaaccagaaccagaggggtagttttcttttccctccagaggcagcctttggtacttaaaatatctgtagctgattaaatttttcccaacaacctcactggggagaaagtgtgttcatgttttgtccagcggatcaggatgttaggatgacgagcaagagtccaggtcactgtgcctttgctgtgttgtatggaaaggatggcagggaacatgctgtaagtaattttgagtaagaaaatgagtcactgtgttacctggaactcagccacagatttgtgtgtggtccaagatcattgcagtttctcaccctgtttatttcctggtaaaagtaaaattgaataggtccaagacttgggggtggcaagtaaggctttgcctcaggcacaaaatttaagggggctccaaaaaactcaggaatcaagatcagcaatacagtctgagtatcccttatgtgaaatgcttggggctagaagtgttttgaatttcagattttggaatatttgcatatacatgcgatatcttggggatgagactcaagactaaacatgaaattcatttatgcttcatatacaccttatatacatagcctaaaggtaatttgatacaatattttaaataattttgtgcatgaaacaaagtttcgactgcattttgactgtgatttctggcatgagatcagttatggaattttccacttctagcgtcatgttggcattcagaaattttgaaattttggagcattttggattttcagattagggatgctcaacctgtatatatattttttaatcgacgtgaaattcacgtaacatagaattaaccattttgaagtgaacaatttggttgcattcactgatgttgagcaaccaccacctttaactatttccaaaacattttcatcactccaaaataaatgcctgtacacactagcagtcactccctatcttcccctccacctgtccgctggcaaccactgatctcctttttatttctgtggctttttctattctggatatttcatataagtggaattacacaatatatgtggtcttttgtgtctggcttcttctgagacagtaggaagggggcttggctttggctcacccccactagagcattttttcatgcattcccactgatcacaaaacccatactactacctcattgacaccatacctgctaacctcgaggctttagtcatacaaagaaaatggcctttctgtattgttcttctgtgctctcataatgcttaaccatgtcttttacttaaacaattccaggaactggccttaggagatccaaatagggaaccaagattgcagagtgtcccatcttgggagggaatgctgaataattaattgatttacagccttgttgccgctggccagaccaccaggtggcccattactcgagatgatcatcacaaccagatgatgctaacctatatcctctacccttcgcgtgctttgtctgggaagtcttttggccccatgtcagtttctattgcattgagagcccaagagcccctggtcagtcaggcttccatttagcatggcgtttgcaaggtttacccatgttgtagcatgtgtcagaatttcattcctttctatggctgaataaaattccattgtatgaatatacca

SEQ ID NO: 102928 - DNA, 2284 bp, Homo sapiens
aaaaggcaggcattctctttccttttccttctctcctgagcgctcctgcagttcctggggcgtagtaggggatccacaagcgtttgtgaccagtgaagttctttacaagggtgagatctgcacgggaggacccgagcgagggtctcggcttgccaggaagccggggttccccgggaagcgtggagttcacccgcgcactcgaagtgcctttgcaaaattatatctgggtgttggcacccagccactattctgccaatgaagtacatcctggtcacgggtggggtcatctcaggcattggtaaagggatcattgccagcagcattggaacgattctaaaatcatgtggactccgagttactgccataaaaatcgacccctatattaacatcgatgctggcactttttcaccttatgaacacggtgaagtcttcgtcttaaatgatggtggagaagttgatttagaccttggaaattatgaaagatttttggatattaatctttataaagacaacaatatcaccacggggaagatatatcagcatgtgatcaataaagagaggcgtggtgattacctggggaaaacagtgcaagttgtccctcacattactgatgctgtccaggagtgggttatgaatcaagccaaggtgccggtggatggtaataaggaagagccccaaatatgcgttattgagctgggaggcaccattggagacatcgaaggaatgccgtttgtggaggcgtttagacaattccagtttaaggcgaaaagagagaatttctgtaatatccacgttagccttgtcccacagctcagtgctaccggagaacaaaaaaccaaacccacccaaaacagcgtccgcgcactgaggggtttaggcctgtctccagatctgattgtctgccgaagttcaacgcccattgagatggccgtgaaggagaagatttctatgttttgtcacgtgaaccctgaacaggtcatatgtatccatgatgtttcttccacataccgagttcctgtgcttttagaggaacaaagcattgtgaaatattttaaggagagattgcacctgcccatcggtgattctgcaagtaatttgctttttaagtggagaaatatggctgacaggtatgaaaggttacagaaaatatgctccatagccctggttggcaaatacaccaagctcagagactgctacgcctctgtgttcaaagccctggaacactcagccctggccatcaaccacaagttgaatctgatgtacatagactccattgatctggagaagatcactgaaaccgaggaccctgtgaaatttcatgaagcttggcagaagctatgcaaagctgatggtattcttgtgcctggaggctttggaatcagaggaacattgggaaaactccaggcgatttcttgggcaaggacaaagaagattccttttctgggagtttgtcttgggatgcaactagcagtgatagagtttgcaagaaactgccttaacttgaaagatgctgattccacagagtttaggccaaatgccccagttcctctggtgattgatatgcccgagcacaaccctggcaatttgggaggaacaatgagactgggaataagaagaactgttttcaaaactgaaaattcaatattaaggaaactttatggtgatgttccttttatagaagaaagacacagacatcggttcgaggtaaaccctaacctgatcaaacaatttgagcagaatgacttaagttttgtaggtcaggatgttgatggagacaggatggaaatcattgaactggcaaatcatccttattttgttggtgtccagttccatcctgagttttcttctaggccgatgaagccttcccctccgtatctggggctgttacttgcagcaactgggaacctgaatgcctacttgcaacagggttgcaaactgtcttccagtgatagatacagtgatgccagtgatgacagcttttcagagccaaggatagctgagttggaaataagctgaaatgaatacatgactgggaataatggggactgcctgtgaggcctctgaaataattgaaggcaagatgaaggaactatctgaagaaatcactacactcttagagaatccctctgttctccagcaaacatgggatgtaaagcctcacagggaatctgataatacatacttctgtcaaccagaaccagaggggtagttttcttttccctccagaggcagcctttggtacttaaaatatctgtagctgattaaatttttcccaacaacctca

SEQ ID NO: 102929 - DNA, 1371 bp, Homo sapiens
ggaacttagcaaggcctgtttattcagattcttccctgggatcctgtgtcttcagagataaggatactcgtttcctctgggtatgggggttgggggtacctctcacctgagggccttttgacctgcttggagaaggtcagaaaatccttccggggtgttatgacctgcttcagtgggggaaggtcagaggaaggtcagagagaacttcttgcacatgctgtctcaaattccttccgcttcatgcaatgtatatgtgggggctgttatggttagagtcataatagtctaggtcaggggttgacagactttttctgtaaggttagagagtaaatatgttaggcttatgagccatacgcaatatgccaagatgccatattttggggtagtgtgtcctgaactccctcattgccaaaggaaacagttgtcatcagaagaatgaagaatgaaaaaaacaaactgaagatccaggtaatatcgtatgctatgttattacattgaagaacaaattgacatcagtaggagtaggactaagtgatgctcaacctcagatggactgaggtttagtccctagtatgacaagagtagattcacagaaaataaatgggtccatcaactcaggctttcattttaaatcagtttgttaatataacacctctagtagaaagcaagcaatagttaaggtggcaggaaggcaatctactttcaaggcttttattaaagtttagaaatgatcagtggtcttcagaagattataaatttcagtctaaactgaaatgcgtttttaattttctgaataagtaacttccagtttacgatgaaaataagtgatcagtttctctgaccaaagaaagaggccattgcatgtgattggactgacctcttcctgtggtgactagaaagtgctaaaagaatattctttagtattttctctcatactaaggggttaatatggaatgtgtttgaaattgcaaattgaataattgtccaggttttttttttataccttgctaaattagttcctcttttaatctagtgatagatacagtgatgccagtgatgacagcttttcagagccaaggatagctgagttggaaataagctgaaatgaatacatgactgggaataatggggactgcctgtgaggcctctgaaataattgaaggcaagatgaaggaactatctgaagaaatcactacactcttagagaatccctctgttctccagcaaacatgggatgtaaagcctcacagggaatctgataatacatacttctgtcaaccagaaccagaggggtagttttcttttccctccagaggcagcctttggtacttaaaatatctgtagctgattaaatttttcccaacaacctca

SEQ ID NO: 102930 - DNA, 3938 bp, Homo sapiens
agcggagggtgacgggagctgcctgtgctggaggaatcactttttaggcgcttgttttggaccattgcacaaacccgggtgcaaaccccaagctcaccagcgtgagtgagctgggccagcagcagggaggagaggggaaggtgggcgaggagggcgccgcgcaccccgaggcccgtgtgggcggtgggaagatcccgggggcggctttggacagccccggcagcgaccccttccccagcccgacaggtgagcgccaggccagccgcggggtggagcccgccgtgcccaccggccaccctccccggtgctaccaccaccgcgcagattatatctgggtgttggcacccagccactattctgccaatgaagtacatcctggtcacgggtggggtcatctcaggcattggtaaagggatcattgccagcagcattggaacgattctaaaatcatgtggactccgagttactgccataaaaatcgacccctatattaacatcgatgctggcactttttcaccttatgaacacggtgaagtcttcgtcttaaatgatggtggagaagttgatttagaccttggaaattatgaaagatttttggatattaatctttataaagacaacaatatcaccacggggaagatatatcagcatgtgatcaataaagagaggcgtggtgattacctggggaaaacagtgcaagttgtccctcacattactgatgctgtccaggagtgggttatgaatcaagccaaggtgccggtggatggtaataaggaagagccccaaatatgcgttattgagctgggaggcaccattggagacatcgaaggaatgccgtttgtggaggcgtttagacaattccagtttaaggcgaaaagagagaatttctgtaatatccacgttagccttgtcccacagctcagtgctaccggagaacaaaaaaccaaacccacccaaaacagcgtccgcgcactgaggggtttaggcctgtctccagatctgattgtctgccgaagttcaacgcccattgagatggccgtgaaggagaagatttctatgttttgtcacgtgaaccctgaacaggtcatatgtatccatgatgtttcttccacataccgagttcctgtgcttttagaggaacaaagcattgtgaaatattttaaggagagattgcacctgcccatcggtgattctgcaagtaatttgctttttaagtggagaaatatggctgacaggtatgaaaggttacagaaaatatgctccatagccctggttggcaaatacaccaagctcagagactgctacgcctctgtgttcaaagccctggaacactcagccctggccatcaaccacaagttgaatctgatgtacatagactccattgatctggagaagatcactgaaaccgaggaccctgtgaaatttcatgaagcttggcagaagctatgcaaagctgatggtattcttgtgcctggaggctttggaatcagaggaacattgggaaaactccaggcgatttcttgggcaaggacaaagaagattccttttctgggagtttgtcttgggatgcaactagcagtgatagagtttgcaagaaactgccttaacttgaaagatgctgattccacagagtttaggccaaatgccccagttcctctggtgattgatatgcccgagcacaaccctggcaatttgggaggaacaatgagactgggaataagaagaactgttttcaaaactgaaaattcaatattaaggaaactttatggtgatgttccttttatagaagaaagacacagacatcggttcgaggtaaaccctaacctgatcaaacaatttgagcagaatgacttaagttttgtaggtcaggatgttgatggagacaggatggaaatcattgaactggcaaatcatccttattttgttggtgtccagttccatcctgagttttcttctaggccgatgaagccttcccctccgtatctggggctgttacttgcagcaactgggaacctgaatgcctacttgcaacagggttgcaaactgtcttccagtgatagatacagtgatgccagtgatgacagcttttcagagccaaggatagctgagttggaaataagctgaaatgaatacatgactgggaataatggggactgcctgtgaggcctctgaaataattgaaggcaagatgaaggaactatctgaagaaatcactacactcttagagaatccctctgttctccagcaaacatgggatgtaaagcctcacagggaatctgataatacatacttctgtcaaccagaaccagaggggtagttttcttttccctccagaggcagcctttggtacttaaaatatctgtagctgattaaatttttcccaacaacctcactggggagaaagtgtgttcatgttttgtccagcggatcaggatgttaggatgacgagcaagagtccaggtcactgtgcctttgctgtgttgtatggaaaggatggcagggaacatgctgtaagtaattttgagtaagaaaatgagtcactgtgttacctggaactcagccacagatttgtgtgtggtccaagatcattgcagtttctcaccctgtttatttcctggtaaaagtaaaattgaataggtccaagacttgggggtggcaagtaaggctttgcctcaggcacaaaatttaagggggctccaaaaaactcaggaatcaagatcagcaatacagtctgagtatcccttatgtgaaatgcttggggctagaagtgttttgaatttcagattttggaatatttgcatatacatgcgatatcttggggatgagactcaagactaaacatgaaattcatttatgcttcatatacaccttatatacatagcctaaaggtaatttgatacaatattttaaataattttgtgcatgaaacaaagtttcgactgcattttgactgtgatttctggcatgagatcagttatggaattttccacttctagcgtcatgttggcattcagaaattttgaaattttggagcattttggattttcagattagggatgctcaacctgtatatatattttttaatcgacgtgaaattcacgtaacatagaattaaccattttgaagtgaacaatttggttgcattcactgatgttgagcaaccaccacctttaactatttccaaaacattttcatcactccaaaataaatgcctgtacacactagcagtcactccctatcttcccctccacctgtccgctggcaaccactgatctcctttttatttctgtggctttttctattctggatatttcatataagtggaattacacaatatatgtggtcttttgtgtctggcttcttctgagacagtaggaagggggcttggctttggctcacccccactagagcattttttcatgcattcccactgatcacaaaacccatactactacctcattgacaccatacctgctaacctcgaggctttagtcatacaaagaaaatggcctttctgtattgttcttctgtgctctcataatgcttaaccatgtcttttacttaaacaattccaggaactggccttaggagatccaaatagggaaccaagattgcagagtgtcccatcttgggagggaatgctgaataattaattgatttacagccttgttgccgctggccagaccaccaggtggcccattactcgagatgatcatcacaaccagatgatgctaacctatatcctctacccttcgcgtgctttgtctgggaagtcttttggccccatgtcagtttctattgcattgagagcccaagagcccctggtcagtcaggcttccatttagcatggcgtttgcaaggtttacccatgttgtagcatgtgtcagaatttcattcctttctatggctgaataaaattccattgtatgaatatacca

SEQ ID NO: 102931 - DNA, 3539 bp, Homo sapiens
aaaaggcaggcattctctttccttttccttctctcctgagcgctcctgcagttcctggggcgtagtaggggatccacaagcgtttgtgaccagtgaagttctttacaagggtgagatctgcacgggaggacccgagcgagggtctcggcttgccaggaagccggggttccccgggaagcgtggagttcacccgcgcactcgaagtgcctttgcaaaattatatctgggtgttggcacccagccactattctgccaatgaagtacatcctggtcacgggtggggtcatctcaggcattggtaaagggatcattgccagcagcattggaacgattctaaaatcatgtggactccgagttactgccataaaaatcgacccctatattaacatcgatgctggcactttttcaccttatgaacacggtgaagtcttcgtcttaaatgatggtggagaagttgatttagaccttggaaattatgaaagatttttggatattaatctttataaagacaacaatatcaccacggggaagatatatcagcatgtgatcaataaagagaggcgtggtgattacctggggaaaacagtgcaagttgtccctcacattactgatgctgtccaggagtgggttatgaatcaagccaaggtgccggtggatggtaataaggaagagccccaaatatgcgttattgagctgggaggcaccattggagacatcgaaggaatgccgtttgtggaggcgtttagacaattccagtttaaggcgaaaagagagaatttctgtaatatccacgttagccttgtcccacagctcagtgctaccggagaacaaaaaaccaaacccacccaaaacagcgtccgcgcactgaggggtttaggcctgtctccagatctgattgtctgccgaagttcaacgcccattgagatggccgtgaaggagaagatttctatgttttgtcacgtgaaccctgaacaggtcatatgtatccatgatgtttcttccacataccgagttcctgtgcttttagaggaacaaagcattgtgaaatattttaaggagagattgcacctgcccatcggtgattctgcaagtaatttgctttttaagtggagaaatatggctgacaggtatgaaaggttacagaaaatatgctccatagccctggttggcaaatacaccaagctcagagactgctacgcctctgtgttcaaagccctggaacactcagccctggccatcaaccacaagttgaatctgatggtgattgatatgcccgagcacaaccctggcaatttgggaggaacaatgagactgggaataagaagaactgttttcaaaactgaaaattcaatattaaggaaactttatggtgatgttccttttatagaagaaagacacagacatcggttcgaggtaaaccctaacctgatcaaacaatttgagcagaatgacttaagttttgtaggtcaggatgttgatggagacaggatggaaatcattgaactggcaaatcatccttattttgttggtgtccagttccatcctgagttttcttctaggccgatgaagccttcccctccgtatctggggctgttacttgcagcaactgggaacctgaatgcctacttgcaacagggttgcaaactgtcttccagtgatagatacagtgatgccagtgatgacagcttttcagagccaaggatagctgagttggaaataagctgaaatgaatacatgactgggaataatggggactgcctgtgaggcctctgaaataattgaaggcaagatgaaggaactatctgaagaaatcactacactcttagagaatccctctgttctccagcaaacatgggatgtaaagcctcacagggaatctgataatacatacttctgtcaaccagaaccagaggggtagttttcttttccctccagaggcagcctttggtacttaaaatatctgtagctgattaaatttttcccaacaacctcactggggagaaagtgtgttcatgttttgtccagcggatcaggatgttaggatgacgagcaagagtccaggtcactgtgcctttgctgtgttgtatggaaaggatggcagggaacatgctgtaagtaattttgagtaagaaaatgagtcactgtgttacctggaactcagccacagatttgtgtgtggtccaagatcattgcagtttctcaccctgtttatttcctggtaaaagtaaaattgaataggtccaagacttgggggtggcaagtaaggctttgcctcaggcacaaaatttaagggggctccaaaaaactcaggaatcaagatcagcaatacagtctgagtatcccttatgtgaaatgcttggggctagaagtgttttgaatttcagattttggaatatttgcatatacatgcgatatcttggggatgagactcaagactaaacatgaaattcatttatgcttcatatacaccttatatacatagcctaaaggtaatttgatacaatattttaaataattttgtgcatgaaacaaagtttcgactgcattttgactgtgatttctggcatgagatcagttatggaattttccacttctagcgtcatgttggcattcagaaattttgaaattttggagcattttggattttcagattagggatgctcaacctgtatatatattttttaatcgacgtgaaattcacgtaacatagaattaaccattttgaagtgaacaatttggttgcattcactgatgttgagcaaccaccacctttaactatttccaaaacattttcatcactccaaaataaatgcctgtacacactagcagtcactccctatcttcccctccacctgtccgctggcaaccactgatctcctttttatttctgtggctttttctattctggatatttcatataagtggaattacacaatatatgtggtcttttgtgtctggcttcttctgagacagtaggaagggggcttggctttggctcacccccactagagcattttttcatgcattcccactgatcacaaaacccatactactacctcattgacaccatacctgctaacctcgaggctttagtcatacaaagaaaatggcctttctgtattgttcttctgtgctctcataatgcttaaccatgtcttttacttaaacaattccaggaactggccttaggagatccaaatagggaaccaagattgcagagtgtcccatcttgggagggaatgctgaataattaattgatttacagccttgttgccgctggccagaccaccaggtggcccattactcgagatgatcatcacaaccagatgatgctaacctatatcctctacccttcgcgtgctttgtctgggaagtcttttggccccatgtcagtttctattgcattgagagcccaagagcccctggtcagtcaggcttccatttagcatggcgtttgcaaggtttacccatgttgtagcatgtgtcagaatttcattcctttctatggctgaataaaattccattgtatgaatatacca

SEQ ID NO: 102932 - DNA, 2917 bp, Homo sapiens
ggaacttagcaaggcctgtttattcagattcttccctgggatcctgtgtcttcagagataaggatactcgtttcctctgggtatgggggttgggggtacctctcacctgagggccttttgacctgcttggagaaggtcagaaaatccttccggggtgttatgacctgcttcagtgggggaaggtcagaggaaggtcagagagaacttcttgcacatgctgtctcaaattccttccgcttcatgcaatgtatatgtgggggctgttatggttagagtcataatagtctaggtcaggggttgacagactttttctgtaaggttagagagtaaatatgttaggcttatgagccatacgcaatatgccaagatgccatattttggggtagtgtgtcctgaactccctcattgccaaaggaaacagttgtcatcagaagaatgaagaatgaaaaaaacaaactgaagatccaggtaatatcgtatgctatgttattacattgaagaacaaattgacatcagtaggagtaggactaagtgatgctcaacctcagatggactgaggtttagtccctagtatgacaagagtagattcacagaaaataaatgggtccatcaactcaggctttcattttaaatcagtttgttaatataacacctctagtagaaagcaagcaatagttaaggtggcaggaaggcaatctactttcaaggcttttattaaagtttagaaatgatcagtggtcttcagaagattataaatttcagtctaaactgaaatgcgtttttaattttctgaataagtaacttccagtttacgatgaaaataagtgatcagtttctctgaccaaagaaagaggccattgcatgtgattggactgacctcttcctgtggtgactagaaagtgctaaaagaatattctttagtattttctctcatactaaggggttaatatggaatgtgtttgaaattgcaaattgaataattgtccaggttttttttttataccttgctaaattagttcctcttttaatctagtgatagatacagtgatgccagtgatgacagcttttcagagccaaggatagctgagttggaaataagctgaaatgaatacatgactgggaataatggggactgcctgtgaggcctctgaaataattgaaggcaagatgaaggaactatctgaagaaatcactacactcttagagaatccctctgttctccagcaaacatgggatgtaaagcctcacagggaatctgataatacatacttctgtcaaccagaaccagaggggtagttttcttttccctccagaggcagcctttggtacttaaaatatctgtagctgattaaatttttcccaacaacctcactggggagaaagtgtgttcatgttttgtccagcggatcaggatgttaggatgacgagcaagagtccaggtcactgtgcctttgctgtgttgtatggaaaggatggcagggaacatgctgtaagtaattttgagtaagaaaatgagtcactgtgttacctggaactcagccacagatttgtgtgtggtccaagatcattgcagtttctcaccctgtttatttcctggtaaaagtaaaattgaataggtccaagacttgggggtggcaagtaaggctttgcctcaggcacaaaatttaagggggctccaaaaaactcaggaatcaagatcagcaatacagtctgagtatcccttatgtgaaatgcttggggctagaagtgttttgaatttcagattttggaatatttgcatatacatgcgatatcttggggatgagactcaagactaaacatgaaattcatttatgcttcatatacaccttatatacatagcctaaaggtaatttgatacaatattttaaataattttgtgcatgaaacaaagtttcgactgcattttgactgtgatttctggcatgagatcagttatggaattttccacttctagcgtcatgttggcattcagaaattttgaaattttggagcattttggattttcagattagggatgctcaacctgtatatatattttttaatcgacgtgaaattcacgtaacatagaattaaccattttgaagtgaacaatttggttgcattcactgatgttgagcaaccaccacctttaactatttccaaaacattttcatcactccaaaataaatgcctgtacacactagcagtcactccctatcttcccctccacctgtccgctggcaaccactgatctcctttttatttctgtggctttttctattctggatatttcatataagtggaattacacaatatatgtggtcttttgtgtctggcttcttctgagacagtaggaagggggcttggctttggctcacccccactagagcattttttcatgcattcccactgatcacaaaacccatactactacctcattgacaccatacctgctaacctcgaggctttagtcatacaaagaaaatggcctttctgtattgttcttctgtgctctcataatgcttaaccatgtcttttacttaaacaattccaggaactggccttaggagatccaaatagggaaccaagattgcagagtgtcccatcttgggagggaatgctgaataattaattgatttacagccttgttgccgctggccagaccaccaggtggcccattactcgagatgatcatcacaaccagatgatgctaacctatatcctctacccttcgcgtgctttgtctgggaagtcttttggccccatgtcagtttctattgcattgagagcccaagagcccctggtcagtcaggcttccatttagcatggcgtttgcaaggtttacccatgttgtagcatgtgtcagaatttcattcctttctatggctgaataaaattccattgtatgaatatacca

SEQ ID NO: 102933 - DNA, 2863 bp, Homo sapiens
ggaacttagcaaggcctgtttattcagattcttccctgggatcctgtgtcttcagagataaggatactcgtttcctctgggtatgggggttgggggtacctctcacctgagggccttttgacctgcttggagaaggtcagaaaatccttccggggtgttatgacctgcttcagtgggggaaggtcagaggaaggtcagagagaacttcttgcacatgctgtctcaaattccttccgcttcatgcaatgtatatgtgggggctgttatggttagagtcataatagtctaggtcaggggttgacagactttttctgtaaggttagagagtaaatatgttaggcttatgagccatacgcaatatgccaagatgccatattttggggtagtgtgtcctgaactccctcattgccaaaggaaacagttgtcatcagaagaatgaagaatgaaaaaaacaaactgaagatccaggtaatatcgtatgctatgttattacattgaagaacaaattgacatcagtaggagtaggactaagtgatgctcaacctcagatggactgaggtttagtccctagtatgacaagagtagattcacagaaaataaatgggtccatcaactcaggctttcattttaaatcagtttgttaatataacacctctagtagaaagcaagcaatagttaaggtggcaggaaggcaatctactttcaaggcttttattaaagtttagaaatgatcagtggtcttcagaagattataaatttcagtctaaactgaaatgcgtttttaattttctgaataagtaacttccagtttacgatgaaaataagtgatcagtttctctgaccaaagaaagaggccattgcatgtgattggactgacctcttcctgtggtgactagaaagtgcttttgaaattgcaaattgaataattgtccaggttttttttttataccttgctaaattagttcctcttttaatctagtgatagatacagtgatgccagtgatgacagcttttcagagccaaggatagctgagttggaaataagctgaaatgaatacatgactgggaataatggggactgcctgtgaggcctctgaaataattgaaggcaagatgaaggaactatctgaagaaatcactacactcttagagaatccctctgttctccagcaaacatgggatgtaaagcctcacagggaatctgataatacatacttctgtcaaccagaaccagaggggtagttttcttttccctccagaggcagcctttggtacttaaaatatctgtagctgattaaatttttcccaacaacctcactggggagaaagtgtgttcatgttttgtccagcggatcaggatgttaggatgacgagcaagagtccaggtcactgtgcctttgctgtgttgtatggaaaggatggcagggaacatgctgtaagtaattttgagtaagaaaatgagtcactgtgttacctggaactcagccacagatttgtgtgtggtccaagatcattgcagtttctcaccctgtttatttcctggtaaaagtaaaattgaataggtccaagacttgggggtggcaagtaaggctttgcctcaggcacaaaatttaagggggctccaaaaaactcaggaatcaagatcagcaatacagtctgagtatcccttatgtgaaatgcttggggctagaagtgttttgaatttcagattttggaatatttgcatatacatgcgatatcttggggatgagactcaagactaaacatgaaattcatttatgcttcatatacaccttatatacatagcctaaaggtaatttgatacaatattttaaataattttgtgcatgaaacaaagtttcgactgcattttgactgtgatttctggcatgagatcagttatggaattttccacttctagcgtcatgttggcattcagaaattttgaaattttggagcattttggattttcagattagggatgctcaacctgtatatatattttttaatcgacgtgaaattcacgtaacatagaattaaccattttgaagtgaacaatttggttgcattcactgatgttgagcaaccaccacctttaactatttccaaaacattttcatcactccaaaataaatgcctgtacacactagcagtcactccctatcttcccctccacctgtccgctggcaaccactgatctcctttttatttctgtggctttttctattctggatatttcatataagtggaattacacaatatatgtggtcttttgtgtctggcttcttctgagacagtaggaagggggcttggctttggctcacccccactagagcattttttcatgcattcccactgatcacaaaacccatactactacctcattgacaccatacctgctaacctcgaggctttagtcatacaaagaaaatggcctttctgtattgttcttctgtgctctcataatgcttaaccatgtcttttacttaaacaattccaggaactggccttaggagatccaaatagggaaccaagattgcagagtgtcccatcttgggagggaatgctgaataattaattgatttacagccttgttgccgctggccagaccaccaggtggcccattactcgagatgatcatcacaaccagatgatgctaacctatatcctctacccttcgcgtgctttgtctgggaagtcttttggccccatgtcagtttctattgcattgagagcccaagagcccctggtcagtcaggcttccatttagcatggcgtttgcaaggtttacccatgttgtagcatgtgtcagaatttcattcctttctatggctgaataaaattccattgtatgaatatacca

SEQ ID NO: 102934 - DNA, 3891 bp, Homo sapiens
aaaaggcaggcattctctttccttttccttctctcctgagcgctcctgcagttcctggggcgtagtaggggatccacaagcgtttgtgaccagtgaagttctttacaagggtgagatctgcacgggaggacccgagcgagggtctcggcttgccaggaagccggggttccccgggaagcgtggagttcacccgcgcactcgaagtgcctttgcaaaattatatctgggtgttggcacccagccactattctgccaatgaagtacatcctggtcacgggtggggtcatctcaggcattggtaaagggatcattgccagcagcattggaacgattctaaaatcatgtggactccgagttactgccataaaaatcgacccctatattaacatcgatgctggcactttttcaccttatgaacacggtgaagtcttcgtcttaaatgatggtggagaagttgatttagaccttggaaattatgaaagatttttggatattaatctttataaagacaacaatatcaccacggggaagatatatcagcatgtgatcaataaagagaggcgtggtgattacctggggaaaacagtgcaagttgtccctcacattactgatgctgtccaggagtgggttatgaatcaagccaaggtgccggtggatggtaataaggaagagccccaaatatgcgttattgagctgggaggcaccattggagacatcgaaggaatgccgtttgtggaggcgtttagacaattccagtttaaggcgaaaagagagaatttctgtaatatccacgttagccttgtcccacagctcagtgctaccggagaacaaaaaaccaaacccacccaaaacagcgtccgcgcactgaggggtttaggcctgtctccagatctgattgtctgccgaagttcaacgcccattgagatggccgtgaaggagaagatttctatgttttgtcacgtgaaccctgaacaggtcatatgtatccatgatgtttcttccacataccgagttcctgtgcttttagaggaacaaagcattgtgaaatattttaaggagagattgcacctgcccatcggtgattctgcaagtaatttgctttttaagtggagaaatatggctgacaggtatgaaaggttacagaaaatatgctccatagccctggttggcaaatacaccaagctcagagactgctacgcctctgtgttcaaagccctggaacactcagccctggccatcaaccacaagttgaatctgatgtacatagactccattgatctggagaagatcactgaaaccgaggaccctgtgaaatttcatgaagcttggcagaagctatgcaaagctgatggtattcttgtgcctggaggctttggaatcagaggaacattgggaaaactccaggcgatttcttgggcaaggacaaagaagattccttttctgggagtttgtcttgggatgcaactagcagtgatagagtttgcaagaaactgccttaacttgaaagatgctgattccacagagtttaggccaaatgccccagttcctctggtgattgatatgcccgagcacaaccctggcaatttgggaggaacaatgagactgggaataagaagaactgttttcaaaactgaaaattcaatattaaggaaactttatggtgatgttccttttatagaagaaagacacagacatcggttcgaggtaaaccctaacctgatcaaacaatttgagcagaatgacttaagttttgtaggtcaggatgttgatggagacaggatggaaatcattgaactggcaaatcatccttattttgttggtgtccagttccatcctgagttttcttctaggccgatgaagccttcccctccgtatctggggctgttacttgcagcaactgggaacctgaatgcctacttgcaacagggttgcaaactgtcttccagtgatagatacagtgatgccagtgatgacagcttttcagagccaaggatagctgagttggaaataagctgaaatgaatacatgactgggaataatggggactgcctgtgaggcctctgaaataattgaaggcaagatgaaggaactatctgaagaaatcactacactcttagagaatccctctgttctccagcaaacatgggatgtaaagcctcacagggaatctgataatacatacttctgtcaaccagaaccagaggggtagttttcttttccctccagaggcagcctttggtacttaaaatatctgtagctgattaaatttttcccaacaacctcactggggagaaagtgtgttcatgttttgtccagcggatcaggatgttaggatgacgagcaagagtccaggtcactgtgcctttgctgtgttgtatggaaaggatggcagggaacatgctgtaagtaattttgagtaagaaaatgagtcactgtgttacctggaactcagccacagatttgtgtgtggtccaagatcattgcagtttctcaccctgtttatttcctggtaaaagtaaaattgaataggtccaagacttgggggtggcaagtaaggctttgcctcaggcacaaaatttaagggggctccaaaaaactcaggaatcaagatcagcaatacagtctgagtatcccttatgtgaaatgcttggggctagaagtgttttgaatttcagattttggaatatttgcatatacatgcgatatcttggggatgagactcaagactaaacatgaaattcatttatgcttcatatacaccttatatacatagcctaaaggtaatttgatacaatattttaaataattttgtgcatgaaacaaagtttcgactgcattttgactgtgatttctggcatgagatcagttatggaattttccacttctagcgtcatgttggcattcagaaattttgaaattttggagcattttggattttcagattagggatgctcaacctgtatatatattttttaatcgacgtgaaattcacgtaacatagaattaaccattttgaagtgaacaatttggttgcattcactgatgttgagcaaccaccacctttaactatttccaaaacattttcatcactccaaaataaatgcctgtacacactagcagtcactccctatcttcccctccacctgtccgctggcaaccactgatctcctttttatttctgtggctttttctattctggatatttcatataagtggaattacacaatatatgtggtcttttgtgtctggcttcttctgagacagtaggaagggggcttggctttggctcacccccactagagcattttttcatgcattcccactgatcacaaaacccatactactacctcattgacaccatacctgctaacctcgaggctttagtcatacaaagaaaatggcctttctgtattgttcttctgtgctctcataatgcttaaccatgtcttttacttaaacaattccaggaactggccttaggagatccaaatagggaaccaagattgcagagtgtcccatcttgggagggaatgctgaataattaattgatttacagccttgttgccgctggccagaccaccaggtggcccattactcgagatgatcatcacaaccagatgatgctaacctatatcctctacccttcgcgtgctttgtctgggaagtcttttggccccatgtcagtttctattgcattgagagcccaagagcccctggtcagtcaggcttccatttagcatggcgtttgcaaggtttacccatgttgtagcatgtgtcagaatttcattcctttctatggctgaataaaattccattgtatgaatataccacaatttgtttcaccttttggttattgtgactaatactatgaacaatcacatgcaaatgttt

SEQ ID NO: 102935 - DNA, 3433 bp, Homo sapiens
aaaaggcaggcattctctttccttttccttctctcctgagcgctcctgcagttcctggggcgtagtaggggatccacaagcgtttgtgaccagtgaagttctttacaagggtgagatctgcacgggaggacccgagcgagggtctcggcttgccaggaagccggggttccccgggaagcgtggagttcacccgcgcactcgaagtgcctttgcaaaattatatctgggtgttggcacccagccactattctgccaatgaagtacatcctggtcacgggtggggtcatctcaggcattggtaaagggatcattgccagcagcattggaacgattctaaaatcatgtggactccgagttactgccataaaaatcgacccctatattaacatcgatgctggcactttttcaccttatgaacacggtgaagtcttcgtcttaaatgatggtggagaagttgatttagaccttggaaattatgaaagatttttggatattaatctttataaagacaacaatatcaccacggggaagatatatcagcatgtgatcaataaagagaggcgtggtgattacctggggaaaacagtgcaagttgtccctcacattactgatgctgtccaggagtgggttatgaatcaagccaaggtgccggtggatggtaataaggaagagccccaaatatgcgttattgagctgggaggcaccattggagacatcgaaggaatgccgtttgtggaggcgtttagacaattccagtttaaggcgaaaagagagaatttctgtaatatccacgttagccttgtcccacagctcagtgctaccggagaacaaaaaaccaaacccacccaaaacagcgtccgcgcactgaggggtttaggcctgtctccagatctgattgtctgccgaagttcaacgcccattgagatggccgtgaaggagaagatttctatgttttgtcacgtgaaccctgaacaggtcatatgtatccatgatgtttcttccacataccgagttcctgtgcttttagaggaacaaagcattgtgaaatattttaaggagagattgcacctgcccatcggtgattctgcaagtaatttgctttttaagtggagaaatatggctgacaggtatgaaaggttacagaaaatatgctccatagccctggttggcaaatacaccaagctcagagactgctacgcctctgtgttcaaagccctggaacactcagccctggccatcaaccacaagttgaatctgatgtacatagactccattgatctggagaagatcactgaaaccgaggaccctgtgaaatttcatgaagcttggcagaagctatgcaaagctgatggtattcttgtgcctggaggctttggaatcagaggaacattgggaaaactccaggcgatttcttgggcaaggacaaagaagattccttttctgggagtttgtcttgggatgcaactagcagtgatagagtttgcaagaaactgccttaacttgaaagatgctgattccacagagtttaggccaaatgccccagttcctctggtgattgatatgcccgagcacaaccctggcaatttgggaggaacaatgagactgggaataagaagaactgttttcaaaactgaaaattcaatattaaggaaactttatggtgatgttccttttatagaagaaagacacagacatcggttcgaggtaaaccctaacctgatcaaacaatttgagcagaatgacttaagttttgtaggtcaggatgttgatggagacaggatggaaatcattgaactggcaaatcatccttattttgttggtgtccagttccatcctgagttttcttctaggccgatgaagccttcccctccgtatctggggctgttacttgcagcaactgggaacctgaatgcctacttgcaacagggttgcaaactgtcttccagtgatagatacagtgatgccagtgatgacagcttttcagagccaaggatagctgagttggaaataagctgaaatgaatacatgactgggaataatggggactgcctgtgaggcctctgaaataattgaaggcaagatgaaggaactatctgaagaaatcactacactcttagagaatccctctgttctccagcaaacatgggatgtaaagcctcacagggaatctgataatacatacttctgtcaaccagaaccagaggggtagttttcttttccctccagaggcagcctttggtacttaaaatatctgtagctgattaaatttttcccaacaacctcactggggagaaagtgtgttcatgttttgtccagcggatcaggatgttaggatgacgagcaagagtccaggtcactgtgcctttgctgtgttgtatggaaaggatggcagggaacatgctgtaagtaattttgagtaagaaaatgagtcactgtgttacctggaactcagccacagatttgtgtgtggtccaagatcattgcagtttctcaccctgtttatttcctggtaaaagtaaaattgaataggtccaagacttgggggtggcaagtaaggctttgcctcaggcacaaaatttaagggggctccaaaaaactcaggaatcaagatcagcaatacagtctgagtatcccttatgtgaaatgcttggggctagaagtgttttgaatttcagattttggaatatttgcatatacatgcgatatcttggggatgagactcaagactaaacatgaaattcatttatgcttcatatacaccttatatacatagcctaaaggtaatttgatacaatattttaaataattttgtgcatgaaacaaagtttcgactgcattttgactgtgatttctggcatgagatcagttatggaattttccacttctagcgtcatgttggcattcagaaattttgaaattttggagcattttggattttcagattagggatgctcaacctgtatatatattttttaatcgacgtgaaattcacgtaacatagaattaaccattttgaagtgaacaatttggttgcattcactgatgttgagcaaccaccacctttaactatttccaaaacattttcatcactccaaaataaatgcctgtacacactagcagtcactccctatcttcccctccacctgtccgctggcaaccactgatctcctttttatttctgtggctttttctattctggatatttcatataagtggaattacacaatatatgtggtcttttgtgtctggcttcttctgagacagtaggaagggggcttggctttggctcacccccactagagcattttttcatgcattcccactgatcacaaaacccatactactacctcattgacaccataccagattctctcggacgcattctaagcagtgtgtagagggaaatttatagtcactaaatgcccactgagag

SEQ ID NO: 102936 - DNA, 2265 bp, Homo sapiens
aaaaggcaggcattctctttccttttccttctctcctgagcgctcctgcagttcctggggcgtagtaggggatccacaagcgtttgtgaccagtgaagttctttacaagggtgagatctgcacgggaggacccgagcgagggtctcggcttgccaggaagccggggttccccgggaagcgtggagttcacccgcgcactcgaagtgcctttgcaaaattatatctgggtgttggcacccagccactattctgccaatgaagtacatcctggtcacgggtggggtcatctcaggcattggtaaagggatcattgccagcagcattggaacgattctaaaatcatgtggactccgagttactgccataaaaatcgacccctatattaacatcgatgctggcactttttcaccttatgaacacggtgaagtcttcgtcttaaatgatggtggagaagttgatttagaccttggaaattatgaaagatttttggatattaatctttataaagacaacaatatcaccacggggaagatatatcagcatgtgatcaataaagagaggcgtggtgattacctggggaaaacagtgcaagttgtccctcacattactgatgctgtccaggagtgggttatgaatcaagccaaggtgccggtggatggtaataaggaagagccccaaatatgcgttattgagctgggaggcaccattggagacatcgaaggaatgccgtttgtggaggcgtttagacaattccagtttaaggcgaaaagagagaatttctgtaatatccacgttagccttgtcccacagctcagtgctaccggagaacaaaaaaccaaacccacccaaaacagcgtccgcgcactgaggggtttaggcctgtctccagatctgattgtctgccgaagttcaacgcccattgagatggccgtgaaggagaagatttctatgttttgtcacgtgaaccctgaacaggtcatatgtatccatgatgtttcttccacataccgagttcctgtgcttttagaggaacaaagcattgtgaaatattttaaggagagattgcacctgcccatcggtgattctgcaagtaatttgctttttaagtggagaaatatggctgacaggtatgaaaggttacagaaaatatgctccatagccctggttggcaaatacaccaagctcagagactgctacgcctctgtgttcaaagccctggaacactcagccctggccatcaaccacaagttgaatctgatgtacatagactccattgatctggagaagatcactgaaaccgaggaccctgtgaaatttcatgaagcttggcagaagctatgcaaagctgatggtattcttgtgcctggaggctttggaatcagaggaacattgggaaaactccaggcgatttcttgggcaaggacaaagaagattccttttctgggagtttgtcttgggatgcaactagcagtgatagagtttgcaagaaactgccttaacttgaaagatgctgattccacagagtttaggccaaatgccccagttcctctggtgattgatatgcccgagcacaaccctggcaatttgggaggaacaatgagactgggaataagaagaactgttttcaaaactgaaaattcaatattaaggaaactttatggtgatgttccttttatagaagaaagacacagacatcggttcgaggtaaaccctaacctgatcaaacaatttgagcagaatgacttaagttttgtaggtcaggatgttgatggagacaggatggaaatcattgaactggcaaatcatccttattttgttggtgtccagttccatcctgagttttcttctaggccgatgaagccttcccctccgtatctggggctgttacttgcagcaactgggaacctgaatgcctacttgcaacagggttgcaaactgtcttccaggtctctgagcccaagcctgcacgtatacatccagatggcctgaagtaactgaagaaatcacaaaagaagtgaaaatggccgattcctgccttaactgatgacattaccttgtgaaattccttctcctggctcagaagctcccccactgagcaccttgtgacccctgcccctgcccgccagagagcaaccccctttgactgtaattttccactacctacccaaatcctataaaacggccccacccctatctcccttcgctgactcctttcggactcagcccgtctgcacccaggtgattaaaaagctttattgttcacac

SEQ ID NO: 102937 - DNA, 2216 bp, Homo sapiens
aaaaggcaggcattctctttccttttccttctctcctgagcgctcctgcagttcctggggcgtagtaggggatccacaagcgtttgtgaccagtgaagttctttacaagggtgagatctgcacgggaggacccgagcgagggtctcggcttgccaggaagccggggttccccgggaagcgtggagttcacccgcgcactcgaagtgcctttgcaaaattatatctgggtgttggcacccagccactattctgccaatgaagtacatcctggtcacgggtggggtcatctcaggcattggtaaagggatcattgccagcagcattggaacgattctaaaatcatgtggactccgagttactgccataaaaatcgacccctatattaacatcgatgctggcactttttcaccttatgaacacggtgaagtcttcgtcttaaatgatggtggagaagttgatttagaccttggaaattatgaaagatttttggatattaatctttataaagacaacaatatcaccacggggaagatatatcagcatgtgatcaataaagagaggcgtggtgattacctggggaaaacagtgcaagttgtccctcacattactgatgctgtccaggagtgggttatgaatcaagccaaggtgccggtggatggtaataaggaagagccccaaatatgcgttattgagctgggaggcaccattggagacatcgaaggaatgccgtttgtggaggcgtttagacaattccagtttaaggcgaaaagagagaatttctgtaatatccacgttagccttgtcccacagctcagtgctaccggagaacaaaaaaccaaacccacccaaaacagcgtccgcgcactgaggggtttaggcctgtctccagatctgattgtctgccgaagttcaacgcccattgagatggccgtgaaggagaagatttctatgttttgtcacgtgaaccctgaacaggtcatatgtatccatgatgtttcttccacataccgagttcctgtgcttttagaggaacaaagcattgtgaaatattttaaggagagattgcacctgcccatcggtgattctgcaagtaatttgctttttaagtggagaaatatggctgacaggtatgaaaggttacagaaaatatgctccatagccctggttggcaaatacaccaagctcagagactgctacgcctctgtgttcaaagccctggaacactcagccctggccatcaaccacaagttgaatctgatgtacatagactccattgatctggagaagatcactgaaaccgaggaccctgtgaaatttcatgaagcttggcagaagctatgcaaagctgatggtattcttgtgcctggaggctttggaatcagaggaacattgggaaaactccaggcgatttcttgggcaaggacaaagaagattccttttctgggagtttgtcttgggatgcaactagcagtgatagagtttgcaagaaactgccttaacttgaaagatgctgattccacagagtttaggccaaatgccccagttcctctggtgattgatatgcccgagcacaaccctggcaatttgggaggaacaatgagactgggaataagaagaactgttttcaaaactgaaaattcaatattaataagcttgtcccttgggctggcctcagtagaacacactgaatgcccctccgcatttgatctgcgtgactccctgttcattgggctgttttgtgagttaccgatgctcctggagatgaacttggactgggacttggactgattcacactcagttcttttgaatccacagttctctccattacatttgaaccggttccctgtttaatgtctgtttgcctggtcttagtgactcacaaatgaacttccgagtaggagggcagttatgcacctcagaagcgtatttctctgttccctggcagccccagtgtggggagatggctcgccatttgatatttgctgatctttccactccccataaggttaattctaatttctgtggaactttttcataaattagcatattatataagaataacttattgtttaaaacaaactaaagcctttaattcaatttaataaatgtatcttgagtgcccactctgtgccatgtgcagatataatagtgaccaggacagataccagccctgccctcctagggcctcaaaacaaggggaagaaatgtgacaaaa

SEQ ID NO: 102938 - DNA, 1406 bp, Homo sapiens
aaaaggcaggcattctctttccttttccttctctcctgagcgctcctgcagttcctggggcgtagtaggggatccacaagcgtttgtgaccagtgaagttctttacaagggtgagatctgcacgggaggacccgagcgagggtctcggcttgccaggaagccggggttccccgggaagcgtggagttcacccgcgcactcgaagtgcctttgcaaaattatatctgggtgttggcacccagccactattctgccaatgaagtacatcctggtcacgggtggggtcatctcaggcattggtaaagggatcattgccagcagcattggaacgattctaaaatcatgtggactccgagttactgccataaaaatcgacccctatattaacatcgatgctggcactttttcaccttatgaacacggtgaagtcttcgtcttaaatgatggtggagaagttgatttagaccttggaaattatgaaagatttttggatattaatctttataaagacaacaatatcaccacggggaagatatatcagcatgtgatcaataaagagaggcgtggtgattacctggggaaaacagtgcaagttgtccctcacattactgatgctgtccaggagtgggttatgaatcaagccaaggtgccggtggatggtaataaggaagagccccaaatatgcgttattgagctgggaggcaccattggagacatcgaaggaatgccgtttgtggaggcgtttagacaattccagtttaaggcgaaaagagagaatttctgtaatatccacgttagccttgtcccacagctcagtgctaccggagaacaaaaaaccaaacccacccaaaacagcgtccgcgcactgaggggtttaggcctgtctccagatctgattgtctgccgaagttcaacgcccattgagatggccgtgaaggagaagatttctatgttttgtcacgtgaaccctgaacaggtcatatgtatccatgatgtaacttccacataccgaagtacctgagcataaagaaggaacacaagccatagcgacaaaaccaacggagagatagaccccgacccatcggagatcctgcacagaaagcgccacacaagaggagaaaataggctgacacggtaagaaagggtacagaaaaaaaagacaaaagccgaggcaaggaaaagacacgcagccaaaaacaacgaggaaagacacacgggaagacaaaggccggcgaagacctcaagcccaggcacgaccaagacaagaaatgaaaacggaagggaagaagaaatccacggagccgagagaagacaggagacgagcgaactgagaacaatatgcgaaagaggaagagcacaaaaacagacggagaaataagtaaaggagggaagaaagagagcgcggga

SEQ ID NO: 102939 - DNA, 891 bp, Homo sapiens
gtaagatggaatcttcgaggattgttcatttctctcatggacaagctgtcatcttggtatagaggcgggtattataggacttgcctcacaggatcttgcccctttgagatactcccatttgactggcacagttagcaggacacgcatgacagcccatgacagagttagtgtttggggaaaatggaatgcaccttgggccaggaaaaaaaaaatataagtacacctataaatgtatatgtgggggctgttgtggttagagtcatcatagtctaggccaggggttgacagactttctgtaaggtcagagagtaaatatcttaggcttatgagccatgcagttcctgcggcaactactcaattctgctgttgtagcaggaaagcaaccatagacaatatgtaagtgaacaagcatggctgtgttccaataaaattttatttacaaaaacagtttgctgatccctggtctaggccactcatagaagagcagatttccttggatttgtataaaataaaattaaaataaaataaaacataaaataaaataaaataaaatagtatttgatttctttgtagggagatgcaagagacaggcttagtgtccaagggcagcttatttttccattgctctattatgcactattagagagaataccagcctggatagcttcagtaaatttatgctcagtggcagatagtgcctggattgccctaggcattatggcaggccttgacttgtataagctgttctttagcagagacagcagcttttggaagacttgtaaagtgttcattgctttcctgtgaggtctcttcatgtttatcagggaagatgcaaagctgtgtctatttagttttgcctcaaacatggagaccctttggagcaagccaaaa

SEQ ID NO: 102940 - DNA, 1925 bp, Homo sapiens
aaaaggcaggcattctctttccttttccttctctcctgagcgctcctgcagttcctggggcgtagtaggggatccacaagcgtttgtgaccagtgaagttctttacaagggtgagatctgcacgggaggacccgagcgagggtctcggcttgccaggaagccggggttccccgggaagcgtggagttcacccgcgcactcgaagtgcctttgcaaaattatatctgggtgttggcacccagccactattctgccaatgaagtacatcctggtcacgggtggggtcatctcaggcattggtaaagggatcattgccagcagcattggaacgattctaaaatcatgtggactccgagttactgccataaaaatcgacccctatattaacatcgatgctggcactttttcaccttatgaacacggtgaagtcttcgtcttaaatgatggtggagaagttgatttagaccttggaaattatgaaagatttttggatattaatctttataaagacaacaatatcaccacggggaagatatatcagcatgtgatcaataaagagaggcgtggtgattacctggggaaaacagtgcaagttgtccctcacattactgatgctgtccaggagtgggttatgaatcaagccaaggtgccggtggatggtaataaggaagagccccaaatatgcgttattgagctgggaggcaccattggagacatcgaaggaatgccgtttgtggaggcgtttagacaattccagtttaaggcgaaaagagagaatttctgtaatatccacgttagccttgtcccacagctcagtgctaccggagaacaaaaaaccaaacccacccaaaacagcgtccgcgcactgaggggtttaggcctgtctccagatctgattgtctgccgaagttcaacgcccattgagatggccgtgaaggagaagatttctatgttttgtcacgtgaaccctgaacaggtcatatgtatccatgatgtttcttccacataccgagttcctgtgcttttagaggaacaaagcattgtgaaatattttaaggagagattgcacctgcccatcggtgattctgcaagtaatttgctttttaagtggagaaatatggctgacaggtatgaaaggttacagaaaatatgctccatagccctggttggcaaatacaccaagctcagagactgctacgcctctgtgttcaaagccctggaacactcagccctggccatcaaccacaagttgaatctgatggtgattgatatgcccgagcacaaccctggcaatttgggaggaacaatgagactgggaataagaagaactgttttcaaaactgaaaattcaatattaataagcttgtcccttgggctggcctcagtagaacacactgaatgcccctccgcatttgatctgcgtgactccctgttcattgggctgttttgtgagttaccgatgctcctggagatgaacttggactgggacttggactgattcacactcagttcttttgaatccacagttctctccattacatttgaaccggttccctgtttaatgtctgtttgcctggtcttagtgactcacaaatgaacttccgagtaggagggcagttatgcacctcagaagcgtatttctctgttccctggcagccccagtgtggggagatggctcgccatttgatatttgctgatctttccactccccataaggttaattctaatttctgtggaactttttcataaattagcatattatataagaataacttattgtttaaaacaaactaaagcctttaattcaatttaataaatgtatcttgagtgcccactctgtgccatgtgcagatataatagtgaccaggacagataccagccctgccctcctagggcctcaaaacaaggggaagaaatgtgacaaaa

SEQ ID NO: 102941 - DNA, 421 bp, Homo sapiens
atatgctgtttttcttcctttgaatatgggatttctggatcatatggtagtcctatttttagttttttgaggaacctccacactgttttctatagtggctgtaataacttatatccataccaactgtatgcaagaaaagaacttggtatcttgactcaggcatttcttattgtaatcctagtttcctatgcctgatttatttgaaagcttcagctttcacttatgtacataaagttatgatttataacaactggatgtttatgttgaattcctttgtaaatatcatgaataccactgaatgattatatttttattaaaacttcaagataaaataaaattttaaaaattactgtttattatttcattatttcaaagctcttatttaaaaactgcagaatctataagtgctatcataaatgtc

SEQ ID NO: 102942 - DNA, 354 bp, Homo sapiens
gttgttaaagacaatagagtcttcatgatctaagtgttagcacaacttcttgtttaaaatattttggacgtctatatgttgttaaatgctctgatacgtattctaaaaaggactggttctatgtgattattataatacttaagataaatggaaatccctagattgtcagttttaaaattagtttcaagtagtggaacaatgaaaaggtaaaattttaatatgctgtatatttttagtaatattcataattgtatattatacaatataaaatatttttaaatataacatttgcatgcattagtcttaatagaaatctgacaaacctttcaaagaagatgatataggaagctttct

SEQ ID NO: 102943 - DNA, 235 bp, Homo sapiens
acctttcttacccccaatagcatatggcaccttttacctggtagtactcagctaatatttggtaaatgaattgaacacagtaaagcatgtaatttccctatgttattacactatttccaaattgggaaaacagaacaggtggcagatttatcccctatagtattttttccttcaacttttattttaagttcagggatacatgtgcatgtttgtgacatgggtaaacatgtgccat

SEQ ID NO: 102944 - DNA, 449 bp, Homo sapiens
ctgtcctctctccctgttccctcctccccagtccctgctgttcctccctggcagctgagaaggtcagagttttctcagtggtggggccagttgacttttgccaaggaaaactcgcagcccctgagcccccttctttgttccaccctgagccttctccctctccacttcctcacagctctggactcagaaaagtggcagactgagcatggcctcagctcttcttctcattttataaaattgggagggttagactcccccacccaggggaaaacagctgacctggatcccaagagtaagataggaagcgtagtcctggcttccagcctctggcagagcagcagcccctgcctgcctgactttgacgcccactaggggcgagtttccagggggtgtcccacacagcagccagagcccctcagtgtcatgagattccctttgcctgatttatc

SEQ ID NO: 102945 - DNA, 126 bp, Homo sapiens
ctgtgttagagaagccctgtctttgaggttcagctcatagacctggcatcaggaagagaagaccagctctaactctgcctcttccaggctttgaaccctgtgtgcagttggcagatgaactacaag

SEQ ID NO: 102946 - DNA, 525 bp, Homo sapiens
tatggagggggacatccagtggagccttctagtccaccatcttgctctgtacccccaaatctaaaataaatacattttgacatgaagtgttaagccacagacatgtggaaaatgtatttatgttaaacatccattgcttaatgtcagataaattagatattcattctgacaatactatgttgatatcttgatttattctatttaccatgctgtttttacagaaaaaaaatcctaagtgccattttagaaacctagaaatatgcagggagatggcagaaaaatatttctagattcttctaagttatttctgtatctgaggagaaaaacacatggtttactctttaaagattttgacttggaaaacatatgcacattctcttttttcctataccactcttaattcttataacaagagggaagatctctagtaaaaggggattacataaaactagtggactgcctataaagatgagtcccagtttccaaacatttgactcttcactgccttcaccatccacagcttat

SEQ ID NO: 102947 - DNA, 720 bp, Homo sapiens
ctgatctaaataattctacttgtatgactattctcatacagttgtataaaattatatgtggaaaaatatcactggagttctgtttgtgctagcaaaatactagaaacaacctaaataaatgtccatcagtagattactgaataaatgcatcagagcatgttgatagaatgacattctttacatccattgaaaagtctgctaagagttgagatttttgaaaagggggagtaaagacctgcaaaaatattttcttccataaaagcaataagaatgctggtaataattctcaaaatcaacatttttagaactctaaaaattaaactcttgcaacaatcaaaggagtgtttgtgttaaaaaaaaaaagtatgaataccagtgtatataacaagctttgtatttgggggttcagtttaggtgaaggtatatttatcatatcatcttgattcattgacccatttatcattataaaatgcccttatttacatctaggaacaattttgtcaaaaattctgtttggtctgatgttagcacagccactttggccatgatattcaaaatacagctttttcatcctgtttgtgtctttgtttgtctcatagaaagcacgtggttggatcacagtttttaaaaatccattctgtttgtctctgccttttggttacagcagctaatcaatttaaactcaatataattactgataaaataggattcacatctatc

SEQ ID NO: 102948 - DNA, 647 bp, Homo sapiens
gacttgccttaattgtggattcttcttgattgtcaagtgtatgaaatgtgattgtatttaccaagtatttgctatgtgccagacatcgtggtgtataacaatgaaaaaatcatggtctctgccatggggctttagtataggagacatacattaatcggaaaatcacatcgatatatcattaaacggtgataagtactatgaaggaaatattcctatgaaggaactgtcatagtattatgagacatgcattaatcagaaaatcacatcagtatataattaaactgtaataagtgccatgaaggaaaagtatgaggtgttatgaaaatatataatggagactttgggagactgaggcaggcgaattgcatgaggccaggagttcgagaccagcctgggcaacatgttgaaaccccatctctactaaaattataaaaattagccaggtagccgggcatggtggttcacgcctgtaatcccagcactttgggaggccaaggtgggcggatcacgaggtcaggagatcgagaccatcctggctaataccgggaaaccccgtctatactaaaaatacaaaaaattagctgggtgtggtggcgggcatctgtagtcccagctacttgggaggctgaggcaggaaaatggcatga

SEQ ID NO: 102949 - DNA, 482 bp, Homo sapiens
aatcttattccttcctcccctctcgcagtgggaatgacataggagggagtccctgggtgtttcttcctaacctattaccatgcatctcatgtctgcagtctctccctggctttgtctttgaggagtgcataggaaatggcaggactgacattgagggttgggcatcgaatgcatgaggtcactagttcgggtcattgattgtcatcatccatgtatatatgaagagaacagtttttggatgttttccaaatgccgggaaggtgtgcaaattgcactaatttctcctctcattctacatttctctaataagttaataacattatttaggccctgttcaggccgtctgtcaccatgcagttgaagtatttgtgcgagttgcattctcagtaagtgcctgtttgctgtcttctatatttgtgtgggacaaagaaattatatttcttttttatagctatatcgagcttatgtggccttcccagact

SEQ ID NO: 102950 - DNA, 814 bp, Homo sapiens
gctttgtgttcatgtgattcaatgtttagctgccacttataggtgagaacatgtagtatttggttttctctttctgtttagctcatttaggatagtggcctccagctctatccacgttctgacaaagaaaaccttgttgggagtttgattagacggctgagaaagacagcaaatctacagggtttgtcaaagataagatcgttgtcatggcatgaaaaggatgacctttccagtctgcaatacctgcttgaccactaagaccaaacagctcaaattaaaggtaacaaattccgcagaggcaattgttcaacacaggaaaaagaaaccactttaaggattttaaactggaagagattttacataagctgttttaaacaaaaccattggatgacctggagtaacagtgtcggaaactcagctgagctggatagagaactgagctgcccgttgttggagaagttgattaaagcagcagccgaagatcgaagtaacagtcaagactgtaatcacttactgcaatagtataagcaagaggccaaaaccaaagaaactgccaactcacccaggtcttctaaattccccagaaaggtgcactagtggagggtcagtgaatcaggacagacatgggggtcagctcacgattgaggaagccccaaacaaaaatctccagtagtattatgaaccctggagcaggaggttggagtgagacaaggagagctagggttgaagagtatggagtcgaggagggaacggttcttaaggtctcctcccactctactcttaagaaagcttcagtagaagcacctgaagaaaa

SEQ ID NO: 102951 - DNA, 845 bp, Homo sapiens
tgtgcattcaatgtttagctgccacttataggtgagaacatgtagtatttggttttctctttcgtttagctcatttaggatagtggcctccagctctatccacgttctgacaaaggatatgatctgagaggttggcatttcttccttggtccttgagataaaaggattctcaaccagaaaactaaaggataagcaagaaaagagatctttgggcatctgtgacaagattctttacccatctttggaaacttataaagaaaatattagaacaaagaagaatgaggaaggcacaaaacagttccagaacttctaagcaaccaaaagtaactgaaaagtcaactgaaaatagtagtagctattttttctcatattgtaagaatccagttagctcagaccaaaggaaactccttttaaatttagagcccacagttgaaacctgtgaggtcaaccaactgaaagtaaatacatgattaaataagaatttccacagttggaattgtgtgcaaagatgaatttgacatagtacctttcaaaagggcctttaagacagaaaagcaacacaaactctccttacagggttgatgacagttagacagaaactgtatgaaactcagcacaatgagaaaagttcattaaaggaaaatcgagaaaatgattagtgttgactgtgagccttgaataatgggcagaattatatccagtggaaatagtagaaagagatagaagaggttttttaaaaaataaaggcacacagcttgaaacgccttgtacgcagaccagcctcttcctcagcaccccagggagcctcctgatacccctagccatgcttttggatctaatatccc

SEQ ID NO: 102952 - DNA, 834 bp, Homo sapiens
ggactaatccaatatggctgagatccttatcaaaaggagaaattcagtcacagggacagacaggtacagagagaagatgatgtcaagagacaacgggagaatgccacatgaaggtggaggattggagtaatgcatctacaagccaagaaaaccttgttgggagtttgattagacggctgagaaagacagcaaatctacagggtttgtcaaagataagatcgttgtcatggcatgaaaaggatgacctttccagtctgcaatacctgcttgaccactaagaccaaacagctcaaattaaaggtaacaaattccgcagaggcaattgttcaacacaggaaaaagaaaccactttaaggattttaaactggaagagattttacataagctgttttaaacaaaaccattggatgacctggagtaacagtgtcggaaactcagctgagctggatagagaactgagctgcccgttgttggagaagttgattaaagcagcagccgaagatcgaagtaacagtcaagactgtaatcacttactgcaatagtataagcaagaggccaaaaccaaagaaactgccaactcacccaggtcttctaaattccccagaaaggtgcactagtggagggtcagtgaatcaggacagacatgggggtcagctcacgattgaggaagccccaaacaaaaatctccagtagtattatgaaccctggagcaggaggttggagtgagacaaggagagctagggttgaagagtatggagtcgaggagggaacggttcttaaggtctcctcccactctactcttaagaaagcttcagtagaagcacctgaagaaaa

SEQ ID NO: 102953 - DNA, 499 bp, Homo sapiens
gctttgtgttcatgtgattcaatgtttagctgccacttataggtgagaacatgtagtatttggttttctctttctgtttagctcatttaggatagtggcctccagctctatccacgttctgacaaagaaaaccttgttgggagtttgattagacggctgagaaagacagcaaatctacagggtttgtcaaagataagatcgttgtcatggcatgaaaaggatgacctttccagtctgcaatacctgcttgaccactaagaccaaacagctcaaattaaagctttccttggccatggtgactgagtcaaggacagactcataatctaaggcaaagcaataagtcatcaggagactcaatacctgcgtgtctctcaaccattggaaaaagtgaatattctttgtatctggatgtgaatgagaaaatacacaaccccaggagctgctagaacccatcttgagtttgaagagtttgccttataataaaaccaatatcaaaaaa

SEQ ID NO: 102954 - DNA, 528 bp, Homo sapiens
ttagtagagatggggtttcaccatgttggccagactggtctcgaactcctgacctcaagtgatccgcccgcctcggcctcccaaagtgctgggattacagacgagggccaccaagcctgacctcacttattgttttttaaaaccaaaaacatctcaaagcaaacaagggaaagctccgcaaacagcctggcagcaggaaacccacgagagtttccccgtaataggcgcctccaggggggggaaaacaaattataagggtgatttatttttatcttattacaaacaggtattttccaaattttctatgaagcacaaggagatctttccttccagaatactagcaaacacaaaaaattttattttgtgagtgcttaaaaagagaaaaacctgaacaaacttgctctccacccacgcaggtgattctccacccacgcaggtgattcttcacccacgcaggtgattctgacttttgggcagtcgtcagaagatcagatagaaaacctgagtatcttggcgttagaatgagtt

SEQ ID NO: 102955 - DNA, 416 bp, Homo sapiens
tctttggttgctcactttctagaatctgataaacagcatcattgttgacacttctcaatggagaggttcccaaaattctatcaagcagagtcttgttttcaacatttcttctagtgggctgagctccctcctttttaagagatggagatcaaaatcagttaccttattatgacagagttctaactaggcttaaatggctgcagacatagttcaaataaaattacctcacctgccacccgttctaatttaacaggcagaaaaaaagttttattgaaacagaagcaatcatttttatttttatctggtggtttacagatatatgtgtgtgtgtgcatatatataatttaaatgtcagggcatgtttgtgcagatgtaatttaaattttatgtttatatatatgtaatttaaatgctgg

SEQ ID NO: 102956 - DNA, 372 bp, Homo sapiens
aatgagtatccctcagggctgctccttcctgtggggtgggccctgggcttgggaaggaccaagttctccataggccatgacctcctcaaaacctctctgccctctcttgccatagtccacctccttccgccgcaacttcagttcccctctcctggtgcatgagccgccaccagtctgtgccacaagcaaagagtccccacccactggtgagtgccccccctgggcgcagtccctgctcccattgtggtgggatgagaaatcaacatccctgaccagcctggccaacacagtgaaaccccgtctctcaattgcttgaacccaggaggcggaggttgcagtgagccaagatcacgccactgcactccagcctgg

SEQ ID NO: 102957 - DNA, 300 bp, Homo sapiens
caaattcccatacttgtgtgtaagccagagatcttcacacatgttaaagaagcttgaaaacaatgaagaaaaacccaggggagaccgttagagagagggaaagacagagatgagagtggtagggaaaaacagtgagggatcagagcagcaccctgagagcgcacctggacatcagccattacacgtgagggggaggaacttttctgagtttccctaaaaggcttaaagtaaggggttgttgggtggaccacacatgacatattaagtaagatacaaaagtaatgcacacaattaactgaa

SEQ ID NO: 102958 - DNA, 277 bp, Homo sapiens
atgttaactgtcaatttttgttttgttttgtttttaatctattccttctctctttctattcagattgctattttatgtgtcacttgagagaaaacagttaaataaaaactaatttaatacaaaatttagctgggcttggtggcacatgcctgtaatcccagctactcgggaggctgaggcaggagagttgcttgaacctgggaggcgtagattgcagtgagccaagatcatcccactgcactccagcctgggcgacagagtgagacacagtctcaaa

SEQ ID NO: 102959 - DNA, 791 bp, Homo sapiens
tcaccttttcctacccgcttttaacactgagaaaagtctgcagagtgacagtggcccatttttaccagcaaagacattgaacctggcgtgtacagctttggtggttggtacctgtcaccatctgctcttctgtcttgatgaccatatgtcttggactgcaccctgagatgtgggctgctcgtgctgccccagtactgaacacagctacttgagcatagtaggtgttttgaaaatatttaacctgaattgagaaaagatagtcagcagtggcccaaagataacaacatacatcaaaagtcatgtacaagattcagccagtcaccaagatgctcccaatattcaggggcttggtacctcactaatcaaaactgaaatgtcacccgattggtttttctctgaatgttttagagcagaatagactcagccatgggaagagacatttgagtggactctattcaggttgattggagtctcctccaggttaatcattccacttaagtcaatgagtgaaattttatacacctgagactctagcctatggcaattcctggaaatcaagtggtttttttgatggggagccgggggatggtcagtgggatgcaacttgctgatgatgagagatgaggtgtaagatattatcaggcaaacaccaacgaaacaggctttactataactcagatcaccgcgctttttgagtgtgtcagtgagtaatccataatcacatttatagatacttctttcacatttataataatgtccccaacataaacatgtaaacatgatcaacatat

SEQ ID NO: 102960 - DNA, 347 bp, Homo sapiens
gcaacaacatttttctcagtcctgttgattgggtgtgtgtgcttatgtgtggggcgttcatgagcaaaaacacgagtcatatgtggaggtgaatatacacctccgtgtacttcgggaagtatatattcttgcttgcattgttgatattttaataagctcttttgattttgtccaaatcaatttcccatgtaattataatatgaagtgagttttgtaaactctgctaccctaggccctcaaagtattaataattgactgaatatatcaaaatcagtcatgttgttgaagagattcattattttagttttctgacttctttaataatcatatcactgtattattacttg

SEQ ID NO: 102961 - DNA, 222 bp, Homo sapiens
aataaaggagagaaagaaggcattaataataacacaagctcccctcccctgctggcaggctgtaccccatgctttagagttttctgaggagaaacagaaagtaacaccaccactatttccttttgagaatcaaatggtgaaaggagtatttccatacaggtcaaaaagaaaaaaaaagaaatgagaagttttcttttattgtttttcatttctgtcactgtt

SEQ ID NO: 102962 - DNA, 750 bp, Homo sapiens
gtgacttgtttttatggaacactgaacattaagaaataatttgggtggttgacatatcctgaatggattagagaatatgcaaagctttttttctttgggtaatcatcaaatgacatttaggaatatatgaagagaatttggctatggcgtctgcctccttctatacagttatttgtgagatttacaaccatcacaatagtttgtattctttttggaaactgtcagagaagagatgtcttgacttctgttttgtcaatctgtttatatatattttaaacagaattcaagaaagactttagctttaggtaaaataaatcctaaccgatttcagttttttagttgattcagaatttctttgtaagttagtttttggttttctttttttttttcataatctggaaagttgtggatgaataataagaaaataataataataatagtctaatgcagcttcagcttaagttaaaaccaattgacagtcattcttccctttctcaagttttgtgggtatttaccatgtcactacagaattgtaacaaataaaatgtatcttgtacaacttactctgaacaagtaatactaaataggttagtttcattcttactagtagtttccttgtataaatttcagaattcatagaaaaatatctgtaatactaagctaagtagcctttagttgccagagaataccaaacatacttatttaaaataacttcctattttaatgcacttttacttagaaaaaaatttt

SEQ ID NO: 102963 - DNA, 853 bp, Homo sapiens
gtcaaattatttttacaggggaaaaatgtgataaacagacttggaggaaggaaggaaaaaataatgacagaacaaaaggaaaccagaaatccaaaatgagtcaagccaacagggtattgtgtctaaaagaaaattatctaaaatctgaactaccagaaatgggaagagaaaaatctgaattttcattatttgcctctttttcaccattaactgtgctgattctgtctaggattaccatccagcagaagaaactgtaaacaaatccaatctttccaatatgctaaataatgaacttcataacgtgcccacgatgatgggtcttgtcttcctggaaattgcaatctacttaatttttccaactaaggaacatcggctgtggttttgaaaggttactgagaaaagggttttaaaaggtgatacaaagcaagcaaaatcttggttctattcttcacagaaaatgaatcacatttaaaatgttttaaacttttaagtgatggaagccattttaaggctttgtccatccttcactttcatgaaagggccacggattccaccacgatggaccatgtctgttcttgggcagtgggtgggggttcatggttgtggtccacagcatctctacctggagaataagagcaaagctgtttccctgataatcacaccccacattcatccactggcaaatcgtgtcactgtcaaaatgctcctaattcgagttacttcccatctcttccatcatgagccctggtccaagtccaccctcgtctctcaactgaaatcttatgatagcttctgtaatttcccatttcctctcctgcccccttacgtcccactctctacacagcagctagag

SEQ ID NO: 102964 - DNA, 360 bp, Homo sapiens
  misc_feature (18)..(18): n is a, c, g, or t
  misc_feature (40)..(40): n is a, c, g, or t
ccatctgcagccgcacantggagggatcagatcatttagnacttgactgcttaaatattactcttgctaagatcttgagcttgtctcatgttgacagactagtgaagttggttacgttgtctgtctcctcactggagggagagattcagagttgccctgtccaacccagtgctatctctggaaagggttggattgaaatctagtctgccttcattctgaggtataatcatgagggttaggtgaaagggtcccgagtgagaagatggcatgggtcctagggtggggagcccgatgccaagtcagacttcactcggtatgtttattcaaagccccactttcactcgtagcatatcataggtg

SEQ ID NO: 102965 - DNA, 475 bp, Homo sapiens
ttctacatcttgaacacaaaaatattgtcattccatagtaacatacacatctaaagtaatctaacttatctaccagtctaacattgtaataattttttaaatgttgacttaacatgccttgctggcaaagaatttatacttgctctccacacgttggcagtcatgattgcacagctgcatgatttttgagtcttgaagcagtccaattatcaagtattccctaacttatataaagccctttaccatatcttagaatctcttctttgtttgagtctataatttcccttgatcatgtactctgtttctagtttgaaaatcatccttggccgcgcatggtggctcacacctgtaatcctagcattttggaaggccgaggcggatgaatcacgaggtcaggatatcgagaccatcctggctaacacagtgaaaccctgtctccactaacaaaaaattagctgggcatggtggcgggcgc

SEQ ID NO: 102966 - DNA, 155 bp, Homo sapiens
aggcttaatccctccatcttctagactctgatgagttgccagctgtaattcagagggaccatcaccaacatcttacagacagagtccttgttctcactgcctgacaaaaagagcaggcaaaatccataagaagcatgtggaacctcaaattgcaa

SEQ ID NO: 102967 - DNA, 427 bp, Homo sapiens
atttggaaaatccaaagttaaaggataaaattactactaattgtaatctcagcacacagaaagaatcatgtgtgtgtgtgtattatatgcatgtgcgtgtgtatagagggcattctatttgtattgtatttctttattatttagggttgttgatactgtaaaataaatgattttttttgagaatgaagatgggtgaaccttgtttttctcatatttaactaaatctaaatgacaggatatttggtaaaaggagatataaagctacaagggcccttgcggcacctgccatgaggtctgtctaggtgaagagctggggaaccaaagatgagcagctgaattttctgttcttgatgttctgcgggagtaatgatgcaccagatgataatgatagaagatattttgataatttacttctttgatattggct

SEQ ID NO: 102968 - DNA, 278 bp, Homo sapiens
ttagcctcctgagtagctgggattacaggcgcccaccaccataccaggctaatttttctattttcagtagagacggggtttcaccattttaggtaggctggtctcgaactcctgacctcaagtgatctgcctgccttggcctcccaaagtgctgggattacaggtgtgagctaccacgcccagccgtgtgtgtgtttttttggtgaggaataaaagatttaatattcatctagaagactcaggacagtacttggcaagatgatgacaatgatgatggc

SEQ ID NO: 102969 - DNA, 329 bp, Homo sapiens
tcgggggaattgtagatagacatgcagttgtatgaaacaacgcagagatcctgtgaaccttttacctagttccctgtggtaacgtcttgtgaaactataacacagtatcacagccaggaccctgaaattgatacaatccagtgatctgattcagatgtgctctagtttgacttgtactcttgtgcatgtatgtgtgtgtatttagttctatccaccaccacaaagacatacaataatttcattataacaaggacaataatggtattttaatacctgcaaaaatatgcattacctgtttctttgaatattaatgtcagggtaggttcaaa

SEQ ID NO: 102970 - DNA, 200 bp, Homo sapiens
atgactttttacatataagacaaaaagcctgatccaggaaataaaaggtaggtaaactggacttaattaaatgtaaatgcttattctctatcaaaaatactgttaagagaatgagaagaaaagccactaaaggaacatatttgcaaaacacattgataaatgactgatacctgaaatatgcaaaaaacacttaggtctca

SEQ ID NO: 102971 - DNA, 179 bp, Homo sapiens
tttggtgaagtgggaattggagagagggttgcttccttctgccctaatgaattaacaagaacaatgtaaagcaaaacaaaacaaacacaagccaccagttaggtttttctctgaactcccaggtcttgggaggggtatctcattgtggtttccaagtcctggcaatgtccagaattgga

SEQ ID NO: 102972 - DNA, 235 bp, Homo sapiens
ggactgggttaccaggggctggggtgggaacaacggggagtggcttcttcatgggtgtagggtttctgttgagggcgacgacagtaccctgcaagtggaccggtgaccgatgcacagcgttgaatgtactgaatgccactgaactgtgaactttaaaactgttaaagtggcaagttttatgttatattaaaaaaatcatatatagaaaggatgttgtattaaacgagaaaaactc

SEQ ID NO: 102973 - DNA, 512 bp, Homo sapiens
acaaagccaggagacggggtgctacagacaaaccccatccatatggtacagccacaacactgacagtgtgcccgaggctccctgaggggtcagctttcagtgactatttgacagacttaatcccagcccaatcaatccagcaaagagaaagcggatggcaatgagaagcaacaaaaagatctgctgggctcaccacacaagcatccttggaaacaggaacactcataagcccaatttttgagggggagaaatgagcactgtgatgaacatactatgcattatcactaatttttccaagtttctactcagagaatgggacaatggtgtcacactgggggaaaaaacccaaatgacatctgtcaggacaaactggtaaagccacttacaatcgtttcaaacatgccagtctctaaaaaatttcccagcacagaggagaaactctaattgtttgtttaaagaatgtgtctgaggaagcgagaggctcaggaccagaggggagctgagaagaaacc

SEQ ID NO: 102974 - DNA, 230 bp, Homo sapiens
catacacgagaagaaagcaagccatggaagcagaagaggaaaagactgctgctgagtgctgactgtgtctcaggtgtctatccacacttgacacatgccatcacaccgaattctcagcaggtgtgcatccacgcttgacacatgccattgtgcatccacgcttgacgcgtgccatcacaccaaattctcaggtgtgcatccacgcttgacgcgtgccatcacaccgaatt

SEQ ID NO: 102975 - DNA, 526 bp, Homo sapiens
cccgccagggtgtggagccgcactggggcaagatcaggtgggacagcccaaagactccgggccaagttcctgggggactcggcggagatggaagatgattctcgaagctctccatttccttaattttgagttatcttcagtccttcttcaatgctgtgactgagtgcttgctgattattgtgcttgctgatcctgactaatactctctcttgatgagcttcatattcatcacgacttggataaattttgctgatgagtgcatcaaactttgggtctggccttggtgatcttttggaaactagttttttccaacagttggttggatctaggatgtaaactgcaagtgtggcaggccgactgcactgttttgttactagagggagtgagaacacacctgtggacttgagcaccttccattcaccagttgctccatgggcatactctaattcaggtctccccacaaccctctgagttaatatttctctccccattttaaagatgagaaaataaagcctagacagtttaa

SEQ ID NO: 102976 - DNA, 483 bp, Homo sapiens
ccactctgtccccacggataccaaaatctgcgcgtatccgcgcatgttcaagtccctaatatattctggtgcatatactatggtgtcaaatttgtatgtaacctatgtacatccttccaaatattctaaatctctaggttatttataataccttaatacaatgtaagtgctatttaaatggttgttatactgtgttttttatttgtataatttttattgttgtattattgctttttattatttgtttttttctgaacatttttgatctgcagttggttggatctaggatgtaaactgcaagtgtggcaggccgactgcactgttttgttactagagggagtgagaacacacctgtggacttgagcaccttccattcaccagttgctccatgggcatactctaattcaggtctccccacaaccctctgagttaatatttctctccccattttaaagatgagaaaataaagcctagacagtttaa

SEQ ID NO: 102977 - DNA, 383 bp, Homo sapiens
ctcaggatctctgcagttgacatgaacacacctgcacatgcccacacctgcgcccagggcctcacatgcaggaggacttcgtaaactctggtacacaggaagaaaattattgcagggtcgttggacccagaaaagcatcacgggcggaggatgttgaagcttctgaccaggacagagttcttcagttgatagctgtccagaagtttcggcaagacgtttgaaggaaccacaacccagtctaaccaaaggggtggttggtggaaggtgaaggagtcacacacaagtggaaactccagcagagatccaagaaagcaggagtgatgcattttcccccattacgtttttttttttttggtttttgtattaaatatccaccctccctc

SEQ ID NO: 102978 - DNA, 250 bp, Homo sapiens
ctttactagtgcctgcctgcatgagcagcggggaggggattgctgcatccaaagaggacctctctctccttgtggggtgtctgtctgtctctctttctcctctcctccctccttgcggggtctctctctccttgtgggtctttgtgggggatctctctttttgtgggagtctctctctctctctctctttcagtgactcaatcagcgctgagacaaactgggattagctgaatggttgagaacttacctg

SEQ ID NO: 102979 - DNA, 103 bp, Homo sapiens
gtgacaaattctaccgccagtaatcacttgtgaaaaatcaacagtgaagcccagtggctcccggtcccccggagaaatctgagtggatttccagaagaacaag

SEQ ID NO: 102980 - DNA, 891 bp, Homo sapiens
ggagcctgggtttatcgacgagatctggagtatctattcttttccactgcttgcagtctccaatgtaggcagtgtaaaggtatagtaaaatgattttaggagtcagaaccaaattgccaatatgctccatggctcctaaaggaaaataaaatggaagtttttattttgcggcttcacttcttaccgtgtagtaaccttactacaattacagattttcaggagttgtttgctagtctctttcagtcaggtactaaaaaaaaaacaaaaaacaggctgggcgcggtggctcacacctgtaatctcagcactttgggaggctgaggtgggcggatcacgaggtcaggagatcgagaccatcctggcgaacacggtgaaaccccgtctctactaaaaaaaatacaaaaaattagccgggcgtggtggcgggcgcctgtagtcccagctactcgggaggctgaggcaggagaatggcgtgaacccaggaggcggagcttgcagtgagccgagattgtgccaccgcactccagcctgggtgacagagcgagattccgtctcaaaaaataacagcaacaaaacaaaaccctcgaggggccactctcctgtctttactccttttcccttctctattctttcaccagaagccctcatttgaccagtgaactcctaggccctcttgacccgcacattagctgggcgatttccttgttctgctaattcctaattctgcttaaaatgtatttggatttctgtttttgaacacttatgatgccaggcactgtaatgcttgaaacccgatctttccctagagaatgtaacatacgtttttattcatttaatcacttcattatgccggggttaattatgtttattttataattggtaataaaggcc

SEQ ID NO: 102981 - DNA, 122 bp, Homo sapiens
catgtgcacacgcggctgagggaagaatcagcgagctggaaggtgttagaaacttcacaaactgaaaagcaagaagaaatgagaataaatttgaaaacagaagaaaatggccaagacctgtg

SEQ ID NO: 102982 - DNA, 201 bp, Homo sapiens
ggctctttccggcatctcctttcgtaataatgtgaattaatatgatttgttaaatgttaacttttatatcgcgttgtgcactgctctaagatcctctgctcaaaacttacctaaattcaaactcttaaactgtatttcccttttttttttcccccttaaatagctgtttatttggcagtgtgccggaaagaggagagtggg

SEQ ID NO: 102983 - DNA, 115 bp, Homo sapiens
atcgcccctacacatgtcagcacacagatcattaactagggttcaatatttgcttatgggtttttcctttcaaggtaaaatttacccaagtgaaatgcagactttttgttttttt

SEQ ID NO: 102984 - DNA, 548 bp, Homo sapiens
tgcagacctgggttaacattagcagataggttttgagaacctgctcatgggctaggccctacttcacacattctaggtgctaaggtttcaatctcagctttgccattgactacttttgtgagtttggacaaggtatttaatttctgtgccgcgttttcttcagttgtaccaacagtaccttactaataccgatagtaccttactaatgagtacttgaggattaaatgaggcaaacatataaattccttaaaagagagcattccaggctgggcatggtggcttatgcctgtaatcccagcactttgggaggctgaggtgggaggatcccttgagcccaggagttcgagaccagcctgagaaacatagggagaccccaatctctacaaaatatttaaaaattatctgggtgtagtggtgcacatctgtggtcctagttacctgggagactgagatgggaagattgcttgggcctgggaggtcaaggctgcagtgagccatggttgtgccactgcactttagcctggatgacagagggaaacccggtctcc

SEQ ID NO: 102985 - DNA, 251 bp, Homo sapiens
tgaaggcaactggaacagagggcggatggaggctcaagttaggagcaactcagagaaagctggagtgtggccgggcacaatggctcatgcctgtaatcccagcactttgggaggccgaggcaggtggatcacgaggtcaggagatcaagaccatcctggctaacacagtgaaacctcgtttctactaaaaatacaaaaaattaaccgggcgtggtggtgggtgcctgtagtccctgctactcgggaggctg

SEQ ID NO: 102986 - DNA, 265 bp, Homo sapiens
aatgaacaagaatacttgattttaatattgtcagatttatcttttatagttaatatttgctgttttatctaagaaactcttttttgtccagatgagaagaatgttccctttgattttttactaaaagatgtaaggtttgggacatttaagtccttgagttgttttttttaatatgaggtagggacctgattttatcttgtgccatatagaaaatcttttttatcttgttccatttgttgaataatctctcctttcctctagtaat

SEQ ID NO: 102987 - DNA, 664 bp, Homo sapiens
ggagaaatcaaataattaagaaaaataaaatgggttcgctagggtagggctgtccaacagaactttcagccaggatggaaatgttctatagtctgtgctgttcaagatggtggctggccacatgtggctatcaagcacttgagatgttgctggtgtaactgaagaactaatttttaattttatttaattttaattaattttaatttaagaagccacatgtgctggtagttagcttactaaacaacactgctacaggggaaggaaggaagcagagtttaggaaaagggatagaagctaggtttctttgtatataatttttgtagatttaacattggaaattacgatttttagaaatgagatttttgaaaagcaattcccataaatcaaaataaaattagataaatcaatctacatacatggttggtggtaaaaccacacaaattaaccagttcgaatgactttaaaacacaataacttgactttatattcctagtgagacataatgaccaaaaaaaatttttaaagccattccaataatcatattttgctactcagatattttattctcagacttatacacatgtactgtgaaataaaacaaatgagtaattattattggtgcagctgggcactagaattttcaacatggaagaagtaaatataa

SEQ ID NO: 102988 - DNA, 124 bp, Homo sapiens
ggaagaaagttctgtggggtgccaattcttactaaccccgagcccacagcccttactggcaagcccagtggtttttaatcattgttagctgttgttgctgcagcagcttctgattaagttgcat

SEQ ID NO: 102989 - DNA, 318 bp, Homo sapiens
gcagggcctaggggatgccgaattccagggtccagaaagagcttgggataaaaagaaacttcaaggggacggctttgacctgggctgagtctgtctgtgccatccaactggagtctcaagtcctgaggcaggacgtccagatgccccagtgcagggtcctcctgatcaacacctgctcccctgtactcattagcaacctcacccaccctactctcaaagcacacttggctctcgtatccaggagctctgcatctgtagattcagcaacagcagatggaaaatattcagaaaataaattggacggttatgtttctattg

SEQ ID NO: 102990 - DNA, 1317 bp, Homo sapiens
aaccttgctctgttgccaagctggagtgcagtggcatgatcatggctttcttcagcctcaacctcctgggctcaggcaatcctcttgcctcagtttcccgagtagctgggaccacaggctcacaccaccacaacaggctaatttttaagttatctgtaggggcgagatctccctatattgcccaggctggtcttgaagtcctaggcttaagtgttcctcctgcctcccaaagtgttgagattacaggtgtgagccacctcacctggccaatttgcaagaatataatacattgttattgactatggtcaccatgtcgtacagtagatctcttgaacttattcctcctcactgaaagtttgtatcctttgagcaacgtctccccaacccacttcttgttttttattaacttattaaagtataatttacaataagtttcactcattttaagtatgaattcaatgagttttgataaacacgtgtagtcatataaacaccaccactatcaaaatatggatcatttccatcacccagaaagttcccttatgttcttttgtattcggtccccttcccaacctccagcttttggcagccattgcttttcttttctttgtctttttttttttttttgacagacagggtcttactgtcacccaggctggagtgtagtggtgtgatcacggctcactgcagccttatctccctgggttcaggtgatcctcccacctcagcctcctgagtagctgggactacagctgtgtgcgaccacacccagctggttttttgtttttttttttttgtttttgtttttgcttttttttttttttttgtatttttagtagagataaggttttggcatgttgcccaggctagtcttgaacttctgggctcaagagatctgcctgttttggcctcccaacatgctgggattgcaggtgtgagccaccacgtctggcctttgatctgctttcaacacttttagctcttctagaatttcagaaaaatggtatcggatgtacagcatggacccttctgtggtgggcttctttactgtaatgcttttgagattcatctgtgctgttgagtgtctctgcagtccattccttctgttgagtgtatcagtagtccattccttttcatggctgagtagtatttcattgtataattataccactatttgttcatttactagataataaacagttggcttgtttaagtatgaattcaatgagttttgataaatatgtgtagttatataaacatgactacatatataaacatataaacatatacatatataagcacatataaatttgtgtc

SEQ ID NO: 102991 - DNA, 382 bp, Homo sapiens
cctaagataagcaaaatgggataagtttaacaagtgttagagtccaggtcatcgatatatgaggtttgttatactttctttcatgtatttttacacattaaaataaagaaccagttctgactgtgtcatacatagtacagtgtcttcagaatgggccttagcagacaccggtatttactgaagcagaccaagatgcggtactcttctgaattcagcaccgtgtgggctggtgtctccagccagccaggagaaaatcagcattgatccaactacttaaaagcaccacttttagaatagaaatttaatatgtttacttacgtttggattgtctctggttctccttagaaaaccatgagttaaaatgtctgaagattttcattgg

SEQ ID NO: 102992 - DNA, 308 bp, Homo sapiens
atgatattatacctactacaaaatagtttccattttatataatatatagtatcgtatgattatataatttttatattttatatatcaaactttcatgtaacattttagttatttctacttttacataatcacatttaatgtttatagtataaagttataactataataacgggtcatagggttcagacagcctgcagttggaggtggtcaatatttttattgtttgtcaagaatcccaattctggctgatttagcaccaaggaagctttctccagctttgggcttttgcaccaactgtgttctctggg

SEQ ID NO: 102993 - DNA, 398 bp, Homo sapiens
agtatccatttattcagaatgtaaatgtttgttctgaataattaaatgttctagtttgctaaaagttaccaaattctttaaataaattaccagtattcaaataattttaatatactaaagtatagttacatagaaattaaattccagaggttgaaagatacttcaggaactttaaacatttcacagtcaagtctaacaaatactaattgttattctagcctggagagattagtttagagtttatctaattgagtatctccaaaattgatacttaaagtaaaccatagtataatttttgcttgcttgaaattcgtgtatgtgtttcaagaaattaaatgtagaaagaagtaatttttttttctatatttgggataaataggaattgattttagtatttc

SEQ ID NO: 102994 - DNA, 270 bp, Homo sapiens
tgagtaaagtgaggccccaactttgggatggtcattactgaaaaagaaaaacctcacatgatgacaaagtctttttaacactacatgaatgtgactaaatcagctactgaaccaaagttcacaggagcaaaatcaaaaagaacaaggagaatcaagcaagttaatctggtaaaaagtcacagacggctagggacagtggctcatgactgtaatcctagcactttgggaggccaaggcaggaggattgcttgggcccaggagttcaagacc

SEQ ID NO: 102995 - DNA, 295 bp, Homo sapiens
cttatatgatagaaaaggccgcttctccatttttcataaatttgagtattgaaaggggttaaattcaggttggataacattgcacagtagaaagaaaagtacacttattctacatataacctgattaatttagtataggagagttacattccaccaaaagaaagtgttcctgttcatagtcttgggctttaattacaaatgttgacttcgtgacattttgagatttgagaagtctaagagcagaaagaattatagtttatattgatcatacataagcatgttcaaagactgccag

SEQ ID NO: 102996 - DNA, 601 bp, Homo sapiens
aagttggagcatcaaggtgagagctgaggcacaggagagggaagtgtctgcctcaagactctgtcctcttccagacacgtgtcctgtccccgcttccccagctaggcaacctctcaaagcagggtgttcactctcaacagggcagaagaatttgcccatcttctgatagggcagaagatgacgggaggacagccacacatgttccaaactgctctcagcttccaggtcaggctcagccattgtgcagcccacactggcgtgtctgtctgtctggcatgcatgtctgccccaccccatgtctgtccctaggacatgtgcatccacagctcccacaccagagttcccaggaagacaacgatcaggccagaatgctggacttttgcttaggtcaatgttatatgtttcttagatgctgacacactagtcaaggctctggctgacacggctgacagccaggacgtgggttttcactgggagtcatgggtgtctgtgaggctggatgaccttccacttcctactccaggtcacttatttctaacatttgtcatcatgacccaaatctaactttaaaagcattcttccacttaatgaagctccagtc

SEQ ID NO: 102997 - DNA, 193 bp, Homo sapiens
caattttcctaatggtatataaacaaagacaagcagttctctctcttaattcactttttgtgaataatatgaatacccacaagaacacacacaaaaattcagttgttacacaactagaactcttaaaagaaacaagtcacaggccaggcacggtggctcatgtctgtaatcccaacactttaggaggctgagg

SEQ ID NO: 102998 - DNA, 219 bp, Homo sapiens
ggcataggactaaggagggagagagactggtgtttactgaacccattatccgggcagtcttgtggcctggtacccaagctgaggccagataggtagggctggcttgaactgggccccaaggcagtgcttccttggagactctaaagcaccaagaaactggcatcctggccctgggagaggcctactaggtggccttctctatccacattcactggtcct

SEQ ID NO: 102999 - DNA, 399 bp, Homo sapiens
ggagaagatgtgggagcgaatttattgcaggaatccacaatgactttgaagttgttggagcaatgcattgtattcagaaaacctgtgtcacattaaaaaatttcatctaggctaggtgcagtggcacaatcatggctcacttctgccccaatgtcctgggctcaaatgatgctcccacctcagcctcctgagtggctggtgctacaggcacacaccaccatgcctcactaatgttttgattttttgtagagatggggggtcttactatgttgcccacactggtctcaagctcttggtctcaactgatcttgccactttagcctcctgcatagctgggattacaagccactgtgccctgtattttaaataaatcttcattttcttagatgccaaacacca

SEQ ID NO: 103000 - DNA, 160 bp, Homo sapiens
gcacacacacatctatgccctgagctgggacgagctgcacagagcgggctgggggctgctccctggaaaagaggcagcaggtccctgggacgcctggagccgcttctcccggtgccagccttgccctctgcgtactggacagcaacaagcccaggcacag

SEQ ID NO: 103001 - DNA, 99 bp, Homo sapiens
ctcctgcttgttgctggcaggaggccaggcagcaaagcgtctgaggggagttttccttgcctagaggagtcagctgctgtgttaactccctcactgctg

SEQ ID NO: 103002 - DNA, 586 bp, Homo sapiens
gtggccaggtgcagtgacacacacctgtaatcccggctctttaggaggccaaggcaggaggattgcttgagcccagcagtttgagagcagtgtgggcaacatagtgaaaccccatcactacaaaaaatttaaaaattagcaaggcatggtggcacatgcctgtggtcccagctacttgggaggctgaggtgagaggatcacttgagcctaggaggtcgaggctgcagtgagctgtgatcacaccactgcacactagccttggggacagtaagaccctgtcacacacacaaaaaagataatctggcaaaattaatatgagcagcatttttcactcgaagggaaacctaaataagcaataagcaagttatgttttaatcataagacttacttggaaaattaagtataagaccatagtaagctacagatgcttctcagatacttcccgataaactcatcataaataaaaaataccattaagtaaaaaatgatgctttttttgttgttgtttttttgagatggagtttcgctcttgttgcccaggctggagtgcagtgcaactgcaatctctgcctcctgggttcaagcg

SEQ ID NO: 103003 - DNA, 139 bp, Homo sapiens
cttgagcacctactatgtgcaaggccctgtaccagctgatggggatacaggaatgaacaaggaggaggaggtccttcccctcattgagcacagaatcttgagggaaatgcagatattaaattaaatgttgtaaacgtgt

SEQ ID NO: 103004 - DNA, 626 bp, Homo sapiens
ttctctcctctcccagccttgcctgatggtcttcaggagagccaggagaggccagttgtcacgtgcctgaaacatgaggacttcgagttggctttccttctcttgaccaagggcgcagacccccgtgctatttctctcacggaaggtgatactcctttgcatgcagcactccacatctttctagagattaaagctgacattggttttagcttcctcagccatctgttggatctgttttggtccaaccccactgaattcgactacctcaaccccaatgtccaggacagcaatgggaacacgctgatgcacatcctcttccagaagggcatgctaaagcgcgtgaagaagctgttagacctgctggtgaagtttgacatcaacttcaatctgaagaacaaagagggcaaagatgcacggcaccggattaagaagaacgactctctgctcttggcctggaacaaagctctgatggagaacaggaggaggagccggcaggactctgctgcccacctggggaagctctcaaagtccactgcccctggtcacacatctcagctcaagtcccagggttcattcaagtcagtgccatgtggtgccactgccagaacactgcctgaaggaagtgc

SEQ ID NO: 103005 - DNA, 231 bp, Homo sapiens
taatgtattgctgagtatttgacatgtagaaatgtaatatgtctataacatatttcccagtaacatcaaaaaggaggtggttggaagaaaaatgtatcgtgataagataatcactctagatggtaaagtgataattactaaaatgtattgttggctttgtaactttaatagatgtaatgtgtaaagtgataatactttcaaatggaggaaataaaagagatttgtataaga

SEQ ID NO: 103006 - DNA, 491 bp, Homo sapiens
gaaaatgcatgaaacttccctaggtctacctggttactattcacaggatcactttgggtaggtgagtttgtgccagaggttagggaatggggtctttcaagactcactgtcctgagccctgctcacccaagagacctcttccccagttccagtttggccccaaatggttgcctctccatagacaaaatgtttcccacctctctatccctttaactgtttgacagtaatgcagattcgtttatcagattaactggaagtcaatccaggttggcacccctggagaaggcctggccacctgagctgccttcaactaaaggactgatctgtaatagacactttagcctcatgtggccgtggagaaccaaaatgatctatggaaatgtagggaaactcattttagctcacaacaaaggagtcactttttacctgttagagatgtccaatattagaatgggctacctcataaggtaatgagccttgtcacccaaatg

SEQ ID NO: 103007 - DNA, 102 bp, Homo sapiens
atggtaaagcaggggaatgaactgaaagccttacagaaatgtaaggtcttccgcgtcattagatgctgtgagacaatggaaaccaactcaaatgcctggcgc

SEQ ID NO: 103008 - DNA, 403 bp, Homo sapiens
ctttttctttattttatatatattatatatataatatatataatatatatgtaattatatatatattacatatatatataattcacagtagccaaaaagtgaaaacaacccaaatgttcatcacctgatgaatgaataagtttcaggatatccaccaatggaatattattcagcaataaaaaggtttgatgtaatgatagatgctaaaaacatggatgaaccttggaaatatttaaagtaaaataagacaggtgtgaaagacatacattgtatgattccattcatatgcaagtccagagcatgtaaagctatatagaaagtcagttcgtggttatgtaggcctaggatgtagatcggtggggggcagggagtgatagctaaaggacaaggggttttttttctt

SEQ ID NO: 103009 - DNA, 589 bp, Homo sapiens
tttatatggctggattgtctttttaggtagtctttacaccaaaggggttgagactgcagaatccctctggtatttgatgttccctactgcatgcagtggtgaaaaggtacctggaagatgccttctatcaccttgacatctcacaaaggagtaagggagcacttatatgcagatccgataaatggaaatgaataaaggctctagaggtgtccctccctccctctcatgacttcctcgcttttgtgacaagtagcccatatgatggtggccagtgcaggagctgagatcttgagcaacattttctcaactctacattttttttttaaggccctatgatgcaggtaccatcccatgtgtttttatgccccttatttcattcagaagatctgtttgcctgcagtggaccatatacttttggatggaggttgggagaaaagcatccgtcaggaaccagaatcatgtgatagtaggctatatatattttttgtttcaagtttttttttaacctcctagaaacacttctctgagttagtaacagagaactgtgaaaatgtccaatcaactttaagacaactgattttttatagcc

SEQ ID NO: 103010 - DNA, 418 bp, Homo sapiens
aaagtgctggaattatgggcatgagccaccgtgcctgggccgggttctctattctgtcccattggtgtacttgcctcatatgataccagaaacacagcatcttcattctagcagcagggaagtctcagggtaattgggatgtttccttgatgccttcatggaaaaaaatgagtatctgcgagtccatgtgtaggtctatttctggattctcttactccaccgatctatacgtctatgtttactccaaaagtatactatcttgattactgtggccttataataagccttagatatccagtagcataagttctccaactttgttcttctttctgaatgttgttttggatattttaagtcctttgcatttccatacagcttttaaaatcagcttatcaatttcctgagattttgtttgggg

SEQ ID NO: 103011 - DNA, 771 bp, Homo sapiens
ctgagcacccaatatccagccacttcatccttcttactgccctcagatcgcacctcccactttcagccttctgccccattgtccatgtttcctcaacctggaatgttccctatccccgtggcctctgtgaaaatgtacccgctacttgaggtctaacctcacatgtacctaggcagaattaatccatccctctaaaatattctcaccctcttcctcagtctgtatcaaactcccactccttcacacaaatatcacacacacgtgcctgcaatccccaaatttcaaaatcttccaaattctgaaagctgaaagtgttaatatttttcataattcatttggcagaaaaccccaaactgaagttactttgtaattttgatttatgtcaccaatatgagaattcatgcatttaactgcaaaaaccaaaaacctgaagtgtttgaccacaggcccagaccccactggaagtattagacaacatttgatgtatatagtactgccctaagacccacgtggacacgaggaaccagaagtactcctggaaatttactctattccccctcccttgagttcacagaaccagatgagatgcagttccagtggggaattccagtgcaccccagaccagggcacagatccagactcacatgaactctgcttcctgtttctctcctttgaagcactgtggagtcaccagatggtgactatgttggtgtatgtcataggagtttactccattagataagaagcttgtccacaggtctttccaagata

SEQ ID NO: 103012 - DNA, 331 bp, Homo sapiens
gcggccgcctactactactaaattcgcggccgcgtcgacataatagtttacatttaacttcacttacacagttattttgatagaatgcgtcggtgtttgtgtagtatacttttgagggtgagacagcagaattgccttccattcaaaactgacatgctttataaaaaaatctatgcagtgttttcttttttgagacggagtcttgctctgttgcccaggctggagtgcagtggcgtaatctcggctcaccacaacctccaccttcagggttccagcgattctcctgcctcagcctccagagtagctgagattacaggtgcaggccaccacg

SEQ ID NO: 103013 - DNA, 330 bp, Homo sapiens
attacagtgacatgatctcagctcactgcagcctctgccttcctggctcaagcgatcctcctatctcagcctccaaagtacttgggacaacaggcgcacatgccaccacacccagctaattttggtattttttgtagagatgtggtttcactatattgcccaggctgtctcaaactcctgggctcaagcaatctccccacctcggcctcccaatgtgctagaattacaggcacgagtcaccacacccggccactacaggacactttctctataaaattctccttcttttccttccatttctgataatctaaatcactcttatctctctca

SEQ ID NO: 103014 - DNA, 279 bp, Homo sapiens
ggtgcgatctcggctcactgcaacctccacttcctgggttcaagcaattctcctgcctcagcctcctgagtagctgggattaaaggcatgtaccactatgccctccagcccttttatttttaatattctcttccttgagttcaagcaaagttacttaaaatgcttttttgataatgtcctccctttcctcttttctttctggaatgcctattatttcgatgttgacttttgaattttctcctgtaatttccttatttgaagaatcctatagtgtattgt

SEQ ID NO: 103015 - DNA, 831 bp, Homo sapiens
ccatttaacctcaaaatcaattaaagaaggaattaatacagagtatcaaagctgttatgcatgctaattagaggaatgttgagtcatttttccacttcattcttaaggatgtgagatctgtcagtacatccaattagaaatactcatggttgatgctggccttacattaattgctaaagatatttattcatttcattctttgtatttcttagttttgtaatatacaatgagaatcaagtacataaaacttaaaaaataaaactatgaaattataagaaacatcacctgtaagaacctgtcttgaaattttggcagcaaactgctttaaactattaagcattttgaaaaagaaatttaaatataatagataaaaataatacactattgcaggaaatattcctaattttaattgtgaaaaataatattcgagttgaagtacaagtttctacatttttgaatgcaggtaaatgtagagaacagaattttttttgccagcgaaatacaggacagtaatagatcacaggattttctcaacactttgtcagcctgctcaaattggtcataagatggcagaaatcagtaagtaatagaataagtcagcacttatctgcccagcaaaactgcacaagttgataacaaaaaaggcttgttctgctctttttaggcttcgataatccatgcagaaccaggacaatcatatttgcagattttgaatctgatttaccactgccttccagacatagctgcccaaatgggattcatggccgcaagaccatctataaatgcatacttacattccagttatcccctgtgacacatactccatgaaac

SEQ ID NO: 103016 - DNA, 527 bp, Homo sapiens
tggggacgggggtctgtgtattatgccagggcttgtctatcatggtccggagaggtgggggcagcatctgggcccccttgctcagtcaggctccttgcctttcccatggtccttgccccctcagcaggagtgaactcatgatgatccaacccggatctgggccctgacctcccagcgctcctcttaaacctcggggctgcaaggatttgctagattctagaccagggtttccccagtatcagcactgttgacatttggggctgtttattcactattgtgtgagaccatccagtgctctgtaggatgttgagcaatatccctggcctccacctgctagatgccaggagcacctcctcctccccagtcttgataataaaaaaaagtctccagatttcagtgtgcccaggaggggaagaccatccctagtgaggagcactgtgtcaagggaaagccccgatccacatagctgccacggagactcctgctggcaggacttttaacaaagggttcccaggacggtcctggtt

SEQ ID NO: 103017 - DNA, 397 bp, Homo sapiens
acaaagaacagataaaggtgtcaagtgagaaaggtgaaatgaggttatcactcacttcacctctcacctgatttgtgttgctagctgaaactgctggccagtaacgtatgtataagaaactgttataggccgggcacggtggctcatgcctgtaatcacagcactttgggaggccaaggcaggtggatcaccagactgaccaacatagtgaaaccccctctctacaaaaaatacaaaaattagccaggcatggtggcttgcacctgtattcccagctacttgggaggctgaggcaggagaattgcttgaatgcaagaggcggaagttgcagtgagccgagatcgcgccactgcactccagcctgggcaacaagagctaaattccatctaaaaaaaaa

SEQ ID NO: 103018 - DNA, 335 bp, Homo sapiens
agtataatgacatgatcttggctcacccacagcctctgcctcctgggttcaaggagttctcctgtctcagcctcctgtgtagctgggagtacaggtgtgcatcatcgtgcctgctaatttttgtatttttagtcgagacgggttttgccatgttggccaggttggtgtggaactcctgacctcagaagatctgcctgcctcggcctcccaaagtgctgggatcacaggtgtgagccactgcgcctggccttgtgagtgctcttattttgttttcaggggtgtataattgactttcactttgatggagtttagaacacagcctgctatagaagatt

SEQ ID NO: 103019 - DNA, 374 bp, Homo sapiens
tctcagtggttgcatatgaacctgccagatgtcaacaatgtgtctgctgtgtacaatatcccccaaagactaaagatacttcttgctgatatagtatttggaaataactggcaaacatcgtggacctgcagcatcactaagtgtctgtgtaaacacctctgaaacaacagatgttctgaattcttgttcccttggaataacaaaatgacttgcagggagctgatgttcccctcacttttccaaaacaatttcaggaagaatccgtgagctctcaaactcagatcagcttcaggttctggaatccacctgtggctactggcagtttttttttgcaggtgtttgcccgtgggaagctgtcaagaattggtctaaat

SEQ ID NO: 103020 - DNA, 292 bp, Homo sapiens
atgatctaaaaacttgaaggggctatctgccagaaggttttgggatgatatctgttcagttctgaaggcaagtctgtgcatatctcatccctcactgacttttgcagccacttctatactaataacgttgccttctaccctgaacgctgaactgtcctattttggaggctcttacgggttagttccccagaaaccatctgttccaaatgtgcttgatttcagcttaggactttccagaaaagccttccttgacttagaagaaagataacattcattgatcttgctatgctcc

SEQ ID NO: 103021 - DNA, 406 bp, Homo sapiens
caactatggaattccacagatacatagagagagattgcggaggacagtcagtgaaatctgtggtgttaatgtgattcaagttttctttaaaaatgatttcctttaatgtgactgaagtggatggagttttcccatcgacagatagttttcttcctttccagcagccatttgtggtgagttcatttataggtttctgactgttcattctcatgtctcaatcctgtaataagtctgtcagcctgcagtgactaaatgacaccaactgcaagaaaatggaaatagtagggagggtgttttgacagtttaattaccctcaagtcatagcccaagcacaaacagggctgcttcggttgtgaggacatctggcttcagaactggtggaataagcgtcattcttttccaacgt

SEQ ID NO: 103022 - DNA, 133 bp, Homo sapiens
aaaatttgtccgttgccataaaagtttctaaactcttattctcaatgtctgtactacaggcagtgcatttgactgcagactaataaactagtcctggactggtacacttcaagagcagtgacctaagaagaaa

SEQ ID NO: 103023 - DNA, 1367 bp, Homo sapiens
taagtgttacttttcaagggcagaaactgggcagaatgccagagagacacaactagaactttttgagccaacagagacctttgtgtaagttgttagttggatccatcagcctcgctatcctaagcattcttctcttattttactttctaagcacagctgtgttaggactaacccattcacagcctggtcaccaatgttctatcagcatcacagaatactgtctcatggtgtctagcttgatgaacttggttaggatactctctctgttactcagctttgtcatctgtaacatggggactaatacaaggactaaaaccttctattagccattatccttcttgccatctaccccatgttaaagccaggctgatttgttcttggatcttaagtgtgacaaagcctgcgggaaggaaccacattctgaaggtttgtgggctgtgtgagatccagagaacccaagggggtttttttgctcttgacaaacgaatgttaggtatgacctatgatgatacaacttctgcaaaattgaggaccagcctatttcttcattagaaatgcaggaaacctggccgggcgcagtggctgacgcctgtaatctcagcactttgggaggcagaggtgggcggatcacaaggtcaggagattgagaccatcctggctaactcggtgaaaccccgtctctactaaaaatacaaaaaattagctgggcgtggtggtgggcgcctgtagtcccagctactatggaggctgaggcaggagaatggcatgaacctgggaggcggagcttgcagtgagccgagattgcgccactgcactccagcctgggcaaaagagcaagactccgtctcaaaaaaaaaaaaaaaaaaaaaaagaaatgcaggaaacctatttaaaagtaacagaaacagctgggtgcattggctcatgcttgtaatcccagcattttgggagaccgaagcgagtggattgcttgagcccaggagttcaagacaagcctgagcaacatagcaagaccccatctctacaaaaatgaaaaaattagccaggcctggtggcatgtgcctgttgtcctagctactcaggaaattgaggcaggaggattgcttgagcccaggagttttaggctgcggtgagctatgatcgtgccactgcacaaaaccaagaatttagaaaaaggaatccacataattggaaattgagtattaagtttttgcttcctaggaaggtagtctaaatccttatacaaaaacttagctatgcagtgccaaggttggattgcttgtgaatgggtttgcatgctctgtaacctatcagttattctgaatcaagacttgaatatttaaacatacttggaaaagaaaaagatc

SEQ ID NO: 103024 - DNA, 643 bp, Homo sapiens
gattctaaaatttacatagaggccagccgtggtggctcacacataatcgcagcactttcggaggccactgcaggaagatcacttgagcccagaagttaaagaccagcctgggcgacagacacttcgtggcttatttttttttaattattaaaaatgaaatttagaccaggtgtagtggctcacccctgtaatctcagcactttggaatgctgaggtgggcagatcacctgaggtcaggagttcgagaccagcctggccaacatggcaaaaccccatctctactaaaaatacaaaacattagctgggcatggtggtgggtgcatgtaatcccagctactcgggaggctgaggcaggagaattgcttgaacctgggaggtggaggttgcagtgagcagtgatcacgctattgcactccagcctgggcaacaagagtgaaactccgctaactttcaattgatttttgacaaatgtgactatttcaatgggacaaggatagtcttttcaacaaatggtgctgtaactactggatatccttatggaataaaaagatcactgaccctgtttcataccacatgaaaaatttaaatcaaaaaagatcatatacccctatgaaatttcggaaataataaaacttttagaaga

SEQ ID NO: 103025 - DNA, 784 bp, Homo sapiens
gtgatggattcacagtcctcaagctctctgctgattttctacaatgaatatgtaccacttttgcaatcacaaaaacatgtaaagagtaatgttacttctacctccttcaagtgttttatccctggctgtagttgtatgttccctgcagagcctgtgggcctctgggtttgtgacactaatgcaggagtccccatccctgaatgtatatctgtatatctggtgagacccggggccctgaagggaaatggagatggtgggcaaggtgactgaggaagtctgatgatgaaggcgcagctgacccaggaccgtggaggcaggagaaagcaagctccgtcccacagagcggaggggaagaatagataagccccatcagtctgagtttgctgagcgtcattccccaccagccttcctctcctgcctccctcctaggctcctctggagcaactgctcaccctttcctgggcaccccttggtcttttttctccattcacttgtgaccccttaatgccaccccctgcagacacaatgaattttagggggacacaccaacaaggtccccccgcccatgttagtcatcactagcaccacagtgctctctccaagttccgtgcagccctggagaactggggccacattgtggaaaggggaacaagagcaaggtgagaagactgagtctggagaagtcaggaaggaagaaagaagggtgaaaatagcagagactgtgctagagcctcatctgcagagctcgagggctcagggcatcttcactggaggcccggggaac

SEQ ID NO: 103026 - DNA, 589 bp, Homo sapiens
catatattattattatgaccattacaaatgcgagttatcttccttagatttatgcctgtacctccttgggacactgatcatgtttttttttctgtttctataaagaggaacaatattctccttcacaaaccgtacctttcagcagtttctctttaactctcaaaacttgatgatttctaacaaaatgatcacaatagctccaaggcacagaagatgctgacaagaccaccttcttccctggaaatgtcggaatcaacatttcacacagactggccaaagtagcacacagcctgggccaaaaagaccactgtgcaggcagatgtccaggcttggagcagccacgggcacagaaacccctcttctagctctgtgggtagaaatttgtttatggttatcaccttccacagagtttcccagatttgctttcttttaattaacccaaatcaatctccaattagccatatgaagtaaggaacaaagagctgtgcattgtatcaccgttaaatttctcttgttcctttgtttgtttactctctgtctaccccgccccccccccattaaaatgtaaactccattaaacaagaactct

SEQ ID NO: 103027 - DNA, 238 bp, Homo sapiens
tgctgggaatacaggcatgagctaccgtgcccgacacctccttgtgattctaacaccatgattcatctttgttgctttaaagtgctaatttttttctcttcagagattttgcacaattgtgtgaaatttggaaaaaatattttccacttttgcagaaagttccttccctaggagtacgatgaacacacgtgcttgcttacacagtagttagagtgtaggcggctgtgtacctgatagg

SEQ ID NO: 103028 - DNA, 331 bp, Homo sapiens
ccccgtacggtgtggctctcagcagcctcaccacaggcaccgcagctttcccgctgtgcacccagctgggtgtgtgaatccccctggactgcgcccaggccaccttcatctcccatgacaagatggtcatctccctcaagggcagtcagatctacatgctgaccctcatcaccgatggcatgcgtagcgtccgagtgttccacttttgacaaggcggccaccagcgtcctcaccaccagcatggtcaccatggagcctgggtacctgttcctgagttcttgcctgggcaactctctcctcctcaagtacaccgagaagcttcaggagcccc

SEQ ID NO: 103029 - DNA, 937 bp, Homo sapiens
tgaacttttggtactcctagctctaatgctatatttgagaaaaactactgcagaggacttttaagtctgcattagtgtagtgatcatcctctccaaacgttattcctgctttccctcatttctctatcatttaaccaacccaggcaaggttagacacttaatccatttaaatctaaacctctgctatcaccaaaagactatatttttggtaaagtttgtgtgtgtatatatgctgactgtaaacttaaaaatatacatcagtgtttttattgaagaaataaagagctataaaatgagacactcatacagcttttgacttccagatttttatagaaaagtaggtaggacctacaagtgttcagaaaatatgattagatttgctgtttggcatgcatacatttaacagatgtttaatgtgtatagtttcatttggtacagctgtcttggtatttcctgaatacttttaaactccttagtatcttttatttaaagaaatctggaactacatcagcaaaactgtctttatttttcatccgggcataatgatatctatataggaaatgaagtggcaaatcacatggataagccatacccatggaatgtctatatgataatagtctgcatttgaccacagattatttttattacttgatccttccattcccttgcacaacgccatttatttatgttaaaacagaagaagacaaagagtttcagtgcatttgcatgaattaattggatcctcagagaggacactgcagcaaagagcagatctcttaggatagcatgactaattcatatggtattttagtggcatcccagttgcagtgtgcacttggataacttttttaaacaacaaaattattctccctttgcccttattaatattactccctaacttcagtacagtagaaatgatgcttggtaaagattggta

SEQ ID NO: 103030 - DNA, 779 bp, Homo sapiens
ccaggcaaaaggtgtccaaactatacagatccacatagtctaacagatgtctctatattcctcctcctcaaactctcagaggatccagaactgcagccggtcgtcgctgggctgttcctgtccatgtgcctggtcacagtgctggggaacctgctcatcatcctggccgtcagccctgactcccacctccacacccccatgtacttcatcctttccaacctgcccttgcctgacatcggtttcacctccaccacggtccccaagatgattgtggacatccagtctcacagcagagtcatctcctatgcaggctgcctgactcagatgtctctctttgccatttttggaggcatggaagagagacatgctcctgagtgtgatggcctatggccggtttgtagccatctgtcaccctctatatcgttcagcaatcttgaacccatgtttctgtggcttcctagatttgttgtcttcgttttgttttgttttgtttttctcagtcttttagactcccagctgcacaacttgattgccttacaaatgaccggcttcaaggatgtggaattcctaatttcttctgggaaccttctcaactcccccatcttgcatgttgtgacaccttcaccaggaacatcaacctgtatttccctgctgccgtatttggttttcttcccatcttggggaccttttctcttactgtaaaattgtttcctccattctgagggtttcatcatcaggtgggaagtataaaccttctccacctgtgggtctcacctgcc

SEQ ID NO: 103031 - DNA, 563 bp, Homo sapiens
  misc_feature (19)..(19): n is a, c, g, or t
cccttataatgagagcccngtccaaaccctgcctgatgggttaaaccagtattagggttatttattctgttcagtacttactgagtacctgctaagtatttagggagagaaaagaaaagtgtatagacgatgttatctcttctaataaagcatcatttttgcgggggaggggttgctttttattttgtacatgaatacatgaagtggcacaacattcaaaagagattaaaaggataggcagtaaaaagtaagtcttctttccctgtccctagcccacctagttctgctaccttgaggcaactacagttatagtttcaaagtataatttttaatatttttaaaatactttaatactttaaaaatcagaacatttatctaggaatagaataatatagcagtcatagggacacactttgacacatcacataagaaattaggtaaagagccaggtatatcgtggcatgtgccagtaagtcccaactacttgggaaggtgaggcaggaggatcacttgagtccaaaagttcaagtccagcctaggcaacatggtgagaacccatctca

SEQ ID NO: 103032 - DNA, 179 bp, Homo sapiens
tactttaaaaatcagaacatttatctaggaatagaataatatagcagtcatagggacacactttgacacatcacataagaaattaggtaaagagccaggtatatcgtggcatgtgccagtaagtcccaactacttgggaaggtgaggcaggaggatcacttgagtccaaaagttcaagt

SEQ ID NO: 103033 - DNA, 456 bp, Homo sapiens
cactctcacactctctctcacacacacatgcacacacccatgctgctggaaatttggggaatcacactgagttgagaatcagaaagtaactgagattcttatctttggaaggaaaggtaagtaagtagctgaggagttcctattcttctgtcagctcatcagccagagatgagatctggtgccactccaaaccctgcctgatgggttaaaccagtattagggttatttattctgttcagtacttactgagtacctgctaagtatttagggagagaaaagaaaagtgtatagacgatgttatctcttctaataaagcatcatttttgcgggggaggggttgctttttattttgtacatgaatacatgaagtggcacaacattcaaaagagattaaaaggataggcagtaaaaagtaagtcttctttccctgtccctagcccacctagttctgctacc

SEQ ID NO: 103034 - DNA, 176 bp, Homo sapiens
tgtccagaactcaaaccagtaacaactgcattacagactttggattcagccacaatgctccatttttcagttcctttgggctgcatttcaacaacgtaccccaggactctgctaccgccatcatgttcaggtttctcccacataagtgatgcactggtctgggacacatcagtgag

SEQ ID NO: 103035 - DNA, 844 bp, Homo sapiens
gaagctacttgaatccttagacagtttttctactctgaatttttagtttacattagattcttctaaaggccttacagtcatagtacttacttcataagactgctatcaatttattcctctaagggacttgttatctgcattcacatttgttataaaaagtaaatgagatttttcaaacttaagagatttattttttattatttacatagttaaaatattttttcagtggagttgaagcattgaagatagttttcttattcacttggtttgaccgtaatgctcataattaacgaagtaaaagggctactttttattcatgggccaggaaagtaacttgctggtggagatgtgggaatcagttaacaacttggttcattaaaactatttttttctgtggttaattcagtggttagttgaccatttaattaagtaggattgaccagttaaaaataaacaatatgtttaattatagaattaaaagataaagaaattgctttcactttgacttcttataagttagttaaaataatttcctgttcaatcataaatccatttgtataggaaggcttttcatcaaaaactaaattgaccgttaaatatttttagacaatcaaaacagtacgttaactgtaaggacttagaaaacacatccataaaagcaagaaaattcttttgctttccactagttccactggagataaccattgttaaaactcgagaatgtgtcctttcagtgtgtgtatgtgtacatacagtattgttttgttttattttgtttgacggagttttgctcttgttgcccaggctggagtgcagtggcacaatctcggctcactgcaacctc

SEQ ID NO: 103036 - DNA, 506 bp, Homo sapiens
gccatgtcagccggatccctccagtcttccgttttctctgtgcagcagggaggttctccgcagaccaaaggtatggagaaaatggacaggtggatccacccacagctgagtttttcagccaagagttcaggacaggagggcaaggaacaagggagtgtgttggccggaggctggctgcaggcatgggtcctggggtcaggttgggtagggaaggaggtgcagataggagggctggtgggcagggactcagagaaagacattggagaggagccaggagcggctgtgtggtcggaggagagaggagagctggtgaggagtgagccaggctgggggtcacagggccaggacgtagccgtgggaggggctgccgggccactgttgagtgttgactgaagtagggcctgggacgaagaggaaccagagggggctgttgagggccacttgggtgggtgacagagggagctgggagaagggcgcaagttgatggtgagagaagagtgtgcaca

SEQ ID NO: 103037 - DNA, 459 bp, Homo sapiens
tggaagagttttgttttgtttgtttttgtttttgtttttggagagtactatcctgcaaatgtgtgcacatacacatatgtacacacatgcataattcacataatttttgtgtatcaaatacacatcaccatggtacgtggcacccgtgttatatgctactgttttatgagtgtgggagtatggtggaataacagtgggtgagaatttgcatgggtgcctacccacatgattttgcctggactctctaacccttctgcaggtgttgagatgactatatttgttgaagatttagtttgagcctatagaactcaatggatggagttaattggcctgatttccaactcatgacgttaatagtagtaatagctgccatcaactgaaggattatagctgtggccatatatatgtgtgggtttcatatgctatatctatatattactatacatagttatagttatt

SEQ ID NO: 103038 - DNA, 400 bp, Homo sapiens
gtgtgtggggtcaaggagaccctggggctgttcattggacagcactaattcaatgcctaaaaataacctcggacctggtagggcacttcagaaatttccaggctctttcagaccccccacaaactcatttcagtctccaacatcttgtgaggaagttaattccatccttattttaccaccaggagcaccaagttctagagtaaatctgtgaagggctcacagttagttggtggtagagctgaaactggaactctggtctctctggccataggttcagggccacctcctgtggacctactgtgtgcttagccccgtgcagggcctgggcatggaaacggagtgaaggaggcactggctttgctgccaacatggcctgtctgcagggaagaaggccacctga

SEQ ID NO: 103039 - DNA, 463 bp, Homo sapiens
ctccgcctcccagattcaaacaattctcctgcctcagcctcccgagtagctaggattacagccacgcgccaccatgcccggctaattttgtatttttagtagagacagggtttcaccgtgttagccaggatggtctcgatctcctgacctcaggtgatgtccaccttggcatcccaaagtgctaggattacaggcatgagccgctgcgcccgtcccagatcccatctttatttaaaattttgacattttgttcattatggattttttgacattaattttgaatacaatattttaacaattatattacaacaatatttatcatcgttatcattgtggatcaaatagtgacctacccccccaccccccgccgaatccatgtctacccacaacttcagtatgtgaccttatatggaaacagagaattttgcacatgtaattagttaaaatgatatcacaccagatt

SEQ ID NO: 103040 - DNA, 323 bp, Homo sapiens
cagaaaatgagtatgcaggggtgtctcaattttgttttggttccagtttcctcattcctagtgacattgaatatgttttcctctttcatgaattacctgtccctatgtcctttgcccattatttttaaactgggtacttgtttctctcattaattggtagaatcttttttgtagtcttaataggaatcctctgctctatgttctaaatattttctcccatgctgtaagttgtcttttttttttttttttgagatagggtctctctctgtcatgtgatcctggctcactgcaacctctgcctcctgggctcaagctatcctccc

SEQ ID NO: 103041 - DNA, 678 bp, Homo sapiens
taacagtaagttctacagaaattatatgctgaattgaaattgtatttttatccaaaatataagaatctattcaagaaaaggttcacagtggaacaggaaattgatttaaaagatgttttgaaggctcttggaataactgaaattttcatcaaagatgcaaatttgacaggcctctctgataataaggagatttttctttccaaagcaattcacaagtccttcctagaggttaatgaagaaggctcagaagctgctgctgtctcaggaatgattgcaattagtaggatggctgtgctgtatcctcaagttattgtcgaccatccatttttctttcttatcagaaacaggagaactggtacaattctattcatgggacgagtcatgcatcctgaaacaatgaacacaagtggacatgatttcgaagaactttaagttactttatttgaataacaaggaaaacagtaactaagcacattatgtttgcaactggtatatatttaggatttgtgttttacagtatatcttaagataatatttaaaatagttccagataaaaacaatatatgtaaattataagtaacttgtcaaggaatgttatcagtattaagctaatggtcctgttatgtcattgtgtttgtgtgctgttgtttaaaataaaagtacctattgaacatgtga

SEQ ID NO: 103042 - DNA, 1670 bp, Homo sapiens
tccctgtagaagccagaggcgcagtctggactgtagtttcccgggagagacgaaagcaggaacgagagcggagcggagcacagtccgccgagcacaagctccagcatcccgtcaggggttgcaggtgtgtgggaggcttgaaactgttacaatatggctttccttggactcttctctttgctggttctgcaaagtatggctacaggggccactttccctgaggaagccattgctgacttgtcagtgaatatgtataatcgtcttagagccactggtgaagatgaaaatattctcttctctccattgagtattgctcttgcaatgggaatgatggaacttggggcccaaggatctacccagaaagaaatccgccactcaatgggatatgacagcctaaaaaatggtgaagaattttctttcttgaaggagttttcaaacatggtaactgctaaagagagccaatatgtgatgaaaattgccaattccttgtttgtgcaaaatggatttcatgtcaatgaggagtttttgcaaatgatgaaaaaatattttaatgcagcagtaaatcatgtggacttcagtcaaaatgtagccgtggccaactacatcaataagtgggtggagaataacacaaacaatctggtgaaagatttggtatccccaagggattttgatgctgccacttatctggccctcattaatgctgtctatttcaaggggaactggaagtcgcagtttaggcctgaaaatactagaaccttttctttcactaaagatgatgaaagtgaagtccaaattccaatgatgtatcagcaaggagaattttattatggggaatttagtgatggctccaatgaagctggtggtatctaccaagtcctagaaataccatatgaaggagatgaaataagcatgatgctggtgctgtccagacaggaagttcctcttgctactctggagccattagtcaaagcacagctggttgaagaatgggcaaactctgtgaagaagcaaaaagtagaagtatacctgcccaggttcacagtggaacaggaaattgatttaaaagatgttttgaaggctcttggaataactgaaattttcatcaaagatgcaaatttgacaggcctctctgataataaggagatttttctttccaaagcaattcacaagtccttcctagaggttaatgaagaaggctcagaagctgctgctgtctcaggaatgattgcaattagtaggatggctgtgctgtatcctcaagttattgtcgaccatccatttttctttcttatcagaaacaggagaactggtacaattctattcatgggacgagtcatgcatcctgaaacaatgaacacaagtggacatgatttcgaagaactttaagttactttatttgaataacaaggaaaacagtaactaagcacattatgtttgcaactggtatatatttaggatttgtgttttacagtatatcttaagataatatttaaaatagttccagataaaaacaatatatgtaaattataagtaacttgtcaaggaatgttatcagtattaagctaatggtcctgttatgtcattgtgtttgtgtgctgttgtttaaaataaaagtacctattgaacatgtgaaaaaaaaaaaacaccaaaacacataaataaggggggcg

SEQ ID NO: 103043 - DNA, 878 bp, Homo sapiens
tccctgtagaagccagaggcgcagtctggactgtagtttcccgggagagacgaaagcaggaacgagagcggagcggagcacagtccgccgagcacaagctccagcatcccgtcaggggttgcaggtgtgtgggaggcttgaaactgttacaatatggctttccttggactcttctctttgctggttctgcaaagtatggctacaggggccactttccctgaggaagccattgctgacttgtcagtgaatatgtataatcgtcttagagccactggtgaagatgaaaatattctcttctctccattgagtattgctcttgcaatgggaatgatggaacttggggcccaaggatctacccagaaagaaatcacacccggccctcaccggcatatcacagcctattcccgcccaacaatcccctttctctccgcgaacccacaccttgccttgtgatcctcaccatcccctcctgcccaaccttgccccccttctccccccgcccttcgccccatgtgttggtttccctcaagccactgttgaggtgtaggctatgccccgccgcccaccacctaaccacatccccacccccccatgtccccccgcccgacgcgacactcctccccacttcaccaatgaacccgcacccacgccccctgcttccctttctttccctctctcgttcttcttctctcccctccccccgccgtcccaacgccccacacaacaaaggattctccacacctaacttacccgccgttggtgtgagttttatgtagtaggcaacgcgcggtcagcccgccccgggccacccaatacccttccagctcccgtacggccgactcccataacccgccccctcccaatctcccccccccccc

SEQ ID NO: 103044 - DNA, 368 bp, Homo sapiens
ttgtcgaccatccatttttctttcttatcagaaacaggagaactggtaagtttattatgaaaacaaaattttatttaataggtcacaaagaacctcttttttaaatggagatttttttcctcagtactcatcatataatttcttttcacaattttatttatttattctctttccagagattgaccaactgaattatcagatagtttataatgttgaaatgattttttttaatgaaaataaggctggtgaggtggctcagactttaatctcagcacttcaggagttccaggcagggaggatcacttgaggccaggaattcaagaccagcctgggtaacatagtgagaccccatttctacataaataaaa

SEQ ID NO: 103045 - DNA, 369 bp, Homo sapiens
cagtatatcttaagataatatttaaaatagttccagataaaaacaatatatgtaaattataagtaacttgtcaaggaatgttatcagtattaagctaatggtcctgttatgtcattgtgtttgtgtgctgttgtttaaaataaaagtacctattgaacatgtgactagatctatttttttattttagaagttgtagtataaagatatctctaggtgaactttggaaacaatgtttctctacctcttaaatctcttatgcaggatcaaaacatcatagtaaaatagcattataaacttatgcataacaagcaataacaagtgaggtgaagacaggtactccacaaaaattctcactgtaatttcttggaa

SEQ ID NO: 103046 - DNA, 1632 bp, Homo sapiens
tccctgtagaagccagaggcgcagtctggactgtagtttcccgggagagacgaaagcaggaacgagagcggagcggagcacagtccgccgagcacaagctccagcatcccgtcaggggttgcaggtgtgtgggaggcttgaaactgttacaatatggctttccttggactcttctctttgctggttctgcaaagtatggctacaggggccactttccctgaggaagccattgctgacttgtcagtgaatatgtataatcgtcttagagccactggtgaagatgaaaatattctcttctctccattgagtattgctcttgcaatgggaatgatggaacttggggcccaaggatctacccagaaagaaatccgccactcaatgggatatgacagcctaaaaaatggtgaagaattttctttcttgaaggagttttcaaacatggtaactgctaaagagagccaatatgtgatgaaaattgccaattccttgtttgtgcaaaatggatttcatgtcaatgaggagtttttgcaaatgatgaaaaaatattttaatgcagcagtaaatcatgtggacttcagtcaaaatgtagccgtggccaactacatcaataagtgggtggagaataacacaaacaatctggtgaaagatttggtatccccaagggattttgatgctgccacttatctggccctcattaatgctgtctatttcaaggggaactggaagtcgcagtttaggcctgaaaatactagaaccttttctttcactaaagatgatgaaagtgaagtccaaattccaatgatgtatcagcaaggagaattttattatggggaatttagtgatggctccaatgaagctggtggtatctaccaagtcctagaaataccatatgaaggagatgaaataagcatgatgctggtgctgtccagacaggaagttcctcttgctactctggagccattagtcaaagcacagctggttgaagaatgggcaaactctgtgaagaagcaaaaagtagaagtatacctgcccaggttcacagtggaacaggaaattgatttaaaagatgttttgaaggctcttggaataactgaaattttcatcaaagatgcaaatttgacaggcctctctgataataaggagatttttctttccaaagcaattcacaagtccttcctagaggttaatgaagaaggctcagaagctgctgctgtctcaggaatgattgcaattagtaggatggctgtgctgtatcctcaagttattgtcgaccatccatttttctttcttatcagaaacaggagaactggtacaattctattcatgggacgagtcatgcatcctgaaacaatgaacacaagtggacatgatttcgaagaactttaagttactttatttgaataacaaggaaaacagtaactaagcacattatgtttgcaactggtatatatttaggatttgtgttttacagtatatcttaagataatatttaaaatagttccagataaaaacaatatatgtaaattataagtaacttgtcaaggaatgttatcagtattaagctaatggtcctgttatgtcattgtgtttgtgtgctgttgtttaaaataaaagtacctattgaacatgtga

SEQ ID NO: 103047 - DNA, 614 bp, Homo sapiens
ggcttcagagctggcattttcaaccatgacactaagtggccattatcataagcacaccaatataaattaaatttctccatccatccttttcctggcgtgagagtggaagacagagaaactgggggttggctttccctgggggaggcagcctgggtgtggccctgcattgcttaggaagcagcacagaagctgagccccagagattgtggcgggggacctgagaggttatttgttccagctcttgcctttatgggggtaactgaggcccagcatagagaaggaatttgcccaaggtcacatagggagaaaagtggcaatggaggcaggactaggtcccaggccttcagaaagtgctactgctgctgctgctgagaactgatacttgtacagtagttattcggtgccaggactattccacattaacatacttaatcctctatgtgtgaggcagataacattagcatttttgttttaaagaaaatgaggaaactgaggcacagagaagttatgaaacttgcctaaggtcacacagagccagaatttgagcccaggttcaaccaggacactatacgtctgaggcccagggcaagcttcctgtgtgggcggtgacagaa

SEQ ID NO: 103048 - DNA, 110 bp, Homo sapiens
gattaaaggagctaacacttggaagatactcagaatggtcctgatacatagaaagccctccatagatgttatccctgaacattgttgtcactgggagactgttttgcaag

SEQ ID NO: 103049 - DNA, 766 bp, Homo sapiens
aacatcgaatacagacgaggcatgtaagaaaacgatgttttaagaaatatgttttatgctatatcatttcttttactgaaaacaattggacaaacaaacaagaaaagccaaggaaaatgcgaccgggacgtggaatcggcccgtctgtgagtggaaggatcacactcccagctgagatagaaataaagccacgcgtgcctctgtttctatgcgtggtaaaataaacaagcaacacttcgaggaactattgattctgttattaaaacacagcctgtttggtttgccagatcgtagccattattaatgcattattaattctatgtaagtgcctgcttgtcagatccattaaccgggggagtaattgccgagggagagagctcagaaggtgtgtcacgctgctcgctcggtctaggtggaacgaagcggagggaagccacgcggagcaatggaggcagccctgtaaggcagtgtccgtttctgtctgtggccaaaatggccagggatgtttttggccaagctgatgagacagagattggaagaggaaagtttcatactgatacttcggctggctggctgcagagtaacctgcattttgggccatttttggttaaatgtatgaaagcaaacatccacataaaggctgaaatggtttgtcaatgacccagaggctgttcccgggatcttttgagccctgggaacctggaggtacctgcagagctgagcagattgcttccgcatcaaggaaacaagcgggacttgtgagaag

SEQ ID NO: 103050 - DNA, 1201 bp, Homo sapiens
cccgggcagttgtcttctctgcacgattaggaaggagtttgcttttcagaggtgaaagccacacttcctggctgcctttctgctcccaccctgtctgggagccggggcagtgctggaggctggcccaggctcccccagagccacagcactgtgctgtcccgtgcctaggaaagcagatgctggcaggagaaacacataacctgggctcctggggacagccagctgtggctgcctgccacaaaggacacagagggccgtctgcaggggagcagctgtgagggtcagagggacctaccaagagatagtgtcccctccccctctcctccccaggcctggaaggtggcaggagaagaacctgatcagacccttccccagccacaaggtacctgcactggagatctgaactttaaatctgaaattatgataagggcttggctccctaggagactggacaaagtccagctggggatagggatgggagaaaaatgtaactgtttcattttagacccaatcaaatggagactgatcagcaaatgaatcacaccccaaaacaagtcaatttctatttctcagctttttagaatccttttttctagattaatatacaaaatacggtaaggtcttcccctcatccctatgcccagagactgccttcagtccctactgtgcaggtggccactgggccagtgtgttttacacacacacaatgtatttttccttttcctcctaacaaagataacttcatggattgcattcctctgtaccctgataaggatatatatttactttatataattacattgattatttaataggatatcttgacttacgattcccatgagtgcaggaagagattccccattccttgtattaatggttgcagggtagtctatgatactacaaataatgctaagattagcgagaccctgacagatagacacaagtttacatcctaacagtaaagactgaaaacaacctctgatgcaatgaaacacaaggtgtgggtcatccggtgccctgaggtatctgtgtgcaacttcctagatgtggggtgtccagatcagtgtgtacatcttcactttgagaggctgctaaattgccttccatgagggtgtagcaatgtacactcctgccaaaatcgacgtgagaccccaccttcctgtaccatcaccaccactgaattaccaaacttttgataagt

SEQ ID NO: 103051 - DNA, 440 bp, Homo sapiens
gcacaaggcctaccacatgacagccactcaacggatatttactgcataaactcatgattatgaatattttagtacctgacctatgagttattgatacgtaatgggagtaccatgggttgcagaataacacagaccttgtttcccatcccagctccacagctcacatgctatgtgaactcagaaaatgtatggaaactttttaaggctgtttgcaaagctgtaagagcacgaccaaccacttacttcacagggttgccgtgaagactaaaatacacacagcatatgaagtgccaagagtgctgtattattttatatttttcaaaatgcagtgctacaaacttctttatcactatgtcaattaatgctactgctgccttaacccacaggccatcagatacatttttaaagttctttatgtgagcattattcaaggaaaagcc

SEQ ID NO: 103052 - DNA, 452 bp, Homo sapiens
gtgtgtgtgtgagagagagagagtgtgtctgtgtgtgtgtgtatgtgtgtctccctcatgcacctatgtttcccaacaccacaaggggtggtcatagtctgcagcctctagacctgaacctcctcacaacccaaaagctcaagacccaggccttcaatcagtaggatgtgaactttgaccttgaggccatgcggacatgggcccgaggtcccttgcctaacagccaccaagcctggcatgagcacacactcctcctcacagggcatctgatgttgtgaccagacactctctctggctgccctctcaggtgaggcacatgtggtggaaaaccaactacaaccagcactggagggcaccatcgcaaagtccagcacctcagtttgaaactcagtgtcaaggccagaggcagtcttcccaacctagccaaacaatctcaagacacgggcttcctc

SEQ ID NO: 103053 - DNA, 658 bp, Homo sapiens
taaattgccatttaattccatccatcaacccatttttctgctgtatacatagaaaaggacaacagccactccctcaaccaaatatccctacattcagttaaaagctactctgtaccccaggacatgggagcagctcctatccttcccaggtgaaaaagtgggctttttttcccccttaaggctaaataggatttcttttctgttagctatgggtaggtgacttcttaatgatctttaaggaaagaagtcaatacaaggaaaatatccttttttaatcccattttccttctcaccccacactgagcgttactatagcaacatctttcctgctactaggacagttaagtccccctgtgaagttaaccgaaagctgctttttcactcagagaatgggctgctgttcattgaccagcttttcctgcgtgtctaaattcttcggttctctctgacatgctcaatctagggtttcccgcggctaaaccctaaaattcacttcgaaactcctaacagcagaattccccaaaccttttcagaactgaactcattagaaatgaatttacattttgatttagttataaataacttttcttctgtgtattggtttaagtttagaaaaggccccctgtaaagaagacaagttggagaataatctcccata

SEQ ID NO: 103054 - DNA, 216 bp, Homo sapiens
aacggatgtggcatggggcgggggaccaggccggaggcgggctgccgggaggggggattccctcgtgccccaagggcgaatctcaggtcggaggaaggggctgaggggattccctctcccaccgggtccgactcttcgctccccaagccgcggagggccagcctcttcttcggcgccctccaggcctgttggaggtgagggaggtggggtgaggtg

SEQ ID NO: 103055 - DNA, 488 bp, Homo sapiens
caggtacctgatgcctaaaagaaaaagaacagagtacctctgaggctttatgttgtctactgacttatggattttgaatggatgaaaaaggccttgctttgccatgctgttttgatttatgggagtttatcctcataaatggtatgaagatatttttccagatcattactcagttttatcaacaccatttattgaaagtccaacctaatctcctggatttcaaatactcaacatgtacagatttttctttgtttttattccttaaacaatatggtataacaactatttatataacatttatattgtattagatattataagtaatctaaaaatatttaaaatatatgggaggatgtgcatagtttatatgcaaatactatgacattttgtatcagggacttgagtctgtggattttagtgttcatgggagtgagatgtgggcaggagtttggggggtggttcctggaaccaatccctgacagatactg

SEQ ID NO: 103056 - DNA, 805 bp, Homo sapiens
tttcagaaaaaaagagcaaaactgcagtcatattttcattagaaaatgacattgagattgctatcacccaaaacttaaagggtgtaatcaattctatatcccgaagtaaaattttgtggtcttacattaatatgatggtaatgaagaacagcactctagaatctgacagattcggggtcagttattagctctcccaattttattactgggcaaagttatcagtgtcttcgtttgtaaaataaggacagttatatgtaccttcttgagtgataaggggtcattgagataatgcatgtcaaacacttagaactgggcctgaagtaagtgccaaataaatggtaactatgtatataattattatctgagcacttggctatagaaattggtggagcttaagaaaagcagaaaaagggatttaaagataaattaatgaaatggaaatagaactacagtgatataactatattgtaagtaaatgcaaatacaatttttaaagtgggaaataaaagaaaaatctacataacattaggtttgagaaagtgtattgttacaggaatgaaaagaaattaaaaaatttaaaaccgtttaaaaaattaacttgaatgtgatgggttgatttctaagaaaacaaaaataatttcacacaagaagcagaaaactttaataggtcaataacttgaaaaatggaaaaagcttactttgcaccacctctaaaaaaagctttaaagtggtcttgaacactaaaaaaagatggaaggaaagctcagctcattctgtagtagcaggaaaaaccagatggcaaaac

SEQ ID NO: 103057 - DNA, 320 bp, Homo sapiens
aagtcgacttaaaaaattaaaaaatgttaaggctgagagaattttgagaccttaatacaaggtagtatattgtatcaggcttgttctgtgcctaggcttaattaccagatttctgtgcttctggacttataatgtatagttgtcgttttaatgctaacattctgattggatacgtccagcacttcacttgggtaaatcacaatctttctttcctccctcacaaaggacactttgaaatgatcctaaaataccttcttattcagatagatagaacagctagtggtagaggccctaacaaaaaaaaaaaaaagaaagaaaag

SEQ ID NO: 103058 - DNA, 383 bp, Homo sapiens
attgttttagtgttcatctatgaaagatctttaaaaaaccttgtctcttctggggaattacttcaaatctttgaaacctagcttcatatgcataagagtatttcttagttgtcttagttttcctttaaaataagcaacaattttgaatggtcctaatcaactctgtgtggggtttgagtattaaatagttctctggaaatgatatttttcccaggcattttgcctgttctgttgtattaaagactatgatttgaaccacatttagaaaagtatagaccatcgatttctaggttggtgactgatggacatttcactctttcttagcaagtgatgcgagggtcctttcaaccctgtccaagagctttgcttgaatgagcacaata

SEQ ID NO: 103059 - DNA, 435 bp, Homo sapiens
ttccctattgcaatcagatcaggaagttataaaatctattattttctaagaatagtgtttgaagttgtcaggagggtccagatgtgacttccaattatttattgtctaacttgcctaattcttcttcaccaacaaccattcaccatattaagacatttttagcattcaaagggacacattagcttgctgctcagcaagatgatgagaaaaaaagctagcatttttatgcaaacttgttcatgtgtaatatttgacaagcatcattgagtgcctctacgtgctcatgcatctatgtgacagtatgcaaagggttgtggatacaaagatgcagaataaataatcttttattcttgtttgtcttctagtgtcatagtaaagtaaaatatggcattgggccagagacaggacattggatgggcacttcagagcacactg

SEQ ID NO: 103060 - DNA, 141 bp, Homo sapiens
gtcatcttgaggcaaggcacactcagtctaaacaacagcagaacagcctggtccttcaagcctcacatcatcctgacccaccttctgcagagcctacctggaggaatggagggaaaggcagcctggaggtctcagatgcag

SEQ ID NO: 103061 - DNA, 296 bp, Homo sapiens
ctaaaaatacaaaaattagccaggcatggtgacgcatgcctgtaatcccagctactcagaaggctgaggcagaagaatcacttgaacctgggaggcggaggttgcagtaaactgagattgtgccactgtactccagcctgggtgacacagcatctaaaaaagaaaccaatccaaaaactacaaaatattcttgcaattataggtgacatatttaaatggtaagacaaccaatgttcatgaatggaaagacagagcaagaccctgtctcaagaaaaaaaaaaaaaaaaaaaaaaaaa

SEQ ID NO: 103062 - DNA, 372 bp, Homo sapiens
ttgagataagatactttgttcatataaataggtagatggaaggaggagtattatatcagtaccactcaagtctttcaatttcttctgaattaaatacctaagaatcatacaaagatttattatacaaaattatttttaatgatgtgtttggaaacaacttaattagatctttctttaataatctagccattacagtcagtttctctcttatcaccaatccatgtatttctaataatttgtgtttggcctctggaaagttttcactcttgagcaaaatactgtagtaaaatcccagaatgagaaatattattttcttggtaaagtgagagaagtaaagttgtaaaaagagaggagatggccgggcacggtggc

SEQ ID NO: 103063 - DNA, 1377 bp, Homo sapiens
cggccgcggctcgggacactccctggaggcccagcggccccaagacccgcggcgcgcgcttccggccccggcgcgccaggccgaagttcccgtggcgccgcgtgggccggtgcatggcgctgggcccgggcggctgccgggacgtcgccgcttcccagggcggcgccggcgcgagaccgcggggacgcgaagcagcgaggtctcggctttccgcctgctttaagccacgcggaaactgctgcacccttgactgcactcgttcagctgttcaggcgtcgcgattcgtaaatataagaaatttcccgctctcttccacggcttcccagaacgctgtgtcgctaacaaccagtgaagacccaagggctagggtgcagttctggtagccgggcaggaaaccagggccagatttgctcaccctaaaaacgaagtgtgagggcttccagtggctggctctgcttggagcccagagacattttcatccaatctgtattttagcgcctcgtatcagccaggctaaaggctgaaagagatttgctactgaacctctcttaagtctccctgcatcgcctcgtacataatacaagtgaggtgtactggggactgcggtaactttcttgcctctgtcaccccgtctttgctgacacccagttccatcagttctttgctttcagatggtaatgttgattcctaattccctgtgaacctgcagagataatcgccttaggtcttacttctgtagttctaggtaaatccattcgatggcttgtttaccttgatttgtgaatgagtagaagtcactacccatatatatttttttgattggagatagtgttttactgatttaaattggtagccccataatcctcaagtctgctctctggattgtgaaatactcaggttctcacgtgactgtgggtgatttcctggtgactaaatacagccttacctttcccaggccactcccccaggctctaggtgtcacgtcttaggtcatgatttcacttgtatttctccctgtataatggacacaattactagcattgcgcattggatgccacagaatctctgctgtcaacagctgatcattatagagaaataaaaagtgaaaggaagggccggcgcggtggctcacgcctgtaatcccagcactttgggaggccgaggcgggcggatcacctgaggtcaggagttccagactaacctggccaacatggtgaaaccctgtctctactaaaaatacaaaaattagccgggcgtggtggcgggcacctgtaattccagctactcgggaggctgaggcaggagaatcgctttaacccaggaggcagaggttgcaatgagcggagattgcgcccattgcaccacagcctggacaag

SEQ ID NO: 103064 - DNA, 582 bp, Homo sapiens
agtttgacctgtcaaccgtttatagacaaatatatcaatttaaaacttacacagcagaagaaaccatgagcaagtctgctctctggattgtgaaatactcaggttctcacgtgactgtgggtgatttcctggtgactaaatacagccttacctttcccaggccactcccccaggctctaggtgtcacgtcttaggtcatgatttcacttgtatttctccctgtataatggacacaattactagcattgcgcattggatgccacagaatctctgctgtcaacagctgatcattatagagaaataaaaagtgaaaggaagggccggcgcggtggctcacgcctgtaatcccagcactttgggaggccgaggcgggcggatcacctgaggtcaggagttccagactaacctggccaacatggtgaaaccctgtctctactaaaaatacaaaaattagccgggcgtggtggcgggcacctgtaattccagctactcgggaggctgaggcaggagaatcgctttaacccaggaggcagaggttgcaatgagcggagattgcgcccattgcaccacagcctggacaag

SEQ ID NO: 103065 - DNA, 1176 bp, Homo sapiens
cggccgcggctcgggacactccctggaggcccagcggccccaagacccgcggcgcgcgcttccggccccggcgcgccaggccgaagttcccgtggcgccgcgtgggccggtgcatggcgctgggcccgggcggctgccgggacgtcgccgcttcccagggcggcgccggcgcgagaccgcggggacgcgaagcagcgaggtctcggctttccgcctgctttaagccacgcggaaactgctgcacccttgactgcactcgttcagctgttcaggcgtcgcgattcgtaaatataagaaatttcccgctctcttccacggcttcccagaacgctgtgtcgctaacaaccagtgaagacccaagggctagggtgcagttctggtagccgggcaggaaaccagggccagatttgctcaccctaaaaacgaagtgtgagggcttccagtggctggctctgcttggagcccagagacattttcatccaatctgtattttagcgcctcgtatcagccaggctaaaggctgaaagagatttgctactgaacctctcttaagtctccctgcatcgcctcgtacataatacaagtgaggtgtactggggactgcggtaactttcttgcctctgtcaccccgtctttgctgacacccagttccatcagttctttgctttcagatggtaatgttgattcctaattccctgtgaacctgcagagataatcgccttaggtcttacttctgtagttctagggacagagcagaatgggctgatcatagatccgcgtgccgcaaacatgttgtgcgcgactccccggggtccagactactttataggtgccgacattctcagcatgtttattagcatagtcgaggatgtgactgtaacgtgtatgaacacaacgtgacaacgcttagacatacctgggaatgcttggattaacgacgcaaatatagagggggaaattcggggggaatgtgtgcggacgtaaagtggagtagtagtgtgggtgatgacttgggcattattgagaggacaaatacgatatggtcgaaagcagcattatggggatgaacgcagtgagaaagatgtgatcacgagacaacatgacggacagccaaaaaataagagaggtggcatgaagagagacgcaatctagtcgtgtcgtattacagtagttggg

SEQ ID NO: 103066 - DNA, 454 bp, Homo sapiens
aaggttgagtgcacacgtgtacgtgtgtgtgtgtgtgtgtgtacagtccatgaaaatatactttcccacatggttattaatctttaagagggtgccaagtgacatctcacaaaatgtattctcctctgcactatgcagtattcaagaaaatgacatgagctttgtacaatcttatgattttattgttagaggtcatgttaaactaagaaaatagtaatttcagctcaaatgtgagttaaatcatcaagttaaagtaaagctttttattaagtgaagctctctctgcagaatatctcacttaatatacataacatttaaatagactactaaaaaagtgacagctgaggaatgctttcacttctttccatggtttctactgaatgtcatttcagaaatgcctatacaacacatgacaatgtggaatgtctcctcccatgaaagagcatttgagttg

SEQ ID NO: 103067 - DNA, 259 bp, Homo sapiens
gagaccagcctggccaacatggtgaaattccatctctactaaaaacacaaaaattagctgagtgtggtggcacgcctctgtaatcctagctgttcaggagactgagcacaagaatcgcttgaacctgggagatggaggttgcagtgacccgagaacactcctctgccttccagcctgggtggcagggcaagactgtctccaaaaaaaaaaatagttggctgtaaatatgtcaattaatgtccaggttctctattctgtt

SEQ ID NO: 103068 - DNA, 281 bp, Homo sapiens
catgggctggggacctcctatctgccagcaataggcttacagagggtctatgaatggggcagcttaaagtacacatatagacaactgccttcctctctaaagacaagacaggaagccttccaaatgcttccctggtcttctaggcagagtgctggcccagcagcaagaacccgtatcttcaaagcaccagttacagatggggagtgtagtggacatgctgacattttttgcctgccagaatccattacccttctttctggtaaaagttcctctattttcct

SEQ ID NO: 103069 - DNA, 313 bp, Homo sapiens
cataaaaatataaacaaaaagagtaagagtagctgtaattctatcagatgaaatagattttaagccaaaaatggccacgagacaaagaaagtcaacatatggtgacaaaagggtcaatttttcaaaaagatataacaattggaaatacatatttcagagcacttaaaaatataaaacagatagtaacaaaactgaaacgagaaatagagaaaatataataacagtaggaaattttaatacctcaatacaaataatgcatagatcatccattcagtcagttaataaagaaacagcagtttgaacaacatgttag

SEQ ID NO: 103070 - DNA, 189 bp, Homo sapiens
tgccagttcccttgttcctctcatctgtggcagatggagtaacatagatcttatccctattttatatctgaggaaagtgaggcccagaggaggtaactgcaaaggaccatgatgagcatccaggaatctccattcccaggtcatttcccatcaccaaagcaggaaggatgaggtctaaagctgctctgc

SEQ ID NO: 103071 - DNA, 491 bp, Homo sapiens
gctagggaggcctcacaatcatggaggaaggcgaatgaggagcaaagtcacatcttacatggtggcaggcaagagtgtgtgcagggaaactcccctttataaaacgatcagatttcatgggacttattcactatcatgagaacagcatgggaaagacccacccccatcatacagttacctcccactgggtcccttccatgacatgtgggaaatatgggagctacaattcaagatgagatttgggtagggacatagtcaaaccatatcaagaccaaagcaacaaacataatcaagggtcttagggagagactaaagaagataatacattagtgaaacaaggatataatagaaaaagagggaacgatcagagaacaagaaaggacgtcttgaaaaataaaaatgttagccaaaattgaaaacaaattaaaaattaagagataaagtatttttttaaagaagtataggataccacttgaaaaaaatagaactta

SEQ ID NO: 103072 - DNA, 385 bp, Homo sapiens
gattttgtcccacttaatatatggcttcataatctgaatgatcttgggaaaactgggataactcatcttgcacactacacactaacagggaattattaaaggtagtaacctaaattggatccataaatacatcggtatcacgcagcaaatttttttctgctaggtaggagaacttacatacttgtattgttattggactctaatgacaacaaggtgagaaacgaagtcaacataatttaggaggctcctctccctcactccggaaatacacatggatttcacaattctcgctatgttctatggaaatccaagacaaacattgttgtgtattcacacacacatgagatattcccacttcagagataacataaacatagaggcaaag

SEQ ID NO: 103073 - DNA, 153 bp, Homo sapiens
gatccactgaaagcgaagtgtttttgccaccaagtgcacaggtgagcagtggagaagagaagctggtccaggtctgggtgcaattatctgaagggcgtgacaaactggcagatggcctggccgcatctgtgtgtgtgtgtgcgtgtgtgtgtg

SEQ ID NO: 103074 - DNA, 241 bp, Homo sapiens
aaaaggacaaaattttccttgttagaaacaatgttataaaagtgaaactctggaaactgaatacttaattctatattcaaaataatactgaaatcccaagaaataccaaacactgacacagttgtcatcacaatgagtactaccacaacaactgctacagcaaatacattatttccttgaacaaattgggtatattttctcaaacacaagaccacagtagtcatagccaccaagttaaagg

SEQ ID NO: 103075 - DNA, 119 bp, Homo sapiens
gttctgcccacggggaagattgtgacatatcgatgggtaaaacaccaaaatgattttactcttttgtctttgttctgtccttagaaggcattgggacatattgctgaaccagcaccaag

SEQ ID NO: 103076 - DNA, 530 bp, Homo sapiens
gccaaaagcgaagaaggaagctcctgccccttctaaagccgaagacaaagcgaaggctttaaaggccaaaaaggcaatgttgaaaggtgtccacagccacaaaaaaaagaagatccgcacgtcacccaccttccggcggcccaagacactgcgactccggaggcagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaagaaggcatatgttctgactggctcctgattacgatgctttggatgttgccaacaaaattgggatcatctaaactgagtccagctgcctatttgaatatatatatatatcttttcaccataaaaaaagaagaaag

SEQ ID NO: 103077 - DNA, 222 bp, Homo sapiens
  misc_feature (19)..(19): n is a, c, g, or t
ctcaactgtcgggaggttnatgactctcccctgggctcacccgaagtagttcgcggcacgtagccctcctggcctaatatcatgtccccttaccagaggcagatcacaacttctaactggtcaattcaggaatgtaaaagcccaacccccttgaccccaggcagaacagttatgaagaaccatctcactccagagctccttgtagaatccaggcctctattg

SEQ ID NO: 103078 - DNA, 439 bp, Homo sapiens
ttctgaagtcaaggagagaagtccagtctagcaactatgaggctagggcagggatatgatgttgaatactattacgtgggaatgaaggattgggaccattacttcagtctaccacgtgtgctatagagggacagttgaatgtaggggcttgaggatacttttctgaagatctttcatgtatcaagagtattctgagatgatattctgtatggtatcagactacacgtttcaaagcagagtagtttttggtcattctgaaaaactgtagaggaaagttaactttgcagtatcccttacttgatatttagggtttcctttttttaatctggtcactcttctgttagctttgaaacataggcctctccaaattcattccagccgggtcatgtgacttccgtgttaaacgaagacatgtaaaactcatttctttgggaaatgg

SEQ ID NO: 103079 - DNA, 212 bp, Homo sapiens
tgctcaaacacacagtagtgccttctagagaaagcatagtatagtcctccctcatttccaaggacaagaattcatttctttaagctttcttcacgaaagaatgcaataaaagaggaggaaactgggacttgattgaagaaatatctctactgggagcatgaactaataatgagtgactctaagaaatctctcacaggcatttttatttttgg

SEQ ID NO: 103080 - DNA, 430 bp, Homo sapiens
gcacgagaaagaccacagttgtacttatgggggactggggttgaggcatggctgatgccacagcagttcattcctaaaatcaagtgagagaagcaagaggaaagcatgacctcagaacctaaaaccaaggtctcactgacagtagttcaagtgttcttcaaagataaagatgagattttatgtattcttgtctttcagagcaagcaaactgccttttttaaattgtctaaatgaacacattggtgtgttgatcagatgagagctaggttagaaatccaagaccctgggggccgggcgcggtggcttacatctgtaatcccagcactttgggaggctgaggcaggcagatcacgaggtcaggagatcgagaccatcctggctaacacagtgaaaacccgtctctactaaaattacaaaaaaaaaaaaaaaa

SEQ ID NO: 103081 - DNA, 212 bp, Homo sapiens
gggtggcagaggctaaagaaagcctacatgtaagtggaattgcacggttcaaacccatgttgttcaagggtcaactgtacgctgagtataaagccttattacctagtaaacagaggcttctgaaggctagtcatgaaatagttggcattcattccctctcaccactccctatacgtgccttcttgtacgtcaagggcaggaatgctttattt

SEQ ID NO: 103082 - DNA, 608 bp, Homo sapiens
accataattatcttgatatattataacaacaaaaattttgtttcaagagagcaatttactgctgttttcagtagtatcagtaaaactgtattataaacatgaacattttaaacatatatccccctgtttagtggaggatacccaaaagtggtaacacaggaagaaggaatggaatatatctacacaggttataacaacaatactcgtttgttcagtttctataaatacaaaggtgaagaccagatggttgtacacagcatcatctagaacctgcaggtctatagttggagaaagcccatattgcaggtcaccagacaccctaccagtacaagattgggcccttggctgtctggcagtactaacaatcaaactcaactataatgatcagaaggttttaatctaatggaggtgagatcacagtttagtgcagtttttttttcagtgccttcatttaaatatataaatgggttgcccaaatagtcaccctggctaaatgctgctaaataaattagtgctccttcttatccttctatgaaaagaaaactgaaatcaaatgttaagatctttaatatgatcaggtttctgtgacatagcttcaccttaaatat

SEQ ID NO: 103083 - DNA, 343 bp, Homo sapiens
tgttgcatattttttggtggagatggggtttcaccacattgtccaggctcagatttttttgttttgttttggtgtttccatgtccactgtcatctcagctgcaaaacaccaaagtcagaaggaatgttaatctcccaagtttttttgttgtttttgttttgttttttgagacagtcttcactctgtcacccaggctggagtgcagtggcacgatttcaactcattgcaacctctgcctccagagtagctgggattacaggcgcatgccaccatgcccagctaatttttgtatttttagcagagatggggtttcaccatgttggccaggctggtctggagctcc

SEQ ID NO: 103084 - DNA, 713 bp, Homo sapiens
acctcagaagggctgtgtccaccatggctcctgtcctcctgctgctcctctctcacttcccagaatgtttctgaagtctcaggaatgctgaaaacaaaaacaaaaacctcctgatacactgcggtgttgcccggttatctagatgagcaaaactcagagcctgtggagttgacttttttattattattattttttggaagaagagaaatgagcctttcctagttttcttttcggccagaggccggagaccattcaagcaggtagacagtcgctacagcatggactactgtctttgagggatcagagcagaaacctccttgtccctctccagtcacctccctccaaccccgatcatctgtgcttggggctgcctgaggctccccgtgacccagggatgaggcactaaggtgtgaaatgagtgaggacacaggtcccaggggagttccagcgaagatgtggccagagtcactcacaggcgaagacacaacctgaagtctgcagtctgccacacagaagacagtcctcaccagggcccaaccaggctggcaccctgatatccgacttccagcctccagaactgggagaaatacaattctgtctgccctggggatgagctccccaggctatggctctttgctctaacagcctgaactagcatagaagtgctatcccatcatctgggttgtattctattcagaaaggcgtcactaacc

SEQ ID NO: 103085 - DNA, 474 bp, Homo sapiens
tgctctcaaactcctgggctcaggcaatcctctcaccttgacctcccaaagtgctgagattctaggctttagccaccatgcctgatcgtatgtttacatgttgaaattctaaccctcaatctcatggtatcaggaggtgggaggtaatgaggtcctgagggtggagcccgcatgaatgggattgctggcttattaaaaggaaccccagagagctctcttctccctctctctgccaggcgaagacacaacctgaagtctgcagtctgccacacagaagacagtcctcaccagggcccaaccaggctggcaccctgatatccgacttccagcctccagaactgggagaaatacaattctgtctgccctggggatgagctccccaggctatggctctttgctctaacagcctgaactagcatagaagtgctatcccatcatctgggttgtattctattcagaaaggcgtcactaacc

SEQ ID NO: 103086 - DNA, 715 bp, Homo sapiens
atatacaaacttcacaggaaagcactttctggctcaaaaaatactctcttctcaattctccatagaatgtttctgaagtctcaggaatgctgaaaacaaaaacaaaaacctcctgatacactgcggtgttgcccggttatctagatgagcaaaactcagagcctgtggagttgacttttttattattattattttttggaagaagagaaatgagcctttcctagttttcttttcggccagaggccggagaccattcaagcaggtagacagtcgctacagcatggactactgtctttgagggatcagagcagaaacctccttgtccctctccagtcacctccctccaaccccgatcatctgtgcttggggctgcctgaggctccccgtgacccagggatgaggcactaaggtgtgaaatgagtgaggacacaggtcccaggggagttccagcgaagatgtggccagagtcactcacaggcgaagacacaacctgaagtctgcagtctgccacacagaagacagtcctcaccagggcccaaccaggctggcaccctgatatccgacttccagcctccagaactgggagaaatacaattctgtctgccctggggatgagctccccaggctatggctctttgctctaacagcctgaactagcatagaagtgctatcccatcatctgggttgtattctattcagaaaggcgtcactaacc

SEQ ID NO: 103087 - DNA, 582 bp, Homo sapiens
tgagacagggtcttgctctgttgcccaggctagagtgcagtggtgacatcatagctcacctgggctcaagcaatcctgccatctctgccacctgagtagttgggactacaggtgcaccccacacccggctaatttttaaaaattattttagagatagggtcttgctatgttgcccaggctggtggcaaacttctggcctcaagtgatcccccgacctcagcctcccaaagcattgggattacaggttgaattactatgccctgcctggtttccttgctattccattaacatgccagatgactttcacatcagggggtttgcatttggctggtatatagagaatgaattagaaagatgtaagtccaaagtcagagaaaccatttggggccggggaagagcaataatcaaggttaaagatgattagcaactgaattacggctatggccaggggaatcaagaaaagtagacagattgagagagatttagaaggaaaaaaattactagaacttggtgactgcttggatatggtaaccaaaggagaatggagacgcaagataattcccaggtttctgccttgggtag

SEQ ID NO: 103088 - DNA, 286 bp, Homo sapiens
taaagtttcttgaatatttttcaaatgtatgaatatttccccagaaaaaacacacactcttcatatatatttcacaacacagtaaagtgctaaaatcctgaaacaaactaaactttcttctgaatatgtatgatcttgttatagcagaaatgcacagtgatatatatcttacttacatttagtttcaggactatatttgctttctttttcgaggtcatttaatcctttataaataatatagttcattataagagtatgttagaggcttagaggcagatttaaatga

SEQ ID NO: 103089 - DNA, 160 bp, Homo sapiens
tccatggattcccactggtcattctattacattcttctattgtccctctcctactcttccccattaacatacagtgaaagttaagatttaaaaaaatgaggcctggcgcagtggctcatgcctgtaatcccagcactttgggaggccgaagtggccggat

SEQ ID NO: 103090 - DNA, 247 bp, Homo sapiens
gcccgctctcccctgtctctgtcccactttctgcctctgttcctccccggctctgccctctccccgcactgtcccccctcgccctcctccgcggccatgccccagacggcgggaaggcggccgggcgtccggccgggctgggcctgggcttggcggctgggccggcgtggggagcggcagctgtttgccattagcccgggatcccacaggccccgccccctctctgcacggggcggggtccttctcg

SEQ ID NO: 103091 - DNA, 428 bp, Homo sapiens
ttttggtgtttctgcagttgtggcgcgcgcctgaggttccagctactcgggaggctgaggcgggaggattgcttgagcctggggagttgagaccagcctgggcaacatagcgaaaccccgcctcagaaaaagagagggagagaggaaagcagtggagttattggtcaaagagtatgtcagttttctttccagaaaggttttgtgtctgcattccagcaggaactccctgtgcctgcccctaccactatcttgtttaatttttgccaattcagtgactttgtaaacatatgttttaatttgcttttctttgcttactggtaaagcttaactttttagtttatttactgtccatttgtacgtcttcttttgggaattctctgtgggtatcatttactatggacattttcttagatgtggtctcagttttc

SEQ ID NO: 103092 - DNA, 799 bp, Homo sapiens
tgttccatgcatatacattaactttaatcttcacaatggtcctgtgaggtagatattattatccctattttatggataagaaaactgaggctcaggaaggcagagtaacttgcctaaagtcacacagcataagtagcaaagctgagttttgagcctgcgttgcctgactccaaagtctggatccttcccatgagaatgtctgcctctcacattcaactccaatacacacatctaagactagtgcataagctgatagctgttaacattttcccccacagaaaatgcagctgaaccaagcctgcctatcttgtctatgagcagctgattctttgaatctaaagaattgatacaggacttgatacatgtggaataacagaaagaacctggaccgtggagtgagacaggcttagacttgagttctggctacacacttggctgtgccaactcaaggcggctaccttgacattataaggctgattttcttcaactgtaaaatgtcgatgtaggattacatgataacacatgcaaagcctctggtagaacactcagggcagcactgctcatgcttcttagttgccttcccctgatctggagtgtcaattaatcttggtttgagttcctcttgcccaccagtgcactttggtcccccattcagtcatgtagcaaggggctattcctccagctgttcttgagtaagcatggcacctcacattcatatagaatggttactaatagtcatccaagttattgagaaaaatattgaccacaatgtaccactctcccactccactttttccta

SEQ ID NO: 103093 - DNA, 928 bp, Homo sapiens
agcggcttttgaagacgcccccgagggcgctgccagcaggaggcagagctgctgcgagaagaagacccaggagatctggggcagcgagctgtgcgtctgacagcgcaggtccagcagcgtgggccccaggaaggcgatgcacaggccgaagctgaagaagacgctccagtagggtctggctctgtaacccaggcttgaatgcagtggcatgatgggtgcaatcttgttacctgttactggtctcttcaggttttctttttggctcaatcttgagatggaggctcgttttgttgcccaggctggagtgcagtggctattcacaggcacaatcatcatacactgtagcctagaactcctggcctcaagcgattttcctgtctcagcctacaaagttgctggaactctagaaaatgcagctgaaccaagcctgcctatcttgtctatgagcagctgattctttgaatctaaagaattgatacaggacttgatacatgtggaataacagaaagaacctggaccgtggagtgagacaggcttagacttgagttctggctacacacttggctgtgccaactcaaggcggctaccttgacattataaggctgattttcttcaactgtaaaatgtcgatgtaggattacatgataacacatgcaaagcctctggtagaacactcagggcagcactgctcatgcttcttagttgccttcccctgatctggagtgtcaattaatcttggtttgagttcctcttgcccaccagtgcactttggtcccccattcagtcatgtagcaaggggctattcctccagctgttcttgagtaagcatggcacctcacattcatatagaatggttactaatagtcatccaagttattgagaaaaatattgaccacaatgtaccactctcccactccactttttccta

SEQ ID NO: 103094 - DNA, 740 bp, Homo sapiens
agcggcttttgaagacgcccccgagggcgctgccagcaggaggcagagctgctgcgagaagaagacccaggagatctggggcagcgagctgtgcgtctgacagcgcaggtccagcagcgtgggccccaggaaggcgatgcacaggccgaagctgaagaagacgctccagtagggtctggctctgtaacccaggcttgaatgcagtggcatgatgggtgcaatcttgttacctgttactggtctcttcaggttttctttttggctcaatcttgagatggaggctcgttttgttgcccaggctggagtgcagtggctattcacaggcacaatcatcatacactgtagcctagaactcctggcctcaagcgattttcctgtctcagcctacaaagttgctggaactctagatggagtctctctctgttgcccaggctagagtgcagtggaacgatcttggctcactgcaacctctgcctcccgggttcaagcaattctcctgcctcagcctcctgaatagctgggattacatacgtgcaccatcacgtccagctaatttttgtatttttagtacagatggggtttcaccatgttggccaggctggtctgaactccagacctcaagtgatccacatgccttggcctcccaaagtgctggaattacaggtgtgaaccaccatgcccaacctagccagcctgattttttaatatttgttgggatttattttgtggcctaacatatg

SEQ ID NO: 103095 - DNA, 199 bp, Homo sapiens
aagcaggccctggccagagcagggacctcagagcctttcccggcagagggaacgcaatcaaagctggcgctgcttccgggaggagagaattcccaaaaggctctgtcagcccctctgatagggatctgcagggtgtgtgagagatttgtttttcagccaggatgtggggagttaaaaatagacaccctaatcccttgag

SEQ ID NO: 103096 - DNA, 178 bp, Homo sapiens
tgagattctttttctctgagccatgactgccttttagattagtgcaaatgatttctaaaagcttcctgccaatttgtgtccaaagagagtcataggcaagtaaagacctgttaagaaggtgtttaatggccaggcatggcagctcacacctgtaatcccggcactttgggaggccaag

SEQ ID NO: 103097 - DNA, 1578 bp, Homo sapiens
aaattctctcagaagctagtggtgaaacagaagaaaagcatcacatgcgtcccacttgctgttgcctttttgtctaaggcagtggttatcgtgaattcctcagggtagcaagtcatttggttcactaggacataaaaaatagaatttatccaaagttaatgggctgtttggtggtctctatgtgtgaaatgagattgtccaggagaagaggatagtcagggaatgagtcaatttaattttaaaataacttgataattctgtgaattctccaaatatcctcaaaaccaaagaaaaagcaaatatgaaaggtgtaatttatagtagtcaattggtatcaatagagtcttctgtttttgtgccatgaataatttatcattgtcacatgtattcaatagaccattctgcataacaatagaaatgtcagtgaatttttaaagccataatcttgttcactcttagaagtaaaaaaaagagaaaatgcattcttattgtattaaacatctgataacacattctgaatgtggagactgagatgtctgaaggctgccttttgaaccagtagttttaccccatgaaacatcactgtgttctttctgcacaaccagttcaaaagatctcttttcttcgcaggttaccagccagtcttgtctggtcaacagggattccaaggcctaataggagtgcagcagccacctcagagtcagaacgtgataaataaccaacaaggaactccggtgcaaagcgtgatggtttcctacccaacaatgtcttcttatcaggtgccaatgacccagggttctcaaggactgccccagcagtcataccaacagccaatcatgctacctaaccaggcaggtcaagggtcactcccagccactggaatgcctgtttactgtaatgtcacaccgcccacccctcagaacaaccttaggctgattggcccacactgcccctccagcactgtcccagtgatgtcagctagctgcagaacaaactgtgcaagtatgagcaatgctggttggcaggtcaaattctgagagctctggctgtggtacatttcttcagatatttctcatggcctttgatggaagaggaacaaggtgggaaaactggctgaggacttaagtattcactcaacactcaaatgattgctgctggtattctgtaaaaaataaacaaagactaatatacacgttagctggttaatggtgcatatttctgtcatgtctgctaggtatgcctttatagcttagctagtgacatgaattcatcaaggtaagattttctcctaccactgaataccactgtgtagattataatatccctaatttggattagttttgtactttgtgttgagtttgtgatgctaaaagtatttaaaaattatatactaaatcacattgtaccaaagctgtaatggaaaagcaaagaagaattgatgaattgaaggaataatttatatacattatagagttttcttttttaatggatatatactgtattgtagtgtttaatcaaaataaaactatttgaccttatggaggaaggtcatgtttttaccaccagtttggttcacta

SEQ ID NO: 103098 - DNA, 988 bp, Homo sapiens
gtctaaggtaacctgactctcttaataaccaccgctacaggttaccagccagtcttgtctggtcaacagggattccaaggcctaataggagtgcagcagccacctcagagtcagaacgtgataaataaccaacaaggaactccggtgcaaagcgtgatggtttcctacccaacaatgtcttcttatcaggtgccaatgacccagggttctcaaggactgccccagcagtcataccaacagccaatcatgctacctaaccaggcaggtcaagggtcactcccagccactggaatgcctgtttactgtaatgtcacaccgcccacccctcagaacaaccttaggctgattggcccacactgcccctccagcactgtcccagtgatgtcagctagctgcagaacaaactgtgcaagtatgagcaatgctggttggcaggtcaaattctgagagctctggctgtggtacatttcttcagatatttctcatggcctttgatggaagaggaacaaggtgggaaaactggctgaggacttaagtattcactcaacactcaaatgattgctgctggtattctgtaaaaaataaacaaagactaatatacacgttagctggttaatggtgcatatttctgtcatgtctgctaggtatgcctttatagcttagctagtgacatgaattcatcaaggtaagattttctcctaccactgaataccactgtgtagattataatatccctaatttggattagttttgtactttgtgttgagtttgtgatgctaaaagtatttaaaaattatatactaaatcacattgtaccaaagctgtaatggaaaagcaaagaagaattgatgaattgaaggaataatttatatacattatagagttttcttttttaatggatatatactgtattgtagtgtttaatcaaaataaaactatttgaccttatggaggaaggtcatgtttttaccaccagtttggttcacta

SEQ ID NO: 103099 - DNA, 2558 bp, Homo sapiens
  misc_feature (1036)..(1036): n is a, c, g, or t
ggattctacaggcatagacttacacgagtttctgattaacacattaaagaataattccagggacaggatgatacttttgaaaatggagcaggaaattattgatttcattgctgacaacaataatcattataaaaagttccctcagatgtcatcgtatcagaggatgcttgtccatcgagtggcagcttattttggattggatcacaatgtggatcaaacaggaaaatctgttatcatcaacaagaccagcagcaccagaataccagagcaaaggttttgtgaacatttaaaagatgaaaaaggtgaagaatcccagaagcggtttatcttgaagcgagataactctagtattgataaagaagacaatcagtcagtttgctcccaggaaagcctttttgtggaaaacagtaggctcttggaagacagtaacatatgcaatgagacctataagaaaagacagctctttcggggcaacagagatggctcagggagaacatctgggagtcgacagagcagctcagaaaatgaactcaagtggtctgaccaccaaagggcctggagcagcacagactccgacagttccaaccgcaatctaaagcccgccatgaccaagacggcgagttttgggggcatcacggtgctgaccaggggtgacagcacttccagtactaggagtaccgggaagctgtccaaagcaggttccgagtcttccagcagtgcaggctcctcaggatcgctgtcccgcacccatccacctctccagagcacacccctagtctcaggtgtggcagctggctctccaggctgtgtgccttatccagagaatggaatagggggccaggttgctcccagcagcaccagctacatcctccttccacttgaagctgcaacaggcatcccgcctggaagcatccttcttaatccacacacaggccagccctttgtgaatcccgatggaactcctgcaatatacaacccacccaccagtcagcagcccctgcgaagcgccatggtggggcagtcccaacagcagccnccacagcagcagccctccccgcagccccaacagcaggtccagccaccgcagccacagatggcaggccctctggtcactcagtctgtccaggggctgcaggcttcctcccagtcagtgcaatatccggcagtctcttttcctccccagcacctcctacctgtgtctccaacgcagcactttcccatgagagatgatgtggcaacacagtttggccagatgaccctgagccggcagtcctcgggggagactcctgaacccccatcaggtcctgtctacccatcctcccttatgccacagccggcccagcagcccagctatgtaatcgcctctacaggccagcagcttcctacaggaggattctcaggctctggccctcccatctcccagcaggtcctccagccccctccctcaccacagggatttgtgcaacagcctccgcctgcacagatgcctgtatattattacccatctggtcagtaccctacctcaaccacgcaacagtaccggcccatggccccggttcagtacaacgctcagaggagtcaacagatgccacaggcagcacagcaagcaggttaccagccagtcttgtctggtcaacagggattccaaggcctaataggagtgcagcagccacctcagagtcagaacgtgataaataaccaacaaggaactccggtgcaaagcgtgatggtttcctacccaacaatgtcttcttatcaggtgccaatgacccagggttctcaaggactgccccagcagtcataccaacagccaatcatgctacctaaccaggcaggtcaagggtcactcccagccactggaatgcctgtttactgtaatgtcacaccgcccacccctcagaacaaccttaggctgattggcccacactgcccctccagcactgtcccagtgatgtcagctagctgcagaacaaactgtgcaagtatgagcaatgctggttggcaggtcaaattctgagagctctggctgtggtacatttcttcagatatttctcatggcctttgatggaagaggaacaaggtgggaaaactggctgaggacttaagtattcactcaacactcaaatgattgctgctggtattctgtaaaaaataaacaaagactaatatacacgttagctggttaatggtgcatatttctgtcatgtctgctaggtatgcctttatagcttagctagtgacatgaattcatcaaggtaagattttctcctaccactgaataccactgtgtagattataatatccctaatttggattagttttgtactttgtgttgagtttgtgatgctaaaagtatttaaaaattatatactaaatcacattgtaccaaagctgtaatggaaaagcaaagaagaattgatgaattgaaggaataatttatatacattatagagttttcttttttaatggatatatactgtattgtagtgtttaatcaaaataaaactatttgaccttatggaggaaggtcatgtttttaccaccagtttggttcacta

SEQ ID NO: 103100 - DNA, 1106 bp, Homo sapiens
aattattataaaatctgatttaagtgttgaccatagcctccagttccagccagctgaaaagataagcacatttgtatttgtgtggacaagtctgcagacttcttattgttgtctcaagccagacaatacaacccttttaaataacagttcctcataaggttaccagccagtcttgtctggtcaacagggattccaaggcctaataggagtgcagcagccacctcagagtcagaacgtgataaataaccaacaaggaactccggtgcaaagcgtgatggtttcctacccaacaatgtcttcttatcaggtgccaatgacccagggttctcaaggactgccccagcagtcataccaacagccaatcatgctacctaaccaggcaggtcaagggtcactcccagccactggaatgcctgtttactgtaatgtcacaccgcccacccctcagaacaaccttaggctgattggcccacactgcccctccagcactgtcccagtgatgtcagctagctgcagaacaaactgtgcaagtatgagcaatgctggttggcaggtcaaattctgagagctctggctgtggtacatttcttcagatatttctcatggcctttgatggaagaggaacaaggtgggaaaactggctgaggacttaagtattcactcaacactcaaatgattgctgctggtattctgtaaaaaataaacaaagactaatatacacgttagctggttaatggtgcatatttctgtcatgtctgctaggtatgcctttatagcttagctagtgacatgaattcatcaaggtaagattttctcctaccactgaataccactgtgtagattataatatccctaatttggattagttttgtactttgtgttgagtttgtgatgctaaaagtatttaaaaattatatactaaatcacattgtaccaaagctgtaatggaaaagcaaagaagaattgatgaattgaaggaataatttatatacattatagagttttcttttttaatggatatatactgtattgtagtgtttaatcaaaataaaactatttgaccttatggaggaaggtcatgtttttaccaccagtttggttcacta

SEQ ID NO: 103101 - DNA, 1171 bp, Homo sapiens
tgtatgtggctaggtacagttaactagaaaagggcctcaatacttttatcaaatctttgatgtgatccatatttctttataaatattaaatgtcagtgtccttgatcaataatttttcttagtagtgccctgttcttcccatttcaaagatgagtgagaaaactaagcagcagttcctaaactgaggactgaaggtttctgggagtttctgctgttaaagatagttaccagccagtcttgtctggtcaacagggattccaaggcctaataggagtgcagcagccacctcagagtcagaacgtgataaataaccaacaaggaactccggtgcaaagcgtgatggtttcctacccaacaatgtcttcttatcaggtgccaatgacccagggttctcaaggactgccccagcagtcataccaacagccaatcatgctacctaaccaggcaggtcaagggtcactcccagccactggaatgcctgtttactgtaatgtcacaccgcccacccctcagaacaaccttaggctgattggcccacactgcccctccagcactgtcccagtgatgtcagctagctgcagaacaaactgtgcaagtatgagcaatgctggttggcaggtcaaattctgagagctctggctgtggtacatttcttcagatatttctcatggcctttgatggaagaggaacaaggtgggaaaactggctgaggacttaagtattcactcaacactcaaatgattgctgctggtattctgtaaaaaataaacaaagactaatatacacgttagctggttaatggtgcatatttctgtcatgtctgctaggtatgcctttatagcttagctagtgacatgaattcatcaaggtaagattttctcctaccactgaataccactgtgtagattataatatccctaatttggattagttttgtactttgtgttgagtttgtgatgctaaaagtatttaaaaattatatactaaatcacattgtaccaaagctgtaatggaaaagcaaagaagaattgatgaattgaaggaataatttatatacattatagagttttcttttttaatggatatatactgtattgtagtgtttaatcaaaataaaactatttgaccttatggaggaaggtcatgtttttaccaccagtttggttcacta

SEQ ID NO: 103102 - DNA, 1209 bp, Homo sapiens
ggattctacaggcatagacttacacgagtttctgattaacacattaaagaataattccagggacaggatgatacttttgaaaatggagcaggaaattattgatttcattgctgacaacaataatcattataaaaagttccctcagatgtcatcgtatcagaggatgcttgtccatcgagtggcagcttattttggattggatcacaatgtggatcaaacaggaaaatctgttatcatcaacaagaccagcagcaccagaatgttaccagccagtcttgtctggtcaacagggattccaaggcctaataggagtgcagcagccacctcagagtcagaacgtgataaataaccaacaaggaactccggtgcaaagcgtgatggtttcctacccaacaatgtcttcttatcaggtgccaatgacccagggttctcaaggactgccccagcagtcataccaacagccaatcatgctacctaaccaggcaggtcaagggtcactcccagccactggaatgcctgtttactgtaatgtcacaccgcccacccctcagaacaaccttaggctgattggcccacactgcccctccagcactgtcccagtgatgtcagctagctgcagaacaaactgtgcaagtatgagcaatgctggttggcaggtcaaattctgagagctctggctgtggtacatttcttcagatatttctcatggcctttgatggaagaggaacaaggtgggaaaactggctgaggacttaagtattcactcaacactcaaatgattgctgctggtattctgtaaaaaataaacaaagactaatatacacgttagctggttaatggtgcatatttctgtcatgtctgctaggtatgcctttatagcttagctagtgacatgaattcatcaaggtaagattttctcctaccactgaataccactgtgtagattataatatccctaatttggattagttttgtactttgtgttgagtttgtgatgctaaaagtatttaaaaattatatactaaatcacattgtaccaaagctgtaatggaaaagcaaagaagaattgatgaattgaaggaataatttatatacattatagagttttcttttttaatggatatatactgtattgtagtgtttaatcaaaataaaactatttgaccttatggaggaaggtcatgtttttaccaccagtttggttcacta

SEQ ID NO: 103103 - DNA, 2777 bp, Homo sapiens
  misc_feature (1036)..(1036): n is a, c, g, or t
ggattctacaggcatagacttacacgagtttctgattaacacattaaagaataattccagggacaggatgatacttttgaaaatggagcaggaaattattgatttcattgctgacaacaataatcattataaaaagttccctcagatgtcatcgtatcagaggatgcttgtccatcgagtggcagcttattttggattggatcacaatgtggatcaaacaggaaaatctgttatcatcaacaagaccagcagcaccagaataccagagcaaaggttttgtgaacatttaaaagatgaaaaaggtgaagaatcccagaagcggtttatcttgaagcgagataactctagtattgataaagaagacaatcagtcagtttgctcccaggaaagcctttttgtggaaaacagtaggctcttggaagacagtaacatatgcaatgagacctataagaaaagacagctctttcggggcaacagagatggctcagggagaacatctgggagtcgacagagcagctcagaaaatgaactcaagtggtctgaccaccaaagggcctggagcagcacagactccgacagttccaaccgcaatctaaagcccgccatgaccaagacggcgagttttgggggcatcacggtgctgaccaggggtgacagcacttccagtactaggagtaccgggaagctgtccaaagcaggttccgagtcttccagcagtgcaggctcctcaggatcgctgtcccgcacccatccacctctccagagcacacccctagtctcaggtgtggcagctggctctccaggctgtgtgccttatccagagaatggaatagggggccaggttgctcccagcagcaccagctacatcctccttccacttgaagctgcaacaggcatcccgcctggaagcatccttcttaatccacacacaggccagccctttgtgaatcccgatggaactcctgcaatatacaacccacccaccagtcagcagcccctgcgaagcgccatggtggggcagtcccaacagcagccnccacagcagcagccctccccgcagccccaacagcaggtccagccaccgcagccacagatggcaggccctctggtcactcagtctgtccaggggctgcaggcttcctcccagtcagtgcaatatccggcagtctcttttcctccccagcacctcctacctgtgtctccaacgcagcactttcccatgagagatgatgtggcaacacagtttggccagatgaccctgagccggcagtcctcgggggagactcctgaacccccatcaggtcctgtctacccatcctcccttatgccacagccggcccagcagcccagctatgtaatcgcctctacaggccagcagcttcctacaggaggattctcaggctctggccctcccatctcccagcaggtcctccagccccctccctcaccacagggatttgtgcaacagcctccgcctgcacagatgcctgtatattattacccatctggtcagtaccctacctcaaccacgcaacagtaccggcccatggccccggttcagtacaacgctcagaggagtcaacagatgccacaggcagcacagcaagcagttgcagtgacaggtggatttctacagactgaatctgtggccatagtacttatttcaagataattggccaaggctaggttacatcctgtagccatgcaacagtgacagtaatttgatcacaataatgctgaccccatgacttttgacttcataattatcttgctgtagtcagctggccaacagcacttcatcaatgaaaatatccaccaggaggaatattatcatggggacagttattagagccacctccattttgactttgccccaagcttggtctggggaaaaagcttcttaaagttgcctcagcagtagtttgctgcctcccagcctggttttaagtatatccataattaacacgacgggtagaggtgcaagaatgccacattttcttctaagccatgcaacctcattaagaaagtaaaacgtttgtgagtctttcatgcggtctttctccctctgggttgttgaagctctctggatgtcagcacagcactatgggccaggaaagttcagagaattacttcaataatatgacagcctcttccatttaaaatggaattcaatgctggcttcccttggaggcattcattgaaattccgtgcatgatccattcctctagtcatttaacaatgtgtctcatgtttgccctgatttaaagaaagaaagaaagaaagaaagaaaaccagctttgtatttgtgataacatggatcaggatagtataattgcagtgagagcctgcagtaataggatggttcatctgatgtgtactgccattagaaaatgacccatgcatgaatgttctcaggggacagtaaagaggcttttaagaattacattctgtgtagtatgaaagctaatgagcaaaagaggaagtacgaagaaaaactactgcttcaggaagcatggttccacttaggtagggcctgtcacagctcccctcaaattcatttggatagacaggccattactaggatgactactatattacccccatgcccatgcacactccctgcaggtcatcctgtaccaagttcctaaggaattaaaaccagcgagtaataaatggtgaggaaaagaaagaggatggatacagcaactgccaataaataagttaaaaaaagacatttacgtcaaagatgaaagaagtcgtaatgaacttcaacagca

SEQ ID NO: 103104 - DNA, 733 bp, Homo sapiens
ggattctacaggcatagacttacacgagtttctgattaacacattaaagaataattccagggacaggatgatacttttgaaaatggagcaggaaattattgatttcattgctgacaacaataatcattataaaaagttccctcagatgtcatcgtatcagaggatgcttgtccatcgagtggcagcttattttggattggatcacaatgtggatcaaacaggaaaatctgttatcatcaacaagaccagcagcaccagaataccagagcaaaggttttgtgaacatttaaaagatgaaaaaggtgaagaatcccagaagcggtttatcttgaagcgagataactctagtattgataaagaagacaatcagtcagtttgctcccaggaaagcctttttgtggaaaacaggtaaaataaaatttacttttccatgtctttagaggaacaacgtctgtcatgtgtgtcttgtgtattcataaatatatatcccatatatgtgtgtgcttgaatatatgtattagcagatacatatatctatgcgtacacacatatatgttatttaacacatctacaaatgatctaatttggaaaaaaaattttctttcagttaattccaaacagaattgtaaaactttttcttatttaaagtctcaatttctggtccttgcaaaggtatacttcctattaccttcaccaggcattaagaataataaatatggagacatcacaggaa

SEQ ID NO: 103105 - DNA, 2121 bp, Homo sapiens
  misc_feature (599)..(599): n is a, c, g, or t
ggattctacaggcatagacttacacgagtttctgattaacacattaaagaataattccagggacaggatgatacttttgaaaatggagcaggaaattattgatttcattgctgacaacaataatcattataaaaagttccctcagatgtcatcgtatcagaggatgcttgtccatcgagtggcagcttattttggattggatcacaatgtggatcaaacaggaaaatctgttatcatcaacaagaccagcagcaccagaatgttccgagtcttccagcagtgcaggctcctcaggatcgctgtcccgcacccatccacctctccagagcacacccctagtctcaggtgtggcagctggctctccaggctgtgtgccttatccagagaatggaatagggggccaggttgctcccagcagcaccagctacatcctccttccacttgaagctgcaacaggcatcccgcctggaagcatccttcttaatccacacacaggccagccctttgtgaatcccgatggaactcctgcaatatacaacccacccaccagtcagcagcccctgcgaagcgccatggtggggcagtcccaacagcagccnccacagcagcagccctccccgcagccccaacagcaggtccagccaccgcagccacagatggcaggccctctggtcactcagtctgtccaggggctgcaggcttcctcccagtcagtgcaatatccggcagtctcttttcctccccagcacctcctacctgtgtctccaacgcagcactttcccatgagagatgatgtggcaacacagtttggccagatgaccctgagccggcagtcctcgggggagactcctgaacccccatcaggtcctgtctacccatcctcccttatgccacagccggcccagcagcccagctatgtaatcgcctctacaggccagcagcttcctacaggaggattctcaggctctggccctcccatctcccagcaggtcctccagccccctccctcaccacagggatttgtgcaacagcctccgcctgcacagatgcctgtatattattacccatctggtcagtaccctacctcaaccacgcaacagtaccggcccatggccccggttcagtacaacgctcagaggagtcaacagatgccacaggcagcacagcaagcaggttaccagccagtcttgtctggtcaacagggattccaaggcctaataggagtgcagcagccacctcagagtcagaacgtgataaataaccaacaaggaactccggtgcaaagcgtgatggtttcctacccaacaatgtcttcttatcaggtgccaatgacccagggttctcaaggactgccccagcagtcataccaacagccaatcatgctacctaaccaggcaggtcaagggtcactcccagccactggaatgcctgtttactgtaatgtcacaccgcccacccctcagaacaaccttaggctgattggcccacactgcccctccagcactgtcccagtgatgtcagctagctgcagaacaaactgtgcaagtatgagcaatgctggttggcaggtcaaattctgagagctctggctgtggtacatttcttcagatatttctcatggcctttgatggaagaggaacaaggtgggaaaactggctgaggacttaagtattcactcaacactcaaatgattgctgctggtattctgtaaaaaataaacaaagactaatatacacgttagctggttaatggtgcatatttctgtcatgtctgctaggtatgcctttatagcttagctagtgacatgaattcatcaaggtaagattttctcctaccactgaataccactgtgtagattataatatccctaatttggattagttttgtactttgtgttgagtttgtgatgctaaaagtatttaaaaattatatactaaatcacattgtaccaaagctgtaatggaaaagcaaagaagaattgatgaattgaaggaataatttatatacattatagagttttcttttttaatggatatatactgtattgtagtgtttaatcaaaataaaactatttgaccttatggaggaaggtcatgtttttaccaccagtttggttcacta

SEQ ID NO: 103106 - DNA, 2216 bp, Homo sapiens
  misc_feature (1036)..(1036): n is a, c, g, or t
ggattctacaggcatagacttacacgagtttctgattaacacattaaagaataattccagggacaggatgatacttttgaaaatggagcaggaaattattgatttcattgctgacaacaataatcattataaaaagttccctcagatgtcatcgtatcagaggatgcttgtccatcgagtggcagcttattttggattggatcacaatgtggatcaaacaggaaaatctgttatcatcaacaagaccagcagcaccagaataccagagcaaaggttttgtgaacatttaaaagatgaaaaaggtgaagaatcccagaagcggtttatcttgaagcgagataactctagtattgataaagaagacaatcagtcagtttgctcccaggaaagcctttttgtggaaaacagtaggctcttggaagacagtaacatatgcaatgagacctataagaaaagacagctctttcggggcaacagagatggctcagggagaacatctgggagtcgacagagcagctcagaaaatgaactcaagtggtctgaccaccaaagggcctggagcagcacagactccgacagttccaaccgcaatctaaagcccgccatgaccaagacggcgagttttgggggcatcacggtgctgaccaggggtgacagcacttccagtactaggagtaccgggaagctgtccaaagcaggttccgagtcttccagcagtgcaggctcctcaggatcgctgtcccgcacccatccacctctccagagcacacccctagtctcaggtgtggcagctggctctccaggctgtgtgccttatccagagaatggaatagggggccaggttgctcccagcagcaccagctacatcctccttccacttgaagctgcaacaggcatcccgcctggaagcatccttcttaatccacacacaggccagccctttgtgaatcccgatggaactcctgcaatatacaacccacccaccagtcagcagcccctgcgaagcgccatggtggggcagtcccaacagcagccnccacagcagcagccctccccgcagccccaacagcaggtccagccaccgcagccacagatggcaggccctctggtcactcagtctgtccaggggctgcaggcttcctcccagtcagtgcaatatccggcagtctcttttcctccccagcacctcctacctgtgtctccaacgcagcactttcccatgagagatgatgtggcaacacagtttggccagatgaccctgagccggcagtcctcgggggagactcctgaacccccatcaggtcctgtctacccatcctcccttatgccacagccggcccagcagcccagctatgtaatcgcctctacaggccagcagcttcctacaggaggattctcaggctctggccctcccatctcccagcaggtcctccagccccctccctcaccacagggatttgtgcaacagcctccgcctgcacagatgcctgtatattattacccatctggtcagtaccctacctcaaccacgcaacagtaccggcccatggccccggttcagtacaacgctcagaggagtcaacagatgccacaggcagcacagcaagcaggttaccagccagtcttgtctggtcaacagggattccaaggcctaataggagtgcagcagccacctcagagtcagaacgtgataaataaccaacaaggaactccggtgcaaagcgtgatggtttcctacccaacaatgtcttcttatcaggtgccaatgacccagggttctcaaggactgccccagcagtcataccaacagccaatcatgctacctaaccaggcaggtcaagggtcactcccagccactggaatgcctgtttactgtaatgtcacaccgcccacccctcagaacaaccttaggctgattggcccacactgcccctccagcactgtcccagtgatgtcagctagctgcagaacaaactgtgcaagtatgagcaatgctggttggcaggtcaaattctgagagctctggctgtggtacatttcttcagatatttctcatggcctttgatggaagaggaacaaggtgggaaaactggctgaggacttaagtattcactcaacactcaaatgattgctgctggtattctgtaaaaaataaacaaagactaatatacacgttagctgcgtcctgtgccgactgctacccacgggtcctctac

SEQ ID NO: 103107 - DNA, 2573 bp, Homo sapiens
  misc_feature (1036)..(1036): n is a, c, g, or t
ggattctacaggcatagacttacacgagtttctgattaacacattaaagaataattccagggacaggatgatacttttgaaaatggagcaggaaattattgatttcattgctgacaacaataatcattataaaaagttccctcagatgtcatcgtatcagaggatgcttgtccatcgagtggcagcttattttggattggatcacaatgtggatcaaacaggaaaatctgttatcatcaacaagaccagcagcaccagaataccagagcaaaggttttgtgaacatttaaaagatgaaaaaggtgaagaatcccagaagcggtttatcttgaagcgagataactctagtattgataaagaagacaatcagtcagtttgctcccaggaaagcctttttgtggaaaacagtaggctcttggaagacagtaacatatgcaatgagacctataagaaaagacagctctttcggggcaacagagatggctcagggagaacatctgggagtcgacagagcagctcagaaaatgaactcaagtggtctgaccaccaaagggcctggagcagcacagactccgacagttccaaccgcaatctaaagcccgccatgaccaagacggcgagttttgggggcatcacggtgctgaccaggggtgacagcacttccagtactaggagtaccgggaagctgtccaaagcaggttccgagtcttccagcagtgcaggctcctcaggatcgctgtcccgcacccatccacctctccagagcacacccctagtctcaggtgtggcagctggctctccaggctgtgtgccttatccagagaatggaatagggggccaggttgctcccagcagcaccagctacatcctccttccacttgaagctgcaacaggcatcccgcctggaagcatccttcttaatccacacacaggccagccctttgtgaatcccgatggaactcctgcaatatacaacccacccaccagtcagcagcccctgcgaagcgccatggtggggcagtcccaacagcagccnccacagcagcagccctccccgcagccccaacagcaggtccagccaccgcagccacagatggcaggccctctggtcactcagtctgtccaggggctgcaggcttcctcccagtcagtgcaatatccggcagtctcttttcctccccagcacctcctacctgtgtctccaacgcagcactttcccatggtcctccagccccctccctcaccacagggatttgtgcaacagcctccgcctgcacagatgcctgtatattattacccatctggtcagtaccctacctcaaccacgcaacagtaccggcccatggccccggttcagtacaacgctcagaggagtcaacagatgccacaggcagcacagcaagcagttgcagtgacaggtggatttctacagactgaatctgtggccatagtacttatttcaagataattggccaaggctaggttacatcctgtagccatgcaacagtgacagtaatttgatcacaataatgctgaccccatgacttttgacttcataattatcttgctgtagtcagctggccaacagcacttcatcaatgaaaatatccaccaggaggaatattatcatggggacagttattagagccacctccattttgactttgccccaagcttggtctggggaaaaagcttcttaaagttgcctcagcagtagtttgctgcctcccagcctggttttaagtatatccataattaacacgacgggtagaggtgcaagaatgccacattttcttctaagccatgcaacctcattaagaaagtaaaacgtttgtgagtctttcatgcggtctttctccctctgggttgttgaagctctctggatgtcagcacagcactatgggccaggaaagttcagagaattacttcaataatatgacagcctcttccatttaaaatggaattcaatgctggcttcccttggaggcattcattgaaattccgtgcatgatccattcctctagtcatttaacaatgtgtctcatgtttgccctgatttaaagaaagaaagaaagaaagaaagaaaaccagctttgtatttgtgataacatggatcaggatagtataattgcagtgagagcctgcagtaataggatggttcatctgatgtgtactgccattagaaaatgacccatgcatgaatgttctcaggggacagtaaagaggcttttaagaattacattctgtgtagtatgaaagctaatgagcaaaagaggaagtacgaagaaaaactactgcttcaggaagcatggttccacttaggtagggcctgtcacagctcccctcaaattcatttggatagacaggccattactaggatgactactatattacccccatgcccatgcacactccctgcaggtcatcctgtaccaagttcctaaggaattaaaaccagcgagtaataaatggtgaggaaaagaaagaggatggatacagcaactgccaataaataagttaaaaaaagacatttacgtcaaagatgaaagaagtcgtaatgaacttcaacagca

SEQ ID NO: 103108 - DNA, 434 bp, Homo sapiens
ttcttattgcaacattaaactctggaaaaggacgctgactgcctttgaaatcatcccctggcttgtttcatgagtgtgtcacgttctcccggcaggtcattgtgcagcgctgcctgtgtggcaaggacatgtctcacgtgaaggccgcttgcattatgtgtgcttacctgaagctgctgcccatgttcctcatggtgatgccggggatgatcagccgcatcctgtacacaggtaagccctgaatccgtatgttctctctttttttatgcttgtattctgataagtgtttttaaaatgtcataaaaccttgagaaaatccattctggaaggaagtaaaagcagacttccaggtggagggagcagcctgcacagtggtcaaaggcaggaaaatttggcatattggacgctctgttcctttatcctcttcataccat

SEQ ID NO: 103109 - DNA, 2043 bp, Homo sapiens
cgcctgcaggtcggccatggccagtacggttagccccagcaccatagctgagaccccagagccacctccattgtctgaccacatccgaaatgctgctgacatctcagtcattgtcatctattttctggtggtgatggctgttgggctgtgggcgatgctgaagaccaaccgaggtactataggaggcttcttcctcgctggtcgtgatatggcctggtggccgatgggcgcctctctctttgccagtaacatcggcagcaaccactatgtggggctggctgggacaggagcagcttcaggagtcgccaccgtaacatttgaatggacttcctcagtaatgttgctgattcttgggtggatctttgtccctatctacatcaagtcgggggtgatgaccatgccggaatatctcaagaagcggtttggtggggagcgactccaggtctacctctccatcctctccctcttcatctgtgtggttttgttaatttctgcagacatatttgctggagccatattcatcaagctggccttgggattggacctttacctggcaatcttcatcctcttggctatgactgctgtttacaccaccactgggggcttggcctcggtgatttacacagacaccctccagaccatcatcatgctgattggctcttttattctcatggggtttgcatttaacgaagttggaggttatgagagctttaccgagaagtacgtgaatgccaccccatccgtagtcgagggggacaacttgacaatcagtgccagttgctacacacctcgggcggactccttccatatcttccgagatgctgtgactggggacattccatggccaggaattatatttggaatgcccattacagctttgtggtactggtgcacaaatcaggtcattgtgcagcgctgcctgtgtggcaaggacatgtctcacgtgaaggccgcttgcattatgtgtgcttacctgaagctgctgcccatgttcctcatggtgatgccggggatgatcagccgcatcctgtacacagatatggtagcatgtgtggtaccttctgaatgcgtgaaacactgtggcgttgatgttggctgcaccaactacgcataccccacgatggtgctggaactgatgccccaaggactgcgaggcctgatgctttcggtcatgctggcctctctcatgagctccctgacctccatcttcaacagcgccagcaccctcttcaccattgacctctacaccaagatgcggaagcaagcgtcggagaaagagctcctgatagctggacggatatttgttcttctattaactgttgtgagcattgtgtgggtcccactggtacaagtttctcaaaatggacaactaatccattacacagaatcaatttctagctaccttgggcctccaattgcagctgtctttgtgcttgccatcttctgtaaaagagtcaatgaacagggagcattctggggtctaatggttggacttgcaatgggcctcattcgtatgataacagagtttgcttatggaacagggagttgcttggctcccagtaactgtcccaagattatctgtggagtgcactatctgtacttttccatcgttctcttttttgggtccatgctggtcaccctgggaatttccctcttaacaaaacccattcctgatgtacatctgtaccgcctgtgctgggttcttcggaacagtacagaggagcgaatcgatatagatgcagaagagaaaagtcaggaagaaacagatgatggtgttgaagaagattatcctgagaaatcacgtggatgcctcaagaaagcttatgacttgttctgcggtttgcagaagggacccaagctaaccaaggaggaggaggaagccttgagcaagaagctcacagacacgtctgagaggccctcgtggaggacaatagtgaacatcaacgccatcctcctcctggctgtggtggtctttattcacggctactatgcctgaactctatctgagccattagaataatgaataattcttaaaaaaaaaaa

SEQ ID NO: 103110 - DNA, 384 bp, Homo sapiens
agattatatggacctagtaatttttgttctgttcattgctttggttttcttcttcaaagttaaaaaaatagatactatatctatcttctgtatctctcactttctcttgactctcttaaatctctttcatatcttttttattaaaaagattctttatatcttattatacttgtattaagtgattggtatggtttggatatttcacccctccaaatctcatgttgaaatctgatccaaatctcaagttggaggtggggcctaatgggaggtgtctgggtcatggagacagatccctcatgaatggattaatgtgctccctagggtgcagtacgggggcactgagtgagatctggctctattacgagttggttgttaaaaagaacc

SEQ ID NO: 103111 - DNA, 627 bp, Homo sapiens
gtgctttcattttcaatacatctctgcttctgttgcttcattctgtccttgttttcttagtgcattttgtccgattctttgttcaaaaccccaagaaactggacactctccactgggaaaaaaactagtagaagagaaaatggaatgataataattacagtagtagaagaagagcaagaacaaatcaacttattcaaaaaaaaaaagaaaaaagaaaaaatcagagaattagcagggtaaatagaaaccacaatgtaagatgagataaaaaaggagacttagtatataataattacaatagataaaaataaactaaactttctactcaaaatacagagtatcagttttgattgaggaaaaaatatctactatttaaacgagccacatctaaaacatgaagacactggaagttaaaagtaaaagaatcaaagataataggcaaatattaaagaaagctcacacagctatgaaaataccagataaaataaattattcgggataagaatggttactacatattgatgtaacaattttaaatttgtatgatcttaaatggtttcaaaatatataaagcaaaaattgcttaaactacagggggaaattgacatattctttgccagggtagaa

SEQ ID NO: 103112 - DNA, 364 bp, Homo sapiens
aaaattagccaggcatggtggcgtgtgcccatagtcccagttacctgagaggctgagccaagaggatggcttgagcccaggagtttcaggctgcaaatagcaccactgtactcttgcctgggtggcagaacaagaccctgtctcaaaaacaaacaaacaagcaaacaaaaaagaagacgaaaagaaagggaaggaaaagttattctgaaacccctacttcgatgtaaaaatcctatttaataacttgtccccagaagtctattttattcatacatggttcatgtgtttgctacaaataaagtagatattatcaaaacctgggttggtcctaaattagaaagatctgccaagtcacatatctttc

SEQ ID NO: 103113 - DNA, 81 bp, Homo sapiens
gagccctgctcggctccggcgcgtctattatgctgccggggccggcgagccaaagaggagccggccgcgcgggccgggagg

SEQ ID NO: 103114 - DNA, 824 bp, Homo sapiens
gcgtctacaagccaaggaatgtcaggacttgcagaaaccccagaagcaaatggaaaggcatgtaacagattcttcctagcatcttcagagagagcgtgatgctgcctacaccttgttttgaacttctagcctccaaaactgtgagagaataaatttctgttgttttatcaagacacctagtttctgttattttgtgacagcagacctagaaactgaatataccccttaaaccactgcggttttcctttttgttccaagattctttcatgtatgacctgtgagagccaaatccagtctttatttggcctctctggagcacatgcgactcatttattccttgttgttgctcctccccaacatccttcttggcctccttcattgcttcctaatctcacagccatctaccgcacagtggagtccctgggttcatcaccacatcctcccactctattcatgctccactgcaatctcatccaaataccagctctcctcctaccccccatgctgatgattccccaagccctctagcccaagcatctctcctgagatctacttttgagttccccactgcttcctgaacatttccacttagaacttctacaagcacctcaaaaactacatggctaaaatggaagtcatggtctagaagcctccttcccaaataaacttgcttttcctcctgtaaccggaatgtctatgagaggcttcacattcacacaggggcataagccagacacctggcatcttcttgggcttctcccctgcacccttcgccatagtcactgaggccaaaggactctgcctataagggttcagggaatgca

SEQ ID NO: 103115 - DNA, 419 bp, Homo sapiens
ttctctaaagctaatccttctctaaaaccagcatttctcctgcaccctttaggtattactgtcattcttatttaatatcaagaaaacagaggtctagagaggttacacaattctgctagtgactggcagagccaggtttgtccaacttcaccatctagctgcttttccagtttggacactctgaataatattaaaaggcagatagacaaaccaggggaaagtatttcaacattaatgaaattaaaaaagtcaaacactgtaatggaaagatgaacacagaaaaggcacaagcaattcagaaaagaaaatacgttgataactacaagcaaataaacatgttcactcttacttagtaattaaatgcaaattaatataagaaatcatttctcacctatcaaatcagcaaggattttatttac

SEQ ID NO: 103116 - DNA, 372 bp, Homo sapiens
atgttttcttgcactaggaccatctcatgtcccacaccctggccagtgacaaatcagcagattcgctgcatgggcttctgagaaagttcttgaacaggggtcattcttaaacctgaattcttccctgtatgttttgctctttgctttaccccctacttctcaccttgcaaggagattcggtacctagtattggaagatccaccttatgaccatgcggatgaaagccacagtctaaggaagtgactgcagaaagcccacagctaccctggcctaccctgtggtttctttgagtgtctgcaccagccctggacttgttacttccagacgtcctatcacatgagaaaaaataaaactgattatgggtttaagctg

SEQ ID NO: 103117 - DNA, 416 bp, Homo sapiens
ttcagatgggtggtgtcaggcccagaggtgcagagctatttacccttgttcctgagaatccaagggaggggcctttagtgtccatatagttctgtcctccagcaggtgatactgagtagccatttagctacagagaagtctgaataaggaacaatatggctactttcaccagcccagaagtaattgtaaaggcccattctggcctttatacctaatgattagcaaccatagggaacacacagctatcttcatgccagcagcttctctcagtgtgtgtgcacaagtatgtacctggcaggatgtgaaaatggggctttccaccagtttctcccttgggttgcaagaagcctctttctatcattcacatgggttttcccctgggggccacttatattggatgctggtaactgggaaat

SEQ ID NO: 103118 - DNA, 209 bp, Homo sapiens
atggattatagatactgaacttgaaaaatgcatccatgagtccatgagtttgcgtatccacagtgatacttaaaaaaaagtgggagtaagggggaggccgaggcgggtggatcacgaggtcaggagatcgagaccatcctggctaacacggtgaaaccccgtctctactaaaaaaatacaaaaaaattagccgggcgtgatggcgggcg

SEQ ID NO: 103119 - DNA, 234 bp, Homo sapiens
cttatttctccaacattatttaattcagactaactttatttcttgaaggtatataccagacatacctcggagatattgtgggttcagatccaggccactgcaataaagcaaatatcacaataaagcaagtcacacatactttttggctttccagtgcatataaaacttatgtttacactatattgtagtgtgtaatagcattgtctctaagaaaacaatgtacatgccttaagt

SEQ ID NO: 103120 - DNA, 734 bp, Homo sapiens
cagaagcgctaggaggtagaacagcgtccagcggggagaggagctagagtcggcatcgggaagcccaccctggagcctgcttagcttgacgagccctcaaccggggcgccctgctctgcgaagagtaaccctgcatcctcagaacaaccgtgattgtcttcattcctacatatgaggaacggaggcgcggagccccacggcagccggggatccaaagacagcctccctccagttccatctgccggctcttggaaggcctggatccctgtccttcagggcccagcccaaatgccgcctcgtccatctgcattttacggccaggtgccccgctgcgggcacggcttcttgtaaaatgctcagctcagcagtgggcgaggcagggtccctgccccatgggatggagggcggagatcaggacccacaagagcccaaagaagaccattttggtcggtgaagaccaaagaaattcaagcaggaggatgtgacaggagcttttgggaaagcctctgaggaggtgacagccatgcaaccgtgttcggggaagtgtgccgcaggcagaggggaaatgagtgcaaaagccctgaagctggagttcggtgtctggataacaggaaaggcctgcatagctgatgtgtgccagaggggagaaagatctgtgacacaggggggccgccatgtttaatttggagttttgtgtggaagggggtcattcattgagtctgaattgggagttc

SEQ ID NO: 103121 - DNA, 461 bp, Homo sapiens
atggcaaccttagtttccaccttaagtccaaacgtcttaaaatgttgttcaaaaccaccttaaacctgatcagagcctcctctctctctccctactgcccttcatgttctgaactcctaagctcttcagactgtctgtccttttctgaagactgtacattttcaggcctctgggctagggctcaatcacttaccttatcctgacagggccactgaaccttgccgcctacgctgattcccagaggcatacctaacttgcctgtctttgctctcccatggaatgtcatctctatttatatgtagcaattatttgattctgcattaggttagttcttcagatgtttgtttccttcgccaatagaaaattcttcaaggacagtattctgtctaactcatcttgtattcccacaatgcccattttaggtactcaataaagagttcataaatgtttaaaaacagtat

SEQ ID NO: 103122 - DNA, 387 bp, Homo sapiens
caaccagttcaaaccagcgaggaaagaagaaattaaattcaccttttggccaggcagttgctcatgcttgtgatcccagcattttgggaagccaaagcaagaggatcacttgaggccaggaattcaagaccagcctggacaacctagtgaaaccccatctctacaaaaaaattttttaaaaagccatgcgtggtggcatatgcctgtagtcccagctgcttgtgagacagaggcagaaggattgcttgaccccagaagttcaagtccagcctgggaaacatagtgagacctcctctcaaaaataaataaataaacaacaataataataaaaataaatccacctttcatatgtgtaatgaaaaatatcaaagattttttgttttgttt

SEQ ID NO: 103123 - DNA, 409 bp, Homo sapiens
ggttaggtgcattttatcattttaagggccatgatgagataaaacatggtaagctgttgtgctggctctttttatgttgatcattggcagttaccaagctgactatctgacatgagctgaaaacctatgttgaaaaaatgtccagttccattttatgtagcttcaactcatctttaaaaaatgaagtgatttagaacacatgtcacgcactcctgggccagccagcttccctttctcttctcgtatgtaatatctttttttcccctttctagcaagtactttcaaaagaactctgtacattttaacataaaaaataaattatgttgggccattttggaaaaaaaatacttatttggctaaatttaacatttcaaacaaataaaaaattcaagcagaaaataattgagga

SEQ ID NO: 103124 - DNA, 561 bp, Homo sapiens
gtctgcggcccttcttgtgcacctctgcttaaaagagctcacagtgttggctttcatagcagagcagtctaggaaattttgtactctggttccagggctcagagtagcaagagtgctgggacctgtctgagaagcagtgctgggctgtggatgcttgcctgtggcaccagatgccttacagtggccaggaatgctgcgggacagtctactttgattgctttctttcctccatggctgagatctgagtgtagtgttaactgggcttaaaaatcaagtccgttgtatctgcatggtcacgtagttcggcatctcatggcttttgcacctaggaggtgtggaaccataatacctgaaacacaatttcataacctggctccttgggcttagcctatatggtggaggttaggtctgtatatcatcaagactgtgtctttgcatggttgtcattctgttggaattgaactttcttatttctgtaggcctaggttctgtctattcttctcagacagctcatatgctgcttcttcccttcagccttctctgatacttgtccactccccg

SEQ ID NO: 103125 - DNA, 776 bp, Homo sapiens
acaactgcctcacaatgtcagccactgctccacgttcccaggagagggcccattaagaaagtcaccaattcatttcagcttggcttataattaatgcagcaacctctggcatcaataacctatggattggcatatgagtagggcataatttacaatctctatataaaatgtcattttaaagacttgtggtcttgtctcaggtaatttcaaacaaaatttttaaaaaatttttactcaataggtgtcctcattgccactgccatctcctcatattttccccacgccaatgctggcccctaatctctacaaaaaagcaagagcaaggaatggagggagggaggaagacgaatgatgagcaggagaggatcttagagatctaggacaactggtaccccattttacagatgagaaaactgagacctcctgatattgtgggacaagcacatggatttggtcaaaatctattaaaatcctgccgcctccatttaccgtgtgatctaacctctccaggctactgtttccagaactgtaaaaggcaaataacatccctcacgggcttgttttgaggattaaatggataaggagtgtgaaggcgccgaccacacatacgtgttcaaaggccagggagtcaaaagtcagaccccaaaactagtttccttccttgttgcctccccaggattcttggaagagaatatttactgcagctgaaacctcccattcatacaaaaaggacgctggagacagagggaagccactgaagaaggcagtaagtggct

SEQ ID NO: 103126 - DNA, 428 bp, Homo sapiens
tcaatggagatggaattttgctctgtcgcccaggctggagtgcagtggtgtgatctcagctcactgcaacctccacctcccgggttcaagcaattctcctacctcagcctcctgagtagccaggactacaggtgcatgccaccacgcccagctaattttttgtattttagtagagatggggtttcaccatgttgcccaggctggtctcgaactcctgagctcaggcaatctgcctgccttggcctcccaaagtgctaggattacaggcatgagccactatgcctggcctccattatcctcattttaaaggtagggaaataaagtcttagggacattatatgcccaagattataaagctactaagtagcaaaccagtctttgaacttaaggatactagatactagcaaacacatttttgaactctacac

SEQ ID NO: 103127 - DNA, 649 bp, Homo sapiens
tagaaatgtatgactactctcaaagcatgaggttaaaatgggagcagattagactgagcaccttgaggatagggatcagtcttactcatctctgtatcctgaaaagtgcttggcgctactgcacgctccataataacagaaaaaccaattatttaatgagctaggagttacatatcatctttccttaagtacctaatcagtctttatcatcagtgagtgcagaactcaaatatggtattgttcatcttccatcaccattttctcccaagtttcctggtttaattgcattttcctcactttccatctaatggatcctgatgtcattctttatctttatttcatattgtcctattgtgtgtattgtattgtatttttagctacattaaatccaatatggaaggaagcagagaacgatcataattgaactaacaagcaagtggaggtggagagaaagtggccccaatttggaaggtgaaggaaaactggggatggagcctaactgatcattaaaatgctcgaagcagctctttccaacccagatctgagcttctcttctttgccctctggagggtccacagagaaaggaaatacaagttttattaagaaaaagaggaaagcatctattttaggtgataatacaagcacagag

SEQ ID NO: 103128 - DNA, 832 bp, Homo sapiens
ggctgaggtccatttgtatgcacacaaagaaaagagttgcttgcctttcgaggaaataaaatggcctgaaagacgtcattactctacggaggcatgtggaaacaaaagttagagctaaaatccgtaagaggaaggtgacaacgaaaatcaaccgtcatgacaaaatcaatggaaagaggaagaccgccagaaaacagaaaatgtttcaacgtgcgcaagagttgcggcggcgggcagaggactaccacaaatgcaaaatccccccttctgcaagaaagcctctttgcaactgggtcagaatggtggcagcggagcatcgtcattcttcaggattgccctactggctctacctcacagctgaaactttaaaaaacaggatgggccgccagccacctcctccaactcaacaacattctataactgataactccctgagcctcaagacacctcctgagtgtctgctcactccccttccaccctcagtggatgataatatcaaggagtgtcctcttgctcctcttccaccctctcctcttccaccctcagtggatgataatctgaaggaatgtctctttgtcccgcttccaccctctcctcttccaccctcagtggatgataatctgaaggaatgtctctttgtcccgcttccaccctctcctcttccaccctcagtggatgataatctcaagactcctcccttagctactcaggaggccgaggtggaaaaaccacccaaacccaagaggtggagggtggatgaggtggaacaatcaccgcaaacccaagaggcagagggaggccgaggcacaacaattacccaaacccaagaggc

SEQ ID NO: 103129 - DNA, 768 bp, Homo sapiens
ggctgaggtccatttgtatgcacacaaagaaaagagttgcttgcctttcgaggaaataaaatggcctgaaagacgtcattactctacggaggcatgtggaaacaaaagttagagctaaaatccgtaagaggaaggtgacaacgaaaatcaaccgtcatgacaaaatcaatggaaagaggaagaccgccagaaaacagaaaatgtttcaacgtgcgcaagagttgcggcggcgggcagaggactaccacaaatgcaaaatccccccttctgcaagaaagcctctttgcaactgggtcagaatggtggcagcggagcatcgtcattcttcaggattgccctactggctctacctcacagctgaaactttaaaaaacaggatgggccgccagccacctcctccaactcaacaacattctataactgataactccctgagcctcaagacacctcctgagtgtctgctcactccccttccaccctcagtggatgataatatcaaggagtgtcctcttgctcctcttccaccctctcctcttccaccctcagtggatgataatctgaaggaatgtctctttgtcccgttccaccctctcctcttccaccctcagtggatgataatctcaagactcctcccttagctactcaggaggccgaggtggaaaaaccacccaaacccaagaggtggagggtggatgaggtggaacaatcaccgcaaacccaagaggcagagggaggccgaggcacaacaattacccaaacccaagaggc

SEQ ID NO: 103130 - DNA, 475 bp, Homo sapiens
gaatggcgtgaacccaggaggcggagcttgcagtgagccgagatcgcaccactgtactccagcctgggtgacagagcaagactccgtctcaacaaaagaaaaaaaaaaaagtagtttgcatggcatttagaaaatggaaagcaaaagcaccaattaagcaaggaagtcttgcctcaaacctgcatgtgtttcttctataaacaccagcactattcttataagtgtacagagcactcaccgacactgaaaaccatggaaccctgagtcatgtattatgcttccccatgtagacttcgcagctgtcttttaactctaccttttatcttcaaagttcaaggaaacatttattatgatttcaaattcctgaactcacatctagtcctaaagtcaaaacaatataacttggtatctaaatcaactgaaatgaaatgaaatgcacttggcaaaatcacccttttatgtagtggtggaatgc

SEQ ID NO: 103131 - DNA, 314 bp, Homo sapiens
acacccaccattcacagatgagaggccacacaacgtgcttgagtgcatcaaaggcaagttgacaaggtcgcctgccgctgagccccactgttctcatgagcaggacattattttcagtcttgctgggcagctctttaatatttcttttgtgatgatcagtgtccaagatgagctgtcaggcacttaagaagtgaagagttcctgaagatttcattgtgcatggtttccaatacaggttcaacatccctaatccaaaaatccagattccagaatgctccacaatccaaacatttttgagcaccaacatgatgctc

SEQ ID NO: 103132 - DNA, 312 bp, Homo sapiens
tggttaccaggggctgaggaagaagagaaaggagttactgtttaatagggacagagtttcagtttagaacaatgaaaaatttcaggaaatgaccagtgataatggttgcacttaataccacatgattgtatacttaaatggtaagtcttaacatttatattttaccacaaaaataaagaataaaataatttttcagacaaacaagagaactgagtgcctgcagagctgtaacatattagatgttaaaggtaatgtcttcaagcagagggaaaatgataccacctggaaatttggatctaaataaaataatga

SEQ ID NO: 103133 - DNA, 646 bp, Homo sapiens
tatctgcacttcatagtatttttgtaatgagcaaatattcctttcattaaaaaacaataaaaaagatttatttcaaaaagaaaaaaattactttggctgatgcaatataaaaacaaaccagatgaaagttagcatggataactataaagtcctgtgtcaaggtaggaaaaaaaagtacttacgtaagcataagatgcaggcaagaagggtctgaaaacagtttatttgaaaaatatttggaagtcttggacaaaaagtgaatacacaccaaaggataaactaatgcaatcacaggcagtattaatagaatatcaaattccggaagaaggaaaatgatgaaccccagtgaattgtcagattcccatgtggtgcactatgtccagttctgagcctccatggcctagagaaaggtcagaggagggtcttctggatagtcacaggtttgaagtcactgttcattaagacttctctggcctaggacaattaacctagatcacaggttctcagaagcctttttaaaaaaaattatttaagactttaattaacaggtccttacagtttgttgacttttttgaaaaaaccaagtcgtaaacttttattacaaattaaaaatgaagttcttaaaaatctcaacttgaccagatat

SEQ ID NO: 103134 - DNA, 461 bp, Homo sapiens
caaccataatcaatcaattcccatgccatatctttgaaagtattagcttgttttatgtagaataatgtagtttttagtgcagcataaataatataactcatactaatggcatattagagggatacataaaatttttacccatatattttgcagtctcaaaaatgtgaataagatctaatgttgatgaagaaacaagaaatcaatttgtaaaataaatgctaaaggattttaggcagggattataattaacatttttgtacttgcaaccccacctaatgaagtacattgcatgtgggaggaaaaaaatatgtaatttttgaatgaacatgcttctttgaaaacagaaattaagcctacaatgtagactttgttaaaggtcatagaaaatccagctgtctggctgggcgtggtggctcatgtctataatcccagcactttgggaggccaaggtgggtggatca

SEQ ID NO: 103135 - DNA, 572 bp, Homo sapiens
gcactttctgaggcttctcaccgtagcccttcccaaggtggcaaaacctacaaacaacccaagagcctgaaaaatggaataatgagagttgactttcacttacatgcttgctgtgggccaggcactgtgctaagggctatactggaacgatttatttaatcttcacatccccagaaggtaggaatttccatcattttacttcgcagaagactcttctgttttgcagttttacagatgggattcccattttatagcttgcctgcttgaggtcacacagcaagtaaatgatgctggtaaatcaaccaggctttgaaccctaacactccaactaacggagtgcttgctcttagcaaccacagttatgtgctgtataatgacgttttcatcagtgacagatgacatatacagcagtggtcccataagattataaacctatattatggactggacatggcggctcacacctgtaatcccagcactttgagaggccgaggcaggcagatcactagagcccaggagtttgacaccagcctggggaacatagtgagatcccatctctacaaaaaaaaaaa

SEQ ID NO: 103136 - DNA, 378 bp, Homo sapiens
gttgaaccacacttgaatctctagaataaattttgcctggtcataataaattatctttttactgtattgttcaactcaatttgctagtattttattgaagatttttgtatataccttcagcaagaatattggccttttttgtatttttctttgtctaattttggtatcagggtattactggcctcatagaatgagtttggaagtaatctcttctttcctactttttgtaatagtttgagtaggattggtattagttcttaaacttttgctaaaattcagcaatgaagccattggttcccaggcttttatttgctggaagactttttattatggttttaatctcattacttgttaatagtctattcaggtttttgattt

SEQ ID NO: 103137 - DNA, 811 bp, Homo sapiens
aaggtccttgcatggattacctcactgaagcctcaagatcacccttcaagatgtgtactgtcattcttcccattttaaggatgcagataggaggattgagtaatttcctaagccacgtaattagcaagtgacaccactgggatttgggccttggttgtttgatttcttttctttcttttttttgagatggagttttgcccttgtcacccaggctggagtgcagtggtgtgatcttggctcactgcaacctccacttcctgggttcaagcaattctcctgcctcagcttcccgagtagctgggattacaggtgcccaccaccatacctggctaatttttgtatttgtagtagagacggggtttcgccatgttggccaggctggacttgaactcctgacctcaggtgaccagcctggtgggactacaggcatgagccactgctcccggcctggttgtttgatctcacactcgcaaccacgataccaaaccagaactcttaggagagcagaaaaagacccgactcttttcctcttccatgcttggcttccatcccttcgggagcctccacctttccctcttctgcactatcctggctgccttttctctggcaaggctcagcttgtctcacttccttttctctccaccagcacaactgttctttctttggtcctagtcctccagcctttaaactccagcttccctgaagtgcagtgagtatacacatattgataaacataacaactactctggtctccacaggaccttaaattggcagaatttcaggtgctgaggtgagccaatgggagagattt

SEQ ID NO: 103138 - DNA, 463 bp, Homo sapiens
ttaccagcccaccttctgaagcctgggaggtgtgaacccagggcccgccaaccgctgcctttctcgggagtacttagagcctcgaacccgcgtccctgggggctgggccccaggcgcacggggctggaggcaggccttcgtgccttcgtgccttcgtgccttcccgcggtggccaggcctctgctgcagccgctggttgcaggcagagttttggggacctggcccttctcccactgggctcccccatcctgggccaaggccagaactttagtgctaggggaagatgaaatgtgcagttttgaaatgttgggtttccagagagagtcatgctggaggagaaggaagtaggccagaagtccagggctgcactgtggtgtgagggtggctttgtctaagatgcctgctcagcatgatcaccatagggtgtgggcaggtccctggagccgggggggggggggggggg

SEQ ID NO: 103139 - DNA, 228 bp, Homo sapiens
ttggaaaaaacaagatctcatagctgggtcataaaagaattgagatttcaccaatttagagtgtggactatgtcttttcccaaattctattactgtgtgcttcattctacctatttacagtcaggtgaggtcattataaagcttttaccccgaagcctggcatgttaggtctttaaaaagtaaaatgttttctttaagcataaagggattcatgcacatgccccatcc

SEQ ID NO: 103140 - DNA, 674 bp, Homo sapiens
gagatccctgcctgcacgtggggcggtcctggtagaccagaatgtgggtgtgggtcccccttccctgtggttctggggaccttgaggacatggtcaatcccgggcaagggacctgccacccctgtatggggtcaggaactgctggttggtctctgctgggcaggcaacctggggtccagctcaaatcgttggaatgtggaagtccttcctctcgccccgtcctgaggagcagctgcaggagcttcatgagtgttttcactggaacttgtggaggagtttcctttgatccctcatggagagacggaagcatgagggagccctcaacatttattctgaagatgaagagagtcctgcagctttttggagtttgtgaagtcagcccggccctgtacagatgtggaaaccgaggcccaggaagtttgtgagccagcccggccctgtacaggtgtggaaaccgaggcccaggaagtttgtgagccagcccggccctgtacagatgtggaaaccgaggcccaggaagtttgtgagccagcctggccctgtacagatgtggaaaccgaggcgtaggaaggaagcccttctctgacctcagagctgaaatggccagtgctgggtgggcattgaggggtcacacagaaaagaatgtttcaggccatgttcaggggatacttcct

SEQ ID NO: 103141 - DNA, 763 bp, Homo sapiens
ctgaaaatcatttacagataaccacaatttgctgtggtatataaactaattcttggtctatactaagatgtatttgagaaaatacatttgatttgattttgtggcccattcctaaaggtcattgtatccatttttaaaacaaactaaaatgagaacattaggttcaattttcttattattccaaatgataaaatttaagatttttctaataaaagagtacagataatgggacagttgagagagatggctttaaatacattcttaagtaatcattttcctatttactgaccactgtaatgaaaatatatcaatttatttatggaactcctgattggggataatattttaaaggtatctgttgcacacttggattttcaaaactcggtgaaagttacaagtttgcatggtaagaataaaataagaatattgaaactggtacattagctaattctattactacttagcgtgtttctaatgagaagttactgaaatctattactgtccttaataaaaattgagtagaaaaaagtggaactagagatacattttacagatgtatttccttaataatataattaagcaaaagtgctaattgtgattttgacagttgggccttttaagtagcatttgcagcacaatttgcatttgcaaagttccgaatttcttgactctttcttcactaagcaaatactgttttactctaataattaagagttagtagtacccaaatatgttgaatttttacttaggatatctgtgtgat

SEQ ID NO: 103142 - DNA, 239 bp, Homo sapiens
tgagacagagtcttgctttgtcgcccaggctgaggtgcagtggcgcgatctcagctcactgcaacctccatctccggggcttcagcgattttctcaccccagcctcctgagtaaagcgtgcgctttagcaggaaggagaattaccccagaagagcacactgggccctccttacacttggcttcagatccatggattcaaccaagcagactgaaaatattgttttaaagccaaagcaata

SEQ ID NO: 103143 - DNA, 183 bp, Homo sapiens
gcaatgtggagaggtggaaaagtcacaagctttgagtcagaaacacgtgggctgcagtccagactctgctacttacgctatcagcctggacaagtttcttgaccactctgagctgatctagagaactggggataatagcactgagttgtcatgagaagtaaacaaaattataggaactacttg

SEQ ID NO: 103144 - DNA, 341 bp, Homo sapiens
gctgggattacaggtatgcaccactacgcctgactaatttttttgtatttttcatagagacagggtttcatcatgttggtcatgctggtctcgaacttctgacctcgtgatctgcctgcctcggcctcccaaagtgctgggattacaggcttgtttgcttttaaacagtttgtgggcagggatggtattttcttatgattctattcctcacagatcctggcccagagccattagcagagaaaattctcagtagatgtttgctgacctaaacttcattccaccacctttgccttccttttgccttttcacctcctcttagaaggtaccttatatgataatgt

SEQ ID NO: 103145 - DNA, 425 bp, Homo sapiens
ccctgaattgccctactcaccggatgggtgggggagtggggagggactgcagcccctggcttagtgcagccctgtttatgtaggggaatgtctggtatgtttggtatttgggtgtttacttcccagggtgctcatgggtccctggtgttgaaatgtggctcctccatgcagggggggccctggtgggcctggctggctgtgtgaggcctgaggctagatttggaggctgcggggctgttactccaggcctgctcactgacaactcagcacgccctgaactccccagcctgctcctccctctccgcagtactcctttctgtgccgcattctgcccggaggcaggccagtgtgccgctgctgcaatagcaccacctccgccttgcctgcgaaggaaggcagggaagctggcatcacggaactcttcc

SEQ ID NO: 103146 - DNA, 453 bp, Homo sapiens
aaaaaaaagaagttaattataaactatgtagaggtactaaaaattgaaagccagaaaatgatcagtgaagatgggggttagtcaggaaaggtttcttaggaagattcaaactatattaatgaagtgaccagagggaacgcagttattgagacataaaattgagcagaacgtaaaactcaaacaagaacattgaccagcttatcaaattcattccctgattcactataaaatttcagaacactggggattaaaaaaaaaattctaaaagtttctagagagaaaaatctgctggcatatgaagaatctggaattaaaatgttgtcagatttctaaacaattctgagagttagaactatgtggaattgtctttaaaatcctgaaggaggccgggtgtggtggctcacacctataatctcagcacgttgggaggccgaggcaggtggatcatgaagt

SEQ ID NO: 103147 - DNA, 547 bp, Homo sapiens
ctcttgtttgtgtgtgtggcccttctccccagtcagatgagagacctttccagagtagtaatcacagttcatttttacaagccctgcggctccccagccccaaacgggtgcttagaagaaatgcaagtccttgattaagggcctcagaaggatgtgggatgtcctgagtccttaaaatgtcatgttttcccccaaagaactcaaggtgtggattgctaaagacttgctgcgcttgggcatagataggtatctgtttttcttcttcttgagggagatataataattaagcccttctccttcacctcacccttaaatttggaattttcttttctttttctttctctaataataaggtagagcccttttttatgccacaactgagagattctaaagcatattcagaataatttgcttcatagatgtgagcacagaaatttacagattttgggagatgtatactgaatgtcttatgactttctcacttaataaattaatcctccctcacccattttttaaaggtaaaaatatttcactaaaacaagctggt

SEQ ID NO: 103148 - DNA, 276 bp, Homo sapiens
gtccgtaggctcaaacactgaacagacagagaaaagctcacaggcttcccttcccaacaggtgtggcaaagggagggaaagcactgaaagacttgaagattgtcaactattgggtctgaagccagggcacccagtagttccttccagccgtgtcagtccgtcctgcacgggtgtctgttcagttcgagccaatgaagttaaaagtgaaggaaggaaagcagaaaggaagaaggaaaaagacaacaaataggggacgcgagggaagggaaaacattg

SEQ ID NO: 103149 - DNA, 894 bp, Homo sapiens
gggatggaagggaagagaaaaagaagaaccaatgtcacttgcactatgccactgagaggggatggaggaacattcgaatgccatcttagagccacataaaggctttaaaaagaaaaaagcagattcactactaagagaactccaaaagtaccaagcccaagggagaaacctctctatgtccactatggattgacatgaagagtggattttcaaagaatgatacctgccatgggccaggcacagtgctgaatcctcttacatacatcacctaattctagcctctaaacaaccataatgattccaaccccactgacaagaaaactgagttagcagggtagcttgatttcttcagagttgggatttcagcccagagttttcaactgccaagaatgaggctcaaaagcagagactttgaatcaagagaggcaattgtagagtgagatgtaaatgccacaaatgcatacttttaaaaatgttttgttcgctgctgtattcccccatacctagaaagtaaaatatttatttaataaaggaatgaataaatttgcaccactctgtgaatggagcctggatagaaatgaggaaacaacccttaaagaccttatgtgtgtaagcacttttgaaattcttgatgcaacttcattgcgtggttgctgcagggaatccaagtcaagactgtatttcctcacattcgaaatgaaggcaatgatgttgaataggtgaagtcagctgcagggtcacccaagctggtcagtgacaatgtcagagccaggatgggatcttcccaatatggcagaaggaacaagagactcagtaggttcaaactgtgggactaacactacccagaataaaaacctggatcatggacagtgtttttttggacagaaattttga

SEQ ID NO: 103150 - DNA, 260 bp, Homo sapiens
acacccttgactttgccaggctctagggaccaactacttcttcggcaatgcgggcagggcatgccacacccatttctgaaactaagcgggagattttccaggtttttctgctttttgttaactcggccattgcacaggatagggaaaggatgtaatagaaggtgtgtgtgtgtgtgtgtgtgtgtgtgtgtgtgtgtgtgtgtaatatactgaatggcaggcagtgctgtagtgaagagcaaaactcaaatcgttaatat

SEQ ID NO: 103151 - DNA, 239 bp, Homo sapiens
ttttgccgtgtttcccaggctggtctcgaactcctgagctcaagcaatctgcccacttcgacctcccaaaatgctgggatcacaggtgtgtgccactatgcccggcctccagaagactttttaacagctcacagggcacagtttagaaagcactgcctgcaaatcgggtggggtgctgaaatcaaggacaagataaatataataggaaagacgtaacagataaaaaaattttccacatt

SEQ ID NO: 103152 - DNA, 249 bp, Homo sapiens
tgagtgtatagactggagtatactgtggcattggagtgataggaggacggggttgagtaagcgctgacatcgcgcttattgcactccagcctgggggacagagcgagactatctcaaaaaagacagaaaaaacctgaagaaattcctaatggcagcaaggctccaatttccccagctctgccaactgtggtgactccctctctggcccaggatgtgcaggagcactgggactgtgtctcagggcccccg

SEQ ID NO: 103153 - DNA, 471 bp, Homo sapiens
ggttgatgcaatgttattttaatgagtttattggttcgatgcacaaaacaccacatggtgcttgaaggttttaggttataaattttctcgtgaggcacttacttgaaggaactctgttacataatcaattggtctttaaatctatccgcacaaaatacaacctttcagttttttacatatatggttgttattatgtgattatgaaaaccaaataaaaatttccatagaagatgttatattccttaatgaactattttgtatatatattgaagttttcacaataaacatttatttcacagtatttgttgagtgaatctacaaagtgaatttggagtcttctagtaaagactgagaataaaggatcttcctctttattttgtctttgtacttcctgtcctgaagggacccttagcagacatgcctgcatttggcaataggcctactctatcattgttacagtgttaactgtac

SEQ ID NO: 103154 - DNA, 914 bp, Homo sapiens
ttgaaatctgtccgcacaagttcgcctccttgggaatcatctcgcagtcctgagtcgtttggttattggcgttcaataacctttgggttattgggtagaagatgaatgcgtttatataaagccactttcaaaactgagatgggaacgtgtttcatagggacagatttctcctcccatctgctggtttcctaattatctggctgttgtagaacgtagcattcctgacagctttgaagccttgctacttcgtggtggtttgaagaagttactatatgatgatctcaggcgttgtagcagaggcacttcttttttgaccatctggaatgcccttagttgacgctggccacttgagtgtaaaatatgcgtatcgctcctaaggaaaagtagaatttcaacttcattgcttaaaaaaatcatgaaattaaactatagacacttctaagtcgatggtttgacagaagggcggagactgatagttttgtgtctttatgtgtaaaattatgtagcatctgatcaatatcttttgtgaaactaatctgttctctttgctatggaaagatttatctgcattaaaaactcatgatttaactttaatacaattttattaacagacatggcataacgcttagataaattggaaaattcttccttcgaaaaaatcaaattgccgggcgcggtggctcacgcctgtaatgccagcactctgggagaccgaggcgggcagattatcagaggtcaggagttcgagaccagcttgaccaacatggagaaaccccgtctgtactaaaaatacaaaattagccgggcgtggtggcgcatatgcctgtaatcccagctactcgggaggctgaggcgggagaatcgcttgaatctgggaggcggaggttgcggtgagccaagatctcgccgaaccg

SEQ ID NO: 103155 - DNA, 502 bp, Homo sapiens
attttttcagtgccctctagaggaaagtagcacatattggttcctagcactgccgaatttatgcagagttctctttttgggggcatcttaagagttcaagatcacatgcaaagtcaaggttgtgttggaagtaggagccgtgacttctgactcttaggattgatgtaactttccacgttttgatttttccaactggcatgttagtgttttctgggagaagatttaggatgtgtgggaatggagatagtaccattagattcttcgggactgtttggatttcctaccttgctaaacacacaaacagcttcctgacttattttttttttttttttaaaaaggattcatagtgggagaaaagggcatgggagattttcaattcataaatacagttctggctgacatatattagaagaggctaaagggttttgttcttttttttccccctttggataaaagtatgaagcagtgaaccaggcactgtgtaagtacttctttctttcct

SEQ ID NO: 103156 - DNA, 705 bp, Homo sapiens
ctgcagtgaaaaagtctgttttgcgtcgaaggaagctgaagaaagtgttcacaagctcccgcacgccgccctcgtgctgctgagccatggccagcaacatgccatcgaaccgctcctcctcctgctctccgcccatcgcgccggctcggatccacgtcctgaggtctgcgctctagtcctgtgctctctccactacttcgggtcacgccgggcccaacaactctagtctaaatcagtccttatttctaaaaggtacataagaattcggagttaaagatctaactatctgaagacaaagtatctcccactgccataaactgaatgtgtctcctcaaaattcatgggttgaaacctaacccctaaatgtaatggtttcaggagatggggctcttgggaggtgattagatcatgaaggcggagtcctcgtaaatgcgattagtgcccctaaaaaagaggtcccagagagcttacttatcctttctgctatatgaagatacagcagaaggatggctgtctccaaaccaggaggcaggtcctcccctcaaatttgctgatgccttgatcttggacttctcagtctccagaaccatgagaaataagtttctgttctttagaagctacctaatttataggactctgttactgtacagcaggccacaatggactaagacaccctacactgtgttaggctttatagaaaaaaaa

SEQ ID NO: 103157 - DNA, 577 bp, Homo sapiens
gaaggaccctcaagacacagtcctgggctcccaggcaggaccaacccccaaacctgtccccccaggagcctgcagagccactgccctgacaggggacacctcacttcctctccttgcagctgctcttggctgggagagcagagaacaggggacaggagagaagccccgagagtactgaagctgaggctggggcggtcttcacttccctctttcctcggcccttttcctgttctcttgtcttgtctctctttctctactttccttctccctagcccagtctctcaccgctcttcagcctctgggcctttccttcttcctctcttgccctcattcttccttctctgtccctcttgtcttctcttttacctcttctcttcttccctccttcctacagctatgccctcttccctcctttctcttgtccccaaccagggcattagaaatgcattccagttacactgatctgatcactgcatattgtatgcatgcatcaaaatatcacatgtaccccagaaatatgtaaattactgcatatcaataaaaagaaatgtagcttctttgcctcacatacagaaaa

SEQ ID NO: 103158 - DNA, 403 bp, Homo sapiens
gacgcttggtgagagaactgagttcctctgaaggggatggaggaagcaattgacatgaatttattatgactgcttgggggcaccacaattgcttttctatttcctgaaagtaaaagcaaagtcaaaaatgatcctaataatgatagtagtttcagtagaaggaagagtattaataatgatatcagaggacattgacttagtgcatgcgcttagtgcatgccagatacaactctgaggcctttccagatgtcatccaacttaatccttatgattctacagggtggtgctgtggagtgcttggtacacactcagggcatactgtctgggtttgatccctggctctgccatttacaggcagtgacctgggatacgtcatctggctttctggtgcccccgtattctc

SEQ ID NO: 103159 - DNA, 731 bp, Homo sapiens
ccatcttctcttcctcttccccaccgtcctctccccacgccctcttctcctctcactgtcttctccccgcgccttccccacaaccgttttctcccccgttttcttcccctcacaccgttttcttcccatgtcctcccaccgtctcgcagcagcgtctgtcagtcgcaatcttcttcccactttcttctctccccctcccatcgtcttttttccccagcctcttattctccgccatcttcttcccctccccaccttctcgcagcagcgacttcctgccgcgtttttctctccccgcaccctcttctcccctcttccactccccaccgtcttcgcccccgatcgtcttcttgcccacccccttctcgcgctctccaactgcctttcacctagaagcgctccacgcgtgcgcccgcctgtgtccctgcgcctggtgtgtctgtgcgcccagccagccccatgagctgggcccctgagctccgccccaacagccaacaggagacccaggagagtcgctgccagggccatcacggctgccgccgcccccgcccccgccgctacctcagaactgaacagtgttggctgcgggcgaaagacagtggggcccggaagactgcggggagagggggaggaggggacggagagggtgggaaagaccttggaaagtgggatggggagaaaggtggggaagaagacagtggggagaaagtgcagggagaagacagtgtggtaga

SEQ ID NO: 103160 - DNA, 371 bp, Homo sapiens
ctcccatcagggtcctctctggacttctggcctccatttctctaatccacctccatgaatcagctaggtagacatttattaatttgtctatctgactgtattactcccgtgagtgtaaccccttcatgcccctggggataaagtccaaactcctcagatccacagggcactgggcaatgtggccaacacagatccctctagccagttctcttcccacagccacccctcttcttacactctggatgccagtgacactcaacttctttcagtcacttacatgcagccttttctcaccgctgggcctttgcacatgctgttccttgcatgtagaatactcttccttgtctttgcgcaactccttccccctaatc

SEQ ID NO: 103161 - DNA, 1038 bp, Homo sapiens
ctagataggtgtcctgtagaaatgttaaacacgggtgagatgtgggaagtggctgttttctactggagatggagaggagccacctccccacgctgagcatctgtgggcatcatgaacatttggaacttaagccacaatcatttgaatttttttggatgccccagttgttttccttctgtcaccaacaactttgggacttccctactgcagaattgtcgcatattaagtaggagacctcagttgttatggagtttttctcctccctagatacctagatctgtgaaagaaatccacatagcaaacgcttgtctagagctacatctctggacattttttttcctttttctgtagcaatagtgaaaaatttcttattcttacagtccaaatatatgtaagtgtacttaattcttaagaagtttattttgacactgacattttagtggtattgatgatacagttctacctttaattttatttgtttttttttttaatcattagagatggggtctcactgtgttgccgtggctggtcttgaactcttgggctcaaacagtcctcttgcctcaacccccaaggtgctgcacccttaattttaacttgtttcatttaagttacatatttgaaatgtcagactgtactttatgaactgccttaaattacttttcaaacaagatgggttataaataaggtgatgctttggcctattatttttaatatctacatttttacttttttgtgagataaaaactaatggggctggacacagtggctcacacctataatcctagcactttgggagacccagagaggcggattgcttgagcctaggaattcaagaccagcctgggcaacatggtaaaaccttgtatctacaaaaaaaatacaaaaattagctgggcttgtggtacccacctgtagtcccagctacagggacagctgagatgggaggattgattgagtccaggatgttgaggctgcagtgggcaccactgcacttcagcctggatgacagagagagaacctgtctcagaaaaaaaa

SEQ ID NO: 103162 - DNA, 350 bp, Homo sapiens
gctggctctaggtctcctctccagtctcttgaacccggtgccatccctaatgaaatttaaaggggtctggcacgacaggcccctcacccagcattcagctgcttttcaaacagcatcatgaagatcacatgaacaccagcttgaaaccattcagatctggtttaagtccctcgtccaccacacttagcctgcgtgaccacaagcaactccctgagcagctggccttaggtgtcttcacctgaaacctgcagggcaggctgataggaaaccttctcagctggctacaagcacagcaaggaagaagaaacaacggcccagagatgataccaagtcaactggagctgcctttc

SEQ ID NO: 103163 - DNA, 398 bp, Homo sapiens
tcccaaaaagggaaacagtgggttgtgtttataagtgcaggtggcaggggcggggaggagacacaggtctctgtctttgtttacccacttccgcaaggggaagccaccgccagttacaccacctgagcagagggagcttctgccagggcccgcctaggagggaccagcaaaacaatggtagtgagctgatgtcaattgggcacaagtcccagggtggctgaggcttccctgtcaatcccacccctcttagctgtcaggtcactccagttactgcaaagtccaacccagcttctcccagatctcctgggcccacagggatgtgccacaccccaagtcctgtggtagttactatctacaagacaacccttgcagcagctctgccggaaggaagcagaaac

SEQ ID NO: 103164 - DNA, 258 bp, Homo sapiens
taaatggcaaagtctttcctgtcacctctgtcagtaagaaggaaaacatcatgacagcttagtgtcatgacaggagtgggccaccttctgcccctgctccccaaggctgaggtggtccggaaggggctcagtgccccagacaagtgcatgatccagatctgaagacacctaggagatggaatgacaaaccaaacctaaagtgaccttcataggacaggacactgagccaaaaccaacaagctgaaggcgaaggaggca

SEQ ID NO: 103165 - DNA, 142 bp, Homo sapiens
taatttctgtggttctatgtcttggcctggctatagactcttggaggagagaaactctgtcttgttcttctcttaaatcctgggagagatcctccatgaggtgtggtattgagtgggtgctcagagaagccatattggatgc

SEQ ID NO: 103166 - DNA, 695 bp, Homo sapiens
agcctaggcctattaatcagtctaagttccagcctggactgagcgagtctcgagaaagccagctcctctccttttgtgctgaagggcaggggaggggaaccaagattgaggatcaaggctgcgctgcttcagtgccttcgtggacaaccaaattccagttgccagctttcttcgtaggcatctgttcctcacaaaatggcttcagcggaacataactttccaaaagaagagcactccagcccctgcctctacgttcacctatctttctgagtcagcttttcagcaacaaatgccaccaagctagttagctgacagtaccaactacagaaggaaatcatgttggaaatgtcactgaggccgggctgcctccccgcctgcacccacagcctctttcatctcaccacccattccttccagagcggcagaaggagactgggtggcaagtgtatttaggattctgaggaaaatgtctgttaagtcgaccttggtaacttaactgaaacagtatatgtgtaaatccattgaaaatccctggccttttacaacttctgtcccaatggaaatcagatcacaggactgtttacaagagaccacgattcatttggataaagacccatgacagcacggcccaggattatttgaaattttagtaacctaagctttaaaaatattctaaaagcaaaataatgaggggc

SEQ ID NO: 103167 - DNA, 739 bp, Homo sapiens
aaaaataaaataaattagctgggcatagtggcaagcgtctgttgtcccagctgctcaggaagctgagatgggaggattgcaagcctgggaggtcaaggctgcaataagctgtgattgcaccgctgcacaccagcctgagtgacagagtgaggccctggttcaaaaaaaaaaaaaaagagcaggaagtagaattgggaaagaaagaagcttcaggcagggatttgtaaatgaacaaaaccgcaggaatatttgcatactgttttaaaaaacagtggttacaatgagtgagtctcatctaccctcaggaaaagaaagagggtataccagcagtctaaagcccagcccatttggagattttttgggaagatttcttgtgataagaaattgtcggccgggcacgacaactcacacctgtaatcccagcactttggcaggcggatcactaggtcaagagattgagaccatcctggccaacttggtgaaaccccgtcactactaaaaatacaaaaattagccaggcatggtggcgggtgcctgtaatcccagctactcaggagactgaggcaggacaattgctggaacccgggaggcggaggttgcagtgagctgagatcgtgccactgcactccagcctggcaacagagggagactccgtcacaaaaagaaaaaaaaaaagaaaagaaaagaaactgtcttccaggtgctgtcctaggtgttagtggaagatacccaaaaaacc

SEQ ID NO: 103168 - DNA, 783 bp, Homo sapiens
taaggctagcatttttagtttgtttagagaatttggattgggtgcagcaagacatttttgaagtcattcttttaaatagatgttccatgaaggagggaaaatctgaaagaaggaatttcaaagcaacccaagcagtgttttgaaaattctcaagactgaagaataatgactgactagtaggcaggaagcctgcagttgtattgtggtattgttcctccatctcatgcatttgagaactttagtacaaaagaagagaaagcatggggaggggaagaaagggttttaacaaaaaagggggcacttttggagtaaatattctttgcccttctgtttaaatgaaatctaaagccatattattttactttgaaagaaaatgtgtatcataatagaaatgtcctaaactgacatttttataaatgaaagttaattgctgttggtggaaagagcagcatgatcatatgttcagtttcaaaacagaactttgattaaaaagaaatctacatgtgaaaacctttttttcctttttggtacctgatcaatatattttgttagcttgttactttgaaaagaagacttacctagggcagagttcagaataatttgtaagcatgtgctataagctttggacaaatcaatctctcttggccagtttttaaaattttaaaacaaagggtgctctgtatggttttccaaggttccttattttatacaattctataaacttaaggcattatgtagatatgtacaatgctcttttacttaaattttgttgattgaacataa

SEQ ID NO: 103169 - DNA, 139 bp, Homo sapiens
  misc_feature (16)..(16): n is a, c, g, or t
cgcactctagctcggnacccagtagatccaaagccaaagtctcacctcacacagtgggattggtcagtgtatcctgtggataaaagaaaggctgggaattatcctcctgtgtgaaaactgaggcacataggaagggtca

SEQ ID NO: 103170 - DNA, 463 bp, Homo sapiens
tatgtatgatgtgagctagcattccaattatatttcttttcctatatggacaatctgttatttcagtatgttttttgaaccgttcatcctttttgcactgattggcaatgctgcctctgtcatacatgaagttccagtgtatgtacgtgcctgttattggggaacattctttctcactggtttctttgtcaattattataaaaatgatatgttgtcttcattacagttgtcttgtttaaaagtccagaaatccagtaggacaagtccagcatcctgtccttttttagaaatgttttgactgttcatgacccttaccttcctcatataaagtttagtattatattgacaagttccaagaaggatcttatttagattctgattgaaattgaattgactctgtaaattaatttggggattcttctctatgattgagtcttgctatatagaacatgctatatcttat

SEQ ID NO: 103171 - DNA, 440 bp, Homo sapiens
atacatgtatatggaaaggaatatctatattagacatcacagttaacatttaaaacatggttgtgaaaaaaaataaaaccaacagtagctatggcttggacttacctcttttgcagttatcttcctattattagataatctacttggtaaaattgcatggtacaagaggattattaataaataatcattaaaaatggctagttcattcagactattctccatattcctgctgttgttattgcaataactttccaaattttctaaatccatgaataccctttcaatgaatataatttttctacattatcttcctacctctctctctctctgcttttatcttaattgataatgaaacccagtaaggtaagtgattatttagaccaataacattgaacaaatcaatcattcctaaatgtaggacccaaacttatatcacagaa

SEQ ID NO: 103172 - DNA, 152 bp, Homo sapiens
tctgaatgaggaaacttaggttccgggaaactaagtgacccacccaaggtcattcagagagtcactggccaagctaggcttagaactcgggcagtctgattccaagttggtattgctaaccacaatgctgtcctctctatggcacgaaaaac

SEQ ID NO: 103173 - DNA, 450 bp, Homo sapiens
cattcatatgaattggaatttaatataatagagataatatttcagatcagtagagaaagatggatttttttcaggaaatggtataagaacaattggctgtccacttcaggaaaaaatatcaagtgaggctcctagtcaggactgtcttgattgcaaattacacattcagctcaaactagctgaagccaaaaagagagcggacatattgggaggatgttaaggtatcacagaaaggagggaataggtgaacagtattccctcaggaatgcaagaagcagcaaacctcttcagtcctcatagactagttactctttcatttatatcatatgttctccacttcatttttaactacggtaggctaactctgtgtggcagagaatgtagcctttagcagcttccaggttttgtcaccttttgaagaaaagtgttctctggcatgttgaaaatact

SEQ ID NO: 103174 - DNA, 485 bp, Homo sapiens
gcttgtttcacttaagaaaatgacctctaagtccatccatgtgaccatgaatgacatgatttcatttttttaatggctgaatagtattccatgtgtatctatatcatattttatttatccactcatcaattgatgaacaattaggttgattccatatatctgatattgtgaatagtggtgcaataaatatacaagcacaggttttttgatatattgattttgtttcctttggatagacactcagtagctggattgctggactgaatggtagttttatttttagttctttgaaaaataagtctccagatgctgtaaatagtgattcctttgaggcatctggcaaagtaaatttaaaactttctggaaaatttcactctcctacataccattaagtacattcataagtcatgggaggaagtaaaaataacaactagtttggaaaaagagaagattccagtcgaccggccgcgaatttagtagtagta

SEQ ID NO: 103175 - DNA, 330 bp, Homo sapiens
gtaaaatgaggataccaatacctttctcacaacattgttgcaagtattaaatgatcaaataaggtacccagtaaaatagaaggaattcatgacatataaattcttctttaatagagactccgattgtttttcttctttcatttacttttgtttcaattgaattttctattatcctgttccaatcaacagcggttttgattagaatattttctgatgtttcggaaatatgtcagtgaaggactaggggtgtgcttctcctgcatttttgtacataaactaaacatccctttcagccacaccctcatggatggtttaccatttcagtagtac

SEQ ID NO: 103176 - DNA, 426 bp, Homo sapiens
gatggtgcatgcctgtagtcccagctaactaggaggctgaggcagaaggatcagttgggccaggaggtcgaggctgtagtgagctgtgatcatatcactgcactccagcctgggaaacagagcgacacctcatctcaaaaatagtaataataatcagtgataacaccatgatttttaaagataatggaatttgagtgatttctcactagactttttattgttaaaatttaaatcagtgaatgtaagtgcagactataaggtaagatgtattatttttgtttgatatgtagacattttagttcaggaatggccattttactgaatttgattatcttgaaaattgaaatttattctttaaaattgttagttgttgttaaaccaaagaataaatcaataaaagaaaacattaccttaaaaaacaatgta

SEQ ID NO: 103177 - DNA, 413 bp, Homo sapiens
tgagacagagtcttgctttgtcacccacgctggaatgcagtggcatgatctcagctcactgcaacctccctgcctcccaggttgaagagattctcgtgcctcagccactggagtagctgagattatagacgctcaagaccaggaatggctaatttttgtatttttaggagagatgggatttcaccaagttgcccaagctggtctcaaactcctggcctcaagtgatccacctacctcggtctcccaaagagctgaaagtataagcatgagccaccaagcccggccatcttctgcatttttcagtcttactctattcttcatgatgttttgggctgagctaaatttgaacccaggcttatacagccccaactctatttctttcttctttattacacagccttgcagaagacaac

SEQ ID NO: 103178 - DNA, 380 bp, Homo sapiens
tctctatctttccctctagactttaaacttctggagagcaaggctctcatttcatctttgttatcccagtatctgacatgcagtagatatttttcaaaatgttagctaaaacaataattaaggggtgtgaaaacacattaggaagcaaaaagtggccaggcacggtggctcacgcttgtaatcccagcactttgggaggccgaggcaggcggatgacctgaggtcaggagttcaagactagcctggccaatatggggaaaccccgtctctactaaaaatacacacgcacacaaaaaaattagctgggcatggtggcttgcgcctgtagtcccagctactagggaggctgaggcaggagaagcacttgaacctgagaggcg

SEQ ID NO: 103179 - DNA, 418 bp, Homo sapiens
aaatggatagtttttcagtggataggaacttcatcttaatgataaattatgccacagcctccttccagagtttcattttctcctgggatgatgataatacaggcttttgattcttaacctttttttatttggttgacttacgtgaacttttctgcaataaagaactggaaattttgaaaagagaaccaaaagaacaaagccaatactaaagcagtcaaatgtaactgccaactcctccccagccccacagtttgaaaacaacccgtttcactcaatgctctacctccagcacctagaacagtgcctggcaaaattatgcatttatgcctttgtaaaatttgttgaatgaatgttattcctttgaaaaagaggaggacgacagtagcactgctaaatacgggtttgagttttgggaaca

SEQ ID NO: 103180 - DNA, 1076 bp, Homo sapiens
aaagacaggtgactagaaatattaaaacaaaaacaaaaaaaaagagagagagagaaaaaggaaagagaaaatacatatttcttccccttactaagctagcgaaaataaaatttaaggcaactgaaatatgcacccaatcaatgtgagacgagaccccagcatccctatctatggactccgacagtccatcttattaaataccaggcttcaggactgctatgtggactcaccggctctcaccaacatctggatggccagaacatgtgcaaagcagaacattaatgccccagcaccagctaccacttcctcttgggaagttgtaaggaacccattaattgccagttccttctccctggttaagcttgtactcaggcggcaactgaagaataagtgctgcccaccaccatgcaagtttggagaaggaaaactctcgaagagattaaagcacaaggacgattcagtgatgaaagccacccagcaggccaggaaaagaaacttcatcagttccaagagcaagcagccagcagggcataggaggcctgcaggaggcatcagagagagtaaagaaagttcaaaggagaaaaaactaacagtccgccaagatcttgaggacagatatgctgaacatgtggctgccacccaagcgctaccccaggacagtgggacagcagcctggaagggccgagtgttgcttcctgaaacccaaaagagacagcagttgtcggaggacacgctaaccatccatggtctccccacagagggttaccaggctctgtaccacgctgtggtggagccaatgctgtggaatccttcagggacccccaagaggtacagcctggagctgggcaaggccattaaacaaaagctctgggaggctctttgcagtcagggtgccatctctgaaggtgctcagagggaccggttccctggcaggaagcagccaggtgtccacgaggagcctgtactcaagaaatggcccaagttaaagagcaaaaaataggaacaagaactcatgggattagagtattctctgctagagatctgaaaaataaacacaactttgcaccttcaaaaaa

SEQ ID NO: 103181 - DNA, 1001 bp, Homo sapiens
  misc_feature (1)..(1): n is a, c, g, or t
  misc_feature (13)..(13): n is a, c, g, or t
  misc_feature (28)..(28): n is a, c, g, or t
  misc_feature (32)..(32): n is a, c, g, or t
  misc_feature (34)..(34): n is a, c, g, or t
ngtctcggagagncgcgtatactcatcngtancnggggagtcgtcccggtgcaagcacccaatcaatgtgagacgagaccccagcatccctatctatggactccgacagtccatcttattaaataccaggcttcaggactgctatgtggactcaccggctctcaccaacatctggatggccagaacatgtgcaaagcagaacattaatgccccagcaccagctaccacttcctcttgggaagttgtaaggaacccattaattgccagttccttctccctggttaagcttgtactcaggcggcaactgaagaataagtgctgcccaccaccatgcaagtttggagaaggaaaactctcgaagagattaaagcacaaggacgattcagtgatgaaagccacccagcaggccaggaaaagaaacttcatcagttccaagagcaagcagccagcagggcataggaggcctgcaggaggcatcagagagagtaaagaaagttcaaaggagaaaaaactaacagtccgccaagatcttgaggacagatatgctgaacatgtggctgccacccaagcgctaccccaggacagtgggacagcagcctggaagggccgagtgttgcttcctgaaacccaaaagagacagcagttgtcggaggacacgctaaccatccatggtctccccacagagggttaccaggctctgtaccacgctgtggtggagccaatgctgtggaatccttcagggacccccaagaggtacagcctggagctgggcaaggccattaaacaaaagctctgggaggctctttgcagtcagggtgccatctctgaaggtgctcagagggaccggttccctggcaggaagcagccaggtgtccacgaggagcctgtactcaagaaatggcccaagttaaagagcaaaaaataggaacaagaactcatgggattagagtattctctgctagagatctgaaaaataaacacaactttgcaccttcaaaaaa

SEQ ID NO: 103182 - DNA, 405 bp, Homo sapiens
gggtttttgagagaacagcagggaagggcagcaggattatttcatccacattcagggtgttatatctagaaatatcataattgcaagtaaagatggtgaagcttgtcgctttcctcacagtgctgtgcttcatcttgatagtgcatatcacatttctcatggaacatttccttccttaagcagtcggtacctttaaaagagcatgtcttaactgaatgtcattatcaccaaaagtctattcaaatgataacatagagctatggttacagatgtaaactgagatctgtgaaatatttttggatgaaaatagcagcctcttgaccagattatttttcatataatgttatatttatggaaagtttcttagaatgatcctcatcaaaatgcttgtagtagttatcttta

SEQ ID NO: 103183 - DNA, 210 bp, Homo sapiens
caaatattatataaatgaataaatggtagcagtcacctgtgggaagatgccgagagagagacagatgcatacagctgctggtgggaacagatcagtaaaccatatagagtgaagctggcagaacacaccagcgaaaacagacatggaagacctctgacccagaaattccacttctataaaagtgggaatatatgagatgggaggaaggat

SEQ ID NO: 103184 - DNA, 541 bp, Homo sapiens
gtcctgacaatgctagtatattctactgcttaataacggatgccacttactaatgaattgtccttgagcaaacttcatctctatattatcaatattgatgacatttaaatgcttgctccgtgttaggcactgatcgaatcagtttacacatgttaagacatttattcctcaaaacggtctatgaggcaggcattgtcatcatccccattttacagatagataaactgggcacagagaggtcaagtgaaagtccaaggtcacagtgttggcattttaagcagcccatttaactatagtgcttccagtcttaattactacattttagattctaaaataaagatgacagtatcaatttcttacatttgctagcagtttttcgaaagtagttgccatagagcctgacacacaggaaacatttactaaatggcagtcactggaaacaataataatgaaaatgataagcccccagttaagtagaactataattctaacctggtcatatttacctctgaagtccacatgtgtatcctttccccctaca

SEQ ID NO: 103185 - DNA, 368 bp, Homo sapiens
aactgattagttatttaggcacaccctgtgaagaattatctttataaggggagtcattcaattagactaggcagtgcaaaattcattcctgactttttaactgaactaaccaatgacaacaccttggccctggaaggcattaaggtctgcctcaattcactgacaagagttattatggatgataaaattgccctggacttttttcttgtgagccaaggcagagtctgtacaattaactaatatatcttattgttcctagattaatatcttaggccaaaaggaaagatcaatacagaaagctacttggctttctgaggtagaccctgatggcttatgggatttcattatcttatttgggtgtgggattc

SEQ ID NO: 103186 - DNA, 433 bp, Homo sapiens
ctggcatgtaccagatgtcttcttagaacacataagcatgcattttcttctctgcattccctacagttaccctttctgggccacagtactttcagatatttgttgataatgtgttctttgcgatcctcatggcccaagattatacagttattcatacctgaagaaagagttgttaaatagggatctgtggccatatctctacacaaagtgaacatcgggtctggggaattaaaaaatgaacaggaaagcacacttgtggcattgtactagaccctttacacatattatcttatgatcagaatgtattattattctgctatacatttttctaaggcaaatctattctattatttccatccagagatgttttcccagtaaaggagatttgactgactatatagtgttaagtcacaataatttttataatggaaat

SEQ ID NO: 103187 - DNA, 343 bp, Homo sapiens
  misc_feature (1)..(1): n is a, c, g, or t
nggacctaatcacaggtcgtggcagtaagggcagggcggggttgtgcgggctcacacctgtggtcccagctacttgggaggctgaggcaggaggctctcttgagcctaggaggtcaaggctgcagtgaactgtaattgcaccgctgcaatccagcctgggtggtgacagcgaggacctgtgtcaaaaaagtatgcgtgcatgtctagttgagtctgtgtgtgattgtacattgagtgtgactgtgggtctgtgtgtgtgtgtgtgcatgtgtgagaacgtgtatgagaagaggcatggtgcagggtttaaggtttatatactgaaagaaagttctcatttcag

SEQ ID NO: 103188 - DNA, 292 bp, Homo sapiens
ggcaatgagtgggagaaattaatactattaccatcagcagccataaatgctgtgagtagtaagtgaaggtggtgggtaggtaagggagaaggtttgtcttggtaacctgagcaaatgaacaaatgcaatgaagacactcagctaaatatattcctttgttcattcattcattcattcagtaagcatttcctgaggccaattctaggccagatcccatgctgggccctgcaatccagatatgaacaatgagagctcccattaggttggtaaaggggaattaaggatggctggg

SEQ ID NO: 103189 - DNA, 607 bp, Homo sapiens
gtcaggttccaaacatgacagcacacagccatgaagccctgccccattcagccagccctgtgcaaagctttccagatacatgaccttccctactgcctcctgaaccccacgggacatgtggcattagccacacttacagagcctcagaaaggctaagcagctcgcccagtgacacacagtggaggtgacagggccccatccccagctttaggtcacggcttccctcctcactcatacgaacagcggacaccacatagaacagaggcgccaggccctgcccgaagtgctttaatgcatgatgtgcttcagctctgtgtccccacccaaatctcatctggaattgtaatccccaggtgttgagggagaggcctggtgggagtggagggagaggcctggtgggaggtgattgactcatgggggcggtttcccccatgctgttctcgtgatagtgagtgagctctcacaagatctggtggttttataaggggctctttcccctttgctttctcttctctctctcctgccaccatgtgaagatggtccttgcttcccctttgccttctgccataactgtaagtttcctgaggcctccccagccatgtggaaa

SEQ ID NO: 103190 - DNA, 132 bp, Homo sapiens
ctaaggacactggagataagaaaattaatttgtacaatctcaataaacaagtaagagaggtgagaagaattccaactcacatgggctaacaaccagtctctctactgctccttcctatcagcagctaatcag

SEQ ID NO: 103191 - DNA, 122 bp, Homo sapiens
tgatgttttcagggtctaaccatgccttagaaatggggaccatattgactaccagacgtatctcagagtcctcagtctactagtgatctttctttttcctctctctcctccattggagtttc

SEQ ID NO: 103192 - DNA, 121 bp, Homo sapiens
ttctataatatccaggtcagagtagtcatgaatttcttcccatcatccattgatacgtattcttatagagtaccaaacatcagccaagacccaagtaatacagtaaggtagctattatgga

SEQ ID NO: 103193 - DNA, 768 bp, Homo sapiens
ggctttgaacacaatctggccttcagatgcagttgagacattacagtaatcatcaaaataatcccatctccaccatgcttattttgcaaaagcagtatagggccttcctctcatccctccatagtggttggaaacagcaatcaaattatagcagcgaggccctgcgcttggattaatcagaaattccaatacagccaagtcattgataggaaaatcaactaagttatctaacttgtttctcaaggatctactgtaagaaaaatcacttgagatgcaacagctactggaggcagggatcatacatccaatttcttagtggtggcttcttgacggatttggataccaggaatctttatcacttagttttcttttgttgaaaagggtctgaggcagtcttttaatttcgcaaaagttttttttttttcaaggaagtttatattctatgtttccatatttttcaaaatcttctgtggcattttaactcaggatcccaatccaaggccagaatagatctttcatctagcccaagctgcccatcatcgaatcaaacatgtctggtatcatttctgatgtagctgatatcaggactgcttaactgttaaactggagctgatatcaggactgcgtgttaaactggaatctaaactaccattttttgtgccctgtgagatgctgacctttgcaaatttcatcaacacatcatcccttttcaaagtcattgtctcctccagctaaatctttagaatgactgttttttccctgagggag

SEQ ID NO: 103194 - DNA, 430 bp, Homo sapiens
ttgagacagggtctcactctgtcacccaggctggagtgcagtggtgcaatctcagctcactgtaacctctgcctcctgggctcaagccatcctcccacctcaggctcccaagtagctgggactacaggcacacaccaccacgtctagctaatttttgtatttttatagagatgaggtttcaccatgttgcccaggatacttttgaacccctgggctcaagtgatgagcccacctcagccttccaaagtgctgggattaaaggcatgggccaccatgcccagccagatttttttctaatataaaaataaagatgggatctcattacgttgtccaggctagtctcgaactcccggcctcaagcaatccttccccctcagcctcccaaagtgctaggattacagatgtgagtcatctcacctggcctaaaata

SEQ ID NO: 103195 - DNA, 192 bp, Homo sapiens
ctgcaattcttgagagatctctatttcaatggggttgctaacctggtagaaatatctaagaagctgctggtgggtggtcatctttgccacagccatcctatgggtacagtgtctctaagaagaagctacacataggaaagcagtatgtgagtgggaatactcattacagtttgaacacctacctggatctag

SEQ ID NO: 103196 - DNA, 175 bp, Homo sapiens
tggaccgaaagctcaggaaggagctgtggggacggtgcactgtactccgctgagccaggggaggtgctcagaggcggcctcgagtcttctcgactgttgggaggggaagatccacgtagctctccgcaggcccacaggtagaaacgctacctctgacacctttcgcgttttcatg

SEQ ID NO: 103197 - DNA, 401 bp, Homo sapiens
aaagtgaaatacaggctgaacatcccaaatctgaaatctgaaatgctctaaaattcaaaattttttgagcactgacatgctgcttaaaggaaatgctcaccggagcatttcagagtgtagatactcagaaatattccaaatatgctaaaattggaaaagctttgaaatctgaaacacttctggtgtttcggataagggatgctcaacctgtagtgagtgagtggttggaagttagaacatattcttctgtagaaacaaacctgtttgacccacaatttggccaatatacggagatttgagatgaaaaacttacaaaatgatagaatgactggctgtcattttaccagtaaggaaacaaacccagagaagtgaagtcaggatttaggtttgtggacctttta

SEQ ID NO: 103198 - DNA, 292 bp, Homo sapiens
gagggtcttaggaacacataatggatacaatccagcatgtcacaaagcattatcattctttcttctagattatggcaaagttcctgacttttgttcttccccttgccataagccagtgttggatctggtcttgccttagctgctacagctaacttttaaaaccatcatcatggtcaggcatggtggctcacgcctgcaatcccggcacttcgggaggccgaggcaggtggattacctgaggtcaggaattcaagaccagcctggccaacgtggtgaaaccccgtctctacta

SEQ ID NO: 103199 - DNA, 821 bp, Homo sapiens
agcatgctgggattgatttgtgatgtctgccacgaatataagattggccatttggggcatgaatgctattcatggattggatctcctaagagcccgaatttctgagaaaccactgaagacctgaccccagcgcttaattatttctcctttccaagcatctctcatggaaggcatcttggatgaaaagacctttggcagcgtgggttttgcagggaccgtctggtaccaggaactggccaaatgtgaaggtgtaaaacacaaagttcacaccctgaagaaccttctagtccagtcggggagatggacccagaatgtcagattaagattggcctgcatcagcccaaatggttccatgttcttctttttaatggctgcatagtactcctttgcatggatgcaccacagttcatttaaccagagtcctgttggcaggcatttcagatgtttgcaatttttctgtgagaccaacaccactgtgatcagcatcctgttgctgtgtgaaaagtccaggctagcctgctggaggatgagtgatgggtgaagcagagatgaattttcagagctggcttcatctgagaccagccagccctagctgtggaaggcagacacttagcaaacccagccaagatcagccaagcccatcccagggcagaagaaccaccaagctgatcccagtccacatctacttctggaagcacgtgctaaataaatggttgctgttttaagccactgagctatgggaggctttgtttcccagcaataactaattgataaatcatcaacagtaaaatggataaatgaattgtggtacaggcacacgt

SEQ ID NO: 103200 - DNA, 396 bp, Homo sapiens
caccagaccagggccaggctccctctgggccgcctccaggtggggactgatggctgcagcccccaccacgcagccctcctccagctcactcacccccagctgctccccagctcactgcgcccctgcctcttgcctgcactcatgccacccctgcctgccacacctgttcctacctgcccccaactgcccacaggagctgacgtggccatttctgtctgccccatcatagcccccagcctcctcggtgggaggtctcatcagtgcccctcactccatcctgagaactccctatgggagggcctgggccagtgcctggaagagatcaggggccctacacactgttgaatgaatgaatgaatgagtgcgctccaattataaactcttagtctttgccca

SEQ ID NO: 103201 - DNA, 608 bp, Homo sapiens
gggagcaatcagtctccccaatttttactcttatatagttatagtaatcaagactgtgtggtatcagtggagggatagacatattgatggaacagaatagacaacccagaaatagacctacgcaaatatgcacgactaatttttgacaaaagcacaaaagcattgcagtggaggaatgatagacttttcaacaaatgatacgagagctgttggacatccatagaaataaacttcaacctaaattttctaccttatgcaaaagtttactaaaatagattatagattaacacgtaaaatgtgaaaatgttagaaaaataaaactggagaaaatcttcagctgtaggattagtcaaagagttcttagacttgacatgagaatactgtcaatacaaggaaaaattgataaattggactacttcaagattgtgatataaagttcttgttaagatgatgaaatgacaagctagaaactcagagaaaatgtttgcaaagcatatacccaaagaggtctcaaatccacaatacataaatgtgtcaaaacgctacaattaaaataatcataaaatggcaagaaaacagaatatatagatggccaataagcagatgaa

SEQ ID NO: 103202 - DNA, 332 bp, Homo sapiens
gctccctttatcagcatcagtccttagctgatcttaaattccatctgctgggccactgccattcacttttttcctatgtacttttattaactgattgtataagctcgtttttgcttttggaaatggatcattattattaatcccataataaatttctttatcacaaaattatagttaagggattatacaatgttaaaaaatacatatggtattaaatagctcaaataggttgcagaccatttgaaaagatcagccaattcattgtgtaaataaaagtttacaattcagtcacttccctttggcaatatctgtcagaattacaaggtccatgt

SEQ ID NO: 103203 - DNA, 708 bp, Homo sapiens
ggcaaaatgatagatgtagatttaagataatatgtataaatactttaataagtgtctatataaggattacttaattactcaacttcaagtttatgctgttaactttagaacttttaagtgagcaatgaaatttatattacatctattcaaaggatatggtaattagatttattacttatcactataagggtccttgctttaagttacttttgtagtgttaaaattgtaggcttgataattgcagaattctgatgagaaaaagggcatatatgtctctgttgcaatattatcaataccttcatttttaaaattaaattgagacattccatccaccaattagtctgaggaaaaaatcaaaagtggttattttatcattaaagatagaacaaaaactagccagcttgtgatttacatataaaaacttgcaaaatgtatgtattttatctaaatttaaataaatgctatctaatactggtagtgttataatgctattaactacttttagaatttgcagatatttgatgttttcttagcatgtagcaacttattttcataatctttaaactgtcttttaggactttgtacattttagtgatgcctatgtttactaaaattagcaatgaaatctaaaaccaaagttattcttctttgcctaataaaaaatagttcttaaataagaaaatattaagtggttaatttaaaagcaag

SEQ ID NO: 103204 - DNA, 417 bp, Homo sapiens
aaggaaaggccttaccttggaattagagaaaggaatttcttgaagagtttaagatgggcaaggtctgtatgtctagaattttctgcatgttgtttttacttgcagaactagatcgtaaagttgcaaatagtcatttgtcatacacaggaaaattgacctgtagctgtgctgctcttggtaatgtgttaccgagggaagggtgggaaaagtaaggctaagttctccaaccttgacccaggccttgggcattcctgtggcagcagcatgaaatgctgacagcttcctgcctccttgcaacaacagagtttgtttaaccccttagtgtctatcaagaatctttatttgtagattcacagatttttacagaacaaaactcaactttgttatagtttttaaaaggtaagttctttttgacat

SEQ ID NO: 103205 - DNA, 326 bp, Homo sapiens
gggctccgagcctgcagtccctggggacccacgggggctgccaacagaattcagggagcctatgaccttggatgggaaagcattacacctcaatttcactcacttctcactgaaattgagcagttctttcaatgagatgtaggcaagaaaccaaagtagcagtggtaggacctgcaactttgttactagtatttgcttatcacatgacagtagctgcaaatatttcaaaatatcatttacacatattgctgctttgaaattgtggtagctactgagatcaccagatcttgttatttgatgtgttaataaagaagcacatatatagc

SEQ ID NO: 103206 - DNA, 84 bp, Homo sapiens
gattcagaactggagacagcgtcctggaggctctcatagtggagcatcctgaaactgctgaaggtctgcctgtgaacctgagct

SEQ ID NO: 103207 - DNA, 414 bp, Homo sapiens
gattaaatgagaaaaccagtctagtgcttagaacacctgtcactcagtaagtatccaataaatattgttatagtacagattaggcaactagctgtgaatggttaaccaggttgcctagggtaatcagtggcaggccacttccaacctagatcttacccattaactataggttgcttggaggtctaaactgcctcttctatatcacattcttgttcagtaaatacagggacaataccttgggttaagtttgaattatgagggataatttatacctcctcatctctcaagcctcagcaagaatcgactgatgtgccctcccatgttgagtcagtgcctaccttatacaggatggattttctgtttatgactgtcttactcaggccctgcttcattagattctctgttcttagcaca

SEQ ID NO: 103208 - DNA, 326 bp, Homo sapiens
aagaggcgaggtctcactgtcacctaggctagagtacagtggcacaattgtagctcactgcaacctcaaatgcctgggctcaaatgatcctcccacctcagggaccataggcacacgccaccacgcccagctaatgtttaagtttttttgtaaagatggagtctcactatgttgcccaggctggtctggaactcctgagctcaagcagccctcttgcctcagcctcccaaagtgctaggtttacaggtgtgagccactgcacctggcccgacttctcttttaatttatccttccatattttaaaaattatttacctcaggctgtct

SEQ ID NO: 103209 - DNA, 473 bp, Homo sapiens
gtaggggaagttgttccaaccccttctttctctcagagccctcagtgcccgttttctcgtggcttattttgattccgcacctctcatctcagcccttgagacatccagtgtgcagccacgaacttttttctctttgtcaccagatgaagtgttttttaaagatcaattagagtttgttgacaggtggagagagtttaaagagccttctatgtagtaagaccgccaagagcaaaggacttagactgtaagggactaactagaggttaagttttggtggggaaagggtggttggtgtggagggaagtgagtggtggaaggtaaatctggcagagggtgctttggggaccaggaggcacatgttggaattatttggcaagtttaaaaatctctgggacataagatagcttgataattgggcagaaggatcaagaaaggtatcgtctcccataataaaattgggtactagtgtggat

SEQ ID NO: 103210 - DNA, 460 bp, Homo sapiens
aaagcacactacatgtttgctaatgaggatctaggaagtattcactgagatcgttaagcttcttcaaatatttatgttcatgtttcctaaaatgcatatgaagtcttagaggaactcttcatcttaaacttcagcatctttgcaggcacctgtaagttgcatgcagtaggtgctcattaagtattcataagtttgatggcatcttctacttcaaagagatactagtgtaatcttggctctttgtttcactaaatgtcaagccgtcctgccattaaatattgactgcacaccctgttaagagctgctttcgttgaaagtaaagtatataaacctcatggagaagacaaattgtgttctttcacttaattttttccaacatatgaaaattttaaaacatccacaaaagtggaaagggttttggcagtgaacatacacctgcatctgcctgccaccaggatgc

SEQ ID NO: 103211 - DNA, 714 bp, Homo sapiens
ggccatgccacattatttggggttcagaaatattagccctgtgatgaaaacagcctggtagaaatcagatcaaccaagcttcctgttctattctgatttagctgctctccttgtagacacagtgtacactcggctgccattgcacaaaaccgtccatttggaattacagcgtagcaatgccctccaactggtttgggactaagtctccccgagcttagggtcccctgcaagtgagtcttccaggtgacccatatgctcttctcaaatgtgttatcccacccatcctgtcttcacccaactgcctaagtctcttcctcctgagtaatagccaacaatccacaatggattttgttctcctttatttctgacagctctctgggtcagaaagatttgttgggagaatggtgcttgaataagttgtaatatgtcttccattagtggcaatgccaaagatgccccagtctttgacccctggctgctggttgaccagtcagctttttagagagcagtggagtacctgccactgggcactgttttcacgtggcatgcccatggtcaggggctttcgcacatcaggtgagtataaacaggaatgaagaaaaggaagaccaagagaaaaatgtgctttgccctatgttattcaactcctgtgagcttagacttgatagatttattctatttgcttagaaatttgcttatattcagagctttggt

SEQ ID NO: 103212 - DNA, 382 bp, Homo sapiens
gacttctacaaagtagccttctcctcctaccagaacctcaggttgcccagacgctggagggcacagggacatctgagggtcccaccacgacaggctagaagtggctcttttatgaaaacctttgtcagaacaagcgaggggacatgggtgacagcctcacaggccacccaacagccacccctccttccttgctgacaaagcccaattttgtcctgtggtctaggcattgccctgtgtgcctcaggcataggctctgattggctaagccaatgattctcctagacaatgattggcttagcctggggcatgtgacccaatcctagccaatgagatgtgaggggtggctattgaggaatgctgggaaaggcttcttggctgataa

SEQ ID NO: 103213 - DNA, 307 bp, Homo sapiens
gaaaaacaccggggaaattgcatcccattttccccaagcccattagcaaccagcggtctcattctcgatgattccgctgagccaccccggctctaggggagggggttttattctgcctctgccgccacccccacccaccctcagaagggcaccagcttttccaatctgtgaaccccaaagaactgcagggcagggacccctggggacccctcaacccccctcacccccgcagccttcagtacctcccgccggcattcctctaccccctctccatgtccacccagcctggccccaagggcggatttct

SEQ ID NO: 103214 - DNA, 438 bp, Homo sapiens
tctggataatggtgatagttgcacagccttgtgaatatactaaaaacccctgaattcactttaaaatggtgaataaggtatattaattctatctgaatttctttttaatacaaaccagccaatacagtgactcacacctgtaatcccagtgcactttgggaggccaagagaggaggatcgcttgaggaagttaaatatcaattaaagattgtgagaaaccattaaaatattacttatggagggttttttgttttgttttgttttgttttagagacagggtcttgctttgtcacccaggctggagtgcagtggcgtgatcacagctcactgcagcctcgaactcctaggctcaagctttcctcctccctcatcctcccaagtagctggactacaggcacacaccaccacaaccggatagttttaaaattttttgtagag

SEQ ID NO: 103215 - DNA, 312 bp, Homo sapiens
acgccattgcactgcagcctgggcgacaagaaccaagactgtgtctcaaaaagaaaaaagagttactcaaattatttcctatgttggaagacaaacttagtggctgggtgtgcattggcgggacccagggctgagaagtagcatattaagtgaggttttaaattcatgcagcaacctgttgtagagcagtactatccaatgtactctagtttgttacaagagaagcctgtgttagaatgcaaatggacaacttttctttttttttttttttgaggcgatcttggttatggagggatgacagctgactcaaaa

SEQ ID NO: 103216 - DNA, 348 bp, Homo sapiens
acacatgtagtacctacctcaattccgatcagccatattttaattgctcagtagccctccatggctctgcctacaacactgactagcacaagtctagttgcacgtaaataagacttcctgggtttgaatcccagatctcccatctactagctatgtaccttggactatttttcttaacttctctgtgccttcagttggtaatctgtaaaatcagagtcataaaaatagagtctacatcaaaaggctttgggagaattaaatgagataacatgtataaaatactcagaactgacacaaagtaagtcctcattagagggtaatcaatattatacaggcttaacttatgta

SEQ ID NO: 103217 - DNA, 318 bp, Homo sapiens
atcaattgagcctgggaggcagaggttgcagttagctgagattgtgccactgtactccagcctgggcgactctgtttccaaaaaaaaaaaaagcacggggagaaatcagaagcaggggctgctgatggggtggccaacaggccatgggatcagctgtggctgctagtcatgtgggcgtggcccagagccacgggaccattgaaatactgcctgagggtgggagcaggtggtgcctgtgggtggcgccctcgtctggtggcggtgtgcacagcatggccaccagggggcagcagaggctgccgaggaacacaggcgtga

SEQ ID NO: 103218 - DNA, 372 bp, Homo sapiens
agcgtccgaggtcggtgcttcgggcgaccttgggttgctgctggaaccctgacgtgcagcaggcccaggccacggttcgcggagagcgtcgggcgctggtcctcaagatctcccggctctgcccttgcagagctcagtgggggagacgtgcgtgcgcttccctcgggcagggccgctgccctcctccgcccttcaccccagacaccctggggcagtggggcctccccccatccggttgcttctgcttttcctaacccagttaggaaactccgagaccacaggagcctcagtccggccactgtggcctccccgtgaccatgacccagaggttggacagccccgcagggctggacgtttgactttggctcagtt

SEQ ID NO: 103219 - DNA, 438 bp, Homo sapiens
agtgtgtgttaactatgacttagctgattttgccatgatcctgaatgtgctattatatgaattgttattacattgaaacattataaacatacaattaggaaaagtaaaatttaaggtttttaactggtaaattcactgaaaaactataaaatctgctgtctagtttttgactttttatagtattatttcaataactatcacattctgtattagctttgatattatttctccactcatggagtaaagtatagaaatcagagaagtgacacagtgctttaaaattactctaactagccgggcactgtggcacacacatgtagtccttactactcaggaggctgaggcaggaggataacttgagcccagtaagtcggggctgcagtgagccgatcacacctctgcattccagccttggtgacaaagcaagacttcatctca

SEQ ID NO: 103220 - DNA, 729 bp, Homo sapiens
attattgataagctcctgtaggtgtatgtggcatttaccttaaaacatgcagaccaaaggaaaggcaatcttttttccccccacgaagcagttaacttggcagaggccacccattgtgtggaagagaaagagaggcattagtctcttcaggacaaccagtttggatcctgctaaaccagaataaaaagtctagaacatggatgtcctcttgatttagcagatctagctgttcacacagggtcctctattgttaggctgcatcacgggccgcaaagacccaggtgtctatccacttgctagaaaccatcatgagagttagataccagttttctgctggaaatacagaacatttcctgaaaccgtgtggttgaggtgaaacaggcattttgcagtcttatattttgagtaaggccaaacctgcctagtgttataaaactagacaaaaaacccaggtacccggtcttgcaggatagaaatgtgtgactaaaatgaagcatcgatctgagaagactacaaattagcgggaacctttggacaggagcatgctatacattacttagattaatgttgatatttaaggagccaggatattgatttgtttttgaggggtgcccatctacttcatataagaggctataaactgcacttctttcagtttctgcttaatccttgctcaaacaagaaataatttcttattccaaagtagacattggtacatctttttctagg

SEQ ID NO: 103221 - DNA, 120 bp, Homo sapiens
cacaccctgtggccagagctgtcttagagaagggatgggccactcagggacaggctggacaaggagctgactgctctgtgctcacttttgtatagattgtttgttggaccttgtgtaaaa

SEQ ID NO: 103222 - DNA, 363 bp, Homo sapiens
caggtccgtgtggacatgctgagggcacggtgtcgattaaagtctcagcaatgtccaatgtcttatctcactcatgaggtcttcatcttgccctcagtttggtatgttaaaaaagaaaaacttaaagacactatagaaatgagatcactcatacgtgaccactgctgctgatagttctggaggtaatttgacgatcaccagtcaagctgaagatgcacacacctggcaattctatccttagaaacacattctagagaaactcttgcccatgtgccaagaagacgaagataagcatattcacagcagctcgagcagtcgagccaacagaggcgccaggccgtccctgccaggctgtccagcagc

SEQ ID NO: 103223 - DNA, 294 bp, Homo sapiens
gttgggcttttttttctagttttcctgtcctttatagcctcctgactcaaattaggactgcagtggtgagaatagaagtggagagaaaggaatgaagctgaaagacatttcaaaagaaggattaatgggctttagagactgagtagatgtgtgggacaaaggacaggaagcaaagaggcattttctaaacatggacaccagatttactctttggaaaacacttctttcatcttgttatttcccagttcaagaatctgcagtgagataaatctaaaatgagatttatttgaataa

SEQ ID NO: 103224 - DNA, 297 bp, Homo sapiens
aagaaaacccacccagactggtggctcatatctgtaatcccagcactttgggaggctgaggtggaaagatcactcagagtcagaagttcaagacctgggtaacatcgagaccctatctctacaaaaaaatttaaaaattagctgagcgtggtggcacatgcctggagtcccagctacttgggaggctgaagtggaaggatcacttaagcccgcgagttccaggctgtaacgagctatgactgcaccactgcactccagactgggtgacagagtgagactccatttccaaaaaataaa

SEQ ID NO: 103225 - DNA, 342 bp, Homo sapiens
gatctaattgtacccctccccctaagtcataataatagaaaatgtttgcagacattaacaaatgtgccctgggaagatacagtcacctttggttaaaaaccactattatgggtataaagttgtaatgtaatttttttaaaaaagaaactaaaaccgtatttattcaacaagtaggtatgttcccatctgttctgcagcacttcatacctaagaatggaatataaagaaaatccagaaccttcagtttggattttctgattaaaaagtctgaggccatctgccatagttataataatctgacagattgtcacaaatgatcagcctaatgttaggaatcaatgg

SEQ ID NO: 103226 - DNA, 504 bp, Homo sapiens
gggactgggggctgggatctgcaggctctactgtgtcctcaccgcagctgtgtccttggcagtgcaactggtgtggagaaggggcacagtgaatgtcctcttagtgaagatcatagtaaactggcacattttaaaaaatatcaatactcagtgccgacaagggtatggcaaaacactgccacaagagaagtataaattggtaccatattttttaaaagatttggcaatatgtaatacaaacctttaaaaacattcaaccctaaggaaaaatgatctctttgtaggtaatatcaaagcacacctggaaaccccaataaaataagtgctaagatatccttagaatacaaatgaaaaagtatttagtaagagcaagatataaaattgacaacaaccaattataacccaccacatgcagtgcaaacaatgtttagttcaaaacagaatgaaagaggccgggcgtggtggcgcacgcctgtagtcccagctacttggaagctgaggtgg

SEQ ID NO: 103227 - DNA, 666 bp, Homo sapiens
attataacctaatatacaaaataggaaaccatgatttcctgtgatacagattattacctaatgaattgatagtttgatgacaaagtatttacataatttcaaagaactctgcaaaaaggacttattaattacaaaaggaaaatgagtacatttacagtggagaagcttgacagtctccaccttgatcaagtgacccaagtaaacatcattagtaatgggacacacagaaaccatgggccacttcatagggtacagtaagaagttgctactgagatagtcctgccaaagatgtacagctgcatctaatcacgaggaaacattagacaaatccaaattgagggacgtattttaaaataacagtcttgtaatcttcaaaagtgttaaggttatgaatgtcaagggaggcctgataaactgtttcagattgaggaagaagagacatgacaactaaaggcagcttgtgatcctgaactagatcattttgctatcaaaaacatgatgggtacatttgccaaaacttgagtggttgtaatgtactgatgcgaatttactgattttgatgtttatattttagttatgtaggagaatgttcttatttgtaagaaaatacactacaaagaaagatgggacatcaagacaacaaattactctcaaatggctcagtta

SEQ ID NO: 103228 - DNA, 745 bp, Homo sapiens
tacttgagaggctgaggatcacttgagcctaggagtttgaggctgcagtgagctatgattgtaccactgtacttcagcctggggacagagcgagatccagtgaaaagaaatcccactcaaattggattcagacaaaaaaggaacagtcccaggaagttcagcttcaggcatggtttgatcaagtggcttaaacaaacagtgtcagcagtctgatgtttctctatctctgattccctgtcttcctcatcagccctcttccttctgcattggctccattctcagtgagacttctgcgagttgtcagcgtgaccatcagcagcttcaggcttgcatcttgtcatagtaatacatctttccccagtaattccaaaaccaaattccaggtatccagccccagatgggtaatatgccccttcgtgaactagtaccgtggttggggagagggcacgtgctaattggccaggcaggagccacttgctcccggaaacctcgagggctgagaatgaggtgaggtggttccacagtagaaaaatcagggtgcttctttcagaagccggggtacgtatggcctgctgggcaggcccacacagcatacagatgctacgagagcctgctgtgctttgtaggtcacagacccccacggtgtgcttggaaatgccagatcatgctgtgaggcttttcctctgccccagcctctggcacgagactcccacgtgtgaaaagcagactcacagtccctgcgtgt

SEQ ID NO: 103229 - DNA, 205 bp, Homo sapiens
ctgcattagccttctcctttcttacgttaatggcaacaaactccctggaggttattctgtattagctcactaaagttccaggtcctagtcttttgttactactaacaagtggcatttcataatcattatctcctccatattttttattatgaaccccatcaataaaacatctttgaaaacacaatttttttttatttttattttt

SEQ ID NO: 103230 - DNA, 241 bp, Homo sapiens
tttattttaattctggggtacatgttcaggatatacaagtttgttacacaagaaaacgtgtgtcatggtggtttgttgcacagatcaaccccttgcctcggtattaggcccagcatccgttagctattcttctcgatgctctccctccgccgacccccaacaggccccagtatgtgttgttcccccgctccatgtgtccgtgtcctcttctgggtctttgatagtcttcactgatgctttc

SEQ ID NO: 103231 - DNA, 283 bp, Homo sapiens
actcagaggctatgaagagggaggcatgcaacttaatgaaattctttatgatgaacagttaacaggttatcctagtactcaaaaggaataccaattgccacaggatggtaatagagctgagagtctctacaattcaatagatgcccttaacaggacaaaggtaaagaatacacgtaccttttgagaatatgcacattaggattctcaggttcttgactctgattatttttgtttgtttgttttttgagacggattgggctggagtgcagtggagcgatgttgg

SEQ ID NO: 103232 - DNA, 257 bp, Homo sapiens
agagagagaatgaggaaagtcttggctttctaataaaatccgagcaggatttttttccccacatctgttttggcgaacaggagcgtcagcttctgaattgttttagatagtctcacaggtataaaggaagtagcattttagtttacaaagggggtgggagtagattattgtgatgtcccccgccttctcttgttactattattataaacaaataaacagcttgtctgagtgcagtggtgtttacaactggttggtca

SEQ ID NO: 103233 - DNA, 455 bp, Homo sapiens
cgagaacttacaacacagccttggactgcacagttccactcagactccatttatgtggcataaaagatatgtttctgggggtttgggacttcaaggaccgtttctggaggagtggaattgtatgggccttggagaacggctggagaggaaatgagataggagggtgggcacatcccttaaggaaggagcttggcaaggggggcatgggaccaggttcaggtcatattggaattgggatcctcttcagtgctttgagtataatagacacttgaaaactattgctccataagtgagtgaataaatgagagagttgtgaatttgccactcaaagttgtattctgccatcatcagaggtatgtaggcagagtcagcacctggggagcaggtgatgcacctggccttgctgagcattggcacctgctttgctctaggcactaggtaaccagtggctactt

SEQ ID NO: 103234 - DNA, 709 bp, Homo sapiens
tccttctcatagggtgttgacgttttctctaaatccttcttactcaaaggcaaatttgaaattgttttacttataacggggatacaggttaaatgataaatgccacatagtgggcatatgtttcaggccaggtgctatgctcagagttcacacctgcctgatactgtgaggattgggctacagattctaaaccacactctccatagaggacatggcaggtgagcggctggcttctgtgggtctgggcctggtgggttagtgtgggctgcatggccccaaggctgggagctgtgttgggatctggtggcagggggtttatctgacaacctcactattccatgtctcctctctgtgtggaggaatgggatgcagcgaggagaccaggctggagttctgtagagtgtaaaatcctggatgtcctctcagcctgtctccttgagaggacctgctgcctgcccttctggagcacgtcattctcttcttggatgaccaaataaatcattcaagagtgaaatgaaaactccttatctccttataggatctgagctcagtgatgagaagtggaaggacaataattgaccaatcacacatttaaatgaataaattaggccgttggtgttcagcagcaatttcatgccataattgacaataaatagcaattttgaaaatcatcctgcaatgtacactcagccacagcaacccaaaaccc

SEQ ID NO: 103235 - DNA, 188 bp, Homo sapiens
  misc_feature (2)..(2): n is a, c, g, or t
  misc_feature (5)..(5): n is a, c, g, or t
  misc_feature (14)..(14): n is a, c, g, or t
  misc_feature (19)..(19): n is a, c, g, or t
  misc_feature (25)..(25): n is a, c, g, or t
  misc_feature (27)..(27): n is a, c, g, or t
  misc_feature (37)..(37): n is a, c, g, or t
anctnagattacanaggangacgantnttggcgctancaagacatggagtgtgtgccttgtggagaccctcctcctccttacgtgtttggcctgtatagtcttagctactcaggaggctaaagcaagaggattccttgagtccaggagttcaaggccagcatggacaacatagcaagaacttgtttct

SEQ ID NO: 103236 - DNA, 369 bp, Homo sapiens
ttcagtcaaaacccaaattactattaggtctgcagaagctgctgaaaaaataatatgaaaacagattagaaaagcagcttcgctctcacagatgtacactgtaattataactgttcagagctattggaaaatcataagcagaattgactttctgtccttgctagcttcaaagaggtgcagaatgacaggaaagttctctcattcgtggctaggctgacaccaaacgaattacaagttctgatctgactaatcagaaaatgtcacagaagctactggtctctgctatacaggtcgacacctgtcctgagtcactaggaacgtaagcagtttagggatagacatacttgttctggtttctaaatcatggta

SEQ ID NO: 103237 - DNA, 357 bp, Homo sapiens
tgggcacaattaaagaagctgacacagttagctaaaaaaggccttgagaacacaaaggtgacacaaactccagagagtatgctgcttgcagctttgatgattgtatcaatggtgtctgcaggtgtacccaacagctccaaagagacagcgaccatcgagaacgggccatgatgacgatggcggttttgtccaaaagaaaagggggaaatgggaaaagagagatcagactgttaccgtgtctatgcagaaataagtagacataagagactccgttttgttctgtaccaagaaaattcttctgccttgagatgctgttaatctgtaaccctagccccaaccctgtgctcacagagacat

SEQ ID NO: 103238 - DNA, 474 bp, Homo sapiens
tatcaaaaatcactgtattccacttccatattgtgtcttaccagaaggtcttcaggggcaataacatgcatggaactgtcatctatcttcttcttttttttttttttttttttgagacatagtttcgctcctgtcacccaggctggagtgcaatggcacgatcttggctcactgcaacctccacctcccagattcaggcgattttcctgcctctcagcctcccgaatagctgggtttacagacaccagccaccacgcctggttaatttttttgtatttttagtagagacaaggtttcaccatgttggccaagctggtcttgaactcctgacctcaggttatcaacccaccttggcctcccaaagtgctgggattataggtgtgagccaccgcacctggccagaactgtcatcttctatgacaaaaatgtctgcttctggaagaacctgtctgaggttgttttacagttaactta

SEQ ID NO: 103239 - DNA, 376 bp, Homo sapiens
tttgagacagagtcttattctgtcgcccaggctggagtgcaatggtgcgatcttggctcactgcaacctctacctcctgagttcaagcaattctcctgccttagcctcccaagtagctaggattacaggctctcaccaccacgcctggctaactttttgtatttttagtacagatggtatttcgccacgttggccaagccggtctcaaactcctgacctcaggtgatccacccgccttggcctcccaaagcgctgggattacaggcgtgacccactgcacccggccaaaacaggcctttatttaaagacacattttgaatttaaaaaaaggtaaatatgcaacttttaggggaaaaaacattgtatctctcataca

SEQ ID NO: 103240 - DNA, 264 bp, Homo sapiens
gtcacctgcctctgcctaagggatggatggcaaacagccctctgcttctgtgctccatctgggctttgcagatagggggactgcggttaagtccattaagccagggtatgaatgagggggagggggatgagcagcagggacagcagggagtgggcagtgctgggctgggcatgggcacccctgagccatgttgccttctgcttcattccttccctgctcaggagcttgctctgacttcctccagacagtcctgcttctccatcc

SEQ ID NO: 103241 - DNA, 655 bp, Homo sapiens
agcggaagagccggaggaggtggcggcggtgggagaggcgagggttctggccgattttagcatcgaaactaggagaaataagaatggctgtagaggaacttcagtctataataaagagatgtcaaatcctagaagagcaagactttaaagaagaggattttggcctatttcagttagctgggcaaagatgcatagaagaagggcacacagaccagctattagaaattattcaaaatgaaaagaatcaggtcatcatcaagaatatgggctggaatctcgttggtcctgttgttcgatgccttttgtgtaaagataaagaggatagtaaaagaaaagtttattttttgatctttgatttattggtaaagttatgcaatccaaaggaattattgttgggtttgcttgaactgattgaagagccctctggaaaacagatatcccaaagtattcttcttttgcttcagccattacaaacagtgattcagaaacttcataacaaggcatattcaattggattagcattgtctaccctttggaatcagctatctcttcttcctgttccatactcaaaagaacaaatacaaatggatgactatggcctttgtcagtgttgcaaggccttaatagagttcactaagccttttgtggaagaagt

SEQ ID NO: 103242 - DNA, 889 bp, Homo sapiens
cagaagtgactctccaggggagctaaaatccatgtatttgggcacacacttgaacaatattgctagagaaatttaagcaagaacacaaaggttaatgacatctcttgtggggaccactgtgagaataaaacaaggcactacgttgtctgggatgatggaaggagctaaagtcttcagtgaatgaaggagcaggaccaggagctcaaaatacttctttgaagacaaagaagaaatgatattaccaaatggttggctcaaaagaacagggattttgcaacagagagagtatgtcatggtcttgaacaagcaatgttttgccaggacgattaaatatcattgatgcttctggtctacaattagtcagagaagagattaaaaaaatgatgagtattcaagaaggaaagtgtttgctttaacatatgaagaaaaggagcttcagagtggtgattaaccccagaattgtgtggaacggatatggaaacaagaccacaggagcatcgagaactgagcagaactgaaggtgacatgaaaatcagctgcaagattcacctcagggtgataatgggctgcaggtggctgcaggaatcccgggacattctaggcactgccatattttcttaggggccagtaaggatggctatcatcagatgtacctgatgatacaaacatgggctgtcttgccttctagtattcattcttgatgattgcatccagagctcactttggaggtgcagatcaactcttcttcaggctcatccatgcgacttgagtgggctctcatccccattcccaggggcttatgacaatcaaggtttccactcctccatggtctcaatggtttttctccccatgggaagcacataatcccattagaggccacgggaagctt

SEQ ID NO: 103243 - DNA, 837 bp, Homo sapiens
gaaagaatcatctgaaaggaatgtggagatcagagaaaaatgatgggaaagttaccacagcctgcaaatgagaaatgatgagagcctgcctgggacaaagaatctacaatagatcttctccagcagctctggaggtcagacccagctgtggagagaatcatttctaaaaaactagaaggcacgttgggagactactactttctgtggatgaatgggaaattcaagacagaaaatggatgggcgatatggaaatacaactgttttgccaggacgattaaatatcattgatgcttctggtctacaattagtcagagaagagattaaaaaaatgatgagtattcaagaaggaaagtgtttgctttaacatatgaagaaaaggagcttcagagtggtgattaaccccagaattgtgtggaacggatatggaaacaagaccacaggagcatcgagaactgagcagaactgaaggtgacatgaaaatcagctgcaagattcacctcagggtgataatgggctgcaggtggctgcaggaatcccgggacattctaggcactgccatattttcttaggggccagtaaggatggctatcatcagatgtacctgatgatacaaacatgggctgtcttgccttctagtattcattcttgatgattgcatccagagctcactttggaggtgcagatcaactcttcttcaggctcatccatgcgacttgagtgggctctcatccccattcccaggggcttatgacaatcaaggtttccactcctccatggtctcaatggtttttctccccatgggaagcacataatcccattagaggccacgggaagctt

SEQ ID NO: 103244 - DNA, 2319 bp, Homo sapiens
  misc_feature (1226)..(1226): n is a, c, g, or t
  misc_feature (1242)..(1242): n is a, c, g, or t
ccatttggaagcttagaatggcagcattccatactgaggtgacatgatggtttctatataggaaggcagcaaataaacttaaaggaggtgatgatctgtgtgtgttctgtcagtctcagatacttgaatgcatctgcaaatagtctggagtctttaccatccgcctgcactggagaggagagtttgagtatgctgcagctgctttatctgaccaacaatctcctgacggatcagtgcatacctgtcctggtagggcacctgcacctgcgaatcttgcaccttgcaaacaatcagttacagacctttcctgcaagcaaactaaataaattggagcaattggaggaactgaacctaagtggcaacaagcttaaaaccattcccacaaccatagcaaactgtaaaaggctgcacacccttgttgcacactccaacaacatcagcattttcccagaaatactgcagttgcctcagatccagtttgtagacctaagttgcaacgacttgacagaaatcctgattccagaggctttgcctgctacattacaagaccttgacctgactggaaatacaaatctggttctggaacacaagacactggacatatttagccatatcacaaccctgaaaattgatcagaaacctttgccaaccacagattctacagttacgtcaaccttctggagccatggactggctgagatggcagggcagagaaataagctgtgtgtctcagcacttgctatggatagctttgcagagggggtgggagctgtgtatggcatgtttgatggagaccgaaatgaggagctcccgcgcctgctgcagtgtacgatggcagatgtgcttttagaagaggtacagcagtcaactaatgacacagttttcatggctaacaccttcttggtatctcacaggaaattaggaatggctggccagaagttgggctcctccgctctcctgtgctacatccgccctgacactgccgatccagcaagtagctttagcttgactgtagccaatgttggcacgtgccaagcagtcctgtgccgaggtgggaagccagtgcccctctctaaagtcttcagcctggagcaggacccagaggaggctcaaagggtgaaggaccaaaaagccatcatcacagagaattgggttcttaaccaaaagcacctgcaggattttcctggggaagataagtgagaacaaacacatgaaaccacattccntgacactgcaaagctntgagttaaggttccggaagatctcaaagagttccagaccacagatattccggtgcatcactgtaacttccgggctgttctcggctgcctttgtagcgcttctgttctcggtagctacgcagggccagcaccacgctggcgccgtacatgatcacgagaagacaagcaaaggtggctgctgctccgtcggtgcctgccagctggcagtccatccaggtgagacccttgcgggcatagagcctctctcttgttttgcaagtgtcggtgctattgatctgcagagccacgtggaggtaaacaccaatgcctgtgcagtagcccactgccgctaggaggctgaaggcggcctccgtgaggagccacttccctgacaacattgttcgactcttggctccttggagtaaaacacccatggtgaggacccccagacccagagaaacagccacgccaccgtatatcaggggcgagcggaggatcgtgtactgctggtccagctgccgaacctgctctagctcagtgccctcgaacgatgttttcagatcagttcctacaagaggagccacattttgttaagtggccttcgacttcattgtatggatggatttgtctattcaaccaggaccttactgatagatatttggactgaaaggaacccacaaatggcacgaggcagaggaagccaacaggccaacagactgaagatcttcttgtccgaggtcagcttttatttgttactgacagaggccccaaatccttcttaggtgtccttctgggagagggtctcctgccattcccgtggtgttcagggatgagcatgaagagaaatacaaatgaaccgagagcaggaccaccaggttcaagtccccgctttttactgccttgtcatcttggccaagccattcagtccttctaagcctcagacaatatgacaaatgaagctaagtctgccaatcttcacccacagggatgtggggaggctcaaatgaaagcaaccgtgtgatactgtgggaagttaacaacaacaacaaaaaagcaagtatgtgaaaatactctaaaaataaaataatgtacaaatgga

SEQ ID NO: 103245 - DNA, 993 bp, Homo sapiens
  misc_feature (917)..(917): n is a, c, g, or t
  misc_feature (924)..(924): n is a, c, g, or t
  misc_feature (974)..(974): n is a, c, g, or t
  misc_feature (976)..(976): n is a, c, g, or t
  misc_feature (993)..(993): n is a, c, g, or t
ccatttggaagcttagaatggcagcattccatactgaggtgacatgatggtttctatataggaaggcagcaaataaacttaaaggaggtgatgatctgtgtgtgttctgtcagtctcagatacttgaatgcatctgcaaatagtctggagtctttaccatccgcctgcactggagaggagagtttgagtatgctgcagctgctttatctgaccaacaatctcctgacggatcagtgcatacctgtcctggtagggcacctgcacctgcgaatcttgcaccttgcaaacaatcagttacagacctttcctgcaagcaaactaaataaattggagcaattggaggaactgaacctaagtggcaacaagcttaaaaccattcccacaaccatagcaaactgtaaaaggctgcacacccttgttgcacactccaacaacatcagcattttcccagaaatactgcagttgcctcagatccagtttgtagacctaagttgcaacgacttgacagaaatcctgattccagaggctttgcctgctacattacaagaccttgacctgactggaaatacaaatctggttctggaacacaagacactggacatatttagccatatcacaaccctgaaaattgatcagaaacctttgccaaccacagattctacagttacgtcaaccttctggagccatggactggctgagatggcagggcagagaaataagctgtgtgtctcagcacttgctatggatagctttgcagagggggtgggagctgtgtatggcatgtttgatggagaccgaaatgaggagctcccgcgcctgctgcagtgtacgatggcagatgtgcttttagaagaggtacagcagtcaactaatgacacagttttcatggctaacaccttcttggtatctcacagggnaattttnggaatggctggggccaaaaaatttggggcgccccccggtccccccggggncnaaaatcccggccccggn

SEQ ID NO: 103246 - DNA, 413 bp, Homo sapiens
ccatttggaagcttagaatggcagcattccatactgaggtgacatgatggtttctatataggaaggcagcaaataaacttaaaggaggtgatgatctgtgtgtgttctgtcagtctcagatacttgaatgcatctgcaaatagtctggagtctttaccatccgcctgcactggagaggagagtttgagtatgctgcagctgctttatctgaccaacaatctcctgacggatcagtgcatacctgtcctggtagggcacctgcacctgcgaatcttgcaccttgcaaacaatcagttacagacctttcctgcaaggttgttgtcttctatgatcattctctatatgagcatggagtgcggggacttcggctctttcaaaagcctgtgggggtcatctgttttctctgttgaatc

SEQ ID NO: 103247 - DNA, 335 bp, Homo sapiens
atgacagctactgagtggcatgcctgaatgcaacgtttgggatggttgtggcaacaagcttaaaaccattcccacaaccatagcaaactgtaaaaggctgcacacccttgttgcacactccaacaacatcagcattttcccagaaatactgcagttgcctcagatccagtttgtagacctaagttgcaacgacttgacagaaatcctgattccagaggctttgcctgctacattacaagaccttgacctgactggaaatacaaatctggttctggaacacaagacactggacatatttagagccacggtcaacccacaagccacggtcaacccac

SEQ ID NO: 103248 - DNA, 6272 bp, Homo sapiens
ccatttggaagcttagaatggcagcattccatactgaggtgacatgatggtttctatataggaaggcagcaaataaacttaaaggaggtgatgatctgtgtgtgttctgtcagtctcagatacttgaatgcatctgcaaatagtctggagtctttaccatccgcctgcactggagaggagagtttgagtatgctgcagctgctttatctgaccaacaatctcctgacggatcagtgcatacctgtcctggtagggcacctgcacctgcgaatcttgcaccttgcaaacaatcagttacagacctttcctgcaagcaaactaaataaattggagcaattggaggaactgaacctaagtggcaacaagcttaaaaccattcccacaaccatagcaaactgtaaaaggctgcacacccttgttgcacactccaacaacatcagcattttcccagaaatactgcagttgcctcagatccagtttgtagacctaagttgcaacgacttgacagaaatcctgattccagaggctttgcctgctacattacaagaccttgacctgactggaaatacaaatctggttctggaacacaagacactggacatatttagccatatcacaaccctgaaaattgatcagaaacctttgccaaccacagattctacagttacgtcaaccttctggagccatggactggctgagatggcagggcagagaaataagctgtgtgtctcagcacttgctatggatagctttgcagagggggtgggagctgtgtatggcatgtttgatggagaccgaaatgaggagctcccgcgcctgctgcagtgtacgatggcagatgtgcttttagaagaggtacagcagtcaactaatgacacagttttcatggctaacaccttcttggtatctcacaggaaattaggaatggctggccagaagttgggctcctccgctctcctgtgctacatccgccctgacactgccgatccagcaagtagctttagcttgactgtagccaatgttggcacgtgccaagcagtcctgtgccgaggtgggaagccagtgcccctctctaaagtcttcagcctggagcaggacccagaggaggctcaaagggtgaaggaccaaaaagccatcatcacagaggacaacaaagtgaatggggtaacctgctgtacccggatgctgggctgtacatacctctacccttggatcctccccaagccccacatatcttccactccgctgaccattcaagatgagttgctgattctgggaaacaaagcattgtgggaacacttgtcctacacagaagctgtcaatgctgtacgtcacgtacaagacccattagcagctgctaagaagctgtgcacattagcgcagagctatggctgtcaggacaatgtaggggcgatggtagtttatttgaatattggtgaggaaggctgcacttgtgaaatgaatgggctcaccctcccaggtcctgtgggatttgcttcaaccaccactatcaaggatgcccctaagccagccactccatcctctagcagtgggattgcctctgagttcagcagtgagatgtccacctcagaggtgagcagtgaagtggggtccactgcttctgatgagcataatgctgggggcctggacactgccttgcttccgaggccagagcggcgctgcagcctccacccaacacccacctctgggctgtttcagcgccagccttcttctgctaccttctccagtaaccagtctgacaacggcctggacagtgatgatgaccagcccgttgagggggtcataaccaatggcagcaaggtagaggtggaagtagacatccactgctgcagggggagggatctggagaactcaccccctctcatagagagttctcctaccctgtgttctgaggaacatgctagagggtcgtgttttgggatccgaagacagaacagtgtgaatagtggcatgctcctgccaatgagcaaggacaggatggagttacagaagtctccctccacctcctgcctctatgggaagaaactctccaatggctctattgtgcccctagaggacagcctgaacctcattgaagtggccacagaagtgcccaagaggaaaactggctattttgctgcccccactcagatggaaccagaggaccagtttgttgtgcctcatgacctggaagaagaagtgaaggaacaaatgaaacagcaccaggacagccggctcgagcctgagccccatgaagaggatcggaccgagcccccggaggagttcgacacagcactatgactgccccactgggcacagtgtgggaggaggctgtgcagggttggggtagggacttgctagaggcattctgcctctacatttctttttgtttgttcgttttttttttgtttgtttgttttgagacggagtcttgctcagtcgctcaggctggagtgcaatggtggggtctcgggtcactgcagcctctgtccctgggttcaagccattctcctgtctcagcctcccgagtagctgggattacaggcacctgccattatgcccggctaagttttattttttttttttagagacggggtttcaccatgttggccaggctggtgttgaactcttgacctcaggtgatccaccctcctctgcctcccaaagtgctgtgattacaggcctcagccaccatgcccagccctgcgtctacatttctaaaccatagctgtgtggggttgaactcggagccaaaaagtgtgagagccatcaggggctggctctggataaactggtagccactatcagtgttaagtttcacatttaacctgcattggaattcccaggggtactgggaagaaagcagctgttctgtatcagtcctaccacctgccattaaccctttctctcctaggatcattttgagaatttgcctgcctgggcaggaaagggactatttctgtggaggaaaaaagtgaagattgattctctttactagttgctgctgatggatctctgtgacagagaaatcaccttatctcagactaatggggtgtgatgtgactagtcacatggcttttcattcttctctacgagaatacagcctatcaaaatgatgtctgttggaaatgtagaaccaatcaaacagataatttatgtatgtaatgtaatgagagcacttttcattgactgtgaactttttatttttgaatctgcactcgagccaatcttcttagaggcagcccggcaccttcatccataggcagagagagaactgggtgttggagacttattcgagggtataggaagggccctgtgaagttgatttaacttttggatgtcagactgtgaaagctcctgagaaacttggggtaataggatcttcttttggggatgaaaatggggaaggcgtgaggacctagactacttctccctagatcagaaaaagagaattaccccttgacaaatatgatacctgctaggtatttcccagggaaatttagggattggcctctttccctagcatgtggaggaattggcagacagcttcctaagggcggggagcgggggcccaaggccgacactgcttgcatccacgtgaccttaagttatggcagatgactctgaaacggactgaggccaatgagaacagatggatggagcactcaggttagacttgttccttctcctatgctggaggagagggatggttctctagaatgttggaggtgagttgagagctcgcctcttgaatgttgaacagtgtactcttctgaaaactgcatattcactttatgtggtttcagaatactgggctcaatactaacataagaaagacacttcattgagaaattcttaagcttacagaaaacctatactctttgcacattccacataaccctagcaaaatgcagtttcttcatacttctgtcactttttccattggaagatttgcttaggaaaattaattcctatttattcccacaaaatgttggcattgcttgattttacccaatggggaatgtgctttgaatttttggaacacttttacaattaaaaataaagtagggccatttttaatttgtttcatcagaaactatgttaaagagagggttaaatataaatatattttcgtgtgtatttttgggaagatttttgttcaaagcaatagtcaaaatcagatgacctgtccataataattatgtgtcttcatcttctcagaggccccatgctcatatgcacgtgtcattgggatacactcttgggggatttggtacactctaatggatgtctaatgttcaacccctcgagaatctgaacttgagtccccagattgtcaaactactggtcagctattgagaattttagaactcaggtctttgatttgaagtagggaacatagtggctcacacagagtttaggtgctgttagaaagatgggaacaagagtgttttgccaccttatttttatatgggaaattttttttaatgaagaaaaaatgaaaatgaaataacaggatgatagtgatgagtgatgtaaaacatcttacttagatggcagaaccttcgggttgtagaatagtgatgtctaaaaattaaagttattttgggaatacaccactttaatagtatagtcttataaaaattattcattatggtgaacccttcttgtctgctattcgtttcccaacctacttattggaaccacctcaaaacccagttctgaaatgaccttaccaaaagtaaatgtatttattttttagtcagcagaactctgtaattccaaatgttgttctgtgtggtagaattttttttcaggaaccattaggttgtattgaaaatctttgttataggcgataccaaaactgattattcttttttgcagtctgctttaattcatgtccttctgcagttgctctgtattaaaacagggtaaaaaggccatagcccattatgaaaaatataatacaaaactctttgacctatgaggtaacttacagacattgtgttttctaaacaggctgtcagtgaaagcccgtatctgtctccaggtgaatgtaatttacttccgagtactttacccagaggatgtattccccaggtgggcagagtacagttgatctctagcacagacagagattctggcctctgcatattctcaggtctctgtgtgtacctcccattgagtagagaagcttaagataatttctgagagaagaacactgctgattgtgggagcagtttaggagtccatggaagaaagaaaaatacatgtgtcttggcagccatggtgtatttttgtccaaatggattggaaggatatttgaatatttgaatgttggtatgacataaagctgcagtgcactatagagtcaagtcattgaattaccactcctgatacagggctttattgtactactgtgaagtgtatgtgtgcaatacattggtgagttcatttactggtgtacggaagagccagcaggagcagcgtggtcattgctgggtgctattacagttgcttgtagtgagtgctgttttccaggagatggagccagttgggtgtggcagatctactgaatatcaaatgatgctcttcttcccatgtagaccttcagcaaaagccggtacttggaagccacaggctcaccttctctatctatccaataattattaatgaagagacctccataagggagcagctggctgttatcgataaatgtaccaattattaaataattagtctccaagccattcagtgatgtcttcagcatcactataggactgtctagtgtcactttttacttccttctgggtggaggctttccgactcccaatcatgaaggcaagttaatctttccagttagtgacttttgccccatagttggggtaagcacttcctagattgagaaaaagcagctacagtcaatcctgctctgtttgcctcatttggtgatcagtcagtcacacataagttccttgtattctaaatttcatgcacttctcccagatgctatagggttttctctcactgttgccaatggatgtcatccagacagtgggctcatatcttacggttttgtgcaatcattgtcgtattgtagtcttaagactcattatagtgtatttttgatatttttgaaatgtgttaaattttttaattcagtaatatgagccagagcatgttgcagcaaatctattgtttgtaaaaataacaataacaataataaataaaataaagtggaatcttaaaaaaaaaaataactaactatttat

SEQ ID NO: 103249 - DNA, 6267 bp, Homo sapiens
ccatttggaagcttagaatggcagcattccatactgaggtgacatgatggtttctatataggaaggcagcaaataaacttaaaggaggtgatgatctgtgtgtgttctgtcagtctcagatacttgaatgcatctgcaaatagtctggagtctttaccatccgcctgcactggagaggagagtttgagtatgctgcagctgctttatctgaccaacaatctcctgacggatcagtgcatacctgtcctggtagggcacctgcacctgcgaatcttgcaccttgcaaacaatcagttacagacctttcctgcaagcaaactaaataaattggagcaattggaggaactgaacctaagtggcaacaagcttaaaaccattcccacaaccatagcaaactgtaaaaggctgcacacccttgttgcacactccaacaacatcagcattttcccagaaatactgcagttgcctcagatccagtttgtagacctaagttgcaacgacttgacagaaatcctgattccagaggctttgcctgctacattacaagaccttgacctgactggaaatacaaatctggttctggaacacaagacactggacatatttagccatatcacaaccctgaaaattgatcagaaacctttgccaaccacagattctacagttacgtcaaccttctggagccatggactggctgagatggcagggcagagaaataagctgtgtgtctcagcacttgctatggatagctttgcagagggggtgggagctgtgtatggcatgtttgatggagaccgaaatgaggagctcccgcgcctgctgcagtgtacgatggcagatgtgcttttagaagaggtacagcagtcaactaatgacacagttttcatggctaacaccttcttggtatctcacaggaaattaggaatggctggccagaagttgggctcctccgctctcctgtgctacatccgccctgacactgccgatccagcaagtagctttagcttgactgtagccaatgttggcacgtgccaagcagtcctgtgccgaggtgggaagccagtgcccctctctaaagtcttcagcctggagcaggacccagaggaggctcaaagggtgaaggaccaaaaagccatcatcacagaggacaacaaagtgaatggggtaacctgctgtacccggatgctgggctgtacatacctctacccttggatcctccccaagccccacatatcttccactccgctgaccattcaagatgagttgctgattctgggaaacaaagcattgtgggaacacttgtcctacacagaagctgtcaatgctgtacgtcacgtacaagacccattagcagctgctaagaagctgtgcacattagcgcagagctatggctgtcaggacaatgtaggggcgatggtagtttatttgaatattggtgaggaaggctgcacttgtgaaatgaatgggctcaccctcccaggtcctgtgggatttgcttcaaccaccactatcaaggatgcccctaagccagccactccatcctctagcagtgggattgcctctgagttcagcagtgagatgtccacctcagaggtgagcagtgaagtggggtccactgcttctgatgagcataatgctgggggcctggacactgccttgcttccgaggccagagcggcgctgcagcctccacccaacacccacctctgggctgtttcagcgccagccttcttctgctaccttctccagtaaccagtctgacaacggcctggacagtgatgatgaccagcccgttgagggggtcataaccaatggcagcaaggtagaggtggaagtagacatccactgctgcagggggagggatctggagaactcaccccctctcatagagagttctcctaccctgtgttctgaggaacatgctagagggtcgtgttttgggatccgaagacagaacagtgtgaatagtggcatgctcctgccaatgagcaaggacaggatggagttacagaagtctccctccacctcctgcctctatgggaagaaactctccaatggctctattgtgcccctagaggacagcctgaacctcattgaagtggccacagaagtgcccaagaggaaaactggctattttgctgcccccactcagatggaaccagaggaccagtttgttgtgcctcatgacctggaagaagaagtgaaggaacaaatgaaacagcaccaggacagccggctcgagcctgagccccatgaagaggatcggaccgagcccccggaggagttcgacacagcactatgactgccccactgggcacagtgtgggaggaggctgtgcagggttggggtagggacttgctagaggcattctgcctctacatttctttttgtttgttcgttttttttttgtttgtttgttttgagacggagtcttgctcagtcgctcaggctggagtgcaatggtggggtctcgggtcactgcagcctctgtccctgggttcaagccattctcctgtctcagcctcccgagtagctgggattacaggcacctgccattatgcccggctaagttttattttttttttttagagacggggtttcaccatgttggccaggctggtgttgaactcttgacctcaggtgatccaccctcctctgcctcccaaagtgctgtgattacaggcctcagccaccatgcccagccctgcgtctacatttctaaaccatagctgtgtggggttgaactcggagccaaaaagtgtgagagccatcaggggctggctctggataaactggtagccactatcagtgttaagtttcacatttaacctgcattggaattcccaggggtactgggaagaaagcagctgttctgtatcagtcctaccacctgccattaaccctttctctcctaggatcattttgagaatttgcctgcctgggcaggaaagggactatttctgtggaggaaaaaagtgaagattgattctctttactagttgctgctgatggatctctgtgacagagaaatcaccttatctcagactaatggggtgtgatgtgactagtcacatggcttttcattcttctctacgagaatacagcctatcaaaatgatgtctgttggaaatgtagaaccaatcaaacagataatttatgtatgtaatgtaatgagagcacttttcattgactgtgaactttttatttttgaatctgcactcgagccaatcttcttagaggcagcccggcaccttcatccataggcagagagagaactgggtgttggagacttattcgagggtataggaagggccctgtgaagttgatttaacttttggatgtcagactgtgaaagctcctgagaaacttggggtaataggatcttcttttggggatgaaaatggggaaggcgtgaggacctagactacttctccctagatcagaaaaagagaattaccccttgacaaatatgatacctgctaggtatttcccagggaaatttagggattggcctctttccctagcatgtggaggaattggcagacagcttcctaagggcggggagcgggggcccaaggccgacactgcttgcatccacgtgaccttaagttatggcagatgactctgaaacggactgaggccaatgagaacagatggatggagcactcaggttagacttgttccttctcctatgctggaggagagggatggttctctagaatgttggaggtgagttgagagctcgcctcttgaatgttgaacagtgtactcttctgaaaactgcatattcactttatgtggtttcagaatactgggctcaatactaacataagaaagacacttcattgagaaattcttaagcttacagaaaacctatactctttgcacattccacataaccctagcaaaatgcagtttcttcatacttctgtcactttttccattggaagatttgcttaggaaaattaattcctatttattcccacaaaatgttggcattgcttgattttacccaatggggaatgtgctttgaatttttggaacacttttacaattaaaaataaagtagggccatttttaatttgtttcatcagaaactatgttaaagagagggttaaatataaatatattttcgtgtgtatttttgggaagatttttgttcaaagcaatagtcaaaatcagatgacctgtccataataattatgtgtcttcatcttctcagaggccccatgctcatatgcacgtgtcattgggatacactcttgggggatttggtacactctaatggatgtctaatgttcaacccctcgagaatctgaacttgagtccccagattgtcaaactactggtcagctattgagaattttagaactcaggtctttgatttgaagtagggaacatagtggctcacacagagtttaggtgctgttagaaagatgggaacaagagtgttttgccaccttatttttatatgggaaattttttttaatgaagaaaaaatgaaaatgaaataacaggatgatagtgatgagtgatgtaaaacatcttacttagatggcagaaccttcgggttgtagaatagtgatgtctaaaaattaaagttattttgggaatacaccactttaatagtatagtcttataaaaattattcattatggtgaacccttcttgtctgctattcgtttcccaacctacttattggaaccacctcaaaacccagttctgaaatgaccttaccaaaagtaaatgtatttattttttagtcagcagaactctgtaattccaaatgttgttctgtgtggtagaattttttttcaggaaccattaggttgtattgaaaatctttgttataggcgataccaaaactgattattcttttttgcagtctgctttaattcatgtccttctgcagttgctctgtattaaaacagggtaaaaaggccatagcccattatgaaaaatataatacaaaactctttgacctatgaggtaacttacagacattgtgttttctaaacaggctgtcagtgaaagcccgtatctgtctccaggtgaatgtaatttacttccgagtactttacccagaggatgtattccccaggtgggcagagtacagttgatctctagcacagacagagattctggcctctgcatattctcaggtctctgtgtgtacctcccattgagtagagaagcttaagataatttctgagagaagaacactgctgattgtgggagcagtttaggagtccatggaagaaagaaaaatacatgtgtcttggcagccatggtgtatttttgtccaaatggattggaaggatatttgaatatttgaatgttggtatgacataaagctgcagtgcactatagagtcaagtcattgaattaccactcctgatacagggctttattgtactactgtgaagtgtatgtgtgcaatacattggtgagttcatttactggtgtacggaagagccagcaggagcagcgtggtcattgctgggtgctattacagttgcttgtagtgagtgctgttttccaggagatggagccagttgggtgtggcagatctactgaatatcaaatgatgctcttcttcccatgtagaccttcagcaaaagccggtacttggaagccacaggctcaccttctctatctatccaataattattaatgaagagacctccataagggagcagctggctgttatcgataaatgtaccaattattaaataattagtctccaagccattcagtgatgtcttcagcatcactataggactgtctagtgtcactttttacttccttctgggtggaggctttccgactcccaatcatgaaggcaagttaatctttccagttagtgacttttgccccatagttggggtaagcacttcctagattgagaaaaagcagctacagtcaatcctgctctgtttgcctcatttggtgatcagtcagtcacacataagttccttgtattctaaatttcatgcacttctcccagatgctatagggttttctctcactgttgccaatggatgtcatccagacagtgggctcatatcttacggttttgtgcaatcattgtcgtattgtagtcttaagactcattatagtgtatttttgatatttttgaaatgtgttaaattttttaattcagtaatatgagccagagcatgttgcagcaaatctattgtttgtaaaaataacaataacaataataaataaaataaagtggaatctttttcatggctttgttttaaaa

SEQ ID NO: 103250 - DNA, 311 bp, Homo sapiens
agcccactgccgctaggaggctgaaggcggcctccgtgaggagccacttccctgacaacattgttcgactcttggctccttggagtaaaacacccatggtgaggacccccagacccagagaaacagccacgccaccgtatatcaggggcgagcggaggatcgtgtactgctggtccagctgccgaacctgctctagctcagtgccctcgaacggtgagtagtagttgttcccaaagccaccgccgctggaaaagctggcactgaatccggcaaggacaaagtaggaggccacgatgcatatgagaaccatc

SEQ ID NO: 103251 - DNA, 465 bp, Homo sapiens
ctggactcaatctgctgacctcaagcgatccgcccacctcagcctcccaaagtgctgggattacaggcatgagccaccatgcccgtcctcaattctttaactttgcctcagtccaaagagagcatttataaagtcaagtgtgtgaaaaccatagttgtctaatgcggagttttaaaagacctgtctttttgagagaaacaatgtgcgttcacatttaggttccggaagatctcaaagagttccagaccacagatattccggtgcatcactgtaacttccgggctgttctcggctgcctttgtagcgcttctgttctcggtagctacgcagggccagcaccacgctggcgccgtacatgatcacgagaagacaagcaaaggtggctgctgctccgtcggtgcctgccagctggcagtccatccaggtgagacccttgcgggcatagagcctctctcttgttttgca

SEQ ID NO: 103252 - DNA, 156 bp, Homo sapiens
tctgttggctatgccctcctggattctcccaccccgctctgccttcatttcggtagctctgactcctccttcagcctgagttcattcagtgtgatccatgccttgtcacctctggccacccccaggtcagtccttgctctccctgactcctcatta

SEQ ID NO: 103253 - DNA, 244 bp, Homo sapiens
attgatgaatacaatcagtgagggtggcccaagggaagcttgagcttttagagccgagttttcaaaatttcttccacagagtataataaggactgttgtatgggaaggattccgacaagactgtgcaggtggccctctctatctgaccagcttcagctggagcagctctgttttttttttaacttttattttaggttcatgggtacatttacaggttagttaataggtaaactcgtgtcacagg

SEQ ID NO: 103254 - DNA, 348 bp, Homo sapiens
aagaaaaagaaaagaaataaaatgaaaagaaaaataaaagaaaatgaaaagaaaatagaaaggaagaagaaaaagaaaaagagaaagaaaagaaagagaaagaaagtgaaagaagaaacaagaagaggaagaagaagaaggaaggaaggaaggaaagggcatacagattggaaaggaaaaagtaaaactattcactttttgcatttcatataattattgatatagagaactctaataaaactacaaaactaccagatattgtatacttgaactttgctaagggtatagttcttaaatattttcaccccaccccccacacacagaaggtaactatgtgaagtgatagat

SEQ ID NO: 103255 - DNA, 381 bp, Homo sapiens
atgagaacacatgggcacagggaggggaacatcacacactggggcctgtcagtgggtggagggaaaggggagggagagcattaggacaaatccccaatgcatgcaaggcttaaaacctagatgatgggttgataggtgcagcaaactaccatggcacatgtatacctatgtgacaaacctgcatgttcagcacatttcagcacatgtattccagaatttaaagtaaagaaaaaaaaaattagcaatatgcctgttggtgactgtgttagggtgagttctccagaaacagaccctgaggcaagggcaattttcttatcccatgttatgggttgaattgtgacccccaaatgatactgtgaagtcttaactccgggtatctgt

SEQ ID NO: 103256 - DNA, 642 bp, Homo sapiens
cttcttgcctcccattcattcagcaggacagagtgacccagaagagcagagaggccagtggttcctagcccctcgcacacagcatgtgctcattgaaaactgtgagtgaatggagagtggatggagccatggacacttggacagatggatggatggttgcacagatggatggttggttgtcagcataaagaaatgcctgttaacggggcctctgatgcttttggttatcctccagtaggaaggattatggatgatccgttttacttgccttgaactctgggtggcttagcacacattcttggaaacaaagacccatggataccctcatgagatgacccagaaagtcaggactttccagagggagaaggctgaagaaacactgagccataaagctcagaagatcccaggctgcaaagccatcgactatctgaaggaggccggccccctttactgcaggcactgctggctctgagtgtgtctgtgcctgctggctgattccctgtgtgtcagacccgggacacatcacctcggggtgagaatgtgtaacatcttcgtgtgtgggtgtagcaactgcagtgggaacatgtctgaatgactttgcacagttctggatggcaaataaatgtttaaataggtgcatcc

SEQ ID NO: 103257 - DNA, 968 bp, Homo sapiens
agccagtgcgcaggcgcgcgctgcgacgccaacctcggcttctcgccgctaacggcatcgagtctggacgccccgtgacccgcctgggccggagcgagggcggacggcgccttcttggccctttctgcctctagcagcggcgccggggtagccggagccagcgactgggaaacggctgcattccactgcgtctccttggcctggctgggcggtcggaggctggtctgccaagattactgtttggagaccgctgcagcccacgtccacctgatagactatttactacacatagtagattcagagccgctaaatgtccaagaccatggcgatgaaccttctggaggattggtgcaggggaatggaagtggacatccacaggtccttgttggtcacaggcatcccagaggactgtgggcaggcagaaattgaggagaccttgaatggggtcctctccccactgggcccgtaccgcgtgctcaacaagattttcgtgagggaagagaatgttaaagctgccctcattgaggttggtgaaggtgtgaatctgagcaccatcccccgtgaattcccaggaaggggtggtgtctggagagtggtctgtagagaccctacccaggatgccgagtttttaaaaaatctgaatgaattcctggatgccgaggggcgcacctgggaggatgtggtccgcctgctccagctcaaacacccaacctgtcccagaaccagcatcagcccccagagaactgggcagaagctctgggggtgcttctgggagcagtggtgcagatcatcttctgcatggatgccgagatccgcagccgggaggaagccagggcccaggaggccgctgaattcgaggagatggcagcctgggctttagcagcagggaggaaggtgaagaaagaaccggggcttgcagcagaggtgggttctgccttaaaggcagagacccccaacaactggaatgc

SEQ ID NO: 103258 - DNA, 332 bp, Homo sapiens
tgcacaagaagtccaaaaacgggctccaggggttttgcaaaatgactctttatcatcatgctataaagtgaaaccttacatgaatgatgtggcatcgtgtaatcatttaattttatcagaaaaattacacatacccccaacagtaaaaaataacacttggttccctccttgttgattctaagaattcatgcaatgttgttattacattctaaatacagttactgacgggataaaattccacctatttttaggattgtggttttcttcttcaaagtgaaggactcatctagactctacccccgccaccccacattctcaatattgctatgtta

SEQ ID NO: 103259 - DNA, 304 bp, Homo sapiens
aaacaatagctgctgagacggccacagctgccgaaagagcgcgcagccggctgtagtgacgtgtggtcttaggacaccacctgagtaaagacggtgcggtgctgcggagatctccgagctcacagtccatagctctgaggggctgggtgctgagtgataaagtgaaggagaagctgcgtgtttgctcgtggccagcaaggcaatctgtgttttgcagaagcggaggacgtgacgcctccctgccggtggactagtcggcttgtcggctctgcatgttcagtgttggctctggtgtgtgtttcgg

SEQ ID NO: 103260 - DNA, 553 bp, Homo sapiens
tgctaattgttagatcagtctctctcttgatttctctctctctcgatctctctctctgtctttcctttatttgtagagacagtctccctatgttgcccagtctggtcttgaacttcggagctcaaatgatcctcccacctcggccttcgaaaatgctggaattataggcatgagccagcatgcccagcctgatatttcttaattttacatattaagatatagagcagagtataagttggtttttagagaatccagattaaaagtcatatccagtataagaaatctttatttcttattattttgttctgtgaattctgcaattctggtgctctctgaggggaaaatagttataatagaaacaaatgtaaagaatgtttagaaaacatttacagtcactgggcgcggtggctcacacctgtaatcctagcactttgggattacagacatgagccactgtgcctggccaacagcctgtacttttttttggtttttttgtttttggagaccgagttttgctcttgttgccccggctggagtgcaaaactccatctca

SEQ ID NO: 103261 - DNA, 597 bp, Homo sapiens
ccatcttcgcggcatgccctgcctactgttgacataaaaactgaggatctgtctgacagcctgccacccgtttgtgacacagtagccactgacttatgttccacaggcattgatatctgcagtttcagtgaagatataaaacctggagactctctgttactgagtgttgaggaagtactccgcagcttagaaactgtttcaaatacagaggtctgttgccctaatttgcagccgaacttggaagccactgtatccaatggaccttttctgcagctttcttcccagtctcttagccataatgtttttatgtccaccagtcctgcacttcatgggttatcatgtacagcagcaactccgaagatagcaaaattgaatagaaaacgatccagatcagagagtgacagtgagaaagttcagccacttccaatttctaccattatccgaggcccaacactgggggcatctgctcctgtgacagtgaaacgggagagcaaaatttctcttcaacctatagcaccgctctcttactgcagtcataacacgcgtattcaggataactagtggttacatcataggaacagctatgccagatacgtc

SEQ ID NO: 103262 - DNA, 3376 bp, Homo sapiens
ccatcttcgcggcatgccctgcctactgttgacataaaaactgaggatctgtctgacagcctgccacccgtttgtgacacagtagccactgacttatgttccacaggcattgatatctgcagtttcagtgaagatataaaacctggagactctctgttactgagtgttgaggaagtactccgcagcttagaaactgtttcaaatacagaggtctgttgccctaatttgcagccgaacttggaagccactgtatccaatggaccttttctgcagctttcttcccagtctcttagccataatgtttttatgtccaccagtcctgcacttcatgggttatcatgtacagcagcaactccgaagatagcaaaattgaatagaaaacgatccagatcagagagtgacagtgagaaagttcagccacttccaatttctaccattatccgaggcccaacactgggggcatctgctcctgtgacagtgaaacgggagagcaaaatttctcttcaacctatagcaactgttcccaatggaggcacaacacctaaaatcagcaaaactgtacttttatctactaaaagcatgaaaaagagtcatgaacatggatccaagaaatctcactctaaaaccaagccaggtattcttaaaaaagacaaagcagtaaaggaaaagattcctagtcatcattttatgccaggaagtcctaccaagactgtgtacaaaaaaccccaggaaaagaaagggtgtaaatgtgggcgtgctactcaaaatccaagtgttcttacatgccgaggccaacgctgcccttgctactctaaccgcaaagcctgcttagattgtatatgtcgtggctgccaaaactcctatatggccaatggggagaagaagctggaggcatttgccgtgccagaaaaggccttggagcagaccaggctcactttgggcattaacgtgactagcattgctgtgcgtaacgctagtaccagcaccagtgtaataaatgtcacagggtccccagtaacgacgtttttagctgccagtacacatgatgataaaagtttggatgaagctatagacatgagattcgactgttaaatcagtgggtcttttaaacctactcctggtagggaaatagctacagttttacggcagctatggttctgttggtttaacttgccggagctcctgcatatagatcacttgtatcaagtgttttcattgctaagttatatgtgttagtgtcggggaaatagtttgcagataatggaggagtaaccctacaactatatgtccttagttcttacagaacctcatagtttgagaacaaagctgatgcaactgatttatacaaaatgaactttggcaagaaaaataacattaacctcattgtttatggccatgctttgtgcataatcaaagtttatgattaaatgtaaggaagtggtatctagtcagtccataaagattgtgctaatttttttgtggaaaagtagccattagttcaggaaactcagtgctgccttcagatgtcattgatgtttctcctgttggaaagctgatgtgtccagctcaacctttgtgctgacatcataccatttctgatcatgaaatattggctactggtgtatgtagcagttcttaaatcagcagtattatgaaaaaaaattccccctcattagaatgtttaagaaatctttttaaaaagtaaaattctgtcagactacaaatgtttagctgttactcatttctagggaagaaattctaaatccctccttcactttgagcagtgttctaattggataaatgaaggagagtagttttattctgaaggtaattaaatttagactatgtagtatgtgacagaatttttttaaaattataaaaagattttatttagtaattgggatttacttaaaataattttggaataatgctcccagacttgcccagatttgtgtattgtacttattgccactggccgccactttgacttattttctctaatagtttatttgccacagtctttattttgaatatgctcctagtttttttttagggtgctgttcattatgaaggcttctttatagaggcctaataagaatgcctttttataaagcctgtgcatttaggtaggttgaagctaggaggattttctttagaatgctcttttgcatgtaaagcacaaagtatgtttcagtttaaatgcacttcttccggttaatttttatggggaagacaagtgagtcacaaacattctgttgaagggaaatctagtcagttgcttgaaagagcacagcccaaataaaacaaggactgactaggtgtaatgaaataacctgtgatttaaaagaagagctgcagctttgacagtgcttatttaaagaaaaatactgctggaaaatttccaatttctactacgttcaccatctctagtaagatctgacatatgctgaagttatgttttgatttggcacacagcatgttcaatgatggttactcgcctagtacaagacatggagaagaaacctttggacacagagcagatgacacctccttctgttttgtagtgtatcctggtgtcattttctgtgaatgtggtcaggtagagttgtttttgttgttgttgttgggcttttttttctttttttttttttggtctcttttggtggggtgggggtgggctaaagccataggaagaaaaatgtgatgtatgtgtccagtatgtactattttgtttttgttttgcaagaagagttgaactatttttgataacaagagtaaatggtggaaaatgcttcttagttgtcttgtctttatttgctttccaagatttggaattttatttaattcctttaagtgttagcagtgtcttatgaaacatgtatttacctaacgtttgtaacagttttgtgttgaacccagatgccctgctatataaagttgtaaatctgttctttattcactaatgatcactgcaaaaatgattagaaatgagattgtacacatggatgaggatatattttgcaaatcgaccaaactttcctaatattatgatcttaaaattcatagagtactttattgcttcccaagtttgataatcttgtgggtttttttttttttttgatgcatgggaggttggcaatatagacaaagtggaaatcattagtatgtgagggccttgattgttatgtaatattgccaatgatgaattcaggttgtttttagcacaagtttctcttttttatgctggtattctcactgccacatttttggaaacctgtattacaccttaaatctatcaataaatgatagttttctaattctatgttgtagaatactgaagagtttgggatagcatgctctgaatggtctgtattat

SEQ ID NO: 103263 - DNA, 4297 bp, Homo sapiens
ttctgcgctctgtggtcgctccggacgaactcgaacgctggtttctctctcatatttttggtctggaagtctcagggacggaggggcgccaaggccccatgtgtgggaggattgtttcagctccacaaacttgcacggattttggttacttgtttggccaatggttcggctctgatttcttccgaattgttgcaaattcgccatcgttccctggctgcttactaagttggatccggaatttcttttcaaccgggagccattggtgtcgaagtgtctgcaatgaaccccgtgaatgctactgctctctacatttccgcgagccgcctagtgctcaactacgaccccggagaccccaaggcgtttactgagattaacaggctcttgccttacttccgacagtccctttcgtgctgtgtttgcggacatttgctacaagatcctattgcacccaccaactccacctgccaacattatgtctgcaaaacttgtaaaggcaagaaaatgatgatgaaaccttcctgtagctggtgcaaagactatgagcagtttgaggaaaacaagcagttaagcatcctagtgaactgctacaaaaaactatgcgagtatataacacagactacactggcacgggatataatagaagcagttgactgttcttctgatattttggctttgcttaatgatggatcattgttttgtgaggagacagaaaaaccctcagattcatcctttactttgtgtttgacacattcccctttaccttcaacctcagaacccacaactgatcctcaagctagtttatctccaatgtctgaaagcaccctcagcattgctattggcagttctgttatcaatggtttgcctacttataatgggctttcaatagatagatttggtataaatattccttcacctgaacattcaaatacgattgacgtatgtaatactgttgacataaaaactgaggatctgtctgacagcctgccacccgtttgtgacacagtagccactgacttatgttccacaggcattgatatctgcagtttcagtgaagatataaaacctggagactctctgttactgagtgttgaggaagtactccgcagcttagaaactgtttcaaatacagaggtctgttgccctaatttgcagccgaacttggaagccactgtatccaatggaccttttctgcagctttcttcccagtctcttagccataatgtttttatgtccaccagtcctgcacttcatgggttatcatgtacagcagcaactccgaagatagcaaaattgaatagaaaacgatccagatcagagagtgacagtgagaaagttcagccacttccaatttctaccattatccgaggcccaacactgggggcatctgctcctgtgacagtgaaacgggagagcaaaatttctcttcaacctatagcaactgttcccaatggaggcacaacacctaaaatcagcaaaactgtacttttatctactaaaagcatgaaaaagagtcatgaacatggatccaagaaatctcactctaaaaccaagccaggtattcttaaaaaagacaaagcagtaaaggaaaagattcctagtcatcattttatgccaggaagtcctaccaagactgtgtacaaaaaaccccaggaaaagaaagggtgtaaatgtgggcgtgctactcaaaatccaagtgttcttacatgccgaggccaacgctgcccttgctactctaaccgcaaagcctgcttagattgtatatgtcgtggctgccaaaactcctatatggccaatggggagaagaagctggaggcatttgccgtgccagaaaaggccttggagcagaccaggctcactttgggcattaacgtgactagcattgctgtgcgtaacgctagtaccagcaccagtgtaataaatgtcacagggtccccagtaacgacgtttttagctgccagtacacatgatgataaaagtttggatgaagctatagacatgagattcgactgttaaatcagtgggtcttttaaacctactcctggtagggaaatagctacagttttacggcagctatggttctgttggtttaacttgccggagctcctgcatatagatcacttgtatcaagtgttttcattgctaagttatatgtgttagtgtcggggaaatagtttgcagataatggaggagtaaccctacaactatatgtccttagttcttacagaacctcatagtttgagaacaaagctgatgcaactgatttatacaaaatgaactttggcaagaaaaataacattaacctcattgtttatggccatgctttgtgcataatcaaagtttatgattaaatgtaaggaagtggtatctagtcagtccataaagattgtgctaatttttttgtggaaaagtagccattagttcaggaaactcagtgctgccttcagatgtcattgatgtttctcctgttggaaagctgatgtgtccagctcaacctttgtgctgacatcataccatttctgatcatgaaatattggctactggtgtatgtagcagttcttaaatcagcagtattatgaaaaaaaattccccctcattagaatgtttaagaaatctttttaaaaagtaaaattctgtcagactacaaatgtttagctgttactcatttctagggaagaaattctaaatccctccttcactttgagcagtgttctaattggataaatgaaggagagtagttttattctgaaggtaattaaatttagactatgtagtatgtgacagaatttttttaaaattataaaaagattttatttagtaattgggatttacttaaaataattttggaataatgctcccagacttgcccagatttgtgtattgtacttattgccactggccgccactttgacttattttctctaatagtttatttgccacagtctttattttgaatatgctcctagtttttttttagggtgctgttcattatgaaggcttctttatagaggcctaataagaatgcctttttataaagcctgtgcatttaggtaggttgaagctaggaggattttctttagaatgctcttttgcatgtaaagcacaaagtatgtttcagtttaaatgcacttcttccggttaatttttatggggaagacaagtgagtcacaaacattctgttgaagggaaatctagtcagttgcttgaaagagcacagcccaaataaaacaaggactgactaggtgtaatgaaataacctgtgatttaaaagaagagctgcagctttgacagtgcttatttaaagaaaaatactgctggaaaatttccaatttctactacgttcaccatctctagtaagatctgacatatgctgaagttatgttttgatttggcacacagcatgttcaatgatggttactcgcctagtacaagacatggagaagaaacctttggacacagagcagatgacacctccttctgttttgtagtgtatcctggtgtcattttctgtgaatgtggtcaggtagagttgtttttgttgttgttgttgggcttttttttctttttttttttttggtctcttttggtggggtgggggtgggctaaagccataggaagaaaaatgtgatgtatgtgtccagtatgtactattttgtttttgttttgcaagaagagttgaactatttttgataacaagagtaaatggtggaaaatgcttcttagttgtcttgtctttatttgctttccaagatttggaattttatttaattcctttaagtgttagcagtgtcttatgaaacatgtatttacctaacgtttgtaacagttttgtgttgaacccagatgccctgctatataaagttgtaaatctgttctttattcactaatgatcactgcaaaaatgattagaaatgagattgtacacatggatgaggatatattttgcaaatcgaccaaactttcctaatattatgatcttaaaattcatagagtactttattgcttcccaagtttgataatcttgtgggtttttttttttttttgatgcatgggaggttggcaatatagacaaagtggaaatcattagtatgtgagggccttgattgttatgtaatattgccaatgatgaattcaggttgtttttagcacaagtttctcttttttatgctggtattctcactgccacatttttggaaacctgtattacaccttaaatctatcaataaatgatagttttctaattctatgttgtagaatactgaagagtttgggatagcatgctctgaatggtctgtattat

SEQ ID NO: 103264 - DNA, 3825 bp, Homo sapiens
  misc_feature (64)..(64): n is a, c, g, or t
  misc_feature (148)..(148): n is a, c, g, or t
tatcaagtgttctcaatgctaagttatatgtgttagtgtcggggaaatagtttgcagataatgnaggagtacccctacaactatatgtccttagttcttacagaacctcatagtttgagaacaaagctgatgcaactgatttatacanaatgaactttggcaagaaaaataacattaacctcattgtttatggccatgctttgcttaatgatggatcattgttttgtgaggagacagaaaaaccctcagattcatcctttactttgtgtttgacacattcccctttaccttcaacctcagaacccacaactgatcctcaagctagtttatctccaatgtctgaaagcaccctcagcattgctattggcagttctgttatcaatggtttgcctacttataatgggctttcaatagatagatttggtataaatattccttcacctgaacattcaaatacgattgacgtatgtaatactgttgacataaaaactgaggatctgtctgacagcctgccacccgtttgtgacacagtagccactgacttatgttccacaggcattgatatctgcagtttcagtgaagatataaaacctggagactctctgttactgagtgttgaggaagtactccgcagcttagaaactgtttcaaatacagaggtctgttgccctaatttgcagccgaacttggaagccactgtatccaatggaccttttctgcagctttcttcccagtctcttagccataatgtttttatgtccaccagtcctgcacttcatgggttatcatgtacagcagcaactccgaagatagcaaaattgaatagaaaacgatccagatcagagagtgacagtgagaaagttcagccacttccaatttctaccattatccgaggcccaacactgggggcatctgctcctgtgacagtgaaacgggagagcaaaatttctcttcaacctatagcaactgttcccaatggaggcacaacacctaaaatcagcaaaactgtacttttatctactaaaagcatgaaaaagagtcatgaacatggatccaagaaatctcactctaaaaccaagccaggtattcttaaaaaagacaaagcagtaaaggaaaagattcctagtcatcattttatgccaggaagtcctaccaagactgtgtacaaaaaaccccaggaaaagaaagggtgtaaatgtgggcgtgctactcaaaatccaagtgttcttacatgccgaggccaacgctgcccttgctactctaaccgcaaagcctgcttagattgtatatgtcgtggctgccaaaactcctatatggccaatggggagaagaagctggaggcatttgccgtgccagaaaaggccttggagcagaccaggctcactttgggcattaacgtgactagcattgctgtgcgtaacgctagtaccagcaccagtgtaataaatgtcacagggtccccagtaacgacgtttttagctgccagtacacatgatgataaaagtttggatgaagctatagacatgagattcgactgttaaatcagtgggtcttttaaacctactcctggtagggaaatagctacagttttacggcagctatggttctgttggtttaacttgccggagctcctgcatatagatcacttgtatcaagtgttttcattgctaagttatatgtgttagtgtcggggaaatagtttgcagataatggaggagtaaccctacaactatatgtccttagttcttacagaacctcatagtttgagaacaaagctgatgcaactgatttatacaaaatgaactttggcaagaaaaataacattaacctcattgtttatggccatgctttgtgcataatcaaagtttatgattaaatgtaaggaagtggtatctagtcagtccataaagattgtgctaatttttttgtggaaaagtagccattagttcaggaaactcagtgctgccttcagatgtcattgatgtttctcctgttggaaagctgatgtgtccagctcaacctttgtgctgacatcataccatttctgatcatgaaatattggctactggtgtatgtagcagttcttaaatcagcagtattatgaaaaaaaattccccctcattagaatgtttaagaaatctttttaaaaagtaaaattctgtcagactacaaatgtttagctgttactcatttctagggaagaaattctaaatccctccttcactttgagcagtgttctaattggataaatgaaggagagtagttttattctgaaggtaattaaatttagactatgtagtatgtgacagaatttttttaaaattataaaaagattttatttagtaattgggatttacttaaaataattttggaataatgctcccagacttgcccagatttgtgtattgtacttattgccactggccgccactttgacttattttctctaatagtttatttgccacagtctttattttgaatatgctcctagtttttttttagggtgctgttcattatgaaggcttctttatagaggcctaataagaatgcctttttataaagcctgtgcatttaggtaggttgaagctaggaggattttctttagaatgctcttttgcatgtaaagcacaaagtatgtttcagtttaaatgcacttcttccggttaatttttatggggaagacaagtgagtcacaaacattctgttgaagggaaatctagtcagttgcttgaaagagcacagcccaaataaaacaaggactgactaggtgtaatgaaataacctgtgatttaaaagaagagctgcagctttgacagtgcttatttaaagaaaaatactgctggaaaatttccaatttctactacgttcaccatctctagtaagatctgacatatgctgaagttatgttttgatttggcacacagcatgttcaatgatggttactcgcctagtacaagacatggagaagaaacctttggacacagagcagatgacacctccttctgttttgtagtgtatcctggtgtcattttctgtgaatgtggtcaggtagagttgtttttgttgttgttgttgggcttttttttctttttttttttttggtctcttttggtggggtgggggtgggctaaagccataggaagaaaaatgtgatgtatgtgtccagtatgtactattttgtttttgttttgcaagaagagttgaactatttttgataacaagagtaaatggtggaaaatgcttcttagttgtcttgtctttatttgctttccaagatttggaattttatttaattcctttaagtgttagcagtgtcttatgaaacatgtatttacctaacgtttgtaacagttttgtgttgaacccagatgccctgctatataaagttgtaaatctgttctttattcactaatgatcactgcaaaaatgattagaaatgagattgtacacatggatgaggatatattttgcaaatcgaccaaactttcctaatattatgatcttaaaattcatagagtactttattgcttcccaagtttgataatcttgtgggtttttttttttttttgatgcatgggaggttggcaatatagacaaagtggaaatcattagtatgtgagggccttgattgttatgtaatattgccaatgatgaattcaggttgtttttagcacaagtttctcttttttatgctggtattctcactgccacatttttggaaacctgtattacaccttaaatctatcaataaatgatagttttctaattctatgttgtagaatactgaagagtttgggatagcatgctctgaatggtctgtattat

SEQ ID NO: 103265 - DNA, 2320 bp, Homo sapiens
ttctgcgctctgtggtcgctccggacgaactcgaacgctggtttctctctcatatttttggtctggaagtctcagggacggaggggcgccaaggccccatgtgtgggaggattgtttcagctccacaaacttgcacggattttggttacttgtttggccaatggttcggctctgatttcttccgaattgttgcaaattcgccatcgttccctggctgcttactaagttggatccggaatttcttttcaaccgggagccattggtgtcgaagtgtctgcaatgaaccccgtgaatgctactgctctctacatttccgcgagccgcctagtgctcaactacgaccccggagaccccaaggcgtttactgagattaacaggctcttgccttacttccgacagtccctttcgtgctgtgtttgcggacatttgctacaagatcctattgcacccaccaactccacctgccaacattatgtctgcaaaacttgtaaaggcaagaaaatgatgatgaaaccttcctgtagctggtgcaaagactatgagcagtttgaggaaaacaagcagttaagcatcctagtgaactgctacaaaaaactatgcgagtatataacacagactacactggcacgggatataatagaagcagttgactgttcttctgatattttggctttgcttaatgatggatcattgttttgtgaggagacagaaaaaccctcagattcatcctttactttgtgtttgacacattcccctttaccttcaacctcagaacccacaactgatcctcaagctagtttatctccaatgtctgaaagcaccctcagcattgctattggcagttctgttatcaatggtttgcctacttataatgggctttcaatagatagatttggtataaatattccttcacctgaacattcaaatacgattgacgtatgtaatactgttgacataaaaactgaggatctgtctgacagcctgccacccgtttgtgacacagtagccactgacttatgttccacaggcattgatatctgcagtttcagtgaagatataaaacctggagactctctgttactgagtgttgaggaagtactccgcagcttagaaactgtttcaaatacagaggtctgttgccctaatttgcagccgaacttggaagccactgtatccaatggaccttttctgcagctttcttcccagtctcttagccataatgtttttatgtccaccagtcctgcacttcatgggttatcatgtacagcagcaactccgaagatagcaaaattgaatagaaaacgatccagatcagagagtgacagtgagaaagttcagccacttccaatttctaccattatccgaggcccaacactgggggcatctgctcctgtgacagtgaaacgggagagcaaaatttctcttcaacctatagcaactgttcccaatggaggcacaacacctaaaatcagcaaaactgtacttttatctactaaaagcatgaaaaagagtcatgaacatggatccaagaaatctcactctaaaaccaagccaggtattcttaaaaaagacaaagcagtaaaggaaaagattcctagtcatcattttatgccaggaagtcctaccaagactgtgtacaaaaaaccccaggaaaagaaagggtgtaaatgtgggcgtgctactcaaaatccaagtgttcttacatgccgaggccaacgctgcccttgctactctaaccgcaaagcctgcttagattgtatatgtcgtggctgccaaaactcctatatggccaatggggagaagaagctggaggcatttgccgtgccagaaaaggccttggagcagaccaggctcactttgggcattaacgtgactagcattgctgtgcgtaacgctagtaccagcaccagtgtaataaatgtcacagggtccccagtaacgacgtttttagctgccagtacacatgatgataaaagtttggatgaagctatagacatgagattcgactgttaaatcagtgggtcttttaaacctactcctggtagggaaatagctacagttttacggcagctatggttctgttggtttaacttgccggagctcctgcatatagatcacttgtatcaagtgttttcattgctaagttatatgtgttagtgtcggggaaatagtttgcagataatggaggagtaaccctacaactatatgtccttagttcttacagaacctcatagtttgagaacaaagctgatgcaactgatttatactctgaactttggtcaggcaatgccagcgaagatgtacatgagcgagctcgatg

SEQ ID NO: 103266 - DNA, 432 bp, Homo sapiens
gagatgtgcagagtcagtgagataacctacacaaaacgcttagcagagtgtctggcacacacggccgtgctctaaaaatgtgagttacttctatttttaccggcaaactttatttttgctgttttccagccttctgtttctttgcacattttctttttttgtggcgaccttgattcctttaggatcccagtgctcttggatcactcccttcttgcttctagcaaagcccactctcgggaaggggtcttacgttgtagccgcatcggatttcaagggcagaaccttcaaggtcgttggggccagtgcccgtgtggtatttgtttttgctgagcggctctttgctgtgctgcatctcctcgcctcctttgacggggtacacacgctctacctgctgagacagtctcctccatctttgtcattttctccactttt

SEQ ID NO: 103267 - DNA, 243 bp, Homo sapiens
ggtagacatttgggttgtttccaatttagacctatgatgaataaagctactatataaatactcatgtgcgagtcattttgtcaacagatgctgatatggtttggctgtttccccacccaaatctcatcttgaattgtagttcccacaatccccatgtgtcatgggagggacctgctgggaggtaactgaatcatgggagcagttacccccatgctgttctcatgatagtgagtgagttctcac

SEQ ID NO: 103268 - DNA, 1271 bp, Homo sapiens
accatagggaagaaattgtttgcgggccagactggtgtgccaggaatgtaatggaatatggcataaggagaacggggtaggtgctctcataagtgggttttctttagtgtttcccttctgtccttccaaagggcttacttcctcctgtcctcggtgttacttggcgctcgccctgcctggacaatcataaacccttttgctcagcgattgcttcccagcagcagcagcagcgccccctgagaaatgttcactcttcaatgttccaccgaccctatggtggggggatcgctgctttccacttatttcaaaatcatggtgtgaatggaaaggctttgtttgccattatcttctgtttgtacaatgagccacaagtgagcaccgccttggcgcgcacccaccttgcccgggcctctgtcccctccagccgcgctccaccggcgccctcgccccgctcgcggctgctgggtggcttgctgcttcgttctggtagacttgcgattttgccttgtcctccctctgggttcgccggatcctgtgttttccctgtcccagaatgacccattcgggcttcggtgtttggcttcagaacgaccactgcccagccccggggactccaggtcccagcacctcccgtcccacccctcccgccagtctccgcagtaaaggaagacaatgactaggggcctccgtgtgttggctttaatgtacatagcttataacaaggccacactactcaaacattcttagttttttttaaaaaaaaggaaatacagagatagatgtaaatgaagcattggactgagttgtggttgcttttggggtgagtttgaatgaggggatggctggaggctgttgaggccacgtcttcattttagccttaaggaagaatttctttggtttgtgacaaaggatcaaggaaacctttcagctgggtgagtggtcggcactctaaccctttctaaagcttggtgtgacccaatcaggcggcccaaactaggattaaccaaaccaaacaaggcctgtgaattaagacaatctgctttggggaagccacttgccccaaatacttaatccctgaaagagccgcttgtgtgcccgaagcattgtcctcacacaacattcctttctttacacttcttacttctgatttgattgaattgtttgttcctataaggcaaagtggaaatgtagtcaccggttttactagaaaatagttctatatagtttgcttttgttttggaaaatattctaagaaaagacttaaaaaaaaa

SEQ ID NO: 103269 - DNA, 311 bp, Homo sapiens
caccctgagtttttgattcagcaggtctggggtggggcccaagaatctgcttttctaccagttcccctgtgctgctgctggcccaggggccacatgtgagaagcaccaatctgttatattgtttgtatcactcacctcacgcccagacagtcctgcgtccgctggctttcccctcctctctcccagcctgtgtttcccgccttagcggcccactttctaggatatcaccacctgtattctccatgctcggccactcctggtgcccgcgcttaggagacgtctcttccaggcacacagggatagtaaacagc

SEQ ID NO: 103270 - DNA, 464 bp, Homo sapiens
tgtggccagttgcagtcaaccctgagcctgggcaaaatgcatgcaggctggtcctcctgggtgatatcctgctaggcgggtgggcagtgtacacggcagaagagggttgcggcatgaggcagcaaacgtttttttctaaaatcttgtcaagcgtggggtccgtggaatccacatgtgagcatcagcctggtgggtggggagagtgaagcctgcgatccagtctggatcatgtgctacacagtgcagagccggcatgctcacccctcctgagggatcgctcgagcctatttctaggcccaaagcgactttgcaagagactccctttattctgggcttagtggaattccagcttccaacagccatttccctccacccccttcagttctgagaacatgttttgtaacaggaaggcaggaagaaaagagaaggcgagtttgttcagctgggtcagccgcatcccacca

SEQ ID NO: 103271 - DNA, 554 bp, Homo sapiens
aattgctaataacatttgttgaatatttactaagcgccaggcactgggctaagggctccttgtgaatttttcacttgatcctcaccacagccctcgtcacctccatttgacagatgagaaaactgagactcactaaggcagagctcacacagctagtgacaggcaaagccaggcttgggacctggctccagtctgctgagcagtctgcctccagaacctatactcttaaatcccgaaaacagagctatagatgcttttcctgcctccttaactttcctttcccttagaaggttcggtttaccttctctcatacattagtgccctctcagaggaaatgcaaaacaaatgccaaaaactttaatcagctaaacacttctatgccaaaacaaggaaatgtgaacttacttatttcaagacttgaaattcaatgataaattcaggatgcatcatttcttacaaaatatttcagccacaggatcctaaattttgcagcatggtaaagcatgttggtacacaattgttcctaacatgaggcagggccaggagcccctgaa

SEQ ID NO: 103272 - DNA, 379 bp, Homo sapiens
agtactttcacctttatgaatgcccttcaaaagtgtaaattaataagactctatttgtgctttaaaaaggctaggttggtttgcctcctacatgttccatagagatcaattcagcctggtggccgcaacttgacttggactctgccactctcagtgtgaatgctgggccaacctctgctctttaaattaaacaagggagtgttttcctgtgtgttacccggttatcaaaaataagattcccctaaacagaactgattataactggtaacagaagcaaaaccattgtcccatctggcaatattcatataatttcaggaattctgctttattattaaatgcaggggcagtgtttacaaagatgcagtctcatatagtgaga

SEQ ID NO: 103273 - DNA, 660 bp, Homo sapiens
gggggacagctaagcgccttggagagcaaccacccttatttgcctaataccgagcttcgcacccagggggcactcgacacctactgtagtttggacgccaaggaacgatagggttaggagggggctactgttcaaccacaaagcttgtggaaaagtttgttagcccagacaatctcagggcaacacctggcaggtgctttccacccctgaccacagtggccaatgggacagagcctgaaataaatatttctagtttctgaggtgagctgaaggccaaagagcagctgtccctgcagctcagaccatccagtgaaggagtaaggtgctactttttaaagccttctgctacctacaacctccttagcctttaaaacgtgtgcttgtctctgcacgtttaggagacaatattaagaattagaaatgaaagggccgagcgcggtggctcacgcctgcaatcccagcactttgggaggccagggcgggcggatcacgaggtcaggagatcgagaccatcctggctaacactgtgaaaccccatctctactaaaaatacaaaaaattagccaggcgtgctggtgggcgcctgtagtccaagctactcaggaggctgaggcaggagaatggcgtgaacccgggaggcggagcttgcagtgagagatc

SEQ ID NO: 103274 - DNA, 745 bp, Homo sapiens
gcggagggaacttggggtccactgaagagcttcgaggggccatctacctggtggaggaggtgtgcccccgcatctccgacaccatagtgggccagctcctgcagcagctccacagatattctctaagtggtggagaaacttcatcccactgaaattcctttggcatttggggttttgtttttcctttttttcttcttcatcttcctcctttttaaaagtcagcaagagccttcgctgactccactgaagaggtgcgccaccgggggccaccccagtgccgggcatctgtccagggacacacacagtcctcgctgtgctgcagccagatgaagtctcccagatgggtggggagggtcagctccttccagcgatcattttattttattacttttgtttttaattttaaccatagtgcacatattcaaggaaagtgtctttaaaaactaaaacaaaccctgaaatgtatatttgggatcatgataaggcaactaaagacatgaaacctcaagtatcctgctttaagttgataactccctctgggagctggggaattgctctggaggatgggtgtacagatttgtatatagtgtcatttttgcggagaccctttcagtgtgcataaggaatcactgtgtaaaaactggccaagtgcttctgtagataatgtcagtggagtaaatattcaacaggccaaaaaatatatataaagaaaagtctctaacagttttggggtttttgtgtttct

SEQ ID NO: 103275 - DNA, 585 bp, Homo sapiens
gaaatattttcttcacttggctttcctgacagttttctttcctggttttcctcctcacagaggccaatgtaccttgaagccaacaaagaagcttacatttcagggcttctcacttgcaggacccttctgatgccacatgtctcctctggcaccccagcagcagcacacaacacaacactgttctgttgctgggaggtcacctgggtcagggttcctaggtcttggagtggggtcaggcgactaccagcactatctccactttacttggagtccagcaaaagccctcccatgatgcatttcgtggacattagatctcatgtcccaatccaaggagaagatctgaaggaaacgctctgctctgctccttgcccggggtcaccttgatccaagcttcctggctaccttatgtcacccccagctccagctcaggatttgggagggtggtgggaactgatggttctgtggtcctggccaaacagtccagctgtcgcctgggcctttggatgccacagggtgccatgttagtaagaacaaaggctgcacttctctgaggccttgttcactggcaagaagtaccgccagagc

SEQ ID NO: 103276 - DNA, 806 bp, Homo sapiens
tcccttcgttatgacattttgagtcatcttttttttttaccattctagtcttttaagagaacagcttaaatctacataaaaacagagaagattcctaaaaattacatttaaatggcaaaaaaaaaatactttcaattcttctaagaatttcacagtattaatgaatagagccatatcaacagaaaaaaaaaagtcgaactggtactcttattcaaaaaaatttaaatattaaattatttttattggatgattcaaagtatctccgtctcacctgcagtgtattttctttctttataaaggacaatctttactaaatattatgtcctagagatttgttccattaccatagacactattggcaaaagagatagtgatgtataaatttttaataagggaggcaaggaaaaagtattatatgatagggttttcttcccctgttaatgttagaaaactaaattctttgaactcttttttccaactctggtatgatttaagtcttcatgtaaaaagagagaagttgacagtgctaaatggcaagaaaaaaacagtacttggttaaaatggtttctatcactgtgaatctcatttagattatcattaacttactttaatcaaatcaattattttctcatacaaattccttactatttctgagaatttgacaaacaccttttttggtaagtagaaataatgatacatttataagaatgccagaaaaaaagctcagtcatccacaatttactaaaaccactgttagtaagtttatattttgaatttatcagtaattttagtcttgcaagaaactt

SEQ ID NO: 103277 - DNA, 471 bp, Homo sapiens
ttgtagcttccacttctgagtgtatagctggtatagatattttacatgcctgaactgtgagggatcataagctccaggcagattatgctcactgcgaatagcccatgtagaaaggcattagtaggtttggggccccacaatccttatgacctgtttgagtacaagtctgtgcacagatgactttcctgactagaccatctggcaagaggaacaacctcttcaggtgactcttgggtttggattcaatgcctccctgacgtagctactaggtatgcctcttttgaaaagattcccatttgggaatgagtcaactcaaatgcaatgactaataaggtgggaaaggcccaacaagcctctgtcaccacatggaactggtaatattcaagaatgcagccagtctggcccctagggcatctcagctttacatgaaaaagtagcagcttctccctttgagaaagtctgatcttacat

SEQ ID NO: 103278 - DNA, 352 bp, Homo sapiens
accatgttggccaggccagtctcaaactcctgacctcaggtgatctgccctcctcagcctcccaaagtgctgaaattacaggtgtgagccaccatgcccggccccactgatatgacttttatatgactccatttatatgactttctggaaagggcacagagatcagaccagtgtttgccaggggctgagggtagaagatgaaactgagtgcaaagaggaactaggagctgggcttggtgcatgcctgtagtcctagctacttgggaggctgaggctggaagattgcttgagcccagagttcaagtccagcctgggcaatacagtgaaactccacctctctctccctctcaaa

SEQ ID NO: 103279 - DNA, 396 bp, Homo sapiens
attgccttctaagtcagatataaacaacgaacttgcttgaaatgttctctatcagaccaaggacccatatttaattccaacttacactctgctacaccctttcgctaaattctttagttgatgttaactgcatttggaaccctgtattcagcgttgaattgcacattctgaagcaattgtgttcttactcagcacgctcatttctgtatcccaagtatctccctgcctccagaacatgtttactctttaaccacttcctgataatacagtaggctaccattactctaaatagttgcagttattgaatataggcacatttttaaattataagaatcctatcccaatccaaggtacaatttgctgatcgcatactgattcattttcctcccactctgg

SEQ ID NO: 103280 - DNA, 362 bp, Homo sapiens
tcttagcatggagatgagtgttactgggcagctggcctgggagcatcactgtgccaggcctgggctgagcccggtacataccttccccaacagctccgtaaagtgggggcggttgggggttcccatttgacagatggaggtgtctgagctgcggggccaggagggaaaggtgggcccttctcccttctccctgctgctttctgtcctctgtcccctgagcctgggagctgggtccacctgtttatccacccactccccacagctgaaggaggttgtgctgaagagcagcaaggtcgtgcgggctgacgtctgcgtggtgggcattggtgagttggtgtgtgggcaggcaggcacaaagcagc

SEQ ID NO: 103281 - DNA, 2030 bp, Homo sapiens
agctggtctggtgtgtgcagagacactgcggcaggagggcttctccgaccggatcgtcctgtgcacgctagaccggcaccttccctacgaccgtcccaagctcagcaagtccctggacacacagcctgagcagctggccctgaggcccaaggagtttttccgagcctatggcatcgaggtgctcaccgaggctcaggtggtcacagtggacgtgagaactaagaaggtcgtgttcaaggatggcttcaagctggagtacagcaagctgctgctggcaccagggagcagccccaagactctgagctgcaaaggcaaagaagtggagaacgtgttcactatccggacgccagaggatgccaatcgcgtggtgaggctggcccgaggccgcaacgtggtcgtcgtgggagccggcttcctggggatggaggtggccgcttacctgacggagaaggcccactctgtgtctgtggtggagctggaggagacgcccttcaggaggttcctgggggagcgcgtgggtcgtgccctcatgaagatgtttgagaacaaccgggtgaagttctacatgcagacggaggtgtctgagctgcggggccaggagggaaagctgaaggaggttgtgctgaagagcagcaaggtcgtgcgggctgacgtctgcgtggtgggcattggtgcagtgcccgccacaggcttcctgaggcaaagcggcatcggtttggattcccgaggcttcatccctgtcaacaagatgatgcagaccaatgtcccaggcgtgtttgcagctggcgatgctgtcaccttcccccttgcctggaggaacaaccgcaaagtgaacattccacattggcagatggctcatgctcaggggcgcgtggcagcccagaacatgttggcgcaggaggcggagatgagcactgtgccctacctctggaccgccatgtttggcaagagcctgcgctacgcgggctacggagaaggcttcgacgacgtcatcatccagggggatctggaggagctgaagtttgtggctttttacactaaaggcgacgaggtgatcgccgtggccagcatgaactacgatcccattgtgtccaaggtcgctgaggtgctggcctcaggccgtgccatccggaagcgggaggtggagactggcgacatgtcctggcttacggggaaaggatcctgagctcacatgcagtagacttgggcaggcaaagggggcaccaagggcacaggccaagccttgggggcaggtgccaatctccagtcccaggatcccccagggcagaacctgagccctcccagtgcttgccttcagccacctggctcccctcctgggaggcctctgctggatccagaagatgctcaaccctcaaggcctctgctgccactgacagctggcactggaggcaggacaagccctgcctcttctccctctattgggactggtcccctgaagaaccctgcaacatgttagacattaccgtaaaattaaaacgcacaaatttgcagaaaaaaaaaaaaaaaaaaaaaaaaaaaaaaaaaaaaaaaaaaaaaaaaaaaaaaagggggggcccctaaaattttccccgggggggccaaattcggacccgaagtttttttagtcataggggggcccccatattaggaggaggctgcttattatataaatacagccagtagtagcaccggggccggctggttaataacaactgttgtacgagggggaaacaacttggtaatacttgggagccacttttggggagaagagaaccccctataacttcgggggggggtggcaacaattaggggggggacaatatctacctctaagggaagaatattgaagcagcctccagaaggagaacaattataaaaattcttcaacgggtgtgtatttcagcggtgttcaaacaaaagggcgcatataatgatcgtgggcgggacttggaaaaaagtttgggcctcagcgggatttttaagtattgagaaagattttttatatcgagggattctattttaaaaatgag

SEQ ID NO: 103282 - DNA, 436 bp, Homo sapiens
agctgttcagggtgcccagagtggagagcctgttttcttctgtcttgaccactcctcccctcactcctgcaggactggcgacatgtcctggcttacggggaaaggatcctgagctcacatgcagtagacttgggcaggcaaagggggcaccaagggcacaggccaagccttgggggcaggtgccaatctccagtcccaggatcccccagggcagaacctgagccctcccagtgcttgccttcagccacctggctcccctcctgggaggcctctgctggatccagaagatgctcaaccctcaaggcctctgctgccactgacagctggcactggaggcaggacaagccctgcctcttctccctctattgggactggtcccctgaagaaccctgcaacatgttagacattaccgtaaaattaaaacgcacaaatttgc

SEQ ID NO: 103283 - DNA, 318 bp, Homo sapiens
acatgatgctggaattgagaataaaggacatagactgccttacagtcggtagggcaagcctttctgtgtaagagatatttaaccaaccattaagaatgagaaggagttggcctttcacagagccctggacagattatttttaggagatgaaaaatcccatagaaaactatatgaaatgggaaatgttatgacacaatcgaggagctgaatagaagcaagtcataataagagggagtaaggaggacaatgtctttgaaagaggtctttaggtaaccaaagaccatattatattatatggtaacatgtttggattttatt

SEQ ID NO: 103284 - DNA, 752 bp, Homo sapiens
ggttaagcgtctgcagggtgagaagctggagactgtcctcgtgtcgctgggctgagagccgtgtgcggctgtgagtttttgatgaggaaaagcagtgtgggtcctggatttggacagcacaggcccctctgggagccgtgtgccttcacctcggagtgtgtgggcaaggtacagagctggagcccttgaccctgaccggccagccaggaaggccgtaggaggccagctccctggcgtgaggtgcgcagggcctctggcattgccctaggtgagggctccaggactcggacactggctctcagtggggcaggtgtggcccggcagggggcgctttgtgggtgcacagtggccccagggtggtgcagatggtgggcagacctaccccagggctgtttctgagacagaggtccctggaggagaaccaggtgctgggcctcaggtgtctgtcctgaactggagcagccttggaacaaggaaccacaggaagtccctgtggcatggggtgcagcccctcaggtctggcagggctagcccagggagtgcagggccccaggagccctgccacaggttcctcagctcgggagctcacggcctcctcactgcagggtcctttcaggagggccagggtggccttcacacatctgcttcttcctcagagacacaggtgtgggcacgtactggccagtatagataagcattgagcagcattgatgggtatcgatgatcctccaggagcagcggctggtgccatg

SEQ ID NO: 103285 - DNA, 297 bp, Homo sapiens
ccacctcagcctcccaagcagctgggactataggcgtgcaccaccacgcctggctaaaattatttatttatttgtttgtttgtttgtattttttgtggagaccaagtttctccctgtcgaactcctggactcaagtgatctgcccacactggccttggaaagtgttgggattacaggcacgagctaccgcacctggccttaccattttatttaaaagctcactttggagagaagccagttaggaggcaatggtggacaacaggtcagaagatgatgtaccttgagcgttccagggtc

SEQ ID NO: 103286 - DNA, 424 bp, Homo sapiens
taaaggtgaaagtctttcagaatatagatttaagaagaaaattaaaacatgataaaaataaagcagtaatgaagaaagggatgtaaacaaactatgggtatgaagacgcattactgaaaggtcatttaaaaccacgtgaaaccatatgttaaagaagaaactgatgaagatggcaacagatgaaactaaatgttattaaaatatgaaaaggtattgtttgaatgatccaaaaatagtattaaatattaaaaattaaaatagacatttctttattattatataatattttttcattaactgtatttgcaacaaaatgagtatataccaacatgtaaattttggaatattaatttttgaaaatttattataattaatcattttaatactatatcaaatgaaaataaaattttaactattcaacaat

SEQ ID NO: 103287 - DNA, 403 bp, Homo sapiens
ataaagatgtaagaaggataaggagagaccagatgcagtcgagggcttttgtggcatgaggaaaggatatttaacttggcaccaagaaatggggtggcattctaatgctgctcctgacctcctgtgtgaccttgagctccagtttccctctttgtaaaatggtggccctgatgactacctacaaggttggaggtgggaataagggacctaatgcatgtccagtcatctgtcatcaacactcaataagccttttcctttcgtggccatccatcttcaggtttgacggaagtgaggatctgccctcagggttgaaaggtcaagatggtttgctcaaatattttatttctctcataaatctcttgcaggtttggttcatcccagactattctttttcagggcagta

SEQ ID NO: 103288 - DNA, 364 bp, Homo sapiens
ggtctcctgtaagtatatcccagccaccaactcctaaagaactgcccttttctccatattaaacacacacacacttacacacacacacatacaaacccctgctttgtaaagtttccatcagtggaaactttgatttctttttttaatctcttatgctctcctgaagttcatggttgagcaccatctccaagataccacagaactcttgattgatgatcaaaacagtagtgtcatcttttccttttagaaaacggaacattttctcacctcatgattgatgaattctaaaccaatggggaaaaacaaaaaggctttaaaataatgaatctgtttctcaactactgttatattcaattaatttaac

SEQ ID NO: 103289 - DNA, 549 bp, Homo sapiens
ccccgtcgggctatatctttatcacgcagcgtgaaaacggactaatacactgggcatggtggtgcacgcctgtcattccagcgacagcgaggcggcaggctcggctgtcgctgggattacaggcatgtgccaccacgcccggctaatttttgtatttttagtagagatggggtttcaccatgttggccaggctggtctccaactcctgacctggtgatccgcccacctcggcttcccaaagtgctgggattataggcatgagccatcgcgcccggccatttttctagttcttatccttttggagcattttataacgttttatctacttgatctccatatgaattaaaacgcttattctttggcttccaaaacaatgctttttttcccctcagatcctcttcttacctcctgaatcactcttctgctcacgattcctcttccattgcccactctttgcccagatttctaccccaacccactttctctatattctttcgtctttgtaaccttacccactcccatggcctcatccctcattatgtactaatg

SEQ ID NO: 103290 - DNA, 904 bp, Homo sapiens
aatctgccaagctggatttgcacttttaaagatcagtatcaataatgccctgcttgtttcggttgcactctccctttaaaagacagccccctctaattgatgcgtctgggctagtctagactggtagtgattgaaccaaccaccaattatgttattcatttcactgaacttcactgatgggctcggtgaggaagaaggggtgttgagaaacctgcccttgactgaagcagttgcctgctgaaatataaaatcttgtgtcgttatgcacttttaaatgcctgggtgatcagttgtatgatagcaacctcggaacatgagcaatccacttgaaaacatgtaaaaacctgagagtgccttgaaatacaaattaaaacacttgtattaaattactaccctgttatcactgaaaatcacggaagaattttacctggcatgtttttattgatccatgtatacattttcatagagtaaactgcagatatattttaacttcaaaaagcaccaactgttttacaaatgttggatatgaataatgtggtaatatagattcgtaagttaaatagatgccttgctataatttccaaatacctatgcatacacatcagctaaggtaggggaagtcattaaaccattgaatataaactaacgatgactcgacaatcaaataactattttttttgaagcacattcggactatcaaagactggaaagtaatattctaatattactacacaagaggtttcaacaaaagacgtggtgcaatcgttgcatagttcatattctcagttcaattttctgatacaaaatggtttcttgattgcaatttggcattaatgactaaaattgcaataaacacttaaaataaaaaacaataacaggcaaagaacagtttccctaaccttca

SEQ ID NO: 103291 - DNA, 509 bp, Homo sapiens
tcaaggttgatgtttattagttttcccatctaaagactaggtctgatgccaacaaatcagacttttttttcctgcatctatgatcaagcacttgaacatttccccacgaatgtggatgcgccctgggttagaattgttttctgctgtgagccaaggctgagttccagctctcatttacctgcaaggaggagagggatgcaaaggatcgtcagtggtggagaagatgccacttttttggctgttttccacagcattcagattcatatctgagttcaacatgctttgtatgttttccccacatgctgggacaggcctgtttttaaagacaaggttgaagagtggagagaagaggcttgtttatgcacatggtcatcagtacagcacaatctgtctccaaaatgggaaaggtcccctcactagggatgagcttcagttttggtctgtctctggattctcacctacctgattttccactcttatcccccaatcttgggcctgtcctttaactg

SEQ ID NO: 103292 - DNA, 464 bp, Homo sapiens
cacctcctaccaggcccctccttcaacactgggaattacaattcaacatgagatttggatggggaaacagagccaaaccatattagggtctttaagaggtaataagttaaaatggagttattagggtggcccataattctacagaactgatgtccttgtaagaaggggaagagacaccagaagtgccagcacagaggaaaggtcctgtaaggacacaggctaaagacagccatctacaagccagggagagaggccccagaagaaaccaaagccacaaataccttctcttggactttcagcctccaaagctgtgagaaaatacatttctgttgtttaagccacccagtcggcgctactcggtcatggcaggcatggcaaactaatacaccaaacgctggtgcatggaacatatcacggtcagctacagcgtctcagcagaagaggacgggcaagggacacgagtg

SEQ ID NO: 103293 - DNA, 730 bp, Homo sapiens
tgcgtagtgcttggcgcggtgaccagacctggccgccttcctgactgcacagagcaagaggccacactctggatcccaggccgggtccctgtggttctgggagggaggtcccggatgcctcccagatctcgggcttctgtaaccctgaggctgggttttaaaatcacggctcttccaagttacacgaagagtccatggtcaagggtcaagggtggtcttcgaccctcgggatcgtcttcttgagaaatggctgagagctaagcctagagctgcccagggaaggaagccaaagagctggagccgagcgcgaagggctgggaggcgcggggaggccccttacccccgccccccccccccacactgtcctggccgctaataacgctgataatagtaacagtatcggccaactgtttcccccctgctcctggtctgccaggcaccggatcctcctttagcactcccagcactcactgaagaagacactatggaattctccgttttccagactagaaataagtaactcggagaaattaagaaactcgcccgacgaccctcaggcagtagcacctggccaggtttgggtgctgttgtaggagcaagggatacaatgatgatcaaggcagatgcagccgttaccttcaggttgtggagtccggatacagactggaggcaggcagctgtaagatgtgtgagaaatgctgcgctggatcagcccatggtataggagagc

SEQ ID NO: 103294 - DNA, 818 bp, Homo sapiens
ctgatgtcagcgtccatgtgcaggttttcacgtggatgtggtttcccaccatgttagcttgtccagcctctgcagatgccagctctttcattttcgccctctttggggagggtgtgggtggggaggcgggctctggtcctcgctgacggagacggagcctctggcctgaggaggaaggatgggaaagagcttgcttagccagcgcctcatcctccaaaaccctctgagactgcaggagtcacctctccactttcaagaacagtgccttgcccagggtcattgagcttgggagtgagtggctcagaagtggaattcaagactgtccgccgcagctctctgaagcattcaggggtctctgggctggccctgggcacgggtcatcagtgccacttctacccgaggaacaagagttccggggtccgggccactctcctgtggttttgaccttgctcttgaaccccccattgcctcccccagggtgagcctggagtacctggaaagaagggcgacgatgggacaccaagccagcctggaccaccagggcccaagggcgagccagggagcatggggcctcggggagagaacggtgtggacggtgccccaggaccgaaggtgacatgagagctctctgctctggcgcctgcgggccccgctcagacctccacccagtcgggagtgggagatgtggtttcagctctcatttgcccttttaagtcccaggagggcctgacccaggggtctccctcagcactctcagaagctggtgtgggggcagcggtggtgaatctgggtgagtggcaaggcctccactggtgccc

SEQ ID NO: 103295 - DNA, 265 bp, Homo sapiens
aagatcgtgccattgcactccagcctgggcaacaagaagcgaaactccatcttaaaacaaacaaaacaaaacaaaaacaaaaaagcataatctctttcagaatttttaccttcttggtgtggttctgttaggaaaggcttccatgggaaccttcaataagtgacctaaaaaaaaatctcagagcagaaggtcgacgcgccggagtgcaatggctgctgtaggattaaaaaaaatagtggttcctcaaaaagttgaacatggaggc

SEQ ID NO: 103296 - DNA, 934 bp, Homo sapiens
tttgcaatagatcttgctgctactcacgctttgggtccacactgcctttatgagctgtaacactcaccgcgaaggtctacagcttcactcctgaagccagtgagaccacgaacccaccaggagaaacgaaaacacgccgccttaagagctgtgacactcaccgcgaaggtctgcagcttcactcctgagccagcgagatcacgaacccacgagaaggaagaaactccaaacacatccgaacatcagaaggaacaaactctggacatgccgcctttaagaactgtaacactcgctgcgagggtccgcggcttcattgttgaagtcagaccaagaacccaccaattccagacacaccaagtattcgaggggactgaggcaggagaatggcatgaacccgggaggcagagcttgcagtgagccgagatcgcctcactgcactccagcctgggcgagagagtgagactctgtctcaaaaaaaaaaagaaaaacaaaagcattctttaacacagataaagtgactgtgaaagcaagcacataaaaacaagaaatacaaataaaagaaaaaaatacagtgggaaagaaacaaattcccctcaggtgtgcgggagaatggaccatgcccattcaagatctcagtaaccatgtgtagtcaatctagaggtaaagatgcctgagagagtgggtataggagatgaagacatagcagtagccttagaagtccgatgttaccaccaatatcatcttccattgtgacagtaatattttcactgtaactagaattcacaccagtcaagaagctaatcaaaacaaagatgccaaaagctccatttttcagtctgggcttttattcaatttaattcttttaaatattccttgcttttgactatttttattcaacccattgttaatttacccaatttcacacatttaacaa

SEQ ID NO: 103297 - DNA, 537 bp, Homo sapiens
ttaagcaattagtgtctgttccaagtttgacactgaattggtctacaactccaggcacgctatcccacatctgagtcagttttctccatctgtaatatagggctgataaaatgtgccacctgctcactttataaaaaggggagtgagaaccatgtaagcaacagttactctggttatgtgacattgatataagttaaatgagaatactttttaatgcagtgctcttactttgttttgatattatgaatttcaatcatttgatgaacagttagcataaagataaggagaatgactctccctatgccatcatttaagaattaaaatttcttccgtattaagattggtgttaagatctttagaagcagtgatgacaagaaaatagagtatattttattggttggtttatttactggtagattttacttctgatttatccaaagttttgctcttaattctgaaaattccccctacccttcctactctttaaaatttctcacatacattgccccatttgcctgtcgaatccagccttgtgag

SEQ ID NO: 103298 - DNA, 380 bp, Homo sapiens
ctgctggccgcaggttggacaaacttgctctgggacataagtttaaaagttataggccaagtgccttggctcacgcctgtaatgtctttgcatttcatcagtttttccactgttatctttctgttacagtacacggtcagaataccacattgcatttagttgtcatgtttccttagatgtgaaacaaatttaccaattgtagtagggtatttacgtatagatcggttcgtttgtagccttatagtatctagttaaaacactgttataaagttattgttatgtatccttttgggtgtggtttctttccttagaaaaatacatttaaaattcattcatgttgttaaatgaatcaataggttgtttctcttttaaaaattgag

SEQ ID NO: 103299 - DNA, 583 bp, Homo sapiens
tcaacgctgcctggcatggagaggttggcgcaggctgaggctgctgggctctgaggactcagggtgtgcagcctggaacctgcacctcctaatgaaatatggcctaagcagacaccaggatccagagcccagccactcctctccccaatgctgaggccctcccgagagcccaaggcacggcatggagctcgtgcgtgactgcgagcaaatgccctggcctcaggccaccaggtcaggtgcagcaggtctgtgagggaccccgtgtgcctctcctgtgggggcagcatcagcttccctcctagagaaccacatggagcagatatgggcggtgcagcagagcactgcagcagagggccaggagggtccaagcagtgctgtgatcatccgactctctaaccatgaactcacctagagatgcattccaaccacacctctctaaaatacatgtaggtgttagtggaaaacacctgctatctatttctgacttaataaagtctatttcatacacatagacacatttggtttacaggcagatgagacagtgatcgggcacgtcagcagacagtctccactcaggccctac

SEQ ID NO: 103300 - DNA, 267 bp, Homo sapiens
cattcttggattaaaaaaatactttacagttgacccttgagtagtgttggggtgctgacactgcatagttaaaaatccacatataacggcgtgagccaccatgcctggccggaatttcttgaaataaggcaacaatgaaatttgctgcatcagtcgactcttccttccaggaaagatttctctgtagcatgcagtgttgtttgatagctttttacccacagtagaacttctttaaaaaatggaatcaattctcttaaactttgctgc

SEQ ID NO: 103301 - DNA, 444 bp, Homo sapiens
  misc_feature (22)..(22): n is a, c, g, or t
aggtcgatctcgaggatctttngcggcgctttccattaaactaattactacacagaagtgtggctgagaatctcagaccctcaaacctttcctacagttttccccagtcaataccaaaccctacacaagtgattctccacgggtacctctggcatcgttgggcaatggaagtctccaagaggtaacccagatcttgctctccagaggcggttctagcacatacgacactgatagcataaggagtctaataacttgtggtgtcctagctatgtgtgcttcatcatccagggagtccagtaaaagagaatttctatcatgtttaacaggaagacatatcaagaaagcaaaaatgggcttaggatgactgtgcattctcctacattaactgaatatttctgctatctgataaatttattatatgccagttacaggtttaattctgag

SEQ ID NO: 103302 - DNA, 356 bp, Homo sapiens
tccattgagataattgtggtttttgtctttacttctgtttatgtgatgaatcacatttattgttgaaccagccttgcatcccagggatacagcctacttgattgtggtggataagctttttgatgagcctagtatatttgaccatttattcaaaatagatttattttgatattctcaccacttattctaccaatgtgttatatcaccttagggaatagacaatgcttcctgtggccagatgcagtggctcatgcctgtaatccaagcactttgggaggcctaggcaggtggatcatttgaggtcaggagttcaaaaccagcctggccaatagggcgaaaccccgtttctagtaaaa

SEQ ID NO: 103303 - DNA, 442 bp, Homo sapiens
gaaaagcaacagttttagcagatggagaaatgttgcaatcatcttgagatgagtggagtttgagacacctggacttctaaggggagctggactgttcaggtgtgaatcccagttagagagagatacagggtggaatggggctaagaggaaagatccagaagagaaggggatcctgacccctctccaggtctgctcccccatgggtaaaatgaggggtttggagtttccatttaattcagcacatagttcttggttcctggtatgcacttggccctgctggtgacacaaacaaatcagagtccttgtctacaagcagctcacatttgggctgcaagaaaggccaggagaaaggatagcaacaagaggcacaagcaagatccacagaattcaggggaaaaaaaaaattcttcctgagaccaggagagcttcctggagtggagtg

SEQ ID NO: 103304 - DNA, 297 bp, Homo sapiens
tctctgaattgccagataaagaatttagaaggttgataattaagttactcaaggagataccagagaaaggggaaaaccaatttaaacaaatttaaaaaacaatacaggatatggatgaaaaatgctacagagaaatagatattgtaaagaaaaaacaatcacaacttctggaagtgaaagacacgcttagagaaatacaaaatgcaccagaaagtttcaacaatgatgttgaatgagtaggaaaaagaatgtcagagcttgaagacaaggctttcgaagtaacctaatccaaaaaag

SEQ ID NO: 103305 - DNA, 419 bp, Homo sapiens
gggtaccagaactgcagctgctgctaaggtgacagggctgatgccagaaggccaggcagagccctgcgggctcctgggtggaaccacccctgggcaggtctatttcattattgagatactttaaaatcattttgtaggcaaaattcacagaatctcctcttctcatgtccctttgttgattttctgttatcttttatcagttggctcttgtctgcaccaagttctagccaaagcccaaaacatctagtatcaagggccttttgtgctgccgtgtaatccacattaggccaccccttggcaaaagccagaaatatttttagaacaagtttggagtctgtatgtgggctgaagaattggcacattaaggagatagaaagtctcgggtgacaccaggcatagtaataagactgtaagccccc

SEQ ID NO: 103306 - DNA, 742 bp, Homo sapiens
tgtactcagccatgatagttcttaatcatcaatacatttagctcttgtttgaagacactactctctccccattttcaccatagatttataaatttttgtgctaggagaaaccccagaaacacttaaggctacttgctttatcttgaagatgagacaggggttaaaaccttaatccttaccttaatcctgactttaatccttccagagagagagttcacatcccagtcactattatgccatatacagaatagccctagaacctagatacctaatttaagaattaatgtctgattttttctgagacagatacctatccttctcccgattacatctggtgacgtaaaggtgactagtttaaaatcttactgaaaagaggaaaaaatatatatcattaaatccttcagaaataattatataaatacagaaacaaatttagagccccccttttgaatattgaattgagtatgtgagtaaagagcactctactcaaaatttacaaaacatgtataaaacccaaaactgatgctcccaaatattgtagaatcatcagtagaacatgtaatcagttatttatatatttcaaaataataataactgttatctataaaatatgaaatttatgtcaagattaaaaaaatacaaactatgatcttttttcataatacaactaatgacatgccatctatgcctctataattcaataagtttatgtgtccacctgagacattcttgttcacattga

SEQ ID NO: 103307 - DNA, 856 bp, Homo sapiens
caataattggatgtaacaaaaagcagagtattttgagacgtatattaatgcaaaatattgttaatgtatcagtggattgttcctccaaagtaccagtgccttaacacaacatatctaaaagaacatctctgggaacagtagtacttaatggcaacttgagaattggtttgtgggcacacagccttgtgaagttttgaatactaaatcccttttttaaaaaagtgcttattatcaggctatcaatcaaaagatttgagtctttcagtaaagaaaatttgcttaattttatctagtgccatgataaactttactaaggaagtctcattcagaatatctaatattttggatgtgagcccacactggaaatgccataaccaaaaaagagtgaccctaaagatagaatattcagatctaatggcagatgcttagctatgctgggaaaggaagtgaattgtatattgctctgctgctcacatattcctctgcaataaattgctggcccagtttagtttttatatactcactactatactaatgaggatggctcaattttttatttgaacgtactataatgaatttaaactttcattggtatttatgttttaacaggttttcactatttcaaatatacttcaataaatatccttgtctgtgatcattggtttatgtgaattggaatttcagtagctgtatatacatggaagtacaattgctcatacatcatacactctttcagttatgttagataatactaaatcaaccatgggttctgtataccctactagatatttccaaattgttctcttagactcctgagaactggtaaattgagtgctatagcttcagtttaggtatg

SEQ ID NO: 103308 - DNA, 353 bp, Homo sapiens
ataaaacttggggccagcacttctttgtttctgtataaagatgaaaaaactaggctgcaacatacacatttgtaatacgttttccatcactgcacctggaatggtcttatactaatttgtctccatatttctcctcctctcttggtctctaacctcactgaaggtagagggtggatcttaaatatctttttactttattcccagtaaagggccagaacacttatgttgcatgaatgaagaaatgaaaggaatactaagaaaatggtctaaggagctacaatctcatctggaaaagtcaccacttcagtggtaaaagaataagatactttcgggtatctacccattatagttca

SEQ ID NO: 103309 - DNA, 369 bp, Homo sapiens
ggcctctatggctctgtcgttcccctattggctagggttagactgcacaggctaaactaattccagttggctaatttaaagagagtgatgggatgagtggtttggcgggaaaaatggttatggcagagcaggaaatcggaatgagtcagggtggagagggtaatcagaaaaggttgctttacgaggaagttaaatttaaaagtagaaggcaaagaattgaacatactgacatactgattcttcgaagagaaatttagaactcatatctaacaatcccctcctcttgcattttccttacacctctttctcttcaaacttctttaacatgccttggcttagttctgctcaattttccgaaagaagaagctt

SEQ ID NO: 103310 - DNA, 137 bp, Homo sapiens
gactctaaggatcccaacgctctggaataggggaggtacacaacccacttacaccacggctgttcatctcaagggcaagcaaaaccaaatcaaaggagggcagccagagtattatccttcagaaataatcaagtata

SEQ ID NO: 103311 - DNA, 765 bp, Homo sapiens
tgaaaggttgcctcatcgctggaaatatgtgtaatgttggagcaatgctagattataaaatttatcgttaattaataatgaaacacacaaagattgagcagttgttgtcatcagaaacatctaccaggaacttacagggggtcatgagatagctctacagcaaacaagaaagagaagaaatgcttcttgccctggcagaattataagtgggcacacttgctatgttatacaatattaggcatgcagtagaaaaaaacaaggaaccatacaaatcaccaggtgtctggtcacaaactctggcagagcttcacaccaagcaggcaagctacaagatttggaacaacacagcttatagatgaaagttaaaggcatttaatttacttgaaaacagaggaagaaaggaccaacacataaaagaacattcattttgagggatgagcaattcaattgagttcaagggtagagcaatggtgacttctcagccacctgctatcaatttgacatgtattaagcacacgactgggttaataaaagtgggagtttgggttaaaatgccctttgagaggccctgaaaaaatgtttgtctaagaaagttgaaactatggaagaaaaggtggtcaacttcagagacatagatgtaactcctgcaacgtgcttcaacatggtttagccaagcggaaactttttcttcctagtgtatgctctttaacgtatttaagatgtccttaacatctttcagaaatctacttttctaccaatattata

SEQ ID NO: 103312 - DNA, 1813 bp, Homo sapiens
aagaaaatgaatctgccacgccattgcttagaccctttaatgactcttgagtgttcttgggatgaggtccaaatttactaataaggcctgcgaagccctgtgtaattttgctcctagttatggctggcatctgcaccacaactacagccactgccacctccccctgccacacacacattttaaaagtaacaatagtagtgttttctgtgttttgcatatgcagtcttttctcatctcccagccttcttgagcttttcctctgcctgagatacgctcccactcacatagacattgggggcactaaataaaaatagctgtttaattgaattggaatcgttccacttggaacccaagtttggaaattttgctacttcttgttaagctaggccttttattcttgaagttgctatttctcatacaaactcattttatgcattagacacacagtcactattgttatggagaacatagttgtatcagaagaggtatagctttgggtgtggatgtgcgtgtgtcaggggaaagatattctgattatatgatgattttcataaaatatagtatgctgagtttccgaaaatcctaaatgacttagaaatggtgctatatgtggtttgtttgacccctgcaaatctcatgttgaaatttgatccccattgctggaggtgttttgagcatggagcggatccctcatgaatgtcttggcgttgtccttgcagtaatgagttcttgctctatttttcctcccctggaagctgattgtttaaaagagcctggtatcctccctccctttcttctttgcttcctctctcttgctgtgtgatctctgcacacaccagctcccctttgctttctgccatgagtggtctgaggctctcaccagaagccaagcagaggctggcaccatgcttctggtacagcctgcagaactgtaagccaaataaacttcttctttgttttttttttttgtttgttttgtttttttttcagtaaattacccagcctcaggtattccttaacaacacaaatgggctaagacacagggtcatagggatagcaggcacctgagccaagccagaacttagatctcaactgttaatgcaggatgatttgtattgaaccatgaattttacactgcctctcaatgttggtgtcagcatttaaggttatttaaaaaatacaacctgaaggttacataaagtttcatttaaaaaataagaccttataagtctacttttatttccagtggacagcaactacttaatcgtcttaaaactttcttcttacaatattactttacaatattacctgttggatttattatctgtgtacaaatcagttagttgaagggccaaagaataaaggcattttgtgaattatgaatagctattttgaaatggtcatggagactagctactctagaaaattgggagaatatactgtattaagttactatctggtataacttcaattaattgtgaaaattgtagcagagatctagatatagtttatgaacttctaaagagacattaaagggaattcaagtacttgtgtaaagatgaaccaaggtagagatgattgtgaattggtgatctgctgtatgttacagttatgtaatttgacttgtttcaaaattattaaagttttaagtgtatgcattctactggtcaataagtaaatatattcaggctctgaatgtagacagataaatatataaatatagaaagtacatttgttagaatacaaacaagaataaaaattgagtacagaatgaaaaccttattaaattttatcactccataaattatttgtc

SEQ ID NO: 103313 - DNA, 159 bp, Homo sapiens
tggaggtgtggggccagggtgggattagcaaatggctgagttcatccaccagaacaacacagagcttaggaaatctcattacagtgttcagtgttggcagaaatcttgagctattgcagttcctttgcactgtacaaatggagtggtaaatgtagtggt

SEQ ID NO: 103314 - DNA, 569 bp, Homo sapiens
agagatgaagggcaggacatctgttccaaatggagtgcacagaagtggtctctccggccaggcctgacatgagagaggacccatctcccttgctgtggcagggcaggcatgtatggttgtgtggtctgtgcatagtagcctagccagggaggcaagttccagtgcatcttgtttttttgagccatgtaccctgatgagagactgaaactgcccagaggaatgggtgtctcgtgattagctgaaagtctacatcaccacacagtccccgcacagtgcagccatttctcactggaggtatcatttttttctttttttttttttttttgagactgagcctcactctgtcacccaggctggagtgcagtggtgcaatctcagctcactgcaacttccgcctcccgagttcaagtgattctcctgcctcagtctcccaaatagctggaattacaggtatgcaccaccacacctggctaatttttgtatttttagtagagatggagtttcaccatgttagccaggctggtctcaaactcctgacctcaggtgatctgcccacctcagcctcccaa

SEQ ID NO: 103315 - DNA, 1411 bp, Homo sapiens
gccggaagcctgcacagaattcaagaattgaggtttgggaacttctgcctagatgtcagaggaagtatggaaacagctggctgtctaggcaaaagtttgctgcaagggtggaaccctcatggagaacgttagggcagtgaggaagggaaatatggggctgtagcccccataacagagtacccactgggtcactgcctagtggagctgtaagaagagggccaccatcctccagatcccagaatgtagtcccactgacagcttgcactgtggcctggaaaagctgcagacactcaatgccagcccacgaaagcagccaggaggggggctgtaccttacaaagccacaggagcagagctgcccaagaccatgggaacccacctctttcataagcgtgacctggatgtgagacatggagtcaaaggagatcatttgggagctttaagatttaatgattgcctcactggattttggacttacatggggcctatagcccctttgttttggccaatttctcccatttgaaatggaatcatttacctaatgcctgtacgcccattgtatcttggaagtaactaacttggttttgattttacaggctcataggtggaagggacttgccttgtctcagatgagactttggacttggacttttgagttaagactttgggggacagttggaagggcattattgtgttttgaaatgggaggacatgagattggggaggggccaggggcagaatgataatggtttggctgtttctccacccaaatctcatcttgaattgtaatccccataatccccatatatcgagggagggacatgttgggaggtgactggatcttaggggtggtttcccccagttgttctcatagtaatgagttctcacaagatctgatggttttataaggcagttttccctgctcttgctcgctctgtcttgcctgccgccctgtaagacgtgcctcttccccttctgccataatggtaagttccttgaggcctccccagccatgcagagccatgagtcaattaaacctcttttctttataaattacccagtctcgggtagtatctttacagcagtgagagaacagactaagacaatcagcttctatgttgttggcagttttaccatgagcatggattcctatattccttctgaaattttctttaaaagtgtaagcttatatagaaagtatattcgacactcacaacccttcccagccataaaagacagtggggtgtgagtgtgtgggatgggatgcagcaatggcagcccagtaacaacagcagtgcgtgccgggaacagctcagcagcagggcaggtcagggctaacccagttaactcaatgcaggctccctacaccaagtgatttggtttgcaaataaatattatttgtttctgtttta

SEQ ID NO: 103316 - DNA, 404 bp, Homo sapiens
tggcctctgtgagccccgggagtccgcagggagccaggctggtgattctacaccttcccgaggaggagtcccacctcccggttgagcagactgctcctgatcatcctctccagagagtgggtgtggggataacttcagccagtggctatgcttcagtcatttctgccaggtgtgacatgactgcctggcctggcgttttttcacatagcagcttgccttgcctccctccagcagctttggtccctattttagcggatgcctcttctgagagggaagtgcattggacctggaggtggaagatctacgcttagcacgggcctggctcctctctcattgactggccttacgccgaccacaaataattccccttacccagagtctttgagggtgaaatgaggcgatgg

SEQ ID NO: 103317 - DNA, 382 bp, Homo sapiens
gaaacactcttccgttcaccacggagtgaaaatcacgttctaaagacttagtaaagaatgccaatttaatttatttgaccctagggcgaaggacaggcaggaacaaaaaatcttgatttacaatgtagatttaatcatatgctgctgttgatcatcctttcgtagtcattgaaggtatattttccttcctcctttctcatctctgtctcttccatctccagcaccttagctttcagttaaacatttttatgattaactcagaaagtaatcttagccgtaaaccttcaagttcagatacaggctaagaaagagagaaatattctaaaatgaatccacctagcaccaggatgactatcaggactgtaattctggttcggttgtg

SEQ ID NO: 103318 - DNA, 130 bp, Homo sapiens
aactccacctcgcaacattctatggctctcacatgagagctgagggtctaagaacaaagaacattctctttccaaatgagcaagaacaggaaatcccacacggtgcccttgtcaactaagctgctgagag

SEQ ID NO: 103319 - DNA, 298 bp, Homo sapiens
cctctcagattcaagtgattctcctgcctcagcctcccaagtagctgggattacaggcgcccaccaccatgcccggctatttttttgtatttttagtagagacagggtttctccacgttggccaggctggttttgaactcctgacctcaactgatctgcctgcctcggcctcccaaaatggtaggattacaggtgtgagccactgtgcccagccaggcaaaggtttttaaagtcttgcaagatctacatgattcctaccctatctcctttccagcccttccccatactgatacaagtt

SEQ ID NO: 103320 - DNA, 469 bp, Homo sapiens
ctaaaaaacattggcagtcactaatgcttaggaagacacctaccctgcatctcactccatctttggctaccctcgccctgctcatttgactctcctcctgacccctcctcttgcttgcttatacccagccccatgaatagtagtgaaagactactcacagatactatgtgctttcttatacaccatgagaactgaaccttccctctacgcagttgcaccatcaatccccattacaacctctaatggctgctgcctttgctggatctctaggattttgggtgcaggacccctctttcactacaccctctcaccttttcactttacatttccagttatgcctgacacaagctctcttatttttctgtggttcttccacgtacacctgccaactggatgggcacatgtactctagtcttccttacccccaaaatccagtttgcaaatgggaacgaacaactgcctgtccccc

SEQ ID NO: 103321 - DNA, 483 bp, Homo sapiens
ccagtcttttactgtttaactgtgatgttaaagagtgatggtgttagctgtgagcttttactagatgtcctttatcagactaaagaggttcccttttattcttagtttattgaattttgtatcatgcaagagtgttgtattttgtcaaaatgctttttctactctgtcaaaataactgcttttttgtctgttaatatggtgtattgcactgatgttgaaccaccctggtgttcttagggtgagtcccacttggtcatggtatataatcctttttctatgttgttgggtttagcttgccggtattttctcgagttttgcatttatattcataagggatattgctccattgttttctcaagatgttcgtttggttttcgtgtctggctaatcctggccttatggactgagttaggaaagtcattttgaatgactattttgtaatcattcttcgaattactcctaaatatatcttcagattctaat

SEQ ID NO: 103322 - DNA, 292 bp, Homo sapiens
tcctgtatggtttctggtcttcttatcatactaaggaaggtcttccacactccaagataaaaagaacaaaaaaactgttttcttttagtatttttataatgttatatattaaatctctaatccactttaaatttgttttttagtatgatgtaaaacagagataacagcagacaaaaattacggtgactatccagctcatgacaggtctcccagtggctatctatggctgtgctactcgcctcctttcctggggaggctttcttttcacgttcatccttccccaaatccacac

SEQ ID NO: 103323 - DNA, 471 bp, Homo sapiens
tctatgaaatgcagatgatgataggaattctcataggttatttctttcattcaacaaatagttacagagccgttactcctccgggcgtttgagaacagagcacaagcttgacaaggtccctgcctccgtggagtgtgcaccacaaggtggagagccgagaataagcgagtaaacagctgtgtaaatacaaatagccctgatgtgggcggaaggaggacataacgttacccggaatggagattttcacggagcagggagcagttagggaaatgaagactgggaaggactgggttggtggcgtgtgaaagggcagtttttacgctctccaagggctgatgagcacacggggctgggggtaagagaggctctagcaatggcccccgcttcccaaccacagaacattggttttggaaaaccacctgcattaatgttggctttttcctatctggactttgcctattgtctgagttt

SEQ ID NO: 103324 - DNA, 683 bp, Homo sapiens
agagtaggagtgatagcttcttcaacactttggagcaggaaggaatggaagcaagatacagttggaagagggtgtagtgggtgacttgatgaatcgagttcatggtattatttttgacttggattctccttcattggcatgcttctgagttggcgtcattgcctctgccctgatccttcccttgagtggggctgttcaccagtgcagcggccagtgagctctttgggcggggtgtgtggcatacacagtgcgatgtctggaatcttacacgtgcttacttgaggcattcttactccaccggtcgagtgttctcaaagaaagatgatggagctgctaaaccttgcccattttgatctgttatgtgagacttgcctttcgccttctgtcatgattgtgaagtgtccccagccatgtggaactgtgagtccattaatcttttttccatttaaattaccctctctcaggtatgtttttgtcagcagttttaaaacagactaattttagaagcttggccctagttctttgtaggcctttcaatattaaaaatgtccaatattgaatattaaaagtattcagtatttctattaaactcttgagtcattggggttccaatcagggttgtcaatatgtactgcccctcttccttttggtaatggagtttcccttgtttcttttctttccct

SEQ ID NO: 103325 - DNA, 799 bp, Homo sapiens
cctggcatacaacttttaaaatttttagaatttgaaagtgatagtcttttcatatcctaatgagttcaactatgactggcatccataggtagtagcttcaggatggggttggtcagcagagaccaaagtaggatgacagggtcgcaaccctacttccaacctctcgggaagggagaggggctgaaggttagtttgatcatcagtgccaatgatttaatcaatcacgcctatgtaatgaggcttccataaaaacccaaatggactggctttggagagtttcaggatagctaatacctatcctgaagggtgttgttcctggagagggtatggaagctctaagccctttccctcataccttgccctatgcatcgcttcatctataacctttgtaacagcctttacaattaaccagtaagtgtcttgcccagagttctctgagctgcttagctaattaacaaaacccatggagtgagttgtgagccctagatccctacaagggtatagaacctgccaaaggaattcactttgtagactggtgaaaccacctttgcaaaaattataactgaggaaattatgacagtgaaagagatcagacctaattgactccatcttgtatctaacctttgggctgttcttgttcattgctgggtgtaggtcgaaataaccttgggaaggaattcagtttacggtttgactctgaaacaaaactggtaacagccctttctcggaaagacccccttcttgcttggggaccagtctgcctttgaaggactaacaaattagctacaagattagaaat

SEQ ID NO: 103326 - DNA, 270 bp, Homo sapiens
accttgccctatgcatcgcttcatctataacctttgtaacagcctttacaattaaccagtaagtgtcttgcccagagttctctgagctgcttagctaattaacaaaacccatggagtgagttgtgagaaaatcgatttatagcccatcagtcataatcacaaaacaacctgggaaacttttccctagatccctacaagggtatagaacctgccaaaggaattcactttgtagactggtgaaaccacctttgcaaaaattataactgagga

SEQ ID NO: 103327 - DNA, 1049 bp, Homo sapiens
cgcgctgcgccccctctgcgccggcctctgcggctgcgcgctggcggggctgaggccgaggggtgggggtcgcgccgggggccggcggagctcctgtggtggtagcagcggtagcgggagacggagcgagtccagcggccgcgggcagacccggagggaacggaggaagcggtcatgtctcgctacacgaggccccccaacacctccctgttcatcaggaacgtcgcggacgccaccaggcctgaggacttgcgccgtgagtttggtcgatatggccctatagtagacgtttacattccacttgacttctacactcgccgcccaagaggatttgcttatgttcaatttgaagatgttcgagatgctgaagatgctctttataacctcaatagaaagtgggtatgtggccgtcagattgaaatacagtttgcacaaggtgatcgcaaaacaccaggccaaatgaaatcaaaagaacgtcatccttgttctccaagtgatcacaggagatcaagaagccccagccaaagaagaactcgaagtagaagttcttcatggggaagaaataggaggcggtcagacagccttaaagagtctcgacacaggcgattttcttatagccagtctaaatctcgttccaaatcattaccaaggcggtctacctcagcaaggcagtcaagaactccaagaaggaattttggctctagaggacggtcaaggtccaagtccttacaaaagaggtccaagtcaataggaaaatcacagtcaagttcacctcaaaagcagactagctcaggaacaaaatcaagatcacatggaagacattctgactcaatagcaagatccccgtgtaaatctcccaaagggtataccaattctgaaactaaagtacaaacagcaaagcattctcattttcggtcacattccagatctcgaagttatcgtcataaaaacagttggtgaacagcaacagaaagagcaccacgccgtctttaatataagttattaaactctcattatgttaaataaaaattctttaaggcatacagaaa

SEQ ID NO: 103328 - DNA, 1294 bp, Homo sapiens
cgcgctgcgccccctctgcgccggcctctgcggctgcgcgctggcggggctgaggccgaggggtgggggtcgcgccgggggccggcggagctcctgtggtggtagcagcggtagcgggagacggagcgagtccagcggccgcgggcagacccggagggaacggaggaagcggtcatgtctcgctacacgaggccccccaacacctccctgttcatcaggaacgtcgcggacgccaccagaagatctaaagcagtccacagtagctggcaagcaccccccagtttgaaccaacctgttagctagaatccaagcataaacccagcaggcgagacaaaaggcacctaaagttcaagcatcaaggagtaaagagggagggtggacacagatataaagacctggaagaggggaagtctttatcaagcaaaagacaaagccaacaccaggttgagacttcggctttcctacatttactcagagttccagagtcaaagccaagtctgattttgttggttctgcgtctcttataaagtccatcttgcaagccttaaagagtaaaggtcaaggttcaagatcaagtgacattgagtcaatttgaagatgttcgagatgctgaagatgctctttataacctcaatagaaagtgggtatgtggccgtcagattgaaatacagtttgcacaaggtgatcgcaaaacaccaggccaaatgaaatcaaaagaacgtcatccttgttctccaagtgatcacaggagatcaagaagccccagccaaagaagaactcgaagtagaagttcttcatggggaagaaataggaggcggtcagacagccttaaagagtctcgacacaggcgattttcttatagccagtctaaatctcgttccaaatcattaccaaggcggtctacctcagcaaggcagtcaagaactccaagaaggaattttggctctagaggacggtcaaggtccaagtccttacaaaagaggtccaagtcaataggaaaatcacagtcaagttcacctcaaaagcagactagctcaggaacaaaatcaagatcacatggaagacattctgactcaatagcaagatccccgtgtaaatctcccaaagggtataccaattctgaaactaaagtacaaacagcaaagcattctcattttcggtcacattccagatctcgaagttatcgtcataaaaacagttggtgaacagcaacagaaagagcaccacgccgtctttaatataagttattaaactctcattatgttaaataaaaattctttaaggcatacagaaa

SEQ ID NO: 103329 - DNA, 940 bp, Homo sapiens
aaaaaacaattttagataatgctggtctagatgatgttctttcttttgaaggtttcaagtggatttctgtaggcaaaatattttaatccagctattcatatttctttgccttatttctaaaacacttcaggcctgaggacttgcgccgtgagtttggtcgatatggccctatagtagacgtttacattccacttgacttctacactcgccgcccaagaggatttgcttatgttcaatttgaagatgttcgagatgctgaagatgctctttataacctcaatagaaagtgggtatgtggccgtcagattgaaatacagtttgcacaaggtgatcgcaaaacaccaggccaaatgaaatcaaaagaacgtcatccttgttctccaagtgatcacaggagatcaagaagccccagccaaagaagaactcgaagtagaagttcttcatggggaagaaataggaggcggtcagacagccttaaagagtctcgacacaggcgattttcttatagccagtctaaatctcgttccaaatcattaccaaggcggtctacctcagcaaggcagtcaagaactccaagaaggaattttggctctagaggacggtcaaggtccaagtccttacaaaagaggtccaagtcaataggaaaatcacagtcaagttcacctcaaaagcagactagctcaggaacaaaatcaagatcacatggaagacattctgactcaatagcaagatccccgtgtaaatctcccaaagggtataccaattctgaaactaaagtacaaacagcaaagcattctcattttcggtcacattccagatctcgaagttatcgtcataaaaacagttggtgaacagcaacagaaagagcaccacgccgtctttaatataagttattaaactctcattatgttaaataaaaattctttaaggcatacagaaa

SEQ ID NO: 103330 - DNA, 411 bp, Homo sapiens
ttcagatttttgtacctcttaagagctgtataactcagaccaaatatgcagtgtatttttcagaactgatccctatatgtctagcaaagtaaaaatttttggccatatattctagtataacaaatattacaaacttgttacttatgtttgaaccaaaagcatgcataataaaatgagaaatttttttagcttatctagtaaaaatataactaatgttatgtaaagtatgtaagttcctgaaagtgttatttcctgatctcttattttgtgtgaaatatatgctctaacattatggatgtttgcaggtctcgacacaggcgattttcttatagccagtctaaatctcgttccaaatcattaccaaggcggtctacctcagcaaggcagtcaagaactccaagaaggaatttt

SEQ ID NO: 103331 - DNA, 183 bp, Homo sapiens
taagccatcccagagatgaaagttacatctactttttgcagtcttttcatttccagaaccctccacagttagaattgtgtatgctgacagtatgcagaatctactgaccttaacatatctctgaaagacgggtcagggtaagagagtgcagaaacaaaaggcaggacttatctttttattgag

SEQ ID NO: 103332 - DNA, 1091 bp, Homo sapiens
gtctggactagaagaagtccaggtacctttctgacagactctggggtgaacacaaatggccacaggaccaagccagtgacctgaatgagtcagtcattactcagctccagccaattgcttgggaatgtgggtccagcaaggccagatccttcttctgatttttcaagaaaagacagacttgtggatttttaaaaatatggactgtcctgagttttaaatatcatgcaggccaaataaagccatctgtgcctgcagggtcttgattgtgacctgccagtttgacccctctgttccaggattctcagggttatgtgcacttttgtccttcacaagtaagataaatgaaataggtagggattttcctcctattcaacagatgggcaagtcaggacaccgggaggttaagggacttctagatagacgcactcttataatataaggtaatgttataacagacaagggctagaatcagggtacgtgggtgaataggtagttatgtccctcggctgctccactgacatttcattttttagctcttctcttaaaataatatttgctgaagggagcactgggaaggccccatacttcctatatgactggagcacggaattctgcctcccaggggctctggggtgaggggtatcctccctgcaccgctccgggggttagggtgcccctgagttgtgccttactgagtctgcacatcctgcacagagctcctgcctggagccattctaaaactcagccgctcctattccccaaggatctgtgtctttaggcctccagccatgcctgaaatttcaccattataagcctgcttttgggtgaaggcttcacaggcacccaggaatcactttcacagtgaacacaggaaaaggaaaaaaaaccacaggaatgcaacctgacatctctctcaggctctaagtattggactgccaggacttgggtactgaagaaattagttttgccacgaaggcaacctcaaaaagccagtcatcttcaagccacatttacagcactccgcagtgcgacttgaggcctgtctgcctagcttcctgcttcttggccttcctgccactctttatgctgac

SEQ ID NO: 103333 - DNA, 353 bp, Homo sapiens
agaaggacctgagttgtggccaacaacaggctgcagaaaggcaatgccatcctgaagatttctcaactaagagtctgcacccatgacagcccaccgagaccctcgctccaagtttgtggagaaagggaacccgcttggcagcatgtggaaagaccccacgatgagcagcagacacagcaacgctgcctcctacatctcgacagcatctgtgtaagactcgctagcatctggtgcacacactgtatgagacagcaacagccagaacagacagctttacgttgatgaacacacagacggtggcgcatgttcagagatgccgaggggacgccgcagttcccaaaatcacctctgcc

SEQ ID NO: 103334 - DNA, 353 bp, Homo sapiens
gcctgccaaagtgctgggattacaggtgtttgccaccgtgtctggcccatgtctatgttttcaaaaggttaagtcaacagggaaggagctaggagggtgaggttgggccccctgttgctttctgcttagcagctctgtcctctaaaaatgaactctggtccacagttttgatatgaaccattcctggctataagcaaaatggtactagaaatagctttcacaccgaggcacaaaactgactcaggctagctagataagcctcttgttaatgtcacttgttaaagttggtgacactagccacaatgagtgtattgcaggaaatgttcattaagttcctgaccagcttctataat

SEQ ID NO: 103335 - DNA, 233 bp, Homo sapiens
tgagacagggtctcgctctgtcacgctggctggagcgcagtggcgagatctcagctcagtgcaacctctgcctcccaggttcaagtgatctgcctgcctcagcctcccaaagtgctgggattacaggcatgagtcataatcaatgtgatgaggttatttgaaaatggctcagcattaagtaaaatttaaaaatactacactagccgggcatggtagctcatgcctataatcct

SEQ ID NO: 103336 - DNA, 367 bp, Homo sapiens
aatcctcacaacaacctctatgaaattattattatggttaaggaaacaagcacagaaagagtaaaaattaattatttaagaccaattatttaattaagactagccaattcaataagtactaactgggtgtcatatgtacacatacacatatgtataaatatgtacacatgtacatatacagtcaaatatgtgatatgtatcactatacacagaaatatatacacacacagtgacatatataaatcactgtgctgggtactataaggcatagttctcacccttaaaacatgtctagtcctgtgcgggaatacctgcatctagatacctaagggcatgacatgatcaacttcataaaagatagtacagc

SEQ ID NO: 103337 - DNA, 337 bp, Homo sapiens
accctttctttttaaaccccctgagtaaatagcatttaagatgggcaaacttgatattatatagtgccatatgccccaagcagttaaatttgaattgttttttattattaaggaaatttagagctagaatgacctagttatttcagaaatagaatgatttagatttttgaggattttgatagcatctaagtatatacctataatattggcttaattttaatgaaagttgttaaataaacattttccttgaatgtggacactacttatgtttctagtgaattttattcacttaaacatttttttccaaaaattttaagtgttaatagatgcagaattc

SEQ ID NO: 103338 - DNA, 457 bp, Homo sapiens
gcacttcaccagcctgccagaggggtctatggcacagaaatgaggaagacccccagtcctaagtcagtgctttgtccaagttcccctttgatagcttgggaagtcctcactcagagggcagctggggccagcccatgttcaaacaggctctgacctccatgggcttggctctgtttggtggaaagagcttccagcaatcccaagttgtcacaggggaaggcaggtgttccataaaccgctacagagacagcaaagcactggctgagaggaatggtcctattcaggctccaggtaaagctgtggccggcctgagaggctttaatgcctctgggcaaactgatgattctggaaggtgcagggggcacatgctgaggcctccctgggatggagtgggctcttctactcaaggagaagacacctatcatcctcgatatgccctctctgggcactcagcagc

SEQ ID NO: 103339 - DNA, 762 bp, Homo sapiens
caaaactctctctcctcctcctttgtgaggcattaagagtttgttgctctgtagaaacataggccagaaggagatgaatgcaattgttctctggcaggaggagacaggggatctgaacattaattttattatttctctaatccaactcttccctttttcttaggaggttaatagacatctataagagaatattcatggacaagatttcctgctggatgcaattcaccttgacacttcttgctctcagcctgcactgactactgttttaacttctgttctagattgtatatactttgctcccattatcccaaattctgtggatgggggagcccttcactaggaaagagaacttgtacagtacaaagtgccttcaagaacactgacttttgtttttttaaacatccaactcttttaaaagataaagaaatatacaatctttctagtttcaccttatttccaaatagcacatttttcattccaaatttctggtcagtggctagtaaaaaattctaagagatcctctcccatcctctttaaatgtacaaggatgcatttatttttctcaacatcactttgttgagaatacattttacattgtttcttcattcttcttcttactgaggtagacattcacagctatatctgggacttcactatcatctctactcacctcgaagatgactgtgatacacttctctcaccaccaacagcatttgaatccttagtctctcactagctatgtgactcttaagtaacctcttt

SEQ ID NO: 103340 - DNA, 534 bp, Homo sapiens
aatggtgggcaggaatcattcatctttatatgctttgctaccaaatggtttctcatgcctaaaattacccccatcatgtccaacttgcttaccttccccaataagttcaccctaattatttgaaatggcataaatgatgctctcctctctaatcagaactggttggtaaatatctctatccaatccctcaacagttggtgtttcaggcagatagcaacaaaattaacatattgataaaccaaccagtgaaatccacctaattttgttgcttggaaggctgtgaagcattttaggaaacaagtgagagagcccaaaagctcatgatttaaatttttagtcattattacataagctataatgggatcaggtagacatcctagttttctctcctatatctgcagatgagaatttttcaaatgcaaaggtggccagatgtggtggctcatgcctataatcccagagttttgggaggctgaggagagcggattacctgaggtcgggagttcaagtccagcctgaccaacatagagaaac

SEQ ID NO: 103341 - DNA, 909 bp, Homo sapiens
ccattattattaaatatataattcttaaatattaagttaaataatattacatattattagatattactcagttatcataaatgccttttctgtgccaactagcgtgctagggatgaggaataaatgagaagatataatatgatgtgagaaaggttataataaaggtatgtacaaacagaatgcttgcaactgaaactgcagaaacttcatttacttggggctcaacaggtatgtgcacatgagattttgtaacaggtctgtccatttataaagagtcatcatgatagtgacttttgagtgataagcaatgacagcagacaattctagaatggaagctctatgtgggcaggaactttttaactatttgttcactgctgagctctcaacactgagaaccatgcttggcacatagaagtcactcagtaactccctgtcgaatgaaagaagccgcccgtccaggagtcagcaatctagcctgcccatctgtttacttataccctgtaagcaaagatagtttttacatttctaaatggttggggaaaaaatcaagggaggaataatatttcatgacatagtaaaattacataaaattcaaattcccttatctataaattttattggcacacatccacatcttttcatttgcattttgcctgcggctattttcttgttacaacatcagggttgagtagttgtaaaaggaacctcgtggcccacaaatccgaaaatagccagatagtaatggctggccatttacagaaagtttgctgatcactggactatgctgttgtcagagtggctatcatgagattatgttcaattcagttgttctctgccctcaccaattccgtcaccatggaatcccctactgctcctcatcccactggacccagaaacttctataccatc

SEQ ID NO: 103342 - DNA, 380 bp, Homo sapiens
gaggtgacaggctctttcaaacaaccagcccttgaatggcctaatagagagagctcactcattaccgtggggagcgtaccaagcccaaggggtccacccccgtgacccaaacacctcccaccaggccctacctccaacaccgggggtcacatttcaacatgtgatttggaagggactcatgtgcaaactctatcacccaggtaagggaaaaataatttggttcatgcagcaaagggcttgcttgaaaccacagatgtggaacaggaagtttctaaagctgtaagtatttaattctttactatgtggtggtactatcattatccccattttacagatgggaaaactcaggcaaagaacgttcaaatacattgcccaggatt

SEQ ID NO: 103343 - DNA, 221 bp, Homo sapiens
ccttacctcagtgcattaaaagtttagtatatgtttatcctatgagtcaagtttgtacctttttaaaattatactttgatactttttcataccacactccaccatctagctcctacaaaggatatggtacaataatgtgtcaacacgtgtagagaactgggctgaaatttttacatacaaatgcacttacatttggtaatctgtagataatgatttgccac

SEQ ID NO: 103344 - DNA, 1144 bp, Homo sapiens
gcctcccaaagtgccgggattacaagtgtgagccaccacgcctggccccatttctttgaacagatattagatattgctaaggaaaataggcatatttttgagaaataaatattttctcttaggccagctcttttagaattgctagactagtaatctgtcttctgtgcttttactagctattttatagagatgcttagaaaataccagtatttaaatacattttaggacaaattttggttttatgggtttatggtaaaaaattaagtatctttaacacttagtaaatgaagtagacatctgtttatgtttaactggtttgtcatttttgtaatgcaagccttcaaaaactttttgaggcctaagggaaattaatgtgttctttttcaatgaaatttgataatctagagcagtgatcagcaaactttttctggcagatactaaatattttaggccttttgggctttactgtctctggtgcaattactcaactctattgtagtgccaaagcatcgacagataatacgtaaaccagtatggataaggatggctgtgttccagtagacctttatttatacaaataagcagttggctgaatttagtctgcaggctatagtttgttgactcctggtgtagagcagtgatgtccaatagaactttctgcagtgatctgaaaatgtttagcatctgtgctgtccaatatgctagccacaagccacacgccacacataggtatcgattactggaatgtagttagtgtgattagaaactaattagtagctatcacattggactgtgtaggtttagagtctttggatgagtggcttagcaacaaataattctctgatccatcaagtgacctttcaataaaaatgtttaaatcagggtgtggataaataggaaaactgttatgtcttttttcaagttacaggagaaatattaaggctgaaatagcttgataaagcaaaccaatacttgaagaactatcaatttatgaatggaatcaaggatatttaactactttttcaaaaaagtattttatggccggatgaggtgggaggattgcttgagcccaggagtttgaggctatagtgagctatgatgatgccattgcacttcagcatgggcagcagaacgagactctctt

SEQ ID NO: 103345 - DNA, 333 bp, Homo sapiens
gtgacaggagatgaatccagaaaggacagaagtcaaaccagaaccaactttgccatctttctcactttgaaccctggggctgggtgtacagaacctgctgattaagatgaatcaaatagatgctaactctctctcagaattgtatcatgttgtgaccagcctgggcaacattgtgagaccccgtgtctacaaaaaattaaaaaataattagtcagacttggggatgcacacctatagtccctgctactcaggaggctgaggtaggaggatcgcttgagtccaggagttcaaggttgccgtgaactatgatgtgacagagcaacaccctgtctc

SEQ ID NO: 103346 - DNA, 370 bp, Homo sapiens
ctcaggagagttctgaaattcatccctgaaaccaggctctctgaggagccttccttatctgctgttcctgacacacatacaggccattttgttggctgtgattggctcctttctgtctgagctctgcaaaatggtcttgagcagtgattgctaattttccttgttttcctgcttccaagttccttctttggcacagaaatgaaagaacagagtagctgagtggtgcatgaaaaagaccaaagagaggaaatgagaagccagcagaaaagcagacaaaataaatctctccactgatagctgtagtgagaaaagtgtggttgttctatagtaattcaaagaacttggaaacttacgagaagttctcaagaaa

SEQ ID NO: 103347 - DNA, 239 bp, Homo sapiens
acctcccgggttcaagtgattctcgtgcctcagccttctgagtcgctgggactacaggtgcccgccaccacgcctggctaaatttttgtatttttagtagagacagggtttctccgtgttagccaggatggtctcaatctcctgaatatgtgatatgcctctctggggacctgtggaatgacattttgcatgtcagaccagcacagtgcttttattctagacttttctaaaccttcccc

SEQ ID NO: 103348 - DNA, 696 bp, Homo sapiens
acagttggtggtatttgaggagaaggtgaagattttggttggaagagggaccagcagacaaacttgttctcttgtgtataaaaagccataacacgccccacatccctcaagctaggaagaaacctgggctggatggtgacccactggagaagctgtgacatcctagcatggggaagagtaccaggatgcccactcctcttccccaggaaccaccaaggagcctggagcctggctttatctcagccctgagtccccctctcccggtgcgcacacccctaactttttttttttagatggaatcttgctctgtcgcccaggctggagtgcaacggcagctcactgtaacctccacctcccaggttcaagcgattctcctgcctcagcctcccgagtagctgggattacaggcgcgtgactccatgcctggctaatttttgtatttttagtagaggtagggtttcaccatgttgaccagggtggtctggaactcctgatctcaggtgatctgcctgcctccacctcccaaagtgctggaattacaggtgtgagctaccgcgcccggccaatctggggctcctagctttggtgcaccaactactcaaatccccaacttctctccaagaggaatttcaagaaacactgaccaatctggttacagaagctgaaggggccccaaccaggctgcaataaacctgc

SEQ ID NO: 103349 - DNA, 518 bp, Homo sapiens
ctggtttatgatctatcatctaattcgtgccccagtctcattatctggcaatgtcagggcattccttcaggatgagaaaaatgccatgtgacaaaaagatgcctagctcccctttaccatcacgtgaggtcctgcacacatggtggagtgggagagtggaaggggcacacccagtggtgccatttgtattctgcctcatctgcctactaacgatgtggtcttaacaagtggttgaatctctatgagccttagtttcattagctttttttttttttttttttttttgaaactgagtctcactctgttgcacaggctggggtgcagtggcacgatcccagctcactgcagcctccacctcctgggttcaagggattcttgtgcctcagcctcctgagtagctaggattacaggcatgtgccactacgtcctactaatttttacatttttagtagacacgaggttttgctgtgttaaccaggctagtcttgaactcctggcctcgttatccgcccacctca

SEQ ID NO: 103350 - DNA, 343 bp, Homo sapiens
tatcaaaatgctattatttcaagttgtatataaatatacaaatatttttaagacaatgaaaaagtttttttttgtcaaactgtttttgaaatcaggcatgcattttacacttgcaatcaattcagactagccacatttcaaatattttataaacaccatatttaacggctaccacattgaacagcacaagtctaggtactgtagggactccaatcctgggatttagtaactccagtaccccacaaggataaggactgagggagggaaatggagcagtactttaaaatatcatatagttcagaaccagtccttagtgatagactcaaatatttgacaaaatatc

SEQ ID NO: 103351 - DNA, 978 bp, Homo sapiens
aggtggtattccaactcgggactgcctcaacgcccggcgctgtctcctctgctactctgtttcggtgttttagcagaggcagatagtgagggcggcacagtgccacggatgccgctggactaagcgctaagcgggcttgggatgatgcgcacgcggggggtctgagccagccaaggggccgggcgccgtgggggcgctgcggctgctgcgggacgcaccaggcctagtcgcccgcaggctccgcccgaggagcagcccagccaccccagggcccggaggaccaaccgcttcgacccgcgcccgggcggcggcagtgttggccggcgaggcgaggagggccgggccgccacggtggggcgaaaagccctgaaagttcctctcagttccttccggtgcgcctcccgctcgcccttgcggaggccctgagggcggattcaaggccccgcgagaagccatctgaggcggcgacgactgttctcagccccacgggaacgccgcggacgcagcgtccctctcccggacaagaaaacagccattctagagtttgactgatattacaaaggatccagactttaatgaaatctatgatgaagacgtgaatgaagatccaacatatgatcccaacagccctgaagaaacagctgtatttatgaaatatgctgaaaatattatgctaaagttaacattcagtaccacacaaattcaacagtatgaaaatgtctttatatttgaaacaggctattggcttactaatgctataaaatataatcaggattatcttgatatctgtacctaccagagactacagcaaagattatatcttcaaaaaaagattattcaaaaacactttgagaagaaaaaagatatcagaagagggataggatacctaaagttaatatgttttctgattccatttctactgagtttaaagaagaaaatgaaagttccatatttaagtagtctgcttcagcctttttc

SEQ ID NO: 103352 - DNA, 887 bp, Homo sapiens
aggtggtattccaactcgggactgcctcaacgcccggcgctgtctcctctgctactctgtttcggtgttttagcagaggcagatagtgagggcggcacagtgccacggatgccgctggactaagcgctaagcgggcttgggatgatgcgcacgcggggggtctgagccagccaaggggccgggcgccgtgggggcgctgcggctgctgcgggacgcaccaggcctagtcgcccgcaggctccgcccgaggagcagcccagccaccccagggcccggaggaccaaccgcttcgacccgcgcccgggcggcggcagtgttggccggcgaggcgaggagggccgggccgccacggtggggcgaaaagccctgaaagttcctctcagttccttccggtgcgcctcccgctcgcccttgcggaggccctgagggcggattcaaggccccgcgagaagccatctgaggcggcgacgactgttctcagccccacgggaacgccgcggacgcagcgtccctctcccggacaagaaaacagccattctagagtttgactgatattacaaaggatccagactttaatgaaatctatgatgaagacgtgaatgaagatccaacatatgatcccaacagccctgaagaaacagctgtatttatgaaatatgctgaaaatattatgctaaagttaacattcagtaccacacaaattcaacaagactacagcaaagattatatcttcaaaaaaagattattcaaaaacactttgagaagaaaaaagatatcagaagagggataggatacctaaagttaatatgttttctgattccatttctactgagtttaaagaagaaaatgaaagttccatatttaagtagtctgcttcagcctttttc

SEQ ID NO: 103353 - DNA, 304 bp, Homo sapiens
cagttaagtcagaaggcatttgaaaagatgtataactttggatggctcttttctgattataggctgaagggggttcttttctctttggtttgccttttgcttttaatagcttgaccatttctggcttccactgcattgtaagagctaaactacaggtttgtcagtcagtgtttctctctctgtctctttctctctctccctgctcctaccccctcttctctccattctcctctctccatctctctcatttcctagttacaaatcatgttgtcttactgtcttaagagcatcactgatttcatcc

SEQ ID NO: 103354 - DNA, 512 bp, Homo sapiens
cacacttgaactttctgggatgctgtcaatgggtggtggttacacaggaaaaaacagcttcacacccaggatttgtgcagtttaccgtctgtaactgcagtgcctctagaagcctgaactggctcacctttaaattttttttttttttttaagaagtctcgctgtgatgcccaggcttgagtgcagtggtgtgatctcagctcactgcagcctctgcctcccaggttcaagggattctcctgcctcagcctcccaagtagctgggacgacaggcgtgtgcagcacagccggctaattttcgtatttttagtagaggtttcaccatgttggccaggctggtctcaaacacctgacctcaatgatatgccctcctcagcctccctaagtgctgggattacaggcctgagccactgcacctgacctcacctttcaatttcagataaggaactagaaggtgacacgtgaaatctgtaccggacttctaggatgctgttcattacaccacccacctc

SEQ ID NO: 103355 - DNA, 422 bp, Homo sapiens
gttccacaggctgtgcaggaggcatggctagggagacctcaggaactttcattcatggcagaaggggaaggggaagcaagcacatattcacatggtcagcaggagagagagagaagggggaagagctacacacttttaaacaaccagatctcatgagaattcactcgctgtcatgagaacagcaagggggaaatctgcttctgtgatccaatcacctcccatgaggccccacctccaacattcaggatcacaattcaacatgatatttgggtggggacacagagccaaactatatcagggatgttaatggtgtgaagtcactgagaactgggatgagatgagattcaaggcacttttggagggtgtagctagccataaagtagtgtgacagatatttctctgagattaaagggaaaaaaaaa

SEQ ID NO: 103356 - DNA, 348 bp, Homo sapiens
ctgagtgaaggttgtggtctattggggtttgttctgtgagcattaaatacgcatggaaaaaactgtagtgtccatttgaaccaggctctctggagcttagggctggaatgatatacagcctaaaaggtgagtagtaagggatggggaggatcttaaaagctgctaaagcaattgagttttaaggagcaatctgtaggttaacacacgctggggttattatgatcatattgaaaatttcaggttagagccaggtgtggtggcatgagcctgtggtcccagctactcagaaggctaaggcaggaagatcacttgatcccagaagttcaaggctggcctcagccccatagc

SEQ ID NO: 103357 - DNA, 1187 bp, Homo sapiens
ttccctggattttgccgttcctcacatgctttcgtttcattgttgaggtcagtctcctaggactatgaagctcctgtgttctttgtcagatgatttttggcagacaggtgagcctcctctgctgcccgggaagggaggagaaggcagtctcggaggaaccagctgaccatctcaggtgccgcttggggcagcgtccattctttgtgtcctattttgtatttttaaacccggacaatcttcggccgaaaaccccgagaacacacaggggagatgtagttcatcatctctctcttcccgtttgatctagtgtgttcatttaacaagagctgggttaatccttgttcattgccaactgtatgcgtgcacccacttttggagggattcaggaaatactcggtgcttcctgatgtgcatggaacacagtctcgacgtcttagcttggtgcttaattaaggtccttcaaaatctgtaccagggtcttttccaccttatctctcaattcttctagtttttgctgccttgaaactgaatgctcacccttctttgagaaacctgtccttttgcagatttccctctctgcactgcccttcccttctctgtacacaacagaccctctttgaaagcccagcttcatcattatcttttccacgaagctgtccctgcccctttgtggaaacagtcatacttctttggatttccacagcacttaccttttctttggttaagccccttccaacaataataaattagcagaaacttgtggagcacatacatctgttgcatgttgtgctagacattcactcattcatttattcaccaaacaagcaccgaccgtttgccagatactgtgcaaaattcgggggatagtgtggagaatatgacaaagttcctgctgtcaccaaacttttgctctagtggggcaaataagcagtgagcaaacagataagtttatgacatgctctcaggtgtgatcaccaaagccagggaggagcgatggcgggagtggggtggaccatatctatggtacagtcagttgccactttcagtagttcagaaattatttaccaagtttctgctcagcaccggggattgcgttaggtactttgttctgagttttatggtatttaggttcatgccttatcttctccattggacacaagcatattttactaataattaaaaaaaaa

SEQ ID NO: 103358 - DNA, 367 bp, Homo sapiens
  misc_feature (172)..(172): n is a, c, g, or t
  misc_feature (209)..(209): n is a, c, g, or t
  misc_feature (271)..(271): n is a, c, g, or t
  misc_feature (284)..(284): n is a, c, g, or t
  misc_feature (307)..(307): n is a, c, g, or t
tatttgattcatgtcatatagctagagaggtagttgtaaaggttgaatatcccttatctgaaatgcttgagaccagaagcgtttgggattttagaacttttcggattttggaatgtttatatttaccgatttagcacccctaacagaaattcaaaatccttaattgtaagangttaaataaaacggtcacaatgtttattaataattancattggctgggcgtggtggctcacgcttgtaatcccagcactttgggaggctgagatgagcngatcacgcggtcnggagatcgagaccacggtgaaancctgtctctactaaaaatacaaaaattagccgggcgtggtgggtgtttggggaacaggtg

SEQ ID NO: 103359 - DNA, 369 bp, Homo sapiens
ctaggggaggtgaatcatagggtgtgatgttgagatagtttgctcctttccactgagtgcttctctactaaggttgtcttctggctagtaaaggaggcattccaaaatggttcatgcttcaaaatgacatgttttctttccccagtaaaacagttcttttttttttttttttgaatggtcactttttttttgaacttttctgcttttcttattttttcagaagcagctattctcaaactttttggtgtcaagacccttttacctaaaaattatgaaggatcccaaaaacactttgtctaggtgaattatatctattgcacaagaagaataagttaggattttatggaaagtaactgtctctactgtttt

SEQ ID NO: 103360 - DNA, 505 bp, Homo sapiens
cacacacacacacacacacagccaaagtcctaaaaacaaaaacctctattaagggcctctgaatagttatctctgttccttcagttcctctgaagaattattttatactaggattctcaggttatctcctctcaatctctattgggatcactccactctgacttgtacactcattttcccactgatgtagctgttctcaagttagaagttaagttctcagtcttcattttatcagtcatctcagcagcattcattatggttcaggcactccctcctattttcttcgttagcttctatgacaccagtctcctcatttttctcctactctattagctgttccttcttagtgtctttttctgactccttcattttgaccagatttctaaatactgaagtatgtcaggactctcagctgtcttccatctgtagtaaataaactcactgggtgatcttacctagtttcatgaattttaagtaccatctcttcattgatgagtcccaaatt

SEQ ID NO: 103361 - DNA, 6881 bp, Homo sapiens
  misc_feature (1185)..(1185): n is a, c, g, or t
  misc_feature (1192)..(1192): n is a, c, g, or t
  misc_feature (1199)..(1199): n is a, c, g, or t
  misc_feature (1210)..(1210): n is a, c, g, or t
  misc_feature (1268)..(1268): n is a, c, g, or t
  misc_feature (2216)..(2216): n is a, c, g, or t
  misc_feature (2366)..(2366): n is a, c, g, or t
  misc_feature (3053)..(3053): n is a, c, g, or t
  misc_feature (5343)..(5343): n is a, c, g, or t
  misc_feature (5422)..(5422): n is a, c, g, or t
  misc_feature (6320)..(6320): n is a, c, g, or t
  misc_feature (6419)..(6419): n is a, c, g, or t
  misc_feature (6487)..(6487): n is a, c, g, or t
gctttattacagttatttatgctcaagagtaagaaatgatgttattgagtttccacgggaggatttgatattgcccagctcagtccacagtttcttgcactgacacacctcatgtttgggagtcctctgaagccaacagtgtttatccattgtaacaggatgatatgcagaatgtcagttcctcgctactacactaaccaccctttagggaccctttggttcatgttcttggtgttggcaacaggttgcattgagcatctactctttgttttgatgacttctatggcacacatatgtatatgcacacacacaacataattatcattttaatcacttgtaagtgtacaactcagtgacattaaatacattcacaatactttgtatccatcaccactatgtataccccaatgtttttcatccttcctaagatgaactctgtacccattaaacaatagctctgttttcccgtagcccttggtaacctctgttccatcctccatctctatgaatttgcctagcctagaaacctcatataagtgaaatctcatgtatttgtccttgtgtgtctggcttatttcactaagcataatgtttctaaggtacatgcatgctgtggcatgtatcaaaagtttattcctttttatggctgaatagtattcccttctgtgaccttttggtactcagcacatgacacagggtctggtgtgtggcaagtttcctcttggagccaaaagcagcatattataggacaaggacggaaagccatggcagcacacactgatgatcggatctgctgggagcgcaaacctctttgattcctgctgaaaggccctgatttctcacttacgaagcactttctagttgtttaagtgaattttcatatccactgtcacctaatgttagtcttcaataatcccataaaaagcaggcgttatccttattttacaggtaagggtcacataaagaaaatgactcccttgcctggtgtggtggctcacacctgtaatcccagcactttgggaggccaaggcgaacagatcacctgaggttgggagttcaagaccagcctgaccaacatggagaaaccctgtctctactaaaaatacaaaattagctgggcatggtgccgcatgcctgtaatcccagctactcaggaggctgaggcaggagaattgcttgaacccnggaggcnggggttncggtgagccangattgcaccattgcactccagcctgggtaacaagagcgaaactctgtcaaaaaaaaangaaagacttcctcaaactaattacattgttgttcttatcaacattaaccagaattgagtacagactgcactatgtgctgttactgtgtcgggctccatgcaaagcacttaacaagatttgttactttatccttataacaactctgtgtggtgtaggtgtaataattatcccattgtccagatgaggaaactgaggtaccaagaggttaaataacttgccatagctcgcagaggtggtaagtggggaatctaggattcacttctaagcttgaacgtggtatggttgtggtatggaaccaaggcaagactccagtctgcttacatctgactcagagatcctacaagaacatgccgactgtccctgtttaaccaaatgtcagtccaggcagcattgtctgtgtccctgattgtgcctttctctagtctgggaacactgccaggcagtgtatgtcactagatgtaaataaggccattatttgattttatgaaactctttttggaggttgagacttgtatattctgtgtgacactcccatttggatatcccaaaggcaccttaaattcaatatgtcaaaaaactgaagttatcatttctgcagtctctcctttttgccctgaaaaagaacatgcacttgtttttcatatttccttatctcttggaaagacatcttgaccactcaagaatgtaagctggaaacctcagggtcacctttcttctctgtcactacccctggcttaggtcacccttacagatgtgcctcttaaatatttttcaatcgtgtctctccctattccttcctaccagtgcagccccagactgttgtgtttcatagacagctgccgcagtgccctccagactgccaccatgcctttggctgtgccctcccaccatcctccacactgctgcctggctcatctgtataaggatgattctgtaggcattgtcctncttaaaaccatgtggtgattccaggcttgagtctgaactcagagcaaggcacatggcattctgcctggcacctgaggccacagcagcatattataggtccgctgtgccttgtgccctgagtatgtcctgttgaggccacttctattcctnctcttccttctacctgggaagcactcccttcccattgcggctgaagcctgtctcttcaaacctcagcccaacttctgcttatcttccagagcctatttgagctttcatcccttctagaagctttccctgatgttggcagagtagttttctcttcttttgtgttaccattacactctagagagacctttgtttctgcatgcatcacagtgtatttgtctttttgaaggcagggactctgacactcatcttgacagcaaaggggtgaattactcaactgtcaattcttttgtaaaatggacaatgtcaaccctgttagaagtaaatgcaataatgggtgtcacgtccttagcaccgtgcctggcccatagtatatacccagtggacacctgtacctcctctccacatccctgttgcatggtgactgggcccagaaggcagctagaattggcaactcaagcccttttggtcaggatcctttgctgggtggaagctcctcgcctactaatgcgggtgccctgtggctgaatctggtgaatccatcaggtccaggttgaaaactactgagcagagccctgctgcctctgggtattctgttcaccacccagcccttttgcatttaatgaatgtaaaaaataatggggcagctgctgttccttactctctcttcctgctgcactaagtctctgnctccctggagaggcatttaaccgcacgaaggtttatggtggaaatgacaaattgcttcttcacaacgagctcaccctgctttctaaccagttggaatcacccttgttcatgtaatattagcaatttacctgtctccttaaccactaaccatcctgagaggatttggcattctttgcagctgttaatcctctcatcacctgagggcttattaaataggtggagtgtacatctagcctttctcctacagtgaacagtcattcatgatcttttcctttttactcagcctctctcctcagctgcctgagcccaggataaggcagggtcctcccctctagaggccacagcggagagagctgggctctggaccggggagtccccggtttgactccttgcttggtcaggacttcctcaacataatcgcctggccctggtgccagggtggttgtggggctgagggaggtgcctgtgcagcccatttccctgtggaggtcagttgcccctttcctttcccttcatcaggctcaggccatccttggggcagccctgctatctgagggggtctctcccgagccgctaagacatagtcctcattcatattgggtgttgttgacaatcatcccatcctctgctgcttcattttgtgacttgtggacccaagtgggtctttgtttatcctgatccaggagagctgggaagggagacagtttgaattgctccgggcatatgttacttgttaatattttaaaatttgacttgttgcagtttttcagaggtattaatctaaaagccatttcatggaaaaaagcaacaaggaactggttttatttcttttaggtgacactaataaccaaacatgagacacatcagaatttaagtggctagtcaaaaaaaaaaaaaaaaataccagtgaaaatagcaagtctacattgatgttagttgttatataacaggcgctgttctaagcgttttgcctgtagcaactcactgaatcctcataattactttatgaagaggagattcagtaacctggtcacataggcaatgaatggccaggattcgggctctaaaactgggtctcctgaccacgacgatccctctctagggctgatggagatcatcactaaatcacctcctttgggattctctgctcgttggaaatggagtgttacctgcagagtactgctgtgacctctcctttaggcctctctgtgcagagactgcagtagtctgtgttagtgctgtcctgttgaagctggtccacacttttctggacttctggttgagccagtctgctcagatacgaacttccaaacgaacctgtttctctttggtcctcagccaggctttgtgacatcagctgctacagctgtggaaacagttgataaacagggtcaggctgctcagagggagaatgtggcagtagggtccctggcaagggttgcctgctcacttggaagggcaaaggcctagaaatccacgcgcaattgatgcacaagctgtcattgtgctgaggcttgtgggcaggggggtgtgtttctctttccttctccccttttcttcctctctttcccttgctctctttctttcttcctccttcccttcctctttccttcctccctttctttctcctttgaaaaactaagatgaggtcctggtaaagatagtacatagaagagaggcttcaagcctcaaaaagttatttcgataatatagtaagtcactgctccttattaaataagaggcctaaggggctgaggtggtgagggattgaagtgaagtctggcttggttcaggcctgaatacccaaaccaggccagctttgggttgggttggctctgcctggcatgaggagacatccaaggattccgtctccctcagagagccatgctgggaaatcttctaagcattggactttgaggttaaaataaagagtcttgcacccttggcggggatttctgaaagattgatgggattctaactgcctaacagttccatttccagatgagcgccctccgtgcatgggctttgtagcagctctctgcctttccttgccaaatgaccctatttgatctggagccctggcttgacttttctcttcagcatctgctgttttctgaccaatcccacaccttcccctggttttctcttttacagaaatcctttcttccaacttgattagatttctttgttggcttgcacatctggtcttcatttagtagggatgacacttaattgaagtaagagtttggctgcctttaaatttaacaactgcaccctgctgggggtgctnatgaggagtcagtagctgaattgtttattgaaagagatcatattgatttgtgattttcacttaagaaatgcattcccanacacccctgcatttagttgcttagctgggcactcagacagctgctttaagaatccagtacccttgtctctggagaggcgtttctcctcagtgtgcatgcagtactactgtatgcacgtggcatgtgtccatctgtcctcacagaggagactgtgcattggtagagctggagggctcctgttgtccacccagcatgccactttgaaccagctcctaaagcatgaggtccatcatgtctctattcaaaaactttcagtggctcctcattgcctgtgaatgaaatatggaatctcagcgggcggtcaggggcctcccagtctggcttcactgtgcctgtccaactcatttcctatgattgccatgcagaaacccagttctctggccacaccgaatttcttacaatcttcccattcacttggccattctgcctttatgtttttcactttctctggaatttcctccctccctttcctgcctgtatggtctcagttcttcaaagcccatttcaaatgaaaacctttgctacgaaatcttccctgattcctctcacctatagtgcacccctttgaactcagacaccctctctgtatttctcttcaggtattttagctcactttatgttataattgtttttatgattgttgtttattcttattcaacagagtcactacctgagagcagtgaccttgtgttggtcacatgtgtcccctgaaggatacagctcagtgcttggggtagtaataattgatattcttgagtgctcactacatgccagttctattctaagcactatacatgtattcatcttggttgatcctcacaaaagcccttggagggaggtactgttattagccccattttacagataaggtaactgagatctaggctgagtaacttgnctaaggctacccaggtagcaagcagcagagctgggggtccacctgggccttctgaatccaggctctcaactagtaagccacatggcttctttcattagntacttgctcaatacatatctatcaagaaaagttgtactgaagttaagagatataggggagcaggaatnggttagtttaaaaacaaggagagggaagaagagaaggaaattagaatgggccagtaggaaaagaaaagaaaggagaagtgctaagaaaccaaggaacaggccaggcgcggtggctcacgcctgtaatcccagcaccttgggaggctgaggcatgtaaatcacttgaggtcagaagttcgagacagcctgaccaacatggagaaaccctgtctcgactaaaaatacaaaaactaaaaatacaaaaattagccggatatggtggtgtgcacctgtagtcccacactcaagaggctgaggcaggagaatcgcttgaaccagggaggcggaggttgcagtgagctgagattgtgccattgcactctaacctgggcaacaaagagtgaaactccatctc

SEQ ID NO: 103362 - DNA, 1002 bp, Homo sapiens
tctatttatttttcacatagagtgaaatggatgagaatcaaatccagatggctggagatgatgtggatttacctgaagatctccggaaaatggtagatgaagatcaagaagaggaagaagataaagattctattcttgggcagatacagaatctccagaacatggacttggataccataaaagaaaaagcccaggccaccttcactgaaatcaagcagacagcggagcagaagtgttccgtgatgtgaggggtgggaggggtggagggagggaaccagccatccttggaaaagaccactctcttgtgggacgtttcaagcagtacatgttttaatgtagtgaacacagttaggaaaaccacgatgatccattgacagacaataatttggttgttctaaatattcctggcagagcatttagctaacaccttgcagcgggaaccttactttccttttagttataaatgagataaactggaaaatttcagttgtaaatgatgatgcagaacacatatctgcttaaagaccttgagatgagccaggaagaaacaaaagcaaggggcatttcctctccaactttcttccttggaggccaagttctcaccctgtccaactattcgcaggacaccaggtcccttcagagagaaatgtggagagtcaaggtgtctactgggagccgggtttcccacagggagctgagtctacagactccagggcaatcaaaggtcaccacccccacccctcacctctaggatccttgaatttgtcaatgatactcatcaagtatgcttggatcctttggtccttggatgcttctcagccaagtggcggtagcacagatgtggtgaacaatgacgaattgaggcagggaatagacctcactagccctttgcaatggagatcatcgttctagtggccatgtgaagaatggaaccaagggaggcacaattagaggcagagggaaaccaggcagacggctgctctttttgagttgagcttaact

SEQ ID NO: 103363 - DNA, 298 bp, Homo sapiens
ctaattatcaaatactgacttatagaatacctattcttgaaataatggagacaacacacaaaaaagcaggaaacagaaacacacgcacccagacacccatccaagaacaacacgagaattcatttcaacccagagcaacctgacacagctgtgcccttggagaaaagacccagagtcgttaccggaaggaggagggcagggaagaggaacaggctgtgatttcacatttaaaagttgcaatgctgagcccacatgttcctaaagatggggatgtagtcggtggaggctgcccctcccc

SEQ ID NO: 103364 - DNA, 446 bp, Homo sapiens
gagccaaataaacccctttcctatataaattacccaacctcaggtatttcttgacagcaacaaaaaatggattaagaccactactttttatgattcacattttatttattgtccatgtattcccattagaatgaaagcttcgtgagggcagttattttgttactgtcttctccactacaaaatttttagccctaagatgagtttttgacatactgtgaaccttcaacaaatatttgttgaatggatgaacaaatgactaagttataactaactgccagactatatgcatttatctataacaggcagaagcagacaagctttttgggcagggttcacattcatacacatgttttaggaggtttgctatgctatcggtgtccacgttggattagaagaatgagaaagtagaggcttgaagattagttaggctgaacaacaaaaggcaa

SEQ ID NO: 103365 - DNA, 431 bp, Homo sapiens
aacctctgcctcctgggttcaagcgattctccttgcctcagcctcccgagtagctgggtctaccagtgcccaccaccatgcctggttaattttttgtatttttagtagagacgggtttcaccgtgttagccaggatggtctcgatctcctgacctcgtgatcctcccacctcggcctcccaaagtgctgggattacaggtgtgagctactgtgtctgacctactccttttttttgaagtgaatttctgtgaagctccttccagcatatcatttacgggtagttcagagttacatactcagtctcaaagttgaagtgaccaacaaggagaagtcagtccagcaggtaagaatcacagttgactttacctggatcaccagccacttccccagctggatgttgggaaaacacattcatttagatgcgtgaaaac

SEQ ID NO: 103366 - DNA, 161 bp, Homo sapiens
aattctttgtaatacctgtgtttctattcccctacctcccagtgttggtctgtaccagttaatgccaagatgcccactctccaggtctactatggtctcttcaagtccactgattctagggactcaagccttctccaggggtgaagctctgaggttctatg

SEQ ID NO: 103367 - DNA, 243 bp, Homo sapiens
gcaaaccacaatgtactattataaatctcaggcgttattactactgctgctgttggccttcaaaataagcattgctgtcaattagcatttaaaccttgcatattcaacagaactcacattcagttgtgcctttcgttatttattctccagtaggtattattaaggccaataaacgaaacttcttactaccaaaatgttcaaaataatcatatctgtagattaaatccttccccagagttcatg

SEQ ID NO: 103368 - DNA, 110 bp, Homo sapiens
aggatcatgatctctttcttcggtggaatgaggtatacaaaggcctgaacttcccataagccacaccaaaactcccataactccaactcttccatagagctccacctaag

SEQ ID NO: 103369 - DNA, 629 bp, Homo sapiens
tggcaacgacctcaacgtggatagatctcaaagacacgccccttgggaggcccaggcaggaggactgttttgggccaggagctcaagaccagccggggcaacatcatgaacatcgtgagatcccgtctcaaaagataaaaaaagaaaaagaaaaaaaaaaaaaaaaaaaaaaaaaaaagaaaaaaaaaaaaaaaaaaaaaaaaaaaaaaagaggggcggcggcggcgcagcagaagcaagatctccccccggagcggcgcggccacggtctgaaggaccacgcacacgtgatttaggtggcagagggggcggcgcgccccccataagagggagggtcggtatataagcgcggggccgggcgggcgcgcgtttattcataaaacacggttgaggttagtgggaggagaaaccaagggtagctcattgggggaactttcacttggaagcaaaaaaacacctcaatacttgaggggggggggggcgagaaacatagtgtgggtgcacaaacatccatctcctaagagagtatttatacagccctgtggggggaagtataatctaacatgaagcggaggctgaatcataggggttcaaccaaaagaggttatttgtgcggagaaaaaatttgt

SEQ ID NO: 103370 - DNA, 305 bp, Homo sapiens
cacacattgaaggcatttaataaccatttaataaatgattagtcaatatttattggttttgttcataagcactattctaaactctgaggatatagcagtgaaaagacattgtttctatccggaggtgcttcctctctagtggtgaaaagcacacaatacaaggaaatacaagttaaaaaatattagtgatataaagttctacagttgaatgtcccctcgaaaactcatgctgaggcccagtgcagtggcttacacctgtaatcccagcactttgagaggccaaggtgggtggatcacttgagctc

SEQ ID NO: 103371 - DNA, 393 bp, Homo sapiens
tccttctttagagccccttagttcctggaagccttgaatgagtagtgaaactgggtgaaaatgtaaactatgatgcctctatgagacaacacagattgaaaaacaatcaataggctggtctgagtacagtggtgtttacagctaaatgatcacaaccacttacatatttctttgttccttctttactcccactgcttcacttgactagccttaaaaaagaaaaaagaggccaggcgtgatggctcacacctgttataatcccagcactttgggaggctgacatgggcggatcacctgaggtaggagtttgagaccagcctggccaacatggtgaaaccccatctctactaaaaatacaaaaatgagccagacacggtggcacatgcctgtaat

SEQ ID NO: 103372 - DNA, 458 bp, Homo sapiens
tggcctacgtctggatgctgggttcacacaagaaccacctctcccgcagtcccaaggacttgtcatttcatgttcttattttagacctgtcttgtaaataaagctgcttcccaatccttattttttatagcaattatcatattatgaaatatgttattgtggttcatagaatcttaaaatataattgattataaaatatatcttcatttcagagatgttaaaatccattttgaacatctcagttgatgcagaaaaagcgtttgacaaaattcatgttaaaatcacttaacaaaataggaatataaggaaatgttctcaacatgatagaggccatatatgaaaacccataactaacatcatattcatacatgaaagacttaaactttcccctaagatcaaaaacaagacaagaatgccaacttttaccacttctattcaacatagtactaaagttctag

SEQ ID NO: 103373 - DNA, 911 bp, Homo sapiens
aaatgccagcacagggaggatctcagagagtgtgtgctgaggagtgggttctggaggaagccatctgaggagtcacctgtaggtccttggggccagcacctgactacagctgatgctctgaaattaatctctaacgagcagtgcttttcaagctttactgtgcctatggggtccctggggagcttgttgaaatgcacattctctttcagaaaatctagagtggggcctgattctgattttctacttagtgccccaacaatgcccaggcagggatcaccctctgaagagtaatagcattctaaacaggcttctttgccatgggccagtgaagggggtactatgaaggggagagaaagagtagaccagtgtatctgaagagtttctggatccttgtaggtagcccacaggaaaaatagacaaggaaaaagcagttctatgcaggactaaaatacggttcactgaagtattccaccctgggagtaatgtcctctcaagtgtgttttttttttttgaaaaagtaaagagataataacaaaaacaagagttgagtaggaaggacgtattgaaaaatggaggaatctgataacaagtagtatgaagtcagatttgtaagagtctgagaagaaataagtagagaaaacagaaaatggtgtgaggtttacagtgttaaccacaaagtgaaagcaggcaagaacgtggtgggtacctggctgggtaaaggtcactggcaaagctttggtgtccatagtgactcaaaacaaacaaacaaacaaacaaaaaacaaacaaaaaaacaggtacgataatctaccttaggctaaaaaaaaaaggccaaatttcagcctgaaagggcccacagtatgcccaataaagagaaaatgctgacatctattaatacatctactatggtga

SEQ ID NO: 103374 - DNA, 240 bp, Homo sapiens
attcgcgggcgcgtcgacaactcttgtttttgttattatctctttactttttcaaaaacaagagttgagtaggaaggacgtattgaaaaatggaggaatctgataacaagtagtatgaagtcagatttgtaagagtctgagaagaaataagtagagaaaacagaaaatggtgtgaggtttacagtgttaaccacaaagtgaaagcaggcagtcgacgcggccgcgaatttagtagtagta

SEQ ID NO: 103375 - DNA, 473 bp, Homo sapiens
gcgacaagagcaaaactccgtctcaaaatacatacatacatacatacatacctgcatgaatgtcaagtaattgagactgattcagacatccctgttttaaactagaattgtaaactctcagttgacagcttcttagtaaacacatgcacaacaagtatatttagtgtctaaacgttttcctgagatattacagttatcataaatttaaggcttggccgagtgtggtggctcatgtttgtaatcccagcactttgggaggccaaggagggtggatcacctgaagtcaggagttcaagaccagcctggccaacgtggtgaaaccccatctctgctaaaaatataaaattagccaggtgtggtggcatgtgcctgtagtcccagttactcgggaggctgagacagaagaattgcttgaacccagggagcggaggttgcagtgccaagatcgtgccactgcactccagcctgggcaa

SEQ ID NO: 103376 - DNA, 342 bp, Homo sapiens
gcaaaaccctgtctctactaaaaatacaaaaattagccgggtgtggtggcatgtgcctgtagtacctgctacttgggaggctgaggtaggagaatcactggaaaccaggaggtggaggttgcacttagccgagatcatgccactgtactccagcctgggcaacagagtgagactctgtctcaaaaaaaaaagtttacacaatttattttccgaccacaacaaaattaagttagaaatcagtaacaaggatatccggaaaacctccaaatgtttgaaaatagaacagaatgcttctaagtaatgcataggtcaaagaaaaagtgacagtggaaataagaaaat

SEQ ID NO: 103377 - DNA, 315 bp, Homo sapiens
ctcatccctcctaccacccacacagtttaaatgggtctggtttggcaagaaaattcttcgcactgccatgttttaggtgacaaaagtatacatttttaaggctaaagtttcccctcaagttacataagaggccagaaatgaaacataagaaccagcgttctttatcatttttcacatcatggtcccctttgagtctcttaaatgctatgcatcctctcctccaaaaaagtacacatatgcacagacacacaaaatattacatacaacttcagaggattcacagacctcccctttactctacttgggttgagggaa

SEQ ID NO: 103378 - DNA, 763 bp, Homo sapiens
cactctgtgccctcagggtctctgcttggagagtccatggcatctgagaggatgggccaggtgaggtgggggtggctcctgagagcagggaggacaagggcggagctggaggcgtcaggcccagaagacccccccagtgacttggggcagctgtgggcaaggcttggacccaagaggcctgaccaccccgcctggcagcacaccagagcacaggccagacctgaaggggcagcgccagggggcccatggtccacgggtcactctgctggccctgcggccacactgctcaggtcccagggcctgatgatggctgagccagacatcataacaccaagcaatggagaagttagaatattgctagggatactgacttgtatttttgaatcttaaaatatatgttttaatctgacatctataagcagtgcatgttacatgccagtcagagcatgagcatccccaagaggtgtgcactctgtgtatctatggataatgaaagcacggctttcacacagcaagttatcctcacttcctgtgatcaactctgatatcttctactttattcgaaagagtatcgattgtgtcccactcgactgattttacaccctctatgtacatggtccccagtttatgggcagggcggttattttgtgttttattttgtctttgagacggagtcttgctctgtcgcccagtctggagtgccagtggcgcgatctcggctcactgcaacctccgcctcccgggttccagcgattctcccgag

SEQ ID NO: 103379 - DNA, 286 bp, Homo sapiens
ctagatagcaccatctgaggaatgggccttcaccagtcactgaacctgctggcaccttgatcttgaacttcccagcctccaaaactgtgagaaataaatttctgttgtttataaattatccactctcaggtattttgttatagcagcacaaatggactaagacaacattaaagaaaaacagaataaatatagaaatataccatgttcatggattggaaggccatatattatagatatatcaatcctcccctagattatctacagattcaatgcagttcaattaaaa

SEQ ID NO: 103380 - DNA, 546 bp, Homo sapiens
gagtactttctggaggcggttgtctctgagctggccctgaaggatggagatggtagtggtagtgctgcaatgcaccatcagagggataagggcagtcatagtggatctggcacgtgggtgtttaggtaacaatcactttttggaattgactgactggacgacagagcttgtgaagagtagtttgagaaaacggaattcttgaaaattatactataaataatggaggaaccatgagagccatatgtaagaatattctgcccaggtgtggtggttcacacctgtcatcccagtgcttttggagtctgaagcaggaggatcacttacagccaggattctagaccagactaggcaagcctcctctctacaaaaaaattttaaaaataataaaattcagctgggcattgtggcacgtgcctgtagtcccagcgactcagggggtgaggcaggaggataccctgagcccggaggtggaggatacagtgagttatgatcctgccattgcactccagcctgggcaataaagcgagattctgtctcaaaaaaaaa

SEQ ID NO: 103381 - DNA, 364 bp, Homo sapiens
caggccagagtgagtgcagattacatcactacactgcagcctgggtgacagagtgagaaggtgtctcatgttctaaaaactaaaaaaacaaacaaacaaaaaaaaacccccacaaagttagagattgctttctcttacattaccactctcaactcaaagcttttagcaatttttatgtgaggcaagactaaataaactgataagtgtacaattattcttgtgggtaatttttctttctgcattttggtgttgtaaactgtgtacattagatggcaatactatagtgtgagagagagaattagcgatctagtacttgttttcatgagctgtatcaccagagggcaccaaaggaccagttatgagc

SEQ ID NO: 103382 - DNA, 624 bp, Homo sapiens
ctttccagggtttcccggggtttctgaattgttccggcctcctgtctatgggtgccccgctgatttgccccccttttgtcacactaatccttggtgcggggtagccatctgtgtggccaggggccctgttctctatccccttttcttccccccccgctagcataagaggcccccgcgggttttcttttttttttttttttttttgagatgggagtctcgctctgtcacccaggctcgggtgcagtggcgtgatccagcctgggcaacaagagcgaaactctgtttaaaaaaaaaaagtgtagccaaaacataaacaaaaaaatctgtccaagagtcagaagtgatttgttttatactattcatatgggaaaaacacgtttattctgatagccaggaatatggacatggtgactcaccagaccaaactgtaattcaatttattaagatttagccaggcactgtggcccatacttgtaatcccaacgtgttaggaggccgaggcaggaggacctcttgaggccaggagtttgaggctgcatgatcctccattctcagtttcctgagtagctagggctacaaatgcatgccatcatgcctggctaatgtttttatttttaattattt

SEQ ID NO: 103383 - DNA, 663 bp, Homo sapiens
ggcagtgctccggaggccgtccctggcagggcagggcagagctgggtagggcagccaggctgcagaagctcacaggaggggcttgatgccatcccccaggcagctggtacctctgcgtgtccttggaggagcctccaggtctctgggtttgtggtggggctgacccggtgcccccacctcagagtcctgaggacttgatctcatgggccggctctgctcacatcacagggcagtcagcctgagaaggtagcttcttactcaggcttgtcagtggtgatgaggctgtcactgtgggtggtggctgggccagggccagctggggagagagagagggagggagagagggaaggagaaggcggcacgaagccaggagctggggctggatagtctgtggccataactgccccggggaccgcagggccaagcaagggggctgggctctggaagccaggaggaaggccaggataggggctggtactcagtccacatctcaaagccggtgggagggttctccacacgctctcgggcacggtcaacctctgtctctcgtattagagtctcgactgtattttctctcttaaatattaatcactgccttaacgtgcttgggggagcagctaaatcataattctaggaccagctttgggtcgagggcttgaggtg

SEQ ID NO: 103384 - DNA, 181 bp, Homo sapiens
cggagctggcactcagaagccgttagcgccaccgggctccttgcagctcagggagccctgcctggctaggctgtcctggctgtgtgctctgcactcaggtgattggagagtctcattctcactcaggtgtgagatttcgtagcacaagtctcaggggagcaggttgcagcctgtttcttaa

SEQ ID NO: 103385 - DNA, 650 bp, Homo sapiens
atcacacatcaatccttcatactgatttttagtggtgatttcagagaatgttctatcataacagactcttttattgcaagtgagccctgacatacttgggttgaaataaactaacattctctttttgactcatttgttggtatgatgcaactgacattcaacttgactagaaaaacatgtaggaaatacaggaaaaatgagagttttacagctgatcaagtagtttatagcagaactttacttaacggaaaattatggccctactgatggcccccaaattgctctctcagtagagccctaaaaattgccaatcttttcttttattgccagctgactccttatttcactcttcagcccagcatctcttcaaatctctttctactcttcattagcagccaactccacaccagactgcactccttaattttagccattctgataggtttgtaatagtaactgtaattatttgctaggactgttataacacagtattatagactaggtgatttaaacaatggaaatttgttttttcacagttacagaggctgaaagttcaagattaaggtgttgggaggttgtttcttctgaggccccattcctcggctaacagatggctgctttccctctggctcttcacaaagttgcccccc

SEQ ID NO: 103386 - DNA, 175 bp, Homo sapiens
aaaaaactaaataaataaaaaattaaaacccatcctgaagacatttcatgtcaccacttttcacagtcaccacttttcacagcctttccttggtagtcctcctggccacactgcgccctgtcaccttcctgccttcagccctctgctgtctgaccctcacccacaccagcttctc

SEQ ID NO: 103387 - DNA, 384 bp, Homo sapiens
cttaaatcttcataagataattattcaaataaatgttttttggataaattgaccttttgccacatattgagatgaaatagagtcaattagaatgtctgcctatggtcacatcagctgaataaaggacagactattaaagaaaaagatttataggctgggcgcagtggctcatgcctgtaatcccagcactttgggaggctgaggtgggcggatcacttgagatcgggagtttgagaccagcctggccaacatggtgaaaccctgtctctacaaaaatacaaaaaattagctgggcttcatggcaggcgcctgttatcccagctactagggaggctgagccaggagaattgcttgaacccgggaggcggaggttgcggtgagctg

SEQ ID NO: 103388 - DNA, 363 bp, Homo sapiens
agtactttttttttttaaacaatgacaccttaatggtcaggaggttattaatgaagacttggttaagacaaacagacaaaaagactatgaaatagaaatagaattgttcctctcaagttccactgctgaaaattaccatccaaccctgtgattctattgatttgcctgcactatatcaaattttaatcaccataaaccatagactaatacagttctgccatcaacaagtgctcttagaagaagactttgattactttggacacctctgaaaatcttttaagactgtctagcttggaaactggagattcaaggaagcatctgaatgtccctcctttggttttgtaaaaaaggaggtatcatatt

SEQ ID NO: 103389 - DNA, 1281 bp, Homo sapiens
gaggattcataactgctaacccatgtctgctcccagagctaggtgacccagcagccaagcccttgagtgggaactgcaaaagctggggctgcctatgtgtggtccaaaccctcccctctccaggagaaagctgggagtagggattccttcctcacagtaagtgtttgtccaacatgatgctgcccaactgtacctcaaactctggaacctgattaaggaccagatcgctgatgtgcacttggtggagagactgcaggccctgtatatgatccggatgaaggactccttgatttgccttgactgtgccatggagagtagcagaaacagcagcatgctcaccctccgactttctttttttgatgtggactcaaagcccctgaagacactggaggacgccctgcactgcttcttccagcccagggagttatcaagcaaaagcaaatgcttctgtgagaactgtgggaagaagacccgtgggaaacaggtcttgaagctgacccatttgccccagaccctgacaatccacctcatgcgattctccatcaggaattcacagacgagaaagatctgccactccctgtacttcccccagagcttggatttcagccagatccttccaatgaagcgagagtcttgtgatgctgaggagcagtctggagggcagtatgagctttttgctgtgattgcgcacgtgggaatggcagactccggtcattactgtgtctacatccggaatgctgtggatggaaaatggttctgcttcaatgactccaatatttgcttggtgtcctgggaagacatccagtgtacctacggaaatcctaactaccactggcttccaagcagagcccactgaatcaaagttgggtttcaggaagatcacggagttcagtgagcactcaacacctctatcagacagactgcgtgggcagtgccttcctggagaggggaacacagcaggatgactatccttgacctcccagtatgacagcttaaaggctgtcatctctgtggcctgcctcccctttcccttcaccttgccagctgcctctcagtgactgtctcctccagtgactacactgagggaccagggactgcttgcctcccgaggctgctcagaccttccgacaccgcaaaatgattgtcaaaaatgggtctgcaaagagtaacttcccttccactgatcaaacctgaatgtgcaagctactgtcaattaactggaaaagtggccgtgtgggctggtgctttggtgatttaatgaataaagtctacaacccccaa

SEQ ID NO: 103390 - DNA, 1266 bp, Homo sapiens
gatcacggtgcccaggggagctgacgagcagaggagaagcgtccctttccagatgcttctgctgctggagaagatgcaggacagccggcagaaagcagtgtggcccctggagctggcctactgcctgcagaagtacaacgtgcccctgtttgtccaacatgatgctgcccaactgtacctcaaactctggaacctgattaaggaccagatcgctgatgtgcacttggtggagagactgcaggccctgtatatgatccggatgaaggactccttgatttgccttgactgtgccatggagagtagcagaaacagcagcatgctcaccctccgactttctttttttgatgtggactcaaagcccctgaagacactggaggacgccctgcactgcttcttccagcccagggagttatcaagcaaaagcaaatgcttctgtgagaactgtgggaagaagacccgtgggaaacaggtcttgaagctgacccatttgccccagaccctgacaatccacctcatgcgattctccatcaggaattcacagacgagaaagatctgccactccctgtacttcccccagagcttggatttcagccagatccttccaatgaagcgagagtcttgtgatgctgaggagcagtctggagggcagtatgagctttttgctgtgattgcgcacgtgggaatggcagactccggtcattactgtgtctacatccggaatgctgtggatggaaaatggttctgcttcaatgactccaatatttgcttggtgtcctgggaagacatccagtgtacctacggaaatcctaactaccactggcttccaagcagagcccactgaatcaaagttgggtttcaggaagatcacggagttcagtgagcactcaacacctctatcagacagactgcgtgggcagtgccttcctggagaggggaacacagcaggatgactatccttgacctcccagtatgacagcttaaaggctgtcatctctgtggcctgcctcccctttcccttcaccttgccagctgcctctcagtgactgtctcctccagtgactacactgagggaccagggactgcttgcctcccgaggctgctcagaccttccgacaccgcaaaatgattgtcaaaaatgggtctgcaaagagtaacttcccttccactgatcaaacctgaatgtgcaagctactgtcaattaactggaaaagtggccgtgtgggctggtgctttggtgatttaatgaataaagtctacaacccccaa

SEQ ID NO: 103391 - DNA, 556 bp, Homo sapiens
gtgattctagaggatcccggggacttttggatgatgatgcatggcatgttggtgagcgagaggcaacagtgtccctagagggcagggaagtcaatttgcagatggccagcaaacttttaaagcagtactcaaccttattagtactcaaaggcatgcaaatgcagagatactacttttgagagtttgacaaagattaaaagtttgacagtttctagtgttttagggacgtgaggacacatatactctcaaataatattttgatgtaacagttgggggccgggctcagtggctcatgcctgtaatcccagcagtttgggaggccaaggcgggtggatcacctgaggttatgagtttgacaccagcctggccaacatgtcaaaccacatctttaccaaaaacacaaaaattagccaggcatggtggcaggtgcttgtagtcccagctacttgggtacttgggaggcttagcagtattacttgaacctgggaggcagaggtttcagtgagctgagattttgccacttcactttatccggggagacagagcaagactctgt

SEQ ID NO: 103392 - DNA, 423 bp, Homo sapiens
  misc_feature (320)..(320): n is a, c, g, or t
  misc_feature (326)..(326): n is a, c, g, or t
  misc_feature (367)..(367): n is a, c, g, or t
  misc_feature (393)..(393): n is a, c, g, or t
  misc_feature (410)..(410): n is a, c, g, or t
gtgattctagaggatcccggggacttttggatgatgatgcatggcatgttggtgagcgagaggcaacagtgtccctagagggcagggaagtcaatttgcagatggccagcaaacttttaaagcagtactcaaccttattagtactcaaaggcatgcaaatgcagagatactacttttgagagtttgacaaagattaaaagtttgacagtttctagtgttttagggacgtgaggacacatatactctcaaataatattttgatgtaacagttgggggccgggctcagtggctcatgcctgtaatcccggccaaacttgctnattttnatttgtgtctttttgctttactaaatagtaaccatgagtgntctgagcttttctgagttctgtgagncctggcaaataattganagtgaaagtgatc

SEQ ID NO: 103393 - DNA, 342 bp, Homo sapiens
aatataaatttgcaaataagtacacagacttaatggggtatctcaggaactcagggctgtaaaaggtaaaaagccctttggtcttacataattatgaacgtatctttggtatatatgtggaagataaactggaaaagcctaattatttaataaaggtgggggagggaagattaattattgttgagtgttaactaactgccaggtgcttttatcttgtttgtctaatttaaattttatatggacttaataaagtagatattaccatgcacattttacaggttgccaaactgtggctgtgggaggttctaagcaactgttccaggtcacttgtacagtaagctg

SEQ ID NO: 103394 - DNA, 578 bp, Homo sapiens
ggggagacctggaaggaagcgactgcactgatccagaaatgcctcccaggctatccaggaggggccaagagattaaaagcaggttcagaaggctcagatgccactcaccagacagcagggtcgactgctagtgaccttgagcccagtccggacagacagacaggcagacagacgcacggacaagcagatgctccttggccagctatccactcttctgtgcctgcttagcggggccctgcctacaggctcagggaggcctgaaccccagtctcctcgacctcagtcctgggctgcagccaatcagacctgggctctgggcccaggggccctgcccccactggtgccagcttctgcccttgggagctggaaggccttcttgggcctgcagaaagccaggcagctggggatgggcaggctgcagcgtgggcaagacgaggtggctgctgtgactctgccgctgaaccctcaggaagtgatccaggggatgtgtaaggctgtgcccttcgttcagacacgggagtctcgctatgttgcccaagctagtcttgagcttctggcctcaagcaatcctcccacct

SEQ ID NO: 103395 - DNA, 329 bp, Homo sapiens
gaaagggagccaacagagacatgatgatttatctaactttgtgaggaaaccaagacaggaatttgttagaattcaaagtattatgatttcaaccatgagactacatgaaattaagcaacatttaatgtttaatccctagcgaatgacatacttttgctctgggatgtgatttgtttgccgtaattcgttttagtgatattttgctgagataaagctgcaggaatgtttgcttttcttatggcaactggcaaatagttaaaatggactgtgagaacatttgttcttcaggattctgtttaatactgagtgtaggcaaataaaacaacaca

SEQ ID NO: 103396 - DNA, 386 bp, Homo sapiens
tcctgccataacctcctgagtagctggcattacaggcgcatgccacccggcctagctaattttgtatttttgtagagacagggtttcaccatgttggccaggcgggttcgaacttctgacctcaggtgatccacccactttggcctcccaaagtgctgggatgaggctcacaggcatgagtcaccacacccggcccgaatttatgatgtggtggaattcagtgaataaatttaatgaataaactgcattgaaccgtatgaaaacatgtgtgtgctttatttatggtgtgatttaggaaatttatctttgacatttgcctaagtctgcgtgccatcagtttaatttaaagctagacttatggtatggctttgattgttttgattgtt

SEQ ID NO: 103397 - DNA, 162 bp, Homo sapiens
caaaaaaaaagaaagaaattgtgaattctgatcctcaggataattactaaatccagtgaccttttgttagtactacatgcaaaactagcgtagtttgaagataagatgtatcccagacaattattttagttcaatataaagtcattgagggagcacctttaa

SEQ ID NO: 103398 - DNA, 323 bp, Homo sapiens
gtcaggatggcctcccacatgggcacaagggcaaggctggggacagttgggtctcctcatcttatttcccaggtctaggctgatttctattaataattaaattaatcgtcgttgtcctggacctcacttcttaatgtgattccagggaactggccacattccaaaattcataatctaaggtagtgaaagaacgtgaacatcaagacagtttggctgggctcagaggctcacatctgtaatcccagtactttgggaggccgagggtagatcccttgagcccaggagttcgagaccagcctgggcaacatggcgaaatcccatct

SEQ ID NO: 103399 - DNA, 839 bp, Homo sapiens
aatttcccttttgatttcgtctttgacctacaggttttttagaactgtgttatttagtttccaatctcttgaggatttttaaaacaatatgttattgatttctaatttatttccatctcagtcaaagaacatacttgcctttttttatacatttattgaaactttttttatggcccagaatatggtctgtgttggtaaatgttccatgtgtacttgaaaataatttgtattctgatctcattgagttgaatgttctaggtatatcaagttgatagtgatgcccaagtctcctgtatctttactgattttctgcctgttctgttattgagaaaggggtattgaaacttccaactataattatgatttgtctgttctctttgcagttctcttagtttttgccttcatatatatatacatatatatgtatatatatatatatttttttttttttgagatggagtcttgctctgttgcccaggctggagtgcagtggtgtgatcttggctcactgcaagctccgcctcccaggttcacgccattctcctgcctcagcctcccgaatagctgggactacaggcgcccaccaccacgcccagctaattttttgtatttttagtagagacagggtttcaccatgttagcaaggatggtctcgatctgacctcgtgatccgcccagcttagcctcccaaagtgctgggattacaggcatgagccactgcacccagcccatatattttaaagctctgttattgggtacataaacatttaggattgttatatccttttgataatggactcttctattatgaaaagataatatactgtgggtttataaca

SEQ ID NO: 103400 - DNA, 359 bp, Homo sapiens
ttctgatagatgtagatgtgcttgataacagggctcatctcccttgctcagacacattaaatttgcacagaaggcagatctacctgtagcaacccagaatacttgcatttgaggcttttgcaagaagataatctgtgataatcttgtactgtctgctggtcagtgcttaccagaaattaaatgatattggtatagtggtttaaatcttttttttttcttattttttttttgcgacagagtcttgctctgttgccaggctggagtacagtggtgcaacctcggctcactgcaacctccacctcctaggttcaagggattcttgtgccttagccgtaattacaggcacatgccaccacacc

SEQ ID NO: 103401 - DNA, 386 bp, Homo sapiens
  misc_feature (131)..(131): n is a, c, g, or t
acagcatgagtccaggagcaatgaggaggtctttacccagcacatcctctacgagctccacaaagcgcctcaagtctgtggaggatgaaatggacagtcctggtgaggagccattttatacaggccaaggngctccccaggaagtggcagtcagtcaagtggatggcatgaagtggagccaggaatgccatctccaaccacactgaagaagtcggagaagtctggtttcagcagcccctccccttcacagacctcctccctgggaacggcgttcacacagcatcaccgacctgtcattacaggacccagagcaagtccacatgcaacaccatcgactcttcatttcccgacatcacccattatccagcagcctgggccttacttct

SEQ ID NO: 103402 - DNA, 289 bp, Homo sapiens
gaacagtgttcagaggggactgagagctcaaggagggaaaagtggctagtattccttcaaggcgtcaggtgctagggcagtcgagcaggttcttagccagctatgttagcttgggggtgcccttgtacttggcacttaagagtcccattagctgacctcccccacacaccttgactgccccctcctatagaggcggcagatggcgagagggggaaggggtgctcctgtgtacccctgctgttgagaaccaaggctgccttacaggggacctcagcctggggacagccat

SEQ ID NO: 103403 - DNA, 764 bp, Homo sapiens
gggagggttctgcttggattatgatgaggtttactggaatgtacatctgccaaactcatgaaattatacacttaaaattgatgtagattattgtactgtattgtaggttatatttcaatgaagtcatttttacaaaatggaaatatactgttatacatatgcaaatatggaacaaatggtttggacgatcacttctgtacaagaactttacattttcctttatatagttccagattttaaaaatgtgctacaaagtatatcaatgtatttcttgaaagaacttaaatataaaaaaaatccagttttatgacaaagactggggaagttgacaaagattctctgattggccaaactttagtcagtctcctgaaacttcccctagccccatctgggcacttccttgtaaaatccagttttagaaaagagccctgctcagttggtttagcaagtggtcccatcctcaatatctgatcacccttgatatctgatcgggttcctcatcctataccattcccctaaccaccctgggtgatgtctgatcaccctggcctgtcttcagcaaaaatcacattacattgggttagccagaattccccttacccctgataattcctcctggtaattttccatccactgacccccaccctgctgcttggctataaattcccacttgcccatgccatatttggaatcgagcacacatctctctgtctcactgcaagactctgttgccatggttcctataccttcacaatgctcctgaa

SEQ ID NO: 103404 - DNA, 377 bp, Homo sapiens
tgtgaaagagcatgctttatttggaagcagagtgctgcacagtgaccgacagatgaaggccacccattgggcactcacacatcgtactccaaaatacacacaggatgctttgctaataaaaatcaatgggaacagggattcctctgggcaactcccccaacctcatccctttcaggggttgggaaatctcccaaccatcttcctgatggcagcggtggttcactagagataaagcccctcagggatgccttcgtgtttcttataaagaacactttctatagattttttgaagtcttcatttgttgctttcattctatgttctcttaaggccatcagaccagcttctgtacagattgccttgatgtcagcaccagaga

SEQ ID NO: 103405 - DNA, 755 bp, Homo sapiens
tttccatctcaaaagcagctcctgactttctactggtaaagactaaatgcttaatcacggatcatcaaatagttaagtgatccaagctgcttatcgtgagctgggtgttatctgattcaaaggactgtgaaatcagtcatgcgtactagttttctatcctaatacagaagtggcatatatgaaaatgggccctagcagatccagaagcttcaagaaagcttcataagcatgcagcatctattcacattgtacctactcttcctgcttctacttcaattcacaccagtggcctcttgggtagttctccaacagcttatgggagaaaatctctggcttgatttacaggaagatctgcatcataaatgtgtaccaacaggaaatagccattgtactatagcctcattcagaggtagcctgatagatagtgttgaaataaagtcctcccagaacttcaggaaacacataagtttattcacttcattaggaaaagagatagtctgagacaccgatctacctcgattcatgggcaatggtaaaaacaaattggtctgccaatttggaaggaacaaaattgggagattggtgacaaggagatcttggggaaagggatgtggttgaatttcttagaacagggacagaataggaagatataaccagagattgacaagatgacccatgttgtggagggagttagctttttcttagtctcactggtgcttgttcaatggtccccaaataccttaccatgtgtccca

SEQ ID NO: 103406 - DNA, 362 bp, Homo sapiens
tgcaatacaaatttatatttcttacactccataatttttaacaaccataatgaatcaggtacaatatttaaagcttttatgatttttttttaactaagaaattttaaaacacacatgcccacccaccccaagtgttccatacaaagacatctccacgtggctttctttctcaggaagttagtcaaaaccgtacagctgcatggggcaagtggataagagaggaaaacagaagttgcagatgctgaaattgtagcatacggcattaacttttggttttttatcttgttttttgttttgctaccaagttactcattatattgagcatttttcagtacccttaaagtaaaacaattcaacccctt

SEQ ID NO: 103407 - DNA, 470 bp, Homo sapiens
gttttagggaagtactgtcgactcaacttcaagcatttgtgtcacttgaggtggttgctttttatggtccagatttatatttccctcactagagtactggacccttttgtcagacggtaaacatggtgtttttgaagccttcatttaaattggaaataggagcatggaggaatattggggcgttttgaaataaacgtggatggccgagcatggtggctcacgcctgtactaccagcgctttgggaggctgaggctagtggatcacctgaggtcaggagtttgagacaagcctgaccaacatggtaaaaccctgtctttactgaaaatacaaaattagttgggcctagtggtgcatgcctataatctcagctactggggaggctgaggcaggagaatcacttgaaccctggaggtggaggttgcagtgagccgagatcgccccattgcactccagcctgggcaagaagagc

SEQ ID NO: 103408 - DNA, 245 bp, Homo sapiens
ggagttcgagaccagcctgagcaacatagtgagacttcctccctatttaaaaaataataataaaaaccaggcgtggtggtgcgcacctgtaatctcagctacttgagaggctgaaggaggaacactgcttgaattcagggaggtcaaggctgcagtgagctgtgatgacgccactgcactccagcctggacaacagacccagtctccaaaaaaaaaaagaaatgttaatatgtaaggccttatcc

SEQ ID NO: 103409 - DNA, 115 bp, Homo sapiens
tgtacacagaggctgatcgattctccctgaacagcctattacggaggcactgcagatcaagcccgcctggagaggtggagtttcaagagtcccttcctggttcaccgtctccttt

SEQ ID NO: 103410 - DNA, 197 bp, Homo sapiens
ttttcttacttgaattaatcaaaacacacgaagttgctaattcgacttcctgatcactgtgggctcactggtgctggcacactgagttggcataagctccaggaaggcccagagcggagtccttcacacacttctcatggtcaaatatgtggtttcctttggattttttgaaatgttggaaattgttcattgatcct

SEQ ID NO: 103411 - DNA, 472 bp, Homo sapiens
tttatgtgggacagagaaagcaggcgagcaaggcagatggaatgaggcaagacaagcctggaaaagcaagagatttggtccacaattatgattcatttttatttcttactgtatgtttccacattttggagcagttgaaaaattctaggtaaagaggaaaacctagtttaaaattctttaaactaaccctcacttgttcaatggtgttttaagaagtctagaaagacagatactaaattttccataggtcttctttagtaatgatgtggaaaagcatgatatacttgcagcctggctgctgctaaaaatgactaagtcatttataaaatcttatcaatgtttgttttgatatggcttctccatttccgatgttacctaacacacatttccatcttcataatccaagccattcttgtttcaaatactataactaagacaactttgtaaagaatttcctgatatgtaaatctct

SEQ ID NO: 103412 - DNA, 341 bp, Homo sapiens
ccaacataaaactaaatatgtagatctcaagcattagtgagtcatttgggttggacataaataagagaattttgtcactcagaaaatacactacactaggaatggggagtcagaaagcatagactagctatcatagctatcataatgtacatatggtacaatactgtttcatggtagacgtgccattcaatttttgagaggcagccatatgatgtaaagtggactattaactgttgatgtcaaaattaacaatactctatatagaaaatgtccacagattcatgaatttgaaatgaatttaaaaaataagtaaaaaatgtctgtgggcccagaattgacca

SEQ ID NO: 103413 - DNA, 2171 bp, Homo sapiens
  misc_feature (847)..(847): n is a, c, g, or t
  misc_feature (1675)..(1675): n is a, c, g, or t
  misc_feature (2070)..(2070): n is a, c, g, or t
tcaggtatctttacagcagcaccccactctctgtagtaccaatttactgtattagtctgttctcatgctgctgttaagaaatacccacaactaggtaatttataaacaaaagaggtttaattgactcacagttctgcatggctggggaggcctcagaaaacttacaatcatggcagaaggcacctcttcacggggtggcaggagagagaatgagtgcaagcaggggaaatgccagatggcttataaaaccatcagatcttgtgagactcactcactatcatgagaacagcatggggaactgccttcatgatctgattatctctacttggtcacacccctgacacatggggattatggagagtataattctagatgagattttggggggacacagccaaaccatatcaggcactaagcatttttccccttgaattgtgggatttctttggttttctttttgtcttttgggtgttttttggtagacatatctttgttctgccagacttgagagcagggtctttatctgattcccactgactcacaaggtgctaaccacttggtcttatacacagcaagtgttgaatacatacttgggttcttatttacttctttttttattccacagggatctgtgtggcagcagggaatctattgctaatgatttgagtagtctcagctatgctaatataccagataatgatgagggtgattatttattcagtaaatgattgttgagcacctgctatgcgccaggcatagttctgggcatagtgcaaagcagtgatgcaaagtttctgcccttcaggagcttacattttactcaggggagacagacaataaatgaagnaaaacatttaattccacagggaatttcctcctagaggtgcccaggctctgtcacctggcgctctgggtccacaggtgtgtttcccttttcccgtggttcatccctgtggaataactcagcacttcctgtgtcccctctgccccctcacagatccactcacacaaaagaatttgtgagcgaccaagacattagagagcttacagggagccaaagcaagggcttcactttatactcaactgttaataccaaagcgttcccctgttgccacttcctcccaccacacagctcccaagtgcagatccctgagggatgtttttattcctgaccccagcctgcctgcccatcttggtgcttggtgaacgggcacatggagcccacccttcccagaagcagtgggagtacagacagcaaatgaacaaagcagcagccttccttccagtgcctcacaggtgcagagctctggacagtgctgtgagggaggttgttcccactttcccctttacagatgtgtttccatgtcatgccgttgagatgttagactggccaagggcttgttcatcagattgcttctctctcttaactccttcaccagtgatctcagtccatgccatggctttaaatgtcattcaggtctctattcaaatgtcacttcctcagagaccttccttgacaaccctgtctgaaatagcacatgcatgcacatataccccttaacctgctttatttctcttcatagcatttatgttaatatctttttcgtttattgtctgtctctgaaggtagggactttgcctcatttactgcttttcagttcttggaacaatgctnggcacataggcaatcaacgaatgtttgttgaataaatgatttttttctctggaaattgtcaaaatctgcatgaggtgtatcaggccagccattgtcagcctcagtttagaggcaaggaaataggttcagaaaggttcaaggacgtgctgaagtcacagggcgaggcagcagcagagagcctgcttgttgagagccaagtcttatgggacttgcctccttctctcccactgaggctggggacaccaggtggcccagaggcatgtggatacctccagtgggaggttaggagagtgctacacagaaactctgagttctaacactcttgggaccataaaaaatggaacaagtctgggcatggtaactcacgcctgtaatcacagtattttgagaggctnaggtgggaggatcacttgtggccaggagttcgaggctgcagtgagctatgatcctgccactgtactccagcctgggcaacacagagagacctcacttcttt

SEQ ID NO: 103414 - DNA, 321 bp, Homo sapiens
tccagtttattttttattttatcacattccatctataaaatatattctgcatctaatgacttctcatcacttccattgctaccaccttattccaagccacgattatctttatcctagatgattgtaatagcccactctattacaaacatattccagggtaataacagaacctactctagggaaataatggaagccaattagtcacaacattgttaaatacctgaaagaacaaacagaagagttaggataatccagacattagttattatagccagctgctacccctagagatggtatcatgggaaaccaaaagctgagatc

SEQ ID NO: 103415 - DNA, 415 bp, Homo sapiens
tcacctccttcacgaggccttccatgaacctccacctctgattcctctcttacagtaacccgttagcttcctttttactgctgtgcaatctgtaatgtttatttgtggattgtttaccagactgggagctccactgggataggggctgctgtttgtcactgcttgacacggtgcacagtgcccaagaaacacagtatgagaaagggcgggaggaatagctgagggttcgggaagggagagagctcatttgttttttgttgtttttgtttgtttgtttttgagatggagtctcgccctgtcacccaggctgaagtgtagtggcgaaatcttggctctctgcaacctccacctcccaggttcaagtgattctcctgcctcagcctctcgagtagctgggattacaggcatgcaccac

SEQ ID NO: 103416 - DNA, 751 bp, Homo sapiens
atcccatgggccagcatttactgctgctggtttgttaacagaactccgacctcatggacattggttgcttgatggttatgtgctgggagtagggaatgggaagatgattggaacacctggagtataagtggagtaaagagtacagaagaaatgcctctggcggaaaatttgaagcagtttctgtgcaagactggagctcacacatgaagccaactctgaggaagtacaaagtgttgtccccaatcctcgtaatatccagcttctttggcagcttgctctgcccaaaagaagataggagacagacagacagacaaacacacaggcatacacacagatgcgcagatggacagacaataaacttttcctggggatgtgaagaaagaatctaagaagtaaagatgggactccgtttcagatgatgaagctctaaaatgacttcagttgacgggtaaagcccatgacctctggcctcagcaggtttcagagaacaggcagatgggtgataatactcagaaaggcatccatttatcagtgagttttccttctaagctacatcccacacagcagctttgtgaatgccttcatcccacacctcagcaattttgaaccagaacaagtttccgtaaagggtaaggatgatctgtataaaatggtctgtgtaagaatgatctgcataagaaatgaaaagagcaggtgtgttcaaggagtcagacctcttagactctaagcacccccctctctcataatacct

SEQ ID NO: 103417 - DNA, 481 bp, Homo sapiens
  misc_feature (3)..(3): n is a, c, g, or t
  misc_feature (5)..(5): n is a, c, g, or t
ctntntacggttgctaagaactaccttgattaaatttatggacagtttaagaaggagaatgcttaggaaggtgatctttataaaatcagtggatcctctgggtaaagacggtagggcagaggccgggcgcagtgactcatgcctgtaatcccagcactttgggaggccaaggtgggcagatcgcctgaggtcaggagtttgagaccagcctggccaacatggtgaaaccctgtctctactacaaatacaattagcccgagcatggtggcgggcgcctgtaatcccagctactcgggaggctgaggcaagagaattgcttgacccgggaggtggaggttgctgtgagccgagatcgcaccactgcactccagcctgggtgatggagtgagattctgcctcaacaaaacaaacaaacaaaaaatcccacaaagaatggccaggttggaggggaggggtctgcagttttaattagcgtggtttg

SEQ ID NO: 103418 - DNA, 125 bp, Homo sapiens
ggcgcctgccggcggaatgggcaccttctctgttcaaggttccaagtggaggtcgggggcttcagaaaggagcaggtggggcctcgccctccccttgcaggagcaggaggcagctcacaggcatg

SEQ ID NO: 103419 - DNA, 114 bp, Homo sapiens
actgctctacatttggcctgtgccagtgaccatgtgaaagtggtcactctcctggttagcagaaaatgccagattgatatctgtgacaaagaaaatagaacgcctttgatacag

SEQ ID NO: 103420 - DNA, 105 bp, Homo sapiens
ccacggccacccccagaagctgagacatcctgacggggcctccgttcctggccacctccaagctcacacatcacggagcccccaagcctggagcagccctctctg

SEQ ID NO: 103421 - DNA, 157 bp, Homo sapiens
tcaagaaacattaactgagatcctactatgtgccagatacaaaaataaatgccttcaagaggcacatgttatggtagaaaacctctgtaaaaacatctgttggggcgggtgcggtggctcacacctgtaatcccagcactttgggaggctaaggcgg

SEQ ID NO: 103422 - DNA, 333 bp, Homo sapiens
ctcattctcctttccctcctctccatctccctattgcattgtgtctgactgattttcagagcaccttcgctgtttcccccttctcgttcccttcccataaaatatctagacaggaaggaggtggctgcagaggctgaacaatctcatattctgcctgcaatgtcatcgtttctttcccccattttagggggctgaagttgcccagcaagggatgcagaggagctggaaaagaaggggggagctctccagaggcagctgcggtcaggggcagggactgccgccagatgtgcctgcctttctgggctttgatgagaaaggggcagcaggaggaaa

SEQ ID NO: 103423 - DNA, 401 bp, Homo sapiens
caacaagagacaagtaaaatacaactttataatggagggtgccactaccctaacgccatggtaaatcttaccttcatccaccatgggtaaacaagtgtacaacatcacttataatacattctagtcacaacgtttaacttgaatctaataaagactttaaatgtaacttctagtttagagtaaatcaatgagatccaggagcaagctaaatcatactatgagaagcaatcaggcaaatctaggccaatctcttgaatgtgccagtgaaatgcaaaatgggtctctactagattaaaagaaccttatgggacacaacaaccagatgcaatgtgaagtcctgaaatcaaccacctctagaggacattttggaagaatttgggaaatctgaatatgaactgggt

SEQ ID NO: 103424 - DNA, 968 bp, Homo sapiens
agaattagaacatcaggaaggcaggcacgttactagagagagttgactaaacaagcaggattccacattaaggatgtacatcaatctgtgtacatcaggtcagttcttggccttgagttcataattttaaaaaattgtataagacaatacctacaagccacccttagtgattaaagagcaggataaaaacaagaataattacaccaatcatatttatgttattagccaagaaagtagtcatttagggtgtttatttttccagatgatcttgtggggctgagacaaggagatgaggagtaggaggaagattctgttgcactagttgtttttggctgaactttacaataacctggggagcttaaaaaaatatttatgccaaggcccgccatggtatgatttaattggtgtgcgataagacctggatgttttgttttttagagttcccccaagtggttttaatgtgcctgcaaggtacagaagatcagagaaagtgaattattggactggaaatggctacttagcctgctttactggagcagggagctgtggattggagattaataaagggtctttgaatccacaatgggaagtcataatttgattctagaagcaggactcagaaggatataaagctatgggaatggtggttgaaaaagttctgacctcaatagttaggagctctagagtcagtgggaaaagcagcattcacttcaggctgcagagctgtgtccagagcctgtgattaaaaaaagttggcgggactgggggagcacagatgagactggtaccctatgcctatgctgtatacctaactaacttccagaatggtgaggctagtgcctccttataagagcagtttagtgaagaacaagaagagactttagtgacatccttaccaacttggatttaacaataacacattttttttttgttattgtcgttttttttgttttgagacggagtctcac

SEQ ID NO: 103425 - DNA, 308 bp, Homo sapiens
actgagataggagaaaaccaccttagggctggaggagagacatgctagtggtaatactgctctttaatgcaccgagatgtttgtacacgtgcacatcaaggcacagcaccttttcttaaccttgtttacgacacagagacttttgtttacatgttttcccgctgaccctctccccactattaccctattgtcctgccacatccccctctccgagatggtagagataatgatcaataaatactgagggaactcagagaccagtaagcaccggtcccctgggcccacttttctttctccacactttgtct

SEQ ID NO: 103426 - DNA, 474 bp, Homo sapiens
ggccctggggcaaggggaaaaaatgagggctccggagagagataggggcgagtctaggcgagggagggaacggggtggaaagttgatacctagggtgagacttgggttcagggaggagggtctgggtcctgcagagaggccgcgggcacgactaggtcccaagggagctgggagaagtagggagcccggaccggagaagtcaaggtcggaggcaggggctggaggggcagctggggaggggctggagcccgagggaggagggaggaagggaatcctagggaataagtgggagtcttggtagcttgtcggatgtgagacaacacccaggggtccgacctggcgtcacaagtcacgggatcaggctgggcgcagtgactcacgcctgtaatcccagcactttggggagagggaggatcgcttgagcccttgagtttgagaccagcctaggcaacatagtgagaccaatgtttctag

SEQ ID NO: 103427 - DNA, 815 bp, Homo sapiens
tagattttagttacttaaaagatattcatatggagatattcagaaatggtgtgaaacttaagaggagctagagctgccgttttaggaatcatcacctcgtgatattaactgagctcggactggccacaatagctcagagagagtgtagagagagctgaaggtaaaactgggaaacgccaacatatgagatgaggagtggccagaaaaggcaggagagcacccaagtgtgactggtgtcaccgaagccaagatgggaatacatttcaagaagaatggacacatttaaacagaaagataagtatacacacacacacacacacacacacacacacacacacacactttctctctctctctgccccctggtgaccttttccagaggagtttgcctccagtgggcaagtgacaggaaagttgtaggactgagcaggcaaggaaagagacaactagaggggtcatctctgaactgaggaaatatggccagggacaaataaaagtaatgaatagagtgaggtccctgcagagtagaattggagccagagcacaggtggagaagttgcctggggatgttacctaaagtgtaggacacagagatggctgactgttccaattaatctgtaggtggggaaaaggtaacttagaagtacctccatctgctagccactgcctttgctaactaggagagggcttggtcatctccattcaaattgtcccaaagttgttgtccctgataacagtctgtagagcaggccttctctgattgttcccccccgagagccccaaatgacagaaaacacaaaaagccagtcaaccca

SEQ ID NO: 103428 - DNA, 472 bp, Homo sapiens
ctccatttgctctccagttttccaagaagccttctacctgactggttttgctctaaaccactatctcagactgaaattcttcacaaattccacccaggaataataagggttcatttctgaactggactcagcatgccatatgacccatggagatattttcctcatgagatttgacacaggggtcattggccatgccgcaccctagctgatgactgggcaagttaccaaaaaccatctgagccagcctcctcgtctatgcaggggaataatatggttctgcaggatggttgaggtcagggaaaaatgtattcaaattagcaaattcttgccaaaatacaaaaagcgagattcttcccaccaactctcactcatcatatagaactactcagtgccccatgtatacaaatgtaacaagcctgcatgttgtgcacatgtaccctaaaacttaaagtatcatagtaataaaatttaa

SEQ ID NO: 103429 - DNA, 355 bp, Homo sapiens
aaaaaaatcatgaacatccaggctgcagtccatattccagttgtctcatttgtcctgacactgccctttgtatcattttcccctccagtgcaggctgcagcagccaaggatcgtgtattgcatttagttgtcatgcattagggagacagagcaaaagatgatgatggaacaaaatggggcaaaatgttaaatattgatgaatatgggtacgggaatgttctccccatgtgacccctgctgacctctttatcccagtctcaagacttgtactcttgccaactatacggcagctccagtggcattctttttgttcctcagacaaaccaagctattcctacctttgagccattgactc

SEQ ID NO: 103430 - DNA, 442 bp, Homo sapiens
ctaacacggtgaaaccccgtctctactaaaaatacaaaaaattatctggacgtggtggtgtgtgcctgtagtcccagctactcgggaggctgaggcaggagaatggcgtgaacccaggaggcagagcttgcagtgagccgagatcgcgccactgcactccagcctggtagacagagcaagactccatctaaaaaaaaaaaaaagaaagaaaagacagaggcaaagatgccttccctgctgctgctgatggttgggtcaaaagaagacacacagaatcctatctactgagcttggcagagataaagggtgagaaaatggccttcaagatgccaccaagagccagccagatgtggtggctcacgcctgtaatcccagcactttgggaggctggggcgggtggatcacttgagttcaggagttcgagaccagcctggccaacatg

SEQ ID NO: 103431 - DNA, 375 bp, Homo sapiens
ccatccaggggcacggggacacggctggaacacccggcatgccagcactgcactatgccagcaggggctggcagtagaaatgagagttactcactggcgtcaccctcaccagtgccctctgcttggcccaagaaacgttaagttatgagtgcacagggccccgcagaggctcaggctgctgatttggtaacactggccacctgtgggacagccacagcaggtcagaggcagagatgtgacaacagactgcaaatgagccaaagaacagaatccccaacagaccagttctcacaatcccaccccgggcttctgggaaaagacccaattatctgtgtgagacagtgcctgcctaacaccacagagaacacacaacac

SEQ ID NO: 103432 - DNA, 886 bp, Homo sapiens
ccaccttggcctcccaaagtgctgggattacaggcatgagcctccgcaccccgccagtttcacaatacttttgagcatgggcatcaaagtatcctcaaggttaaaaatgttggggtccaagcattctacctctttgatttgtatggtttgaattatgactcagcattttaggaacatgttggctccataatctttcacccacaccccacttgaaaaagaagataatttttcagatacacttgcagatacaactacatattatccacatcatttttcttggaactgaaaactggttttatactcaaacatcctattgggcaactgtcaaataaattaattctgacatttgttaaaaaaaaaaaaaaaaaaaaaaaaaaaaaaaaaaaaaaaacaaaaaaaaaaaaaaaaaaaaaaaaaaaaaacaaacaaaaaacagacaaaacacaacaccagacacgagagggaggagcgaggcgagcacagaagcgaggcctggcaacgaaaaccagacagggagagaggggagagagacagcgaaggagagagagggaccacacagggcggccggcgcgagagacacgggggacatacgagagagagagaagaggagacagaagagacaaacgaggaggagggaaagagaaagaggaagaaaaaagaaaagaacaggaacgcggcgacgccgaggggaacagatggagagagactagaagaagagaggagaagggagggagggaaggagaaggaagcaccagaaggaaggacagggagagaggcggaagcgggaggggcaggaacagagacagcgccagaagaggaagggaacgaaagaagggagcggcacaagcacagctaggcagaggaggacgcagagggcggggaggga

SEQ ID NO: 103433 - DNA, 170 bp, Homo sapiens
ggaaacttataatcgtggcggaaggtgaggggaaaggaagcacgtcttagcacagcgaagcaagagagatagagccagaaagcgcaagtgcgcatgtgcgatgggggatgtgccacacactttaaaacacccagatcttggccaggcgcggtggctcacgcctgtaatcc

SEQ ID NO: 103434 - DNA, 207 bp, Homo sapiens
ttactatcagtaatctatgctctttaagtaacagttttattctcaggacattaaaatgtttagggagctggcccaagttgtggcggcatgtacttgtagtcccagcttccttagaggctgaggtgagaagatcactttagcccaggaattcaaggccagcctgagcaatatagtgagaccttgtctctaacaaaaaaaaaaaataaa

SEQ ID NO: 103435 - DNA, 424 bp, Homo sapiens
attgcttgcttagctgggtaatcagcaaagtcccagaacttaacattcatctcaaagcctgttctatgtagttagcagttaacttaggtaaaattagagtttcagaacatctggattctgtttatcagaattttaaaaataagatgtcacctagaagataattacaacatttttgtttgtccattaaaatatgaaaacatatttttactttttttccctatgtagtagagaggtataaagctttttaaaaagtgtctttcttatctttcatgattgtttctgactgtcatcttctgtttctctgtattaatctcttacgttttagctttttggtctgctctttgttagtgtggtacatataattttgtaatgatgaggaaaccaaacccaactgctaatgagggttatttagttgataatatag

SEQ ID NO: 103436 - DNA, 347 bp, Homo sapiens
aattggcaaataaggtactcagtggaattaaaaaaaattttttttggggagcctgcattgcatgtgaaaggtgactctgcatggataaaaatgaaaaaatgaaggaaagttatgagtactgtgcacggaagatgtggtacgaatcaaaactgtggagttaggaaaaattttagaagttccctttcagtagtacagcttatgttttctgtgaattcgtgtctcttacctacctgtagtttctttttaagtaaacttattgaggtgtgatataaatacagaaaactgtgccaatcttacatatacagcttgatgaattttcacaaagtgagcacacctgtgcaaccacc

SEQ ID NO: 103437 - DNA, 580 bp, Homo sapiens
ctccctgaagtctcgagtcaaatatccagctacctccttgacatctttactccgatgttcaccaggtgcagaaaaaaactcttactaccctccctctccaagcatttgaaaaaatgagtcccattcttccagacactcaggccaaaagtcttctagtcatgcttaacgctcctctctctctcaccacatatgcttcctcagcaaatcccactggctctacttccaaaagagaagcagaacctgaccatttctcagcagctccactgtcatcgtctggttcaagccactatcaactgccacacagatgagcacagcagcctccacacctgtgtccctgcttctggtccccgaccatgctccacacagcagccagatgacctctttaaagtggtaagtctgcgcctgtaatcctagctactcaggaggctgaggcaggagaatcgcttgaatctgggaggcggaggttgtggtgagccaagatcgcaccattgcactccagcctgggcaacaagagcaaaaatctgtcttaaaaatatatatataaataacggctgggagcggtggctcacacctgtaatcc

SEQ ID NO: 103438 - DNA, 402 bp, Homo sapiens
cagaaatctaatatttacaatattagatttaatattttaaatatttaatctatgtaaatttaatatttacaattcatggattcctcactggctctacagaggcagataaggccttcctatcactcagctactggtctcaggctggccccagtgcccattcttcctatgttgtgcacaacccctttctcagaaagacaggggcaaagctgtcaagagaactttctatcacttccagattcgatcttccaggcagtgtggacttgagtttttacagctgagattctccaaaatgacactcaaaaaaagaaaagagaagagagaagcacttctagaacagctgccttctcagtgcctggggcagggaagagacagcccaaagatcttgaaccagaaaacaaagcc

SEQ ID NO: 103439 - DNA, 1406 bp, Homo sapiens
agatgcattgtctcttcctctgcagttgagctgaatgaatacctccgaagccgctttgttctccagatgtgaatagctccactataccagcctcgtcttccttccgggggacaacgtgggtcagggcacagagagatatttaatgtcaccctcttggggctttcatgggactccctctgccacattttttggaggttgggaaagttgctagaggcttcagaactccagcctaatggatcccaaactcgggagaatggctgcgtccctgctggctgtgctgctgctgctgctgctggagcgcggcatgttctcctcaccctccccgcccccggcgctgttagagaaagtcttccagtacattgacctccatcaggatgaatttgtgcagacgctgaaggagtgggtggccatcgagagcgactctgtccagcctgtgcctcgcttcagacaagagctcttcagaatgatggccgtggctgcggacacgctgcagcgcctgggggcccgtgtggcctcggtggacatgggtcctcagcagctgcccgatggtcagagtcttccaatacctcccgtcatcctggccgaactggggagcgatcccacgaaaggcaccgtgtgcttctacggccacttggacgtgcagcctgctgaccggggcgatgggtggctcacggacccctatgtgctgacggaggtagacgggaaactttatggacgaggagcgaccgacaacaaaggccctgtcttggcttggatcaatgctgtgagcgccttcagagccctggagcaagatcttcctgtgaatatcaaattcatcattgaggggatgggaagaggctggctctgttgccctggaggaacttgtggaacaaagaacaggaccgattcttctctggtgtggactacattgtaatttcagataaacctgtggatcagccaaaggaagccagcaatcacttatggaacccgggggaacagctacttcatggtggaggtgaaatgcgagaccaggatttcactcaggaacctttggtggcatccttcatgaaccaatggctgatctggttgctcttctcggtagcctggtagactcgtctggtcatatcctggtccctggaatctatgatgaagtggttcctcttacagaagaggaaataaatacatacaaagccatccatctagacctagaagaataccggaatagcagccgggttgagaaatttctgttcgatactaaggaggagattctaatgcactctggaggtaccatctctttctattcatgggatcgagggcgcgtttggatgagcctggaataaaagagtcatacctgggcgagttataggaaaatgttcaatccggctagtccgtcacataaatgtgtctgaggtggaaaaaagggtgat

SEQ ID NO: 103440 - DNA, 1090 bp, Homo sapiens
  misc_feature (716)..(716): n is a, c, g, or t
  misc_feature (763)..(763): n is a, c, g, or t
  misc_feature (765)..(765): n is a, c, g, or t
  misc_feature (807)..(807): n is a, c, g, or t
  misc_feature (1037)..(1037): n is a, c, g, or t
agatgcattgtctcttcctctgcagttgagctgaatgaatacctccgaagccgctttgttctccagatgtgaatagctccactataccagcctcgtcttccttccgggggacaacgtgggtcagggcacagagagatatttaatgtcaccctcttggggctttcatgggactccctctgccacattttttggaggttgggaaagttgctagaggcttcagaactccagcctaatggatcccaaactcgggagaatggctgcgtccctgctggctgtgctgctgctgctgctgctggagcgcggcatgttctcctcaccctccccgcccccggcgctgttagagaaagtcttccagtacattgacctccatcaggatgaatttgtgcagacgctgaaggagtgggtggccatcgagagcgactctgtccagcctgtgcctcgcttcagacaagagctcttcagaatgatggccgtggctgcggacacgctgcagcgcctgggggcccgtgtggcctcggtggacatgggtcctcagcagctgcccgatggtcagagtcttccaatacctcccgtcatcctggccgaactggggagcgatcccacgaaaggcaccgtgtgcttctacggccacttggacgtgcagcctgctgaccggggcgatgggtggctcacggacccctatgtgctgacggaggtagacggaaccttatgacgangagcgaccgacacaaggccctgcttgcttcgacaacgcgcgggcgcntnagagccttgagcagacttcctgggatatcacatcatcattgngggatggaaaaagctgctttgtgcctgaagacctgttgaaagaaaggacgatctctctgtgtgactccatggattcagataccgtggtcagccatggagccagcatcactattgacccggggaccagtcttattgggagtgaatgacagacaggtattactcagaactttgtgcatcttatgacaacggtgactgttgttctttgagccggtaaccgtggcctgtcgcgntgaattatagaggggtccttacgcaagaatattctccaagcctcttagactta

SEQ ID NO: 103441 - DNA, 1243 bp, Homo sapiens
agatgcattgtctcttcctctgcagttgagctgaatgaatacctccgaagccgctttgttctccagatgtgaatagctccactataccagcctcgtcttccttccgggggacaacgtgggtcagggcacagagagatatttaatgtcaccctcttggggctttcatgggactccctctgccacattttttggaggttgggaaagttgctagaggcttcagaactccagcctaatggatcccaaactcgggagaatggctgcgtccctgctggctgtgctgctgctgctgctgctggagcgcggcatgttctcctcaccctccccgcccccggcgctgttagagaaagtcttccagtacattgacctccatcaggatgaatttgtgcagacgctgaaggagtgggtggccatcgagagcgactctgtccagcctgtgcctcgcttcagacaagagctcttcagaatgatggccgtggctgcggacacgctgcagcgcctgggggcccgtgtggcctcggtggacatgggtcctcagcagggaaactttatggacgaggagcgaccgacaacaaaggccctgtcttggcttggatcaatgctgtgagcgccttcagagccctggagcaagatcttcctgtgaatatcaaattcatcattgaggggatgggaagaggctggctctgttgccctggaggaacttgtggaacaaagaacaggaccgattcttctctggtgtggactacattgtaatttcagataaacctgtggatcagccaaaggaagccagcaatcacttatggaacccgggggaacagctacttcatggtggaggtgaaatgcgagaccaggatttcactcaggaacctttggtggcatccttcatgaaccaatggctgatctggttgctcttctcggtagcctggtagactcgtctggtcatatcctggtccctggaatctatgatgaagtggttcctcttacagaagaggaaataaatacatacaaagccatccatctagacctagaagaataccggaatagcagccgggttgagaaatttctgttcgatactaaggaggagattctaatgcactctggaggtaccatctctttctattcatgggatcgagggcgcgtttggatgagcctggaataaaagagtcatacctgggcgagttataggaaaatgttcaatccggctagtccgtcacataaatgtgtctgaggtggaaaaaagggtgat

SEQ ID NO: 103442 - DNA, 646 bp, Homo sapiens
aatgtgtgaagagaaagtttaactcttcacccactatgttgtttttagttattttgggctgccatattgaattttttgtttgtttgttttgagaaggcgtttcgctcttgttgcccaggctggagtgcaatggcgtgatcttggctcactgcaacctcctgcttcctgggttcaagcgattctcctgcctcagcctcctgagtagctgggattacaggcatgcaccaccatgcccggctaattttgcatttttagtagagacggggtttctccatgttggtcaggctggtctcaaactcttgacttcagatgatctacccaccttggcatcctaaagtgctgggattacaggcgtgagctaccaagcccggctttttttgttttgacatggagtttcgctcttgtcacccaggcaggagtgcagtggcgttatcttggttcactgcaacctccgcctcccggattcaagtgattctcctgcctgagcctcccaagtagctgggattacaggtgtgacccaccacatctggttaattttgtattgccatattgaatttttgtttagaaaagatatgtgtttatgtttccagttttattacctttccctatttataataaagggattctttatgcttttaaaaaaaaa

SEQ ID NO: 103443 - DNA, 562 bp, Homo sapiens
gtggctgaatgaacagctgggactatgcttaacccattcccagcttataaaagccccatggcagctgcagtgaagcatcagaaaagtatagtaagaagaaactgaatttgaagtggattcttacaaaggaaaaagaaaatcactattgtaactataccaaattactatgtatgtgatgcaacaaaattcaaatatgaaaaccatcttggaggccgggcgcggtggctcatgcctttaatcccagcactttgggaggccgaggcacggtgcctcacacctgtaatcccagcactttaggaggctgaggcgggcggatcacctgaggtcgagagttcgagaccagcctggccaacatgaagaaactccatctctactaaaaatacaaaaaattagccaggcatggtggcgcatgcctgtaatcccagctactcgggaggctgaggcaggagaatggcttgaacctgggaggcggaggttgcagtgagccgagatcacgccattgttctccagcctgggcaacaagagcaaaactctgtctcaaaaataaaataaaaaattgttt

SEQ ID NO: 103444 - DNA, 800 bp, Homo sapiens
caggggggctcccagggcagcctggcccagggagcagtcctgactctgcaggggatgcccagcaaggggggctgcagacccctcagagcctcccctcctctctccctggaaaggagctggggaacccatagtgcaaatctgtggaccactcagttatggagggaggctgtgcctgaaggtggacactggggtgcactccctccaccatctcgccctgcaccgctgtcctcagtacagccacttctcgtaagagtgcaggccatggatgccaccgtcgatctgggctgacatggtctgcttctcaaacttgagctcccctgagtacatcatggaccgaaggacagacaggctgtgggccccgatatcctggcagccatgctggatgcccactatgaggtagggcacgaacttctgaatggaccctttgtcctggatggagcccaagacatcctgcgtgatcttcgccttatccccgtcgttgaagtattgtttctggctgctgctgctcttctccatggcatccagtgagcccatgccctggtacttcttgagctgcattccgtctgagaagaagcactcgccgggggcctccatggtggcggccagcagggagcccatcatcactgtggaggctcctagggccagggccttgaccacatgccccatggtctggatgccaccatcggctatgatgggcacaccaaagttctgggtatgcttggccaccttgtacacagcagtgccctggggctgactgcaggctatcacttcctggttgatgtagatggagccgcgcagtc

SEQ ID NO: 103445 - DNA, 513 bp, Homo sapiens
cacgatctcggctcactgaaagctctgcctcctgggttcacgccattcttctgctgcagcctcccaagtagctgggactacaggcacctgccaccacgcctggctaatttttttgtatttttagtagagatggggtttcaccatgttagccaggatggtcttgatctcctgagctcgtgatccgcacgccgtggcctcccaaagtgctgggattacaggcgtgagctactgcaccccaacaatatttttattttaaaaagagaatttagcatgtacgatatttagaaatctgagatttttctttacaatttctacacagcttagaaaaatgtaacttttactttccaaggtagtatgcctgtttcaaaaacaataattaagtttccaatgtctctgccaggaagaagaatatgtatcttctccctaaccgacattcaatcaatttattgactataaacccagggcttataatggatgaaaatgagctgataataaataagaaaacgtatgttg

SEQ ID NO: 103446 - DNA, 413 bp, Homo sapiens
ggctggtctcgaactcctgacctcagttgatccgcccacctcagcctcccaaagtgctgggattacaggtgtgaaccaccacacctgacctattgattgagttttttagagacgaggtcttgctatgttgcccaggttagacttgaactcctgggttgaagctatcctcccgcctcagcctccacacagctgggactacagatgtgagctactgaatctggctctaggtgtccttttagtaacacttttcaaatgattttgttagtgttatttatgtctatctctccctttatccccatgccctgtgagctactcggtgtgtttaattcatctttgtatctcttctatcttgcatatcttttatatagaaccttctcagttcatatttattgaatggatgtgaatatactagg

SEQ ID NO: 103447 - DNA, 598 bp, Homo sapiens
ctaaaatacattgactccagatggatttttaaaaagataacaacaataataataatgtgaattttttttccaagcatttctgttcaggtagagaattagagaagtttctctcttcttcttctccaagagccatctggctggatagcttttggtggatatttcatgagaggtaccagccaaacaaggagctccagaataatctgtttgaccggatagcccagcactatgccttacttttgtttcgtgtacccaagtcccactctgaagaggcgctcttaaaaaggctgccatcacttctcagcaaagccgtgtacaccagcttctgttgctgctttccacagtcctggttcgacacgcacgaattcaagtctgacatctgtaacacaatgagcctgtggatttcaggcacctatcctagcccacagagctatgacagctgggactactcggaactagacccagagcgattccgcagagaagaattaatgttgtacagaagaagactgacaaaggggagagagttttctttgtttgctggtaagagagccttctcccagaagccagcccagagcaggaaattctaccaccctcaggtaag

SEQ ID NO: 103448 - DNA, 657 bp, Homo sapiens
taaagctctcctggtgattctaatagccagtattgggtaatcaatgttttagctaaatgtgacactggtttgagagtaggcaacaaaattaaagttcaccagacatctctttgtggtagagtttttttttttttaaactgggaccagatttcacagagcttattcaagatacatggaggaataataaagaagattaaggctactgctcattatcatttttgtctttcatattttttaagggtttgcatttctaggacttggaatagttgaccatatacatagctaaaggacatgtccctgaatgagaccattatatatattatctgtaaaatatttcactatttttttattttataaatctttgtagaaataagcaatgaaatactactttcatcttttgaaatgggatttttcaaggcagtgtccttttggcattaaggtaggggggagttaatattctctctgccttgtttccacgtgaatcaatattaaagtcatggacattttaaaatctcaatttaatttcttcttatttactatgcagtatagccgtgaacaagtaatgtagatttagttttctcatcttcaaatgccctgatcaccctacctcacagggttgttgtggggataaataaaacttttatggaagcaaaaaaa

SEQ ID NO: 103449 - DNA, 791 bp, Homo sapiens
ctcgccagaacttccggttctctagctttttatacatcctactcacactcgtcctactgatttccacttaggactgcaactacccgtcctctctgcttgtccatcaggaatattgactttcccaaacatttcttaaaaattgaaaagttaaaccaaaaatacacacttttattttcttatttttattttttctaagccaaactgtatccagctttattaaagacactttccataaacaatcctggaatttcagtcaggacatgggcagacaattattaacagtatacaacaactttcaaaaatccttctctaatggactaccaaaaatcagaaagccactataaaactcaatgaagtcttcatctgatgcactgagcagggaaagttttgagtgagggttgacatttcacatttagcatgtttttaacaacttttcacaaccgaccctgactttcagaaatgaaatgaaaatggcagaatttatttgaagattcacaatctagaaacataaccactgctcttttgaggcacgccatctcagtggcaccactggaaagtccagattgcctgatgcattggtgaccaattaatgggattccggtcccaacagatgtctgggtttaagggagttaagtctatgctggaaggtggaaagggagaagaaaacataagaactaatttgttttccataccacaaggcttttgcaccaaggtggccatgtatgtcaaagtcaggaaatctttcctcctgggaaccaagaggaagtctctcaaaactagaagggaaaggt

SEQ ID NO: 103450 - DNA, 317 bp, Homo sapiens
taggtactgagaatacagcagggaaaaaatagacaaaaatattatattccaactgtgaatccagctaattatttgtgcgtgtgtgaatatatatatttacatcgcattacattgtattaggtattaaaagtaatctagagatgatttaaagtacacaggaggatgtacatatgttatatgcaaatacaatttttttttttttttttgagacagtcttgctctgtcgcccaggctggagtgcagtggcgcaatctctgatccctgcaagatccgcctcccgggttcatgccattctcttgcctcagcctcccgagtag

SEQ ID NO: 103451 - DNA, 736 bp, Homo sapiens
gtctcaactgggtaccaaaatcccccctacccatccccacttgagaaccaccaaaggaattcctctgattaactgtgctgggcatcccctcttctgggcctcagtttccccatctgtcaaatgaatggcttagcccagaagatggatagctattggcctccccaaagcagagttttccccaactctaaattttgtggtgaaaacccaccaagttctaagaacaggcttgggacaaggaggagaaaggacattcggccctcagctggagggaggcagagccctgcagatgcccatctcaggtccaccttttgcggcctcttgtctggctctaggccctctcccttgccagtttcctgttggccaccatgttttcccagttgctctgggaacacgtttccttcccacatcccactgggaataggaaagtccattgaatattcatgaacgtataaaatgaatttgtggttgatatcgatctagttcctgaggcctaagctggcctcatcttccccaagtggcctctcagccctggcttcatgtttctaagggaacttgtcctggttttcttgaaaggtaatcttcttgcggatcaactttgctaagaaaatgaaaagctttttcctctccctttaaatccctgctcgtatctgccaagagcaggaagagtccctgccagagccttgggattgcattgggcatttgagctctggagtcaggaaggtctctgttcaaatac

SEQ ID NO: 103452 - DNA, 857 bp, Homo sapiens
agcctatgagtattaatgcggacttcccagaaagattgctggttcccgtggaatatgtaatataacattgtttacttgattaaaatttaaattttatattacatttgtaataaaactagaaagcatagataagctatcaatcaaaatcacccaaatcctgtgactactactcactgcaaacattttaatgtgcaatttgtacttaattctttactttgtaatacatacaaatatgtccagacactgtgacatatgcttgtgaacttttcaaaggtgatatcctgctgtgtattatattctgttcttttcatgtggcacattacaaatgccctgtaatacagataattatcaaatacttcttagcattcttttatgtataaatgtaccatagtagtaaatttcttccttcacattgagactttttttaaaactataaacagtactctgaattgctataaaatatgttctatatcaattcattcaaataaatatatagaagttgaaaaaaaaaaaaaaaaaaaaaaaagacacaaaagaaaaaaagcaaaaaaggggggcgcaaaaacaaatagatagacgagggacgcacacagaaacgatagaccaccgacgacgaggcaagagcaaacgcagacactccatagcgcagaggagatcaactcaaccgccagagcatctagtaaaaaaccgagtggcgtcactacacacaaccagacggaatgaatcaatgcgcacccctatggcgagggacaaaaacacatgcatccgtaccagcaaagatgaacaccaggaacagtaaacacagaagcaataaccaccagtgcgtgcagccgaacaaccacgtcggcggtcagcac

SEQ ID NO: 103453 - DNA, 446 bp, Homo sapiens
ggattatctgtgtaagatatatttacccaggatgcttaacaagcgttaaacagtaacagttccaaaaatagagccacatttacactgcctactgcactgttttgaaacagttaaccagtggaagatgctaacttttggtacatatatttgttgctggttttggcccgaagaagataaatctggaagcactctaaatggctaagttccttataaaaaataaaggccgggcacagtggctcacgcctgtaattcctagcacttcgggaggctgaggcagacagatcacttgagctcagttctagaccagcctgggcaacatcgtgagacaaaaaattagctgggtgtggtggggtgcccctgtagtcccagctgcttgggaggctgtggtgagaggactgcttgagcccgggagattgaggctgcagtgagctgagaccatgccactg

SEQ ID NO: 103454 - DNA, 380 bp, Homo sapiens
acaggagcaattcaccattaagtcattcaataatggagtccagtaaaagggctaatttacgtgcttggatcctgaaaccactgagtctagggccagagccaacaagaattcaacatgctcccgtggaaagtaagccataccaactaggatatttatgtttgggacatataggagcattgattggggctcttgttcagccagaaccttggctggactctgattagtttgaaccataactactgtttacctgactgtatttgtatcctggttcttggacctagaggtgagtgttgccaaatgaaggagagagcagtgctgagtggctcattcaggatcctagcatcagcttgtggagaacagggaaaagtgttccatctcct

SEQ ID NO: 103455 - DNA, 173 bp, Homo sapiens
accttttggaaaatgaacataattaaagacattttaaagcacatcattttcattaaaatttaatgaaagattaaagcataacattttctaaagattaagaatgttaaatgcaacatatgacactacaaaaaattcactttcattcacacagtcagcctctgctgaccttaggc

SEQ ID NO: 103456 - DNA, 491 bp, Homo sapiens
acgaacccaggcagtctaactcactgctttacactgcccttctgtacatatgcatatatactgccttcttcaaaatctaacgtcaggttaagtatacggcatcctgttacaatgtgaaataagagggctgataaactgtgagaaataaggaaagtgggcatagtacatgatgaataaaaatacaggaatgtagccaggcacggtggcatgcacttgcagtcctagctactcaagaggctgaggcgagagaaaggcatgaacgcgggaggttagggatgcttgagctatgactgcaccactgcactccagccagagcgacagaacgagaccctgtctctaaaagaattaacttaaaaaaaaaaacaggaatacacactatatttgccagactgtattttaaggaaatgagttgttctttacactgttaacaaaagggaggggcattcatgtctgcataggctaagggaaggctggctgaaggtgggagaaat

SEQ ID NO: 103457 - DNA, 141 bp, Homo sapiens
gacccacaaacaagtccttccttgaatgcctgaggcttcctaacagtgaaagagccctgttcttagagtaggcaaactgattctgaggcattgtaggtggtagggatctggtagtaggtagcattaggtgggctcccggca

SEQ ID NO: 103458 - DNA, 213 bp, Homo sapiens
tgggaacagcacggtatgctctcatgtccctggctgcaaagactgtttctgtgcacggcctccttaaaccatttcccggactgaaccgtctgtagagccgaggctgcgagcgcacgtgaaggttttcacagcaggaacgtggcggcctcagtccagactcccgcccccgcagaagtgcttccatgacaccaaagcacaaggaacagagagaaa

SEQ ID NO: 103459 - DNA, 739 bp, Homo sapiens
ccaagttcaggggagatgacaaagcacatacatatgggcacacgccagccaggagggggtgatcctcctctatgtgtgagaacagaagacaccccactggccaccttgtcaatttcaacccaagggcaacagagggtgcaatgactcgtccaaggccaagtctgcaggaggctgtcagagctgctgcctggacccctggctccccgagggtgctgtcaccccagctggtcccctgtgccagcttcatcaccaacacaacacagctggcaccctcttcccatggctggcttcggagctggtttcctgggcaggggagggggcatgataaacctccctttggggcccaggctccccagacagcgtggggacataccagctggccaatgtgcctgcactgtgttcatcggagcttcctgttttgctcaatacagcaggcccttcagcggggaccacagcattccacctggggaggcctgggatgactagactatttgccagggggtgttgggcaggcactaaatctgacctcagtaactgttagcctccaagtgacaggctcctggtgtgaaggggaaataatccaggctcttatccgccgcccccagcagggctgaccatgccacaggcaggtaaggggccctcctaggggcagagccccaatgtggcgggcagtaaaccccatatactgtcacctcttgagacaagaatcccaacagcaactggccctgagaagacagca

SEQ ID NO: 103460 - DNA, 345 bp, Homo sapiens
gtatttttagtagagatggggtttcactgtgttagccaggatggtctcgatctcttgacctcatcatccgcccaccttggccttccaaaatgctgggattacaggcatgagccaccgtgcctggcctcatagttaacaactttcttgatctatctacctgcattttataattggatacatgaatcaatccaagctgtctgaatatttttttttcttcctgcacccacaaaagccagtgagaagtaggaacctaagacaatctctggaacaggtaaccatctcttaccacttacaacataagattaaacaaagagttctctcttgtggcttatttgcatatttcat

SEQ ID NO: 103461 - DNA, 458 bp, Homo sapiens
cttaattattcaattacattagatacatgttatttaataatatacctgaaccagaggcttagggatttcagacgctctgtgttaaaggaatacaaaataagcttgttttaaaatgtaatacatcatgcttctgtccccatgtttacctatgtaattttatgattccataggtaaaatagctgaaagagaaccattatgttatcaaacactgtgtcatgcttgctgagtttgcaaaaatgtaaaacgtacaatgtgtaacttttatcttcaggaagtttataacctaataaataagattcaatacacataaaacctttaatgtacgattaagtgataaagtattaagactataagtgttgtgggagttaaataattttaaaacagattttaggaataatctaatatctcattttattgacgaggaaacaaaagtctggactagctgtttaactcaaaaa

SEQ ID NO: 103462 - DNA, 180 bp, Homo sapiens
gattattcagtatttcattggaattcagtatggattatgcagtattagatcagtgttaattttcagaagtacaattttgtggtcatagggttttaacattttcagatctctgatgttaatataattagaattgtcttggtcataaatattctgtatcctgtataatcttgtatcagccag

SEQ ID NO: 103463 - DNA, 1037 bp, Homo sapiens
gcactgaggtgtttggtttggaatagggaaaaaggtaagagactaacgtggaaaggtgctaactcagagactggagattatagtttacagctgtactttccagatcttctatgtgacacaatgcactgtccttgtgggtttgtcatttattggttaatgctctagtttcaaaaccaccctgttgaaagttccagttatttatatgcccaacaaatttcatagcctgctgaactgaactgagtgtgtcagaagtgctggttaatgacgagaagagattgcctgaaaaacaacaaactgctttctggttagctgaaggcaagtgtgaaaatcagaatttagaatatttagagctaagcttctggaaccacgtagtttctacacgtggcaggccaagaatgggaggctgactcaaaactagatagaaaaatataaaataatcttcgaccacttgatagctctcaaatatatatttaaaagatttatgaatacaaaccatttatggtttatgatttctaaaaagaaagcacaattaattttatagagaggttttttatttttttaatatttctattgcaaaagtctatccgatttgatgcactttgaatattgagatattttgcacggatgaatgtatgggaactacccatgatgatgtaagaggaaagaacatttttttgtgattcaccagacatcactttaaacttggtgatgagtttaaatccagtagctaatcccttcctgagactcaaagatcgtgacgctggttggaatttctgactgtgccctttagggcctcctgagtttcaaaaggaggaagtgttcgtgcttgtgtccctgaagttccctgttgcatgagcctgcgacaggacctcacccccaccaccaggcttctatttgggattcacatcagtattagtatcgtagctacaccaagttcaggcttctctttttgtttttttacctagaaattgggctcagtggtcttcaacttgaggacgagggtgattttcctaagaaatcagcaaagagggaaggca

SEQ ID NO: 103464 - DNA, 648 bp, Homo sapiens
cttaaaaaaaaatttaaaaagatgaaattaaattttaaaaaagaaagatttgtaactggaggcaattgtgtgtgcatatatgtataaatatatagtatttgaatgtacaatattggcaaatatccagatttatctcatagcaagattaaccttttcagtctaggaactgttttcatctgattttgaatccttgtttcattgtgcagtatatattatacaggttctcaaatggtaattgaattgaaaccttcgtttttttttaaagaaatgtaaacctgcattataattgcattattggtattcatatttaaaagctgcatattggaagaaaaatagtttcccatagttggttttacattaatgataaagtttgtatcgacaggataccacttacagcatcttcttactatatgacaagttgtactaggctccctaacatttaattttttgtttctcacaacaaccctattgaggttgtttactgaggttcagaattgttagagacttgcccaagatcacttagctaataagtggccaagcttactttttgaatccaattctgcctaattccagaacactcctttacatggtgatacactgcctcccagtgggatgatttatagatttcatagtgatactttctttggg

SEQ ID NO: 103465 - DNA, 243 bp, Homo sapiens
ctacctctgcctcccaaagtgctgggattacaggtgtgagccaccacgcccagccccacagaatacttctgacaccagatgtgtgggagccccacataccaagtaagcaatcaattctgcagctggcagacaccagctgggtgtcctctaattcagttcctacactatccacctggaaatagcatcagatcccacaggtttagttccccaagactgcccctgacttgcgacatcaattgcaag

SEQ ID NO: 103466 - DNA, 563 bp, Homo sapiens
aaatactactgtgtgccggggattaccctaaatgctttatcttttttatctcattcttacaacatgattactattcctactttatatataaggaaattgaaacctagcaaggtgaagtaatttgagctaagttatgtaaagggagtggcaggacaagattcagactcatgtctgactttctttgcgtgtgtgtgtgtgtgtgtgtgtgtacgtaccactaagcattgaaaattggaagcgccttctcttagccctctttactgtccaagtaaccaaagtattatcttcctccttccattggaaaccaagttatcttattaattatatgtaatttaaattttttttctctctaaatttcaagtttccttgattactgttgaccaataaattgtaattttggaactgagtatattagttatttatttcccaggataattgccacaaacaaatgcagttttagaagaatgatagtgctcccagctatatgtctttcactaaaacttttaacgtcattctttgtataagaagatgagattatttatgtatcagcaataaataagtaa

SEQ ID NO: 103467 - DNA, 1008 bp, Homo sapiens
cagttcagttgtgaaatggtatttatatgtcactggcctgattagcgcttagtaaaagaattcttgaaattaaaggtttagcttcttacttttagctactgtcatcttcatatgttttgatttataataagtcagcctcctaattaatataccaattatttaggagctagagaactagatcttgggcttcttttccattgtgctttccttttggccacctgactgattgtaactcctgtttaggttggctggaggaaacggagagaaaatttacatctggtggagcataaagaaaccagctagaggactggccttgtcattatctaactgtgttgtgacgaactggcacttcctcatctctaaaagcagggccctgaactagaagaccgccacgtcacatgatgaaaaacactcaaactaacacttcttacccttgtgagcagccctactagcagatttaatgtgggaggaggttcacactacgggataaaaatcaagttttaggattccattttatctaagctgaccaccacaaggcagaggatcaagacttagctaaatacagccctcaggcaagcttcacttccccatctgtgaagggagaataaatacacatgttaagataaatgagagagctggtcaagtgtttcgagctctttggcagacaagcctgactttccaaaaaaagacaaaccacaacttcggagccagtgctatttcttctgtgcatggtgaggtgacttccccagttgtaaaggatttagagctgaaattccatattgtctggagctataattacaagtctcttgcactaaaacagaggtcagctggcctaaagcatgctgaaagaaggtaaatgtctggtcacatttccatgtggtatactcctttcctaactttttggcacaaatttcatgttgatagaacattcattcactccacaaatatctggcaagtaggtgctgagtgctgtgtatagacgagtgaacacaacacagaccctgccct

SEQ ID NO: 103468 - DNA, 1049 bp, Homo sapiens
ggaagaacattccaggcagagggaacaacaaaagtacaaaggttctcaggtagaactttgagggaacaacaaaggagaccaggaggcctggggaacaatgagtaaggcagagagggaacagaggcttgtaggccactgtgcggactttggcgtttagtctgagctggggacccactggaggattctgagcagagcagtgacatgattgcgcttacatttttaagacttactctggctgctgtgttgagaacagatgaccatggggcatagacagaagcagaaaggttggctggaggaaacggagagaaaatttacatctggtggagcataaagaaaccagctagaggactggccttgtcattatctaactgtgttgtgacgaactggcacttcctcatctctaaaagcagggccctgaactagaagaccgccacgtcacatgatgaaaaacactcaaactaacacttcttacccttgtgagcagccctactagcagatttaatgtgggaggaggttcacactacgggataaaaatcaagttttaggattccattttatctaagctgaccaccacaaggcagaggatcaagacttagctaaatacagccctcaggcaagcttcacttccccatctgtgaagggagaataaatacacatgttaagataaatgagagagctggtcaagtgtttcgagctctttggcagacaagcctgactttccaaaaaaagacaaaccacaacttcggagccagtgctatttcttctgtgcatggtgaggtgacttccccagttgtaaaggatttagagctgaaattccatattgtctggagctataattacaagtctcttgcactaaaacagaggtcagctggcctaaagcatgctgaaagaaggtaaatgtctggtcacatttccatgtggtatactcctttcctaactttttggcacaaatttcatgttgatagaacattcattcactccacaaatatctggcaagtaggtgctgagtgctgtgtatagacgagtgaacacaacacagaccctgccct

SEQ ID NO: 103469 - DNA, 450 bp, Homo sapiens
ggaagaacattccaggcagagggaacaacaaaagtacaaaggttctcaggtagaactttgagggaacaacaaaggagaccaggaggcctggggaacaatgagtaaggcagagagggaacagaggcttgtaggccactgtgcggactttggcgtttagtctgagctggggacccactggaggattctgagcagagcagtgacatgattgcgcttacatttttaagacttactctggctgctgtgttgagaacagatgaccatggggcatagacagaagcagaaaggtgagttggaagctattccagtaaagcaggccagagatggaggaggtctgaaccaggtgatagagggaagagttagaaaaaagtgtctggattctggatatgttctgaaggtatgttgtgccgaaggctagatgtgtggtatgggagaaagagcaaggtcaagtac

SEQ ID NO: 103470 - DNA, 643 bp, Homo sapiens
  misc_feature (389)..(389): n is a, c, g, or t
caaataattcagtgctgctgtctcttacacttttatccctatctgtaaaacaaactacaaattgagagagtacattccatagcttgggaaaaaacccaattgtgttgtacctaaactaatcatcttaaggcagtagttcagaagaacagtactactataagcctcagaaagaggaaactacctgggtatggcgggtgggagcggagagaggatccgaaaaaaatacctatcgagttctatgcttattactggggtgatgaaattatctgtacaacaaatctctgtgacatgcactttatatataatacaaacctgcacaaaaacctaaaataaaagttaaaaaaaatgacaatcagtttacacaaatcaaagaaaaaaagaaaaaaaangaaaatacctggctggatctaccctctaacatttttaggactcagggcaagacaaatgaaagcctacatactatgtgtctaaatattaaacattataaataggctaacaaatggttaagtaaaatatgctttgtctttctaccttgacaaataaatgttgataatgacaaaattgaaaaatatatggaaagctgtcattcttgaagtcaacaaaatgtccatgatgactgtaatcattattgtgtaatctgata

SEQ ID NO: 103471 - DNA, 574 bp, Homo sapiens
acctttggacatcttcgaatcatctttggacaaaaagatatggcccatatgatcatgtcccagaataactgttaactgttcatttaactcttacgtcaaaagacatcactatattttcacctctttgtcttcaaagatgatggtgtctgttaagagttactagaaagaggggctttaggccattgttgtggctcacgcctgtattttcagcattttgggaggctgaggtgggaggatggcttgagcccaggagtttgagatcagcctgggcttaacataatgagacctcgtctctacataaaaattagccaggtgtggtggtttgtgcctgtagccccagctactcccgggagctgagttgggaggatcgcttgagactgggaggttgaggctgcagtgagccatgatcatacatgtcatgcctagcagtgaacaccaggttgtgtctggtcttctgcagtctgccatggtgaataatcccgtacgtgtgtcatttcacacgctgcaggtgaatctacagggtgaattcctagaagcgggattgctggctcaaaagtgaaatgtattttaatgt

SEQ ID NO: 103472 - DNA, 555 bp, Homo sapiens
atattgtctttaaattgtttcttgttgacacttcccacaatggaaaaattaccaaattaaacctgttttatggatggcagcttggagcatagcaagaatttggaggatttgaattccattcccagttctcattgcgttttgtttcttaaaactataataattggttactgttataaagtttaaaaggtggttttaatatgaatagcaaattctggtatattgtgactaacgcttaagaatgcctgtctttgagaggaaggtgttataatattaatcaacagtgccaaatacactgtgcatatctacaatttaatctttgaatgtttgttactggattagctccctcctccttctgtgtgatggtaccatgcatagagtcaatcaaatccttgtgatgttttgtatggactttgacaacatgtaactaatgtgtaaagcaagtttttatgattaaggaatcaaatttattgaattttattattgaaagttgaaacttaacatgtataaacaaaaaacaataaaataataaactattttcattgactataaaaatta

SEQ ID NO: 103473 - DNA, 502 bp, Homo sapiens
gctaaaactattaatggtgcatcaaagaacgccttcctagtcgaaggaggggaatgaaaggagagcatgatttcaccccttcctcagccaatcaagaaagcatacagaatagacgtgaatgagagaggtgttttcttttagagatatccattcacccttaaaatgtgggacactcgcattttgtagagacacagtgcagttcagtatctcggttgagagttccttccttcccccatttaattaaatgctgaagtttgtgtttcagaaagccctgagtttgcgtgccagctccacgtacttgttttgcagccttgtccttaaatcctgcagctcttggttggagcttctgttttgttcctgtgaactgtccccacaggtctgactcctgcagagcacagttgaagggacaggagagaacatcgagggacacccatggtggcacacactggctcactccagttcctgcacagatctacgaaagcttcagggcctcgttcactcc

SEQ ID NO: 103474 - DNA, 406 bp, Homo sapiens
tgaagatggtggaatttattctttaacagtggagaatccagctggttcaaaaactgtctcagtaaaagtacttgtattaggtaagaattttactacttaggccattaaaaataaattttgataattttgagctcttatatggataaaattacttatcaaactgttatttaacactttttagataaacctgggccacctagagatctggaagtcagtgaaattaggaaagattcatgttaccttacttggaaagaaccactggatgatggtggttctgttattaccaattatgtggttgagaggagagatgttgccagcgcccagtggtcacctctctcagctacatcaaagaaaaagagtcacttcgctaagcatctgaatgaaggcaaccagtacctcttccgag

SEQ ID NO: 103475 - DNA, 544 bp, Homo sapiens
  misc_feature (1)..(1): n is a, c, g, or t
naagtacctgggattacaggcacgtgccgccatgcccagttaatttttggatttttattagagacagggtttcagcatgttggccaggatggtcttgatctcctgacctcatgatctgcccacctcggcctcccaaagtgttgggattacaggcgtgagccaccgtgcccggcctgtttttgtttttaagagacagggtcttgctttgtcacccaggctggagtgcagtggtacaaacgtaattcactgcaatctcaacctcctgggctcaagggctcctctcgttttagcctctcaagtatctgggactaaaggcgtgtgctaccattcctggctaatttttttttttaatagagatggtgtctcgctatgttgcccagtctggtcttgaacctctgggctcaagtgatctgcccaccttggctccccaaagtgttgggattacaggcatgaaccactgcacccagccatgtttttattttatctgagagaaaactgaggttcagaacttaactgtatacttctggaatcttcacagagaaat

SEQ ID NO: 103476 - DNA, 384 bp, Homo sapiens
ctgaatgaaaatgaaaagatgtagtaatgatgaaaagtaatattatatagtatcattaatagtgtgtagtaatcctctcagtagtcatctactcattcaatcagtaaatatttttgagtactttactgccagacactgtttaggatatgccattgaataaaataggcaatcacacttgtccttgtggagcttacattttcatggagggaggcagacaataagaagaagaagaagtaaataaatatgcagtatattagaagatgagagctgccatggaaagaagaaaaaatagagaagggtaagagaagttaaaagtaatatcacttgacaactttcttttatcaagcacattacacatgagccttatgaaattactttgaagta

SEQ ID NO: 103477 - DNA, 404 bp, Homo sapiens
tccaaaacaaaattagatgtcagagatcaattcgtttataagagaactagaaaatgacattaaagccaccaactaagaaagcactacctcatctaaagtagcactttccctccacccgatgatgctccattatatttcttttttctccttttgaacatttatcactctgtcttaaaactaccctcccccttatctcaattactttctaccacattcaacttttgcttcctttgtaacatttatcacaatctataattaccttatgtatgattttgtttacctgtttctttctgtctcccctaccagaaaagtctatggaggcaggaacctcgtcttctcttgctcaccactatagcatggtgcctggcacatagtaggcaattaatcaatatttgttgaataat

SEQ ID NO: 103478 - DNA, 748 bp, Homo sapiens
cagcgggagagtgggaagaaacacaaaagaaggcggcaggatcccatgtgtttctaatccaagagaatatcactgatttgaattcatcacctctactgattcccattaataaatgttaatggaatgggcaaggaaatgatccgaccttttgaagatccatggactgcaagcaaatatgacgagtagggtggctctacccttgataatttcaaaaggcacaagcaataagggggttcatctgcatgacactggcccctgtggacaggaacctgaattcactctcaaaagaagaagatttgccaaccttatgactattccaagaattggctccaggctttgaaagtaacactacaagaagaatttcaaaaagattttgtgcaattgctgcattgttggaaaagttcttgggttcctttggtgactacttttaaagacacaacattcacatgcttttaaaacacatcagtcacatcactttatagaaacactctgtacttgtgcaaagaagaacccatctatggtttttaaaaattggaatccatgaatgactgctgtgccaattaggacgtagagcttcaactgaaaaaatgaacttctctactgctaagctggagcacagataaatatgcaagtatccaaagaggtacctgtgtttaacaatacagagaaagcacaagtgcttaattgacagctaatcttgtcttctacagaacattagaaattctttcaatgttagaattgtagaatg

SEQ ID NO: 103479 - DNA, 534 bp, Homo sapiens
actattcttactcaccaaatttggcttcaagtaactccaggttgtttttcagaacctgaattcactctcaaaagaagaagatttgccaaccttatgactattccaagaattggctccaggctttgaaagtaacactacaagaagaatttcaaaaagattttgtgcaattgctgcattgttggaaaagttcttgggttcctttggtgactacttttaaagacacaacattcacatgcttttaaaacacatcagtcacatcactttatagaaacactctgtacttgtgcaaagaagaacccatctatggtttttaaaaattggaatccatgaatgactgctgtgccaattaggacgtagagcttcaactgaaaaaatgaacttctctactgctaagctggagcacagataaatatgcaagtatccaaagaggtacctgtgtttaacaatacagagaaagcacaagtgcttaattgacagctaatcttgtcttctacagaacattagaaattctttcaatgttagaattgtagaatg

SEQ ID NO: 103480 - DNA, 563 bp, Homo sapiens
cagcgggagagtgggaagaaacacaaaagaaggcggcaggatcccatgtgtttctaatccaagagaatatcactgatttgaattcatcacctctactgattcccattaataaatgttaatggaatgggcaaggaaatgatccgaccttttgaagatccatggactgcaagcaaatatgacgagtagggtggctctacccttgataatttcaaaaggcacaagcaataagggggttcatctgcatgacactggcccctgtggacagggtctttaaaatgaatatgtacaaaagaagtgataatcctgctacaataatggagggaaaccatcaacagaagactgatttctgaaactttctgaaatatggaaaaacggaaagcggaaagtaaagtacaatatttactcatgcagcaaagcaagggaagccataatcttgaatataggcatcaacgggggataagaaaacaccgacccgtttgtcagaagtccagtgaggtgctacaggaggagtgggtgagaagtttccgaaaacactagatttaattaaagatgtggctgtgaga

SEQ ID NO: 103481 - DNA, 355 bp, Homo sapiens
tatatgatgtcctaggcctcttctagccactacagtgtatgattccacaatgctgaaatcacagggcaaatacccctcagcagttcaaggtaaatgagtttaatttcagatacaggccattgaagctattcacagacataaattccctgggaattctagggattacatttttttggaagctatgaaaaaacatttgttctctatttgaaaataaaattatctgtacaaatgtcaacttgccttttatttatattattcacagatttgaattcatcacctctactgattcccattaataaatgttaatggaatgggcaaggaaatgatccgaccttttgaagatccatggactgca

SEQ ID NO: 103482 - DNA, 397 bp, Homo sapiens
tgtcgatagatttattagcagatagataaaaggagtgtcaaaaatatagtattctctaatttcagcaaaaccgtcaatgaaatgtgaaaggctttcagttcaggatggagaatgggagcacaaatgtttgcttctcctttctttctaaggtctttaaaatgaatatgtacaaaagaagtgataatcctgctacaataatggagggaaaccatcaacagaagactgatttctgaaactttctgaaatatggaaaaacggaaagcggaaagtaaagtacaatatttactcatgcagcaaagcaagggaagccataatcttgaatataggcatcaacgggggataagaaaacaccgacccgtttgtcagaagtccagtgaggtgctacaggaggagtggg

SEQ ID NO: 103483 - DNA, 472 bp, Homo sapiens
aactcttccaatgtttttcaaaattttaaacggcttccacttgagtgctggcacattttgagagagacttatctcgtgcagagatctcatttccgtggttggactaggccactggaagttgaactgcaagcataaagttaaaccgcatttttttaaattccacatcctcattttcatttttcagactgaagattaacctgatgaacagtctttttctttctttctttcttctttctttctttttttttttttttttttaccgagtgtcactctgtcacccaggctgaagtgcagtgccatattcttggctcactgcaacctcctccacctcctgggttcaggtgattctcctgcctcagctactagggaggctgcaacaggagaatcgcttgaacctgggaggcggaggttgcagtgagccaagatcatgccattgcactccagcctgggcgacagagcaagatccgtctca

SEQ ID NO: 103484 - DNA, 821 bp, Homo sapiens
caccccacctgaaccagttttattatgtggggtgggaagtgacttaaagttaaacatcaattatctaaatatacatataaggtgggaatagagggtcagaaaagcatttttgttctctaacttgaggactccagctaaaaacataaaaatcgccaatggctgggtgcagtggctcatgcctgtaatcccagcactttgggaggccaaggcaggtggatcacctgaggtcaggagttcaagactagcctggccaacatggtgaaaccctgtctctactaaaaatacaaaaattagccaggcctggtggcacacgcctatagtcccagctactcaagagactgaggcaggagaatcgcttgaacctgggaggcggaggttgcggtgagccgagatcacaccattgcactccagccttctgtgacagagcgagactccatctcaaaaaaaaaaaaaaaaaaaaaaaggggggggggcccttatttttcttataagggggacaacagaaaaacattgtggagaaatatagacccaaattaacaatttgcggaattaaaaaaaaaaaaaaagagggacgccacgacacaagaaaacagaaagaggcccaaggttacggaaacccagaacagggaaaaagaggggacacaaaagagagagagaaataaaaagggaggcgcgcgacacacacacacagcggccaacggcaaaaacaggcgaaccggggaaccctcggcaaggaaaccacgaaaagagaggggcgaacacaaggcgacaaacaccacccaaaagaataggcccccgggccacaacacaaaaaggcaaaa

SEQ ID NO: 103485 - DNA, 331 bp, Homo sapiens
tgggatggggtgggtggcagtcttggggactgagccatcaacccatgggatctgatactatctccaggtagacagtgtcagaattgaattggaggacacctggctggtgtccactgcttggtgtgtgggggagaaaccccacgcatttggtcacaaaagccttctgtgttgctgtggtgtgacagaaaaaaacatggtttgagagtttttttcctatatatatgtggaataatttggcaatatctgtgaacattttaaatgcatatactctttaacccagaaattttatttctaggaatttattctacggatatagtttcatgtgtgaaat

SEQ ID NO: 103486 - DNA, 432 bp, Homo sapiens
caatttcatttcatttattttattgtaccaaactaccaggaccattaatttaatctacagctaaatctattattctttcatgttagaaattcaacaagaaaatttttccctaatgaaacctcacatttcaagcataaggagcctgggcgagttggctcacacctgtaatcccagcactttgggaggccgagacaggtgcatcacttgaggtcaggagttggagactagcctggcaaacatgatgaaaccctgtctctactaaaaacataaaaattggctgggcgtggtggcatgtgcctgtaatcccagctactctggaggctgaggcagggaaatagcttcaacctgggaagcagagcttgcagtgagctgagatggcaccactgcactctagcctgggctacagagcaagactctgtctcaaaaataaat

SEQ ID NO: 103487 - DNA, 101 bp, Homo sapiens
ctccgcatccccttgcaccgtccgctcgcgtgctgcggggcacgcgcagcactaccttcggcggggccgcagaaccctcagctcccgggactcccccaccg

SEQ ID NO: 103488 - DNA, 181 bp, Homo sapiens
gtaaaccttgacttgatttgtatcaactggccaggccatccttcctgatggctgcttcttggcgttgggaggctgtggacatgtctaaagcactggaattcagctgggtctcctcttaaattgcacgagtgctgcgctctagctgtctaccttcattacctgcccacctggatgtagctgg

SEQ ID NO: 103489 - DNA, 229 bp, Homo sapiens
tttcacttcattcatgggcaaacacaaattcctcccaaaagctaaagaaagcccttttctgtttcaaacttcttacagtccctagagttcctctgttcttaattataatttctggtcttagggacatgtttaggttataacagcattagtgattaacatccacccacagaggccaaatgaattaccttaatctgggatccagggatggatttcagaggggtcctgaaac

SEQ ID NO: 103490 - DNA, 358 bp, Homo sapiens
tgatataatctgcagcctcagaaactgaaaaagaaagatggagagtttcctttcctttgtctgagtgatacacagtcagaaacagtgccttggcaccgtcataaattttgtgaataagatcctctcatctattgtcttgtcttacaatttaggcaatcagttacactttaatcattaaaacattagtatacactgaactgtgtcacggtggtattttaaactgtttcctaaaagtccaatgaaattccactcaaatcctggtcattaaaattcacgcccagtgaaacaggagagtatgggaggcccattaaataccactgctagacaaccacatattctaaccacaaatagggcctct

SEQ ID NO: 103491 - DNA, 605 bp, Homo sapiens
cacctgcatttacagagaacacacattgggcaaaatatgtgtctgtcctactgggaaagtttatcaactctacatcatagaactgagaacaaatgcggggagagctaatgttttaccaagatgaacttaaccaaacaaagagatagaaataaaattcaaagccaagagccttacgtatagataaaaatggaggaatgagaacatagcatttatccaggaatcatgagttaatcatgttaccaggctttagggcaaggggctgggtgaacagtcactataatattacatgcatagttctttgaaaatgtcaaggaaaaggccgggcgcagtggctcacacctgtaatcccagcactttgggaggccaaggcaggcagatcacgaggtcaggagatcgagaccatcctggctaacatagtgaaaccctgtctctactaaaaatacaaaaaataaaaaattagccaggcgtggtggcgggcacctgtagtcccagctactcaggagactgaggcaggataatggcatgaacccaggaggcagaggttgcagtgaggcgagatcacgccactgcactccagcctgggtgacagagcgagactctgtctc

SEQ ID NO: 103492 - DNA, 731 bp, Homo sapiens
atctcattatatcttaaacaattttgaattttattccaaagcaaaattatttaaaaaagaagtaaatcaataaatataattcatttccataattaatttttgaagaaatttctaaaacttgagaacttgactgaaaagaaaaatagcattctaaattaatctactcttttaattacatattaatggaaaaaaattattttcaataaaaataaaatgcatgaaaattatcttattttccttgtattatgagacatataaagaaattcatcaaaaatatgatatgaaaaataggtttttgcaagatggatatttttctcaattaggagtacaatcaagggacaggcatggtgactcacacctgtaactccagcacttttggaggccaaggcaggcagcacacttgaagccaggagcttgagacaggcctggccactatggtgaaaccccatcaggtgtagaggtgctcacctgtaatctcagctaatcaagaagttcaggcagaataatcacttgaaactgggaagcagggggttgtagtgtgccaagattgcactgctgtactccagccaaagagacagtgtgagattcctttatacaaataaaagaaaataaattcaatcaattaagaagtgatatataataatttagttttcaatgcagtttgtggcaactatgaattttaattacaaaatgccttgaatacactgcctcccaaagtgctggagtcaggg

SEQ ID NO: 103493 - DNA, 951 bp, Homo sapiens
agccccaaaaggtaacacaatcaaggcaaggcaaaggttgaagagagtactgaaaaatcttttcaaactgtttagagagttcaacatctaatatataaagattgctctgactactacgcaataggcaaaagaagcagtgagacctacagagttacacctgatcccaaaaatagtagctttgaagtttactgtgacatggagaccatggggggaggctggacagtgctgcaggcacgtctcgatgggagcaccaacttcaccagaacatggcaagactacaaagcaggctttggaaacctcagaagggaattttggctggggaacgataaaattcatcttctgaccaagagtaaggaaatgattctgagaatagatcttgaagactttaatggtgtcgaactatatgccttgtatgatcagttttatgtggctaatgagtttctcaaatatcgtttacacgttggtaactataatggcacagctggagatgcattacgtttcaacaaacattacaaccacgatctgaagtttttcaccactccagataaagacaatgatcgatatccttctgggaactgtgggctgtactacagttcaggctggtggtttgatgcatgtctttctgcaaacttaaatggcaaatattatcaccaaaaatacagaggtgtccgtaatgggattttctggggtacctggcctggtgtaagtgaggcacaccctggtggctacaagtcctccttcaaagaggctaagatgatgatcagacccaagcactttaagccataaatcactctgttcattcctccaggtattcgttatctaatagggcaattaattccttcagcactttagaatatgccttgtttcatatttttcatagctaaaaaatgatgtctgacggctaggttcttatgctacacagcatttgaaataaagctgaaaaacaatgca

SEQ ID NO: 103494 - DNA, 393 bp, Homo sapiens
gcggccgcctactactactactgctcgaattcaagcttctaacgatgtacggggacatgtctttctgcaaacttaaatggcaaatattatcaccaaaaatacagaggtgtccgtaatgggattttctggggtacctggcctggtgtaagtgaggcacaccctggtggctacaagtcctccttcaaagaggctaagatgatgatcagacccaagcactttaagccataaatcactctgttcattcctccaggtattcgttatctaatagggcaattaattccttcagcactttagaatatgccttgtttcatatttttcatagctaaaaaatgatgtctgacggctaggttcttatgctacacagcatttgaaataaagctgaaaaacaatgca

SEQ ID NO: 103495 - DNA, 1525 bp, Homo sapiens
gccctgcgcactccctgctggggtgagcagcactgtaaagatgaagctggctaactggtactggctgagctcagctgttcttgccacttacggttttttggttgtggcaaacaatgaaacagaggaaattaaagatgaaagagcaaaggatgtctgcccagtgagactagaaagcagagggaaatgcgaagaggcaggggagtgcccctaccaggtaagcctgccccccttgactattcagctcccgaagcaattcagcaggatcgaggaggtgttcaaagaagtccaaaacctcaaggaaatcgtaaatagtctaaagaaatcttgccaagactgcaagctgcaggctgatgacaacggagacccaggcagaaacggactgttgttacccagtacaggagccccgggagaggttggtgataacagagttagagaattagagagtgaggttaacaagctgtcctctgagctaaagaatgccaaagaggagatcaatgtacttcatggtcgcctggagaagctgaatcttgtaaatatgaacaacatagaaaattatgttgacagcaaagtggcaaatctaacatttgttgtcaatagtttggatggcaaatgttcaaagtgtcccagccaagaacaaatacagtcacgtccagttcaacatctaatatataaagattgctctgactactacgcaataggcaaaagaagcagtgagacctacagagttacacctgatcccaaaaatagtagctttgaagtttactgtgacatggagaccatggggggaggctggacagtgctgcaggcacgtctcgatgggagcaccaacttcaccagaacatggcaagactacaaagcaggctttggaaacctcagaagggaattttggctggggaacgataaaattcatcttctgaccaagagtaaggaaatgattctgagaatagatcttgaagactttaatggtgtcgaactatatgccttgtatgatcagttttatgtggctaatgagtttctcaaatatcgtttacacgttggtaactataatggcacagctggagatgcattacgtttcaacaaacattacaaccacgatctgaagtttttcaccactccagataaagacaatgatcgatatccttctgggaactgtgggctgtactacagttcaggctggtggtttgatgcatgtctttctgcaaacttaaatggcaaatattatcaccaaaaatacagaggtgtccgtaatgggattttctggggtacctggcctggtgtaagtgaggcacaccctggtggctacaagtcctccttcaaagaggctaagatgatgatcagacccaagcactttaagccataaatcactctgttcattcctccaggtattcgttatctaatagggcaattaattccttcagcactttagaatatgccttgtttcatatttttcatagctaaaaaatgatgtctgacggctaggttcttatgctacacagcatttgaaataaagctgaaaaacaatgca

SEQ ID NO: 103496 - DNA, 1731 bp, Homo sapiens
gccctgcgcactccctgctggggtgagcagcactgtaaagatgaagctggctaactggtactggctgagctcagctgttcttgccacttacggttttttggttgtggcaaacaatgaaacagaggaaattaaagatgaaagagcaaaggatgtctgcccagtgagactagaaagcagagggaaatgcgaagaggcaggggagtgcccctaccaggtaagcctgccccccttgactattcagctcccgaagcaattcagcaggatcgaggaggtgttcaaagaagtccaaaacctcaaggaaatcgtaaatagtctaaagaaatcttgccaagactgcaagctgcaggctgatgacaacggagacccaggcagaaacggactgttgttacccagtacaggagccccgggagaggttggtgataacagagttagagaattagagagtgaggttaacaagctgtcctctgagctaaagaatgccaaagaggagatcaatgtacttcatggtcgcctggagaagctgaatcttgtaaatatgaacaacatagaaaattatgttgacagcaaagtggcaaatctaacatttgttgtcaatagtttggatggcaaatgttcaaagtgtcccagccaagaacaaatacagtcacgtccagttcaacatctaatatataaagattgctctgactactacgcaataggcaaaagaagcagtgagacctacagagttacacctgatcccaaaaatagtagctttgaagtttactgtgacatggagaccatggggggaggctggacagtgctgcaggcacgtctcgatgggagcaccaacttcaccagaacatggcaagactacaaagcaggctttggaaacctcagaagggaattttggctggggaacgataaaattcatcttctgaccaagagtaaggaaatgattctgagaatagatcttgaagactttaatggtgtcgaactatatgccttgtatgatcagttttatgtggctaatgagtttctcaaatatcgtttacacgttggtaactataatggcacagctggagatgcattacgtttcaacaaacattacaaccacgatctgaagtttttcaccactccagataaagacaatgatcgatatccttctgggaactgtgggctgtactacagttcaggctggtggtttgatgcatgtctttctgcaaacttaaatggcaaatattatcaccaaaaatacagaggtgtccgtaatgggattttctggggtacctggcctggtgtaagtgaggcacaccctggtggctacaagtcctccttcaaagaggctaagatgatgatcagacccaagcactttaagccataaatcactctgttcattcctccaggtattcgttatctaatagggcaattaattccttcagcactttagaatatgccttgtttcatatttttcatagctaaaaaatgatgtctgacggctaggttcttatgctacacagcatttgaaataaagctgaaaaacaatgcattttaaaggagtcctttgttgttatgctgttatccaatgaacacttgcaagcaattagcaatattgagaattatacattagatttacaattcttttaatttctattgaaactttttctattgcttgtattacttgctgtatttaaaaaataattgttggctgggtgtggtagctcacgcctgtaatcccagcactttggaatgtca

SEQ ID NO: 103497 - DNA, 1503 bp, Homo sapiens
gccctgcgcactccctgctggggtgagcagcactgtaaagatgaagctggctaactggtactggctgagctcagctgttcttgccacttacggttttttggttgtggcaaacaatgaaacagaggaaattaaagatgaaagagcaaaggatgtctgcccagtgagactagaaagcagagggaaatgcgaagaggcaggggagtgcccctaccaggtaagcctgccccccttgactattcagctcccgaagcaattcagcaggatcgaggaggtgttcaaagaagtccaaaacctcaaggaaatcgtaaatagtctaaagaaatcttgccaagactgcaagctgcaggctgatgacaacggagacccaggcagaaacggactgttgttacccagtacaggagccccgggagaggttggtgataacagagttagagaattagagagtgaggttaacaagctgtcctctgagctaaagaatgccaaagaggagatcaatgtacttcatggtcgcctggagaagctgaatcttgtaaatatgaacaacatagaaaattatgttgacagcaaagtggcaaatctaacatttgttgtcaatagtttggatggcaaatgttcaaagtgtcccagccaagaacaaatacagtcacgtccagttcaacatctaatatataaagattgctctgactactacgcaataggcaaaagaagcagtgagacctacagagttacacctgatcccaaaaatagtagctttgaagtttactgtgacatggagaccatggggggaggctggacagtgctgcaggcacgtctcgatgggagcaccaacttcaccagaacatggcaagactacaaagcaggctttggaaacctcagaagggaattttggctggggaacgataaaattcatcttctgaccaagagtaaggaaatgattctgagaatagatcttgaagactttaatggtgtcgaactatatgccttgtatgatcagttttatgtggctaatgagtttctcaaatatcgtttacacgttggtaactataatggcacagctggagatgcattacgtttcaacaaacattacaaccacgatctgaagtttttcaccactccagataaagacaatgatcgatatccttctgggaactgtgggctgtactacagttcaggctggtggtttgatgcatgtctttctgcaaacttaaatggcaaatattatcaccaaaaatacagaggtgtccgtaatgggattttctggggtacctggcctggtgtaagtgaggcacaccctggtggctacaagtcctccttcaaagaggctaagatgatgatcagacccaagcactttaagccataaatcactctgttcattcctccaggtattcgttatctaatagggcaattaattccttcagcactttagaatatgccttgtttcatatttttcatagctaaaaaatgtttgacatcctttgagatattttattactaaaatctgcc

SEQ ID NO: 103498 - DNA, 1096 bp, Homo sapiens
gccctgcgcactccctgctggggtgagcagcactgtaaagatgaagctggctaactggtactggctgagctcagctgttcttgccacttacggttttttggttgtggcaaacaatgaaacagaggaaattaaagatgaaagagcaaaggatgtctgcccagtgagactagaaagcagagggaaatgcgaagaggcaggggagtgcccctaccaggtaagcctgccccccttgactattcagctcccgaagcaattcagcaggatcgaggaggtgttcaaagaagtccaaaacctcaaggaaatcgtaaatagtctaaagaaatcttgccaagactgcaagctgcaggctgatgacaacggagacccaggcagaaacggactgttgttacccagtacaggagccccgggagaggttggtgataacagagttagagaattagagagtgaggttaacaagctgtcctctgaggataaaattcatcttctgaccaagagtaaggaaatgattctgagaatagatcttgaagactttaatggtgtcgaactatatgccttgtatgatcagttttatgtggctaatgagtttctcaaatatcgtttacacgttggtaactataatggcacagctggagatgcattacgtttcaacaaacattacaaccacgatctgaagtttttcaccactccagataaagacaatgatcgatatccttctgggaactgtgggctgtactacagttcaggctggtggtttgatgcatgtctttctgcaaacttaaatggcaaatattatcaccaaaaatacagaggtgtccgtaatgggattttctggggtacctggcctggtgtaagtgaggcacaccctggtggctacaagtcctccttcaaagaggctaagatgatgatcagacccaagcactttaagccataaatcactctgttcattcctccaggtattcgttatctaatagggcaattaattccttcagcactttagaatatgccttgtttcatatttttcatagctaaaaaatgatgtctgacggctaggttcttatgctacacagcatttgaaataaagctgaaaaacaatgca

SEQ ID NO: 103499 - DNA, 2776 bp, Homo sapiens
cggacgcgtgggggcgcgacggcggcggcggcggccggttgggggcggggggctcggacgctgcggggactcatttttcccgtcagcggagcggagggagcggtgctgcggcccgcgccgccatcttggattttactctccatttttctctggaattatttttggtgattaattttctgggggggactgggacgcggggcccggcggcgcggccccgcatcgcagcggccgggcagcggggcctgggacgcgccccgaggaggagcggggcggcgcaggcggagagaacattgaaagtattctctaagctatttgaagagagtgactaaatgcacctgggtcaggctgtctgtgggtatgaagtggttgggagaatccaagaacatggtggtgaatggcaggagaaatggaggcaagttgtctaatgaccatcagcagaatcaatcaaaattacagcacacggggaaggacaccctgaaggctggcaaaaatgcagtcgagaggaggtcgaacagatgtaatggtaactcgggatttgaaggacagagtcgctatgtaccatcctctggaatgtccgccaaggaactctgtgaaaatgatgacctagcaaccagtttggttcttgatccctatttaggttttcaaacacacaaaatgaatactagcgcctttccttcgaggagctcaaggcatttttcaaaatctgacagtttttctcacaacaaccctgtgagatttaggcctattaaaggaaggcaggaagaactaaaggaagtaattgaacgttttaagaaagatgaacacttggagaaagccttcaaatgtttgacttcaggcgaatgggcacggcactattttctcaacaagaataaaatgcaggagaaattattcaaagaacatgtatttatttatttgcgaatgtttgcaactgacagtggatttgaaatattgccatgtaatagatactcatcagaacaaaatggagccaaaatagttgcaacaaaagagtggaaacgaaatgacaaaatagaattactggtgggttgtattgccgaactttcagaaattgaggagaacatgctacttagacatggagaaaacgacttcagtgtcatgtactccacaaggaaaaactgtgctcaactctggctgggtcctgctgcgtttataaaccatgtttgtgtcaactggtcgagatacagcatgtgtgaaggctctaagagacattgaacctggagaagaaatttcttgttattatggagatgggttctttggagaaaataatgagttctgcgagtgttacacttgcgaaagacggggcactggtgcttttaaatccagagtgggactgcctgcgcctgctcctgttatcaatagcaaatatggactcagagaaacagataaacgtttaaataggcttaaaaagttaggtgacagcagcaaaaattcagacagtcaatctgtcagctctaacactgatgcagataccactcaggaaaaaaacaatgcaagtaagtaagggagatttgataagcatatcttttaaaagtattttcacacaatttgctttataaagtgtgcttcagtagttttaaacttttaaatactcagagagactgggacttgtgagctttggctgcacttcaaggctctagacgtgatttgagtagaggcacagtctgtatcccatctctaacttcagtaccgtcctctagactatttttcttgaataccttggtaactggatatgagttcttcatcatatgttccaaggtcatcatatgttttaaacattttcaaggtgttagagactgtgatgatgtcgctaagtcctgcaagaagacaaaaggactgagtagaattaaattagactctatacattccagtgcctagccagtttgttagaaaagatgatggacttggggaattcatagcttctggccttaaggcttccaccttttcattgcttgctgacctttttcaaaacgaactgactcagttcagcagaccaccagtaccagactcagaattgtgatagaggagcattttgaacagtgccgtattgtgacatgctgtattggctactccagaaagtaggagtaaagatggaaaggagaaagaagcaacctctgagattccagtggtgtgtgggggcaagatctgatggaaactgaaaaagagaacgaagactaaacaaagagaaaggaaagagaagaaaccctaaatgggcaaaggaaagcacatcctgtttgcggagctttgaaatattggaaccatttctaattgctcctgtttttctgggtaacaccagttttctgtagttgccactaaagcagtagactcttgagtctcacttgtctctgagagagacagaagttagaaagttttgacttggcgattccgaaagtatgcctttgttggcacttaaatgtccagtgagacttcttggcaccttagagccctctgagatactgattattttaggttcttctccctactttcagatgttttcagcccaacactgggtgctctcttccactacagagaatcctgaagaaaagggaaggtgtttcccatgatggtgaatgtcactgccatgaattcctgaatctacctgctgctgggagtcagagtccaagcataacccgtgtagcataaaagcagcgctgtagccctattccagtctttttcgttaatgtccagagtgaacaacaagagttagtcaatcattaactgttgactgttgattctcataataaatgcagcataacgacca

SEQ ID NO: 103500 - DNA, 927 bp, Homo sapiens
  misc_feature (838)..(839): n is a, c, g, or t
  misc_feature (845)..(846): n is a, c, g, or t
  misc_feature (858)..(858): n is a, c, g, or t
  misc_feature (860)..(860): n is a, c, g, or t
  misc_feature (872)..(872): n is a, c, g, or t
  misc_feature (877)..(877): n is a, c, g, or t
  misc_feature (882)..(882): n is a, c, g, or t
  misc_feature (888)..(888): n is a, c, g, or t
  misc_feature (892)..(892): n is a, c, g, or t
cggacgcgtgggggcgcgacggcggcggcggcggccggttgggggcggggggctcggacgctgcggggactcatttttcccgtcagcggagcggagggagcggtgctgcggcccgcgccgccatcttggattttactctccatttttctctggaattatttttggtgattaattttctgggggggactgggacgcggggcccggcggcgcggccccgcatcgcagcggccgggcagcggggcctgggacgcgccccgaggaggagcggggcggcgcaggcggagagaacattgaaagtattctctaagctatttgaagagagtgactaaatgcacctgggtcaggctgtctgtgggtatgaagtggttgggagaatccaagaacatggtggtgaatggcaggagaaatggaggcaagttgtctaatgaccatcagcagaatcaatcaaaattacagcacacggggaaggacaccctgaaggctggcaaaaatgcagtcgagaggaggtcgaacagatgtaatggtaactcgggatttgaaggacagagtcgctatgtaccatcctctggaatgtccgccaaggaactctgtgaaaatgatgacctagcaaccagtttggttcttgatccctatttaggttttcaaacacacaaaatgaatactagcgcctttccttcgaggagctcaaggcatttttcaaaatctgacagtttttctcacaacaaccctgtgagatttaggcctattaaaggaaggcaggaagaactaaaggaagtaattgaacgttttaagaaagatgaacacttggagaagctcaatgttgatcagggatggccgnntatttnncagataatgggnanttcagactgttnttggnagtgncgcggntgantgcggaaacccgcaggcatttgccggggagcaagg

SEQ ID NO: 103501 - DNA, 5846 bp, Homo sapiens
cggacgcgtgggggcgcgacggcggcggcggcggccggttgggggcggggggctcggacgctgcggggactcatttttcccgtcagcggagcggagggagcggtgctgcggcccgcgccgccatcttggattttactctccatttttctctggaattatttttggtgattaattttctgggggggactgggacgcggggcccggcggcgcggccccgcatcgcagcggccgggcagcggggcctgggacgcgccccgaggaggagcggggcggcgcaggcggagagaacattgaaagtattctctaagctatttgaagagagtgactaaatgcacctgggtcaggctgtctgtgggtatgaagtggttgggagaatccaagaacatggtggtgaatggcaggagaaatggaggcaagttgtctaatgaccatcagcagaatcaatcaaaattacagcacacggggaaggacaccctgaaggctggcaaaaatgcagtcgagaggaggtcgaacagatgtaatggtaactcgggatttgaaggacagagtcgctatgtaccatcctctggaatgtccgccaaggaactctgtgaaaatgatgacctagcaaccagtttggttcttgatccctatttaggttttcaaacacacaaaatgaatactagcgcctttccttcgaggagctcaaggcatttttcaaaatctgacagtttttctcacaacaaccctgtgagatttaggcctattaaaggaaggcaggaagaactaaaggaagtaattgaacgttttaagaaagatgaacacttggagaaagccttcaaatgtttgacttcaggcgaatgggcacggcactattttctcaacaagaataaaatgcaggagaaattattcaaagaacatgtatttatttatttgcgaatgtttgcaactgacagtggatttgaaatattgccatgtaatagatactcatcagaacaaaatggagccaaaatagttgcaacaaaagagtggaaacgaaatgacaaaatagaattactggtgggttgtattgccgaactttcagaaattgaggagaacatgctacttagacatggagaaaacgacttcagtgtcatgtactccacaaggaaaaactgtgctcaactctggctgggtcctgctgcgtttataaaccatgattgcagacctaattgtaagtttgtgtcaactggtcgagatacagcatgtgtgaaggctctaagagacattgaacctggagaagaaatttcttgttattatggagatgggttctttggagaaaataatgagttctgcgagtgttacacttgcgaaagacggggcactggtgcttttaaatccagagtgggactgcctgcgcctgctcctgttatcaatagcaaatatggactcagagaaacagataaacgtttaaataggcttaaaaagttaggtgacagcagcaaaaattcagacagtcaatctgtcagctctaacactgatgcagataccactcaggaaaaaaacaatgcaacttctaaccgaaaatcttcagttggcgtaaaaaagaatagcaagagcagaacgttaacgaggcaatctatgtcaagaattccagcttcttccaactctacctcatctaagctaactcatataaataattccagggtaccaaagaaactgaagaagcctgcaaagcctttactttcaaagataaaattgagaaatcattgcaagcggctggagcaaaagaatgcttcaagaaaactcgaaatgggaaacttagtactgaaagagcctaaagtagttctgtataaaaatttgcccattaaaaaagataaggagccagagggaccagcccaagccgcagttgccagcgggtgcttgactagacacgcggcgagagaacacagacagaatcctgtgagaggtgctcattcgcagggggagagctcgccctgcacctacataactcggcggtcagtgaggacaagaacaaatctgaaggaggcctctgacatcaagcttgaaccaaatacgttgaatggctataaaagcagtgtgacggaaccttgccccgacagtggtgaacagctgcagccagctcctgtgctgcaggaggaagaactggctcatgagactgcacaaaaaggggaggcaaagtgtcataagagtgacacaggcatgtccaaaaagaagtcacgacaaggaaaacttgtgaaacagtttgcaaaaatagaggaatctactccagtgcacgattctcctggaaaagacgacgcggtaccagatttgatgggtccccattctgaccagggtgagcacagtggcactgtgggcgtgcctgtgagctacacagactgtgctccttcacccgtcggttgttcagttgtgacatcagatagcttcaaaacaaaagacagctttagaactgcaaaaagtaaaaagaagaggcgaatcacaaggtatgatgcacagttaatcctagaaaataactctgggattcccaaattgactcttcgtaggcgtcatgatagcagcagcaaaacaaatgaccaagagaatgatggaatgaactcttccaaaataagcatcaagttaagcaaagaccatgacaacgataacaatctctatgtagcaaagcttaataatggatttaactcaggatcaggcagtagttctacaaaattaaaaatccagctaaaacgagatgaggaaaatagggggtcttatacagaggggcttcatgaaaatggggtgtgctgcagtgatcctctttctctcttggagtctcgaatggaggtggatgactatagtcagtatgaggaagaaagtacagatgattcctcctcttctgagggcgatgaagaggaggatgactatgatgatgactttgaagacgattttattcctcttcctccagctaagcgcttgaggttaatagttggaaaagactctatagatattgacatttcttcaaggagaagagaagatcagtctttaaggcttaatgcctaagctcttggtcttaacttgacctgggataactactttaaagaaataaaaaattccagtcaattattcctcaactgaaagtttagtggcagcacttctattgtcccttcacttatcagcatactattgtagaaagtgtacagcatactgactcaattcttaagtctgatttgtgcaaatttttatcgtactttttaaatagccttcttacgtgcaattctgagttagaggtaaagccctgttgtaaaataaaggctcaagcaaaattgtacagtgatagcaactttccacacaggacgttgaaaacagtaatgtggctacacagtttttttaactgtaagagcatcagctggctctttaatatatgactaaacaataatttaaaacaaatcatagtagcagcatattaagggtttctagtatgctaatatcaccagcaatgatctttggctttttgatttatttgctagatgtttcccccttggagttttgtcagtttcacactgtttgctggcccaggtgtactgtttgtggcctttgttaatatcgcaaaccattggttgggagtcagattggtttcttaaaaaaaaaaaaaaaacgacatacgtgacagctcacttttcagttcattatatgtacgagggtagcagtgtgtgggatgaggttcgatacagcgtatttattgcttgtcatgtaaattaaaaaccttgtatttaactcttttcaatccttttagataaaattgttctttgcaagaatgattggtgcttattttttcaaaaatttgctgtgaacaacgtgatgacaacaagcaacatttatctaatgaactacagctatcttaatttggttcttcaagttttctgttgcacttgtaaaatgctacaaggaatattaaaaaaatctattcactttaacttataatagtttatgaaataaaaacatgagtcacagcttttgttctgtggtaacctataaaaaaagtttgtctttgagattcaatgtaaagaactgaaaacaatgtatatgttgtaaatatttgtgtgttgtgagaaatttttgtcataagaaattaaaagaacttaccaggaaggtttttaagtttagaaatattcatgccaataaaataggaaattataaatatatagttttaagcactgcatcagtgggagttcttggcttatgttagtttatgttagtttattatgaaaacatcaaagatttttttgactatattatcagttaaacaaaaaggagtcagatttaatttgttttttgaagcactttgagaaattaattttaattaacttaatgagcaaatttttattactactttatgttcaataccaggttcttttcatttctctggattattttgcaaatcattggacagagaatttgggaatataaatctgtaacaggtgtttgacaccagtaggtctctttatttctgggaaatgtgtacctgtactttctgatatacagtgttcctaagtaaaaatcaattcaggggatttgtatagtgtctataggaaagtagcccatgtcttgaaatatgaaaaggaatctgaaggtcatgaaaagtccagtggagaaaatctcaatgcttactgttactactaattgattcctactagtttccaggtttggggggatattgtttcaatgacgctccttaagactgttgattgcccataggttccaaatagaaattaagactcatgaacatttttagaaagtagattgttttctcctggttctctaaggaactacttctgcagtcttacatagtctcatccttgtttgttgtggtgcagtcgaactcctcaggcgtttggaaagcatgtggtagaccttcttccacacccacccatacccccgttcactgcgtctggaggtcttcaacagtgaagtagggcagcccacacagcctctcaggagcacctgtccgaggcacccggagcactttgcagagcacgtccagccctcatggggtccctgcatagaaatgtgaacccctgccactgaggaagatgaaggtagaccctgtgtctggaggtgctggagggcagcgggtcacctcttgtattcccaccttagtttggggtgttttgaagaggttcagagactaaatcttaaaccttatttgaataccaacgatagctattttgggaatttcgatcttaaaaagtgacaaaacacatttcccattttcatttttcagctgaattttagtaacttatttttgatgttttaattttatcatggcctcctctttggaggccaaccttcccatgggtctcaaagcagtgacatttggtagtaaatcactgcctctcaggagtcggtatgcacaagcactcagcagccactgttgatgccttctagggaaacctaatttccgttggtaaaggtaggggcctcggaactgttccggatctgctgtagaacttcaccgtgtggaatggtgacagccacacaccgttgaccagtttagaagaggttgcattcaataaaactcttagcttgagcttatgcaatgattggttaagattttggcattgtaagaattaggagatgatcatagaaatatatgtaaagtattcaattttcaatcattttcaaattactgttataaattgtttttgctgagttgtaatacttttgagatacaatgtattccttgtactgaaagaatgaaaaaggactttttcagcatttgaggtaagttctttaacgtttcattaaaaacattttttacaaatattttgtacatgcacttgcagtattgaggttaatcattttaataaattcggaaattaaaacaaaaaaac

SEQ ID NO: 103502 - DNA, 5710 bp, Homo sapiens
  misc_feature (21)..(21): n is a, c, g, or t
gcggcggtgcgggcggcaggncagcggggcgatgaggtgaggacgcccgggaaccggaggcggcaccgcgcggcgcacggacctgggacgcggagtcctgaagccggcggacggttttcgtacgggcggccgtgcgcgaggcgaggagagaacattgaaagtattctctaagctatttgaagagagtgactaaatgcacctgggtcaggctgtctgtgggtatgaagtggttgggagaatccaagaacatggtggtgaatggcaggagaaatggaggcaagttgtctaatgaccatcagcagaatcaatcaaaattacagcacacggggaaggacaccctgaaggctggcaaaaatgcagtcgagaggaggtcgaacagatgtaatggtaactcgggatttgaaggacagagtcgctatgtaccatcctctggaatgtccgccaaggaactctgtgaaaatgatgacctagcaaccagtttggttcttgatccctatttaggttttcaaacacacaaaatgaatactagcgcctttccttcgaggagctcaaggcatttttcaaaatctgacagtttttctcacaacaaccctgtgagatttaggcctattaaaggaaggcaggaagaactaaaggaagtaattgaacgttttaagaaagatgaacacttggagaaagccttcaaatgtttgacttcaggcgaatgggcacggcactattttctcaacaagaataaaatgcaggagaaattattcaaagaacatgtatttatttatttgcgaatgtttgcaactgacagtggatttgaaatattgccatgtaatagatactcatcagaacaaaatggagccaaaatagttgcaacaaaagagtggaaacgaaatgacaaaatagaattactggtgggttgtattgccgaactttcagaaattgaggagaacatgctacttagacatggagaaaacgacttcagtgtcatgtactccacaaggaaaaactgtgctcaactctggctgggtcctgctgcgtttataaaccatgattgcagacctaattgtaagtttgtgtcaactggtcgagatacagcatgtgtgaaggctctaagagacattgaacctggagaagaaatttcttgttattatggagatgggttctttggagaaaataatgagttctgcgagtgttacacttgcgaaagacggggcactggtgcttttaaatccagagtgggactgcctgcgcctgctcctgttatcaatagcaaatatggactcagagaaacagataaacgtttaaataggcttaaaaagttaggtgacagcagcaaaaattcagacagtcaatctgtcagctctaacactgatgcagataccactcaggaaaaaaacaatgcaacttctaaccgaaaatcttcagttggcgtaaaaaagaatagcaagagcagaacgttaacgaggcaatctatgtcaagaattccagcttcttccaactctacctcatctaagctaactcatataaataattccagggtaccaaagaaactgaagaagcctgcaaagcctttactttcaaagataaaattgagaaatcattgcaagcggctggagcaaaagaatgcttcaagaaaactcgaaatgggaaacttagtactgaaagagcctaaagtagttctgtataaaaatttgcccattaaaaaagataaggagccagagggaccagcccaagccgcagttgccagcgggtgcttgactagacacgcggcgagagaacacagacagaatcctgtgagaggtgctcattcgcagggggagagctcgccctgcacctacataactcggcggtcagtgaggacaagaacaaatctgaaggaggcctctgacatcaagcttgaaccaaatacgttgaatggctataaaagcagtgtgacggaaccttgccccgacagtggtgaacagctgcagccagctcctgtgctgcaggaggaagaactggctcatgagactgcacaaaaaggggaggcaaagtgtcataagagtgacacaggcatgtccaaaaagaagtcacgacaaggaaaacttgtgaaacagtttgcaaaaatagaggaatctactccagtgcacgattctcctggaaaagacgacgcggtaccagatttgatgggtccccattctgaccagggtgagcacagtggcactgtgggcgtgcctgtgagctacacagactgtgctccttcacccgtcggttgttcagttgtgacatcagatagcttcaaaacaaaagacagctttagaactgcaaaaagtaaaaagaagaggcgaatcacaaggtatgatgcacagttaatcctagaaaataactctgggattcccaaattgactcttcgtaggcgtcatgatagcagcagcaaaacaaatgaccaagagaatgatggaatgaactcttccaaaataagcatcaagttaagcaaagaccatgacaacgataacaatctctatgtagcaaagcttaataatggatttaactcaggatcaggcagtagttctacaaaattaaaaatccagctaaaacgagatgaggaaaatagggggtcttatacagaggggcttcatgaaaatggggtgtgctgcagtgatcctctttctctcttggagtctcgaatggaggtggatgactatagtcagtatgaggaagaaagtacagatgattcctcctcttctgagggcgatgaagaggaggatgactatgatgatgactttgaagacgattttattcctcttcctccagctaagcgcttgaggttaatagttggaaaagactctatagatattgacatttcttcaaggagaagagaagatcagtctttaaggcttaatgcctaagctcttggtcttaacttgacctgggataactactttaaagaaataaaaaattccagtcaattattcctcaactgaaagtttagtggcagcacttctattgtcccttcacttatcagcatactattgtagaaagtgtacagcatactgactcaattcttaagtctgatttgtgcaaatttttatcgtactttttaaatagccttcttacgtgcaattctgagttagaggtaaagccctgttgtaaaataaaggctcaagcaaaattgtacagtgatagcaactttccacacaggacgttgaaaacagtaatgtggctacacagtttttttaactgtaagagcatcagctggctctttaatatatgactaaacaataatttaaaacaaatcatagtagcagcatattaagggtttctagtatgctaatatcaccagcaatgatctttggctttttgatttatttgctagatgtttcccccttggagttttgtcagtttcacactgtttgctggcccaggtgtactgtttgtggcctttgttaatatcgcaaaccattggttgggagtcagattggtttcttaaaaaaaaaaaaaaaacgacatacgtgacagctcacttttcagttcattatatgtacgagggtagcagtgtgtgggatgaggttcgatacagcgtatttattgcttgtcatgtaaattaaaaaccttgtatttaactcttttcaatccttttagataaaattgttctttgcaagaatgattggtgcttattttttcaaaaatttgctgtgaacaacgtgatgacaacaagcaacatttatctaatgaactacagctatcttaatttggttcttcaagttttctgttgcacttgtaaaatgctacaaggaatattaaaaaaatctattcactttaacttataatagtttatgaaataaaaacatgagtcacagcttttgttctgtggtaacctataaaaaaagtttgtctttgagattcaatgtaaagaactgaaaacaatgtatatgttgtaaatatttgtgtgttgtgagaaatttttgtcataagaaattaaaagaacttaccaggaaggtttttaagtttagaaatattcatgccaataaaataggaaattataaatatatagttttaagcactgcatcagtgggagttcttggcttatgttagtttatgttagtttattatgaaaacatcaaagatttttttgactatattatcagttaaacaaaaaggagtcagatttaatttgttttttgaagcactttgagaaattaattttaattaacttaatgagcaaatttttattactactttatgttcaataccaggttcttttcatttctctggattattttgcaaatcattggacagagaatttgggaatataaatctgtaacaggtgtttgacaccagtaggtctctttatttctgggaaatgtgtacctgtactttctgatatacagtgttcctaagtaaaaatcaattcaggggatttgtatagtgtctataggaaagtagcccatgtcttgaaatatgaaaaggaatctgaaggtcatgaaaagtccagtggagaaaatctcaatgcttactgttactactaattgattcctactagtttccaggtttggggggatattgtttcaatgacgctccttaagactgttgattgcccataggttccaaatagaaattaagactcatgaacatttttagaaagtagattgttttctcctggttctctaaggaactacttctgcagtcttacatagtctcatccttgtttgttgtggtgcagtcgaactcctcaggcgtttggaaagcatgtggtagaccttcttccacacccacccatacccccgttcactgcgtctggaggtcttcaacagtgaagtagggcagcccacacagcctctcaggagcacctgtccgaggcacccggagcactttgcagagcacgtccagccctcatggggtccctgcatagaaatgtgaacccctgccactgaggaagatgaaggtagaccctgtgtctggaggtgctggagggcagcgggtcacctcttgtattcccaccttagtttggggtgttttgaagaggttcagagactaaatcttaaaccttatttgaataccaacgatagctattttgggaatttcgatcttaaaaagtgacaaaacacatttcccattttcatttttcagctgaattttagtaacttatttttgatgttttaattttatcatggcctcctctttggaggccaaccttcccatgggtctcaaagcagtgacatttggtagtaaatcactgcctctcaggagtcggtatgcacaagcactcagcagccactgttgatgccttctagggaaacctaatttccgttggtaaaggtaggggcctcggaactgttccggatctgctgtagaacttcaccgtgtggaatggtgacagccacacaccgttgaccagtttagaagaggttgcattcaataaaactcttagcttgagcttatgcaatgattggttaagattttggcattgtaagaattaggagatgatcatagaaatatatgtaaagtattcaattttcaatcattttcaaattactgttataaattgtttttgctgagttgtaatacttttgagatacaatgtattccttgtactgaaagaatgaaaaaggactttttcagcatttgaggtaagttctttaacgtttcattaaaaacattttttacaaatattttgtacatgcacttgcagtattgaggttaatcattttaataaattcggaaattaaaacaaaaaaac

SEQ ID NO: 103503 - DNA, 5301 bp, Homo sapiens
ctctcgagttcaagcaattcccctgcctcagcctcctgagtacctgggactacaggcgtgtaccgctacgtgggcctggctaattttttgcattttagagatggggtttcaccaggttggccaggatggtctcgatctcctgacctcgtgatccatccgcctcgacctcccaaagtgctgggattatagatttaggcctattaaaggaaggcaggaagaactaaaggaagtaattgaacgttttaagaaagatgaacacttggagaaagccttcaaatgtttgacttcaggcgaatgggcacggcactattttctcaacaagaataaaatgcaggagaaattattcaaagaacatgtatttatttatttgcgaatgtttgcaactgacagtggatttgaaatattgccatgtaatagatactcatcagaacaaaatggagccaaaatagttgcaacaaaagagtggaaacgaaatgacaaaatagaattactggtgggttgtattgccgaactttcagaaattgaggagaacatgctacttagacatggagaaaacgacttcagtgtcatgtactccacaaggaaaaactgtgctcaactctggctgggtcctgctgcgtttataaaccatgattgcagacctaattgtaagtttgtgtcaactggtcgagatacagcatgtgtgaaggctctaagagacattgaacctggagaagaaatttcttgttattatggagatgggttctttggagaaaataatgagttctgcgagtgttacacttgcgaaagacggggcactggtgcttttaaatccagagtgggactgcctgcgcctgctcctgttatcaatagcaaatatggactcagagaaacagataaacgtttaaataggcttaaaaagttaggtgacagcagcaaaaattcagacagtcaatctgtcagctctaacactgatgcagataccactcaggaaaaaaacaatgcaacttctaaccgaaaatcttcagttggcgtaaaaaagaatagcaagagcagaacgttaacgaggcaatctatgtcaagaattccagcttcttccaactctacctcatctaagctaactcatataaataattccagggtaccaaagaaactgaagaagcctgcaaagcctttactttcaaagataaaattgagaaatcattgcaagcggctggagcaaaagaatgcttcaagaaaactcgaaatgggaaacttagtactgaaagagcctaaagtagttctgtataaaaatttgcccattaaaaaagataaggagccagagggaccagcccaagccgcagttgccagcgggtgcttgactagacacgcggcgagagaacacagacagaatcctgtgagaggtgctcattcgcagggggagagctcgccctgcacctacataactcggcggtcagtgaggacaagaacaaatctgaaggaggcctctgacatcaagcttgaaccaaatacgttgaatggctataaaagcagtgtgacggaaccttgccccgacagtggtgaacagctgcagccagctcctgtgctgcaggaggaagaactggctcatgagactgcacaaaaaggggaggcaaagtgtcataagagtgacacaggcatgtccaaaaagaagtcacgacaaggaaaacttgtgaaacagtttgcaaaaatagaggaatctactccagtgcacgattctcctggaaaagacgacgcggtaccagatttgatgggtccccattctgaccagggtgagcacagtggcactgtgggcgtgcctgtgagctacacagactgtgctccttcacccgtcggttgttcagttgtgacatcagatagcttcaaaacaaaagacagctttagaactgcaaaaagtaaaaagaagaggcgaatcacaaggtatgatgcacagttaatcctagaaaataactctgggattcccaaattgactcttcgtaggcgtcatgatagcagcagcaaaacaaatgaccaagagaatgatggaatgaactcttccaaaataagcatcaagttaagcaaagaccatgacaacgataacaatctctatgtagcaaagcttaataatggatttaactcaggatcaggcagtagttctacaaaattaaaaatccagctaaaacgagatgaggaaaatagggggtcttatacagaggggcttcatgaaaatggggtgtgctgcagtgatcctctttctctcttggagtctcgaatggaggtggatgactatagtcagtatgaggaagaaagtacagatgattcctcctcttctgagggcgatgaagaggaggatgactatgatgatgactttgaagacgattttattcctcttcctccagctaagcgcttgaggttaatagttggaaaagactctatagatattgacatttcttcaaggagaagagaagatcagtctttaaggcttaatgcctaagctcttggtcttaacttgacctgggataactactttaaagaaataaaaaattccagtcaattattcctcaactgaaagtttagtggcagcacttctattgtcccttcacttatcagcatactattgtagaaagtgtacagcatactgactcaattcttaagtctgatttgtgcaaatttttatcgtactttttaaatagccttcttacgtgcaattctgagttagaggtaaagccctgttgtaaaataaaggctcaagcaaaattgtacagtgatagcaactttccacacaggacgttgaaaacagtaatgtggctacacagtttttttaactgtaagagcatcagctggctctttaatatatgactaaacaataatttaaaacaaatcatagtagcagcatattaagggtttctagtatgctaatatcaccagcaatgatctttggctttttgatttatttgctagatgtttcccccttggagttttgtcagtttcacactgtttgctggcccaggtgtactgtttgtggcctttgttaatatcgcaaaccattggttgggagtcagattggtttcttaaaaaaaaaaaaaaaacgacatacgtgacagctcacttttcagttcattatatgtacgagggtagcagtgtgtgggatgaggttcgatacagcgtatttattgcttgtcatgtaaattaaaaaccttgtatttaactcttttcaatccttttagataaaattgttctttgcaagaatgattggtgcttattttttcaaaaatttgctgtgaacaacgtgatgacaacaagcaacatttatctaatgaactacagctatcttaatttggttcttcaagttttctgttgcacttgtaaaatgctacaaggaatattaaaaaaatctattcactttaacttataatagtttatgaaataaaaacatgagtcacagcttttgttctgtggtaacctataaaaaaagtttgtctttgagattcaatgtaaagaactgaaaacaatgtatatgttgtaaatatttgtgtgttgtgagaaatttttgtcataagaaattaaaagaacttaccaggaaggtttttaagtttagaaatattcatgccaataaaataggaaattataaatatatagttttaagcactgcatcagtgggagttcttggcttatgttagtttatgttagtttattatgaaaacatcaaagatttttttgactatattatcagttaaacaaaaaggagtcagatttaatttgttttttgaagcactttgagaaattaattttaattaacttaatgagcaaatttttattactactttatgttcaataccaggttcttttcatttctctggattattttgcaaatcattggacagagaatttgggaatataaatctgtaacaggtgtttgacaccagtaggtctctttatttctgggaaatgtgtacctgtactttctgatatacagtgttcctaagtaaaaatcaattcaggggatttgtatagtgtctataggaaagtagcccatgtcttgaaatatgaaaaggaatctgaaggtcatgaaaagtccagtggagaaaatctcaatgcttactgttactactaattgattcctactagtttccaggtttggggggatattgtttcaatgacgctccttaagactgttgattgcccataggttccaaatagaaattaagactcatgaacatttttagaaagtagattgttttctcctggttctctaaggaactacttctgcagtcttacatagtctcatccttgtttgttgtggtgcagtcgaactcctcaggcgtttggaaagcatgtggtagaccttcttccacacccacccatacccccgttcactgcgtctggaggtcttcaacagtgaagtagggcagcccacacagcctctcaggagcacctgtccgaggcacccggagcactttgcagagcacgtccagccctcatggggtccctgcatagaaatgtgaacccctgccactgaggaagatgaaggtagaccctgtgtctggaggtgctggagggcagcgggtcacctcttgtattcccaccttagtttggggtgttttgaagaggttcagagactaaatcttaaaccttatttgaataccaacgatagctattttgggaatttcgatcttaaaaagtgacaaaacacatttcccattttcatttttcagctgaattttagtaacttatttttgatgttttaattttatcatggcctcctctttggaggccaaccttcccatgggtctcaaagcagtgacatttggtagtaaatcactgcctctcaggagtcggtatgcacaagcactcagcagccactgttgatgccttctagggaaacctaatttccgttggtaaaggtaggggcctcggaactgttccggatctgctgtagaacttcaccgtgtggaatggtgacagccacacaccgttgaccagtttagaagaggttgcattcaataaaactcttagcttgagcttatgcaatgattggttaagattttggcattgtaagaattaggagatgatcatagaaatatatgtaaagtattcaattttcaatcattttcaaattactgttataaattgtttttgctgagttgtaatacttttgagatacaatgtattccttgtactgaaagaatgaaaaaggactttttcagcatttgaggtaagttctttaacgtttcattaaaaacattttttacaaatattttgtacatgcacttgcagtattgaggttaatcattttaataaattcggaaattaaaacaaaaaaac

SEQ ID NO: 103504 - DNA, 5322 bp, Homo sapiens
agaggatccccgagataagcaggagaaattattcaaagaacatgtatttatttatttgcgaatgtttgcaactgacagtggatttgaaatattgccatgtaatagatactcatcagaacaaaatggagcccaaatagttgcaaccaaagagtggaaacgaaatgaccaaatagaattactggtggcttgtattgccgaactttcagaaattgaggagaacatgctacttagacatggagaaaacgacttcagtgtcatgtactccacaaggaaaaactgtgctcaactctggctggctcctgcttattcaggcgaatgggcacggcactattttctcaacaagaataaaatgcaggagaaattattcaaagaacatgtatttatttatttgcgaatgtttgcaactgacagtggatttgaaatattgccatgtaatagatactcatcagaacaaaatggagccaaaatagttgcaacaaaagagtggaaacgaaatgacaaaatagaattactggtgggttgtattgccgaactttcagaaattgaggagaacatgctacttagacatggagaaaacgacttcagtgtcatgtactccacaaggaaaaactgtgctcaactctggctgggtcctgctgcgtttataaaccatgattgcagacctaattgtaagtttgtgtcaactggtcgagatacagcatgtgtgaaggctctaagagacattgaacctggagaagaaatttcttgttattatggagatgggttctttggagaaaataatgagttctgcgagtgttacacttgcgaaagacggggcactggtgcttttaaatccagagtgggactgcctgcgcctgctcctgttatcaatagcaaatatggactcagagaaacagataaacgtttaaataggcttaaaaagttaggtgacagcagcaaaaattcagacagtcaatctgtcagctctaacactgatgcagataccactcaggaaaaaaacaatgcaacttctaaccgaaaatcttcagttggcgtaaaaaagaatagcaagagcagaacgttaacgaggcaatctatgtcaagaattccagcttcttccaactctacctcatctaagctaactcatataaataattccagggtaccaaagaaactgaagaagcctgcaaagcctttactttcaaagataaaattgagaaatcattgcaagcggctggagcaaaagaatgcttcaagaaaactcgaaatgggaaacttagtactgaaagagcctaaagtagttctgtataaaaatttgcccattaaaaaagataaggagccagagggaccagcccaagccgcagttgccagcgggtgcttgactagacacgcggcgagagaacacagacagaatcctgtgagaggtgctcattcgcagggggagagctcgccctgcacctacataactcggcggtcagtgaggacaagaacaaatctgaaggaggcctctgacatcaagcttgaaccaaatacgttgaatggctataaaagcagtgtgacggaaccttgccccgacagtggtgaacagctgcagccagctcctgtgctgcaggaggaagaactggctcatgagactgcacaaaaaggggaggcaaagtgtcataagagtgacacaggcatgtccaaaaagaagtcacgacaaggaaaacttgtgaaacagtttgcaaaaatagaggaatctactccagtgcacgattctcctggaaaagacgacgcggtaccagatttgatgggtccccattctgaccagggtgagcacagtggcactgtgggcgtgcctgtgagctacacagactgtgctccttcacccgtcggttgttcagttgtgacatcagatagcttcaaaacaaaagacagctttagaactgcaaaaagtaaaaagaagaggcgaatcacaaggtatgatgcacagttaatcctagaaaataactctgggattcccaaattgactcttcgtaggcgtcatgatagcagcagcaaaacaaatgaccaagagaatgatggaatgaactcttccaaaataagcatcaagttaagcaaagaccatgacaacgataacaatctctatgtagcaaagcttaataatggatttaactcaggatcaggcagtagttctacaaaattaaaaatccagctaaaacgagatgaggaaaatagggggtcttatacagaggggcttcatgaaaatggggtgtgctgcagtgatcctctttctctcttggagtctcgaatggaggtggatgactatagtcagtatgaggaagaaagtacagatgattcctcctcttctgagggcgatgaagaggaggatgactatgatgatgactttgaagacgattttattcctcttcctccagctaagcgcttgaggttaatagttggaaaagactctatagatattgacatttcttcaaggagaagagaagatcagtctttaaggcttaatgcctaagctcttggtcttaacttgacctgggataactactttaaagaaataaaaaattccagtcaattattcctcaactgaaagtttagtggcagcacttctattgtcccttcacttatcagcatactattgtagaaagtgtacagcatactgactcaattcttaagtctgatttgtgcaaatttttatcgtactttttaaatagccttcttacgtgcaattctgagttagaggtaaagccctgttgtaaaataaaggctcaagcaaaattgtacagtgatagcaactttccacacaggacgttgaaaacagtaatgtggctacacagtttttttaactgtaagagcatcagctggctctttaatatatgactaaacaataatttaaaacaaatcatagtagcagcatattaagggtttctagtatgctaatatcaccagcaatgatctttggctttttgatttatttgctagatgtttcccccttggagttttgtcagtttcacactgtttgctggcccaggtgtactgtttgtggcctttgttaatatcgcaaaccattggttgggagtcagattggtttcttaaaaaaaaaaaaaaaacgacatacgtgacagctcacttttcagttcattatatgtacgagggtagcagtgtgtgggatgaggttcgatacagcgtatttattgcttgtcatgtaaattaaaaaccttgtatttaactcttttcaatccttttagataaaattgttctttgcaagaatgattggtgcttattttttcaaaaatttgctgtgaacaacgtgatgacaacaagcaacatttatctaatgaactacagctatcttaatttggttcttcaagttttctgttgcacttgtaaaatgctacaaggaatattaaaaaaatctattcactttaacttataatagtttatgaaataaaaacatgagtcacagcttttgttctgtggtaacctataaaaaaagtttgtctttgagattcaatgtaaagaactgaaaacaatgtatatgttgtaaatatttgtgtgttgtgagaaatttttgtcataagaaattaaaagaacttaccaggaaggtttttaagtttagaaatattcatgccaataaaataggaaattataaatatatagttttaagcactgcatcagtgggagttcttggcttatgttagtttatgttagtttattatgaaaacatcaaagatttttttgactatattatcagttaaacaaaaaggagtcagatttaatttgttttttgaagcactttgagaaattaattttaattaacttaatgagcaaatttttattactactttatgttcaataccaggttcttttcatttctctggattattttgcaaatcattggacagagaatttgggaatataaatctgtaacaggtgtttgacaccagtaggtctctttatttctgggaaatgtgtacctgtactttctgatatacagtgttcctaagtaaaaatcaattcaggggatttgtatagtgtctataggaaagtagcccatgtcttgaaatatgaaaaggaatctgaaggtcatgaaaagtccagtggagaaaatctcaatgcttactgttactactaattgattcctactagtttccaggtttggggggatattgtttcaatgacgctccttaagactgttgattgcccataggttccaaatagaaattaagactcatgaacatttttagaaagtagattgttttctcctggttctctaaggaactacttctgcagtcttacatagtctcatccttgtttgttgtggtgcagtcgaactcctcaggcgtttggaaagcatgtggtagaccttcttccacacccacccatacccccgttcactgcgtctggaggtcttcaacagtgaagtagggcagcccacacagcctctcaggagcacctgtccgaggcacccggagcactttgcagagcacgtccagccctcatggggtccctgcatagaaatgtgaacccctgccactgaggaagatgaaggtagaccctgtgtctggaggtgctggagggcagcgggtcacctcttgtattcccaccttagtttggggtgttttgaagaggttcagagactaaatcttaaaccttatttgaataccaacgatagctattttgggaatttcgatcttaaaaagtgacaaaacacatttcccattttcatttttcagctgaattttagtaacttatttttgatgttttaattttatcatggcctcctctttggaggccaaccttcccatgggtctcaaagcagtgacatttggtagtaaatcactgcctctcaggagtcggtatgcacaagcactcagcagccactgttgatgccttctagggaaacctaatttccgttggtaaaggtaggggcctcggaactgttccggatctgctgtagaacttcaccgtgtggaatggtgacagccacacaccgttgaccagtttagaagaggttgcattcaataaaactcttagcttgagcttatgcaatgattggttaagattttggcattgtaagaattaggagatgatcatagaaatatatgtaaagtattcaattttcaatcattttcaaattactgttataaattgtttttgctgagttgtaatacttttgagatacaatgtattccttgtactgaaagaatgaaaaaggactttttcagcatttgaggtaagttctttaacgtttcattaaaaacattttttacaaatattttgtacatgcacttgcagtattgaggttaatcattttaataaattcggaaattaaaacaaaaaaac

SEQ ID NO: 103505 - DNA, 5312 bp, Homo sapiens
ggcacaaggctgtggagctccagggtaggagagaagatagccaggtggggatcccagtgagctaactaaagtatagacagctaggccttttcagtttctgatatttattgtcaggattattttattaaaagaagccttactatatttaattactagtaatttttaacacatcacatattttaaataggaaacgaaatgacaaaatagaattactggtgggttgtattgccgaactttcagaaattgaggagaacatgctacttagacatggagaaaacgacttcagtgtcatgtactccacaaggaaaaactgtgctcaactctggctgggtcctgctgcgtttataaaccatgaagctgtgtttccaaggtgttggcgctagtgttggccattcctgctaactgctagaatggccttgtcaacctcagtcaaacctttatcttcctttaaaggagaatttgaaatagaaatgtttccacaaacttattaaaataaatgtatattcctttagttgaacttgagacctaaactcctatcaaaagttgtaaagttatatggaaagcttatttcagatttctataattgttcgtgtttcagatcttatcaacagttaattgactttatcttttggacatttttcagattgcagacctaattgtaagtttgtgtcaactggtcgagatacagcatgtgtgaaggctctaagagacattgaacctggagaagaaatttcttgttattatggagatgggttctttggagaaaataatgagttctgcgagtgttacacttgcgaaagacggggcactggtgcttttaaatccagagtgggactgcctgcgcctgctcctgttatcaatagcaaatatggactcagagaaacagataaacgtttaaataggcttaaaaagttaggtgacagcagcaaaaattcagacagtcaatctgtcagctctaacactgatgcagataccactcaggaaaaaaacaatgcaacttctaaccgaaaatcttcagttggcgtaaaaaagaatagcaagagcagaacgttaacgaggcaatctatgtcaagaattccagcttcttccaactctacctcatctaagctaactcatataaataattccagggtaccaaagaaactgaagaagcctgcaaagcctttactttcaaagataaaattgagaaatcattgcaagcggctggagcaaaagaatgcttcaagaaaactcgaaatgggaaacttagtactgaaagagcctaaagtagttctgtataaaaatttgcccattaaaaaagataaggagccagagggaccagcccaagccgcagttgccagcgggtgcttgactagacacgcggcgagagaacacagacagaatcctgtgagaggtgctcattcgcagggggagagctcgccctgcacctacataactcggcggtcagtgaggacaagaacaaatctgaaggaggcctctgacatcaagcttgaaccaaatacgttgaatggctataaaagcagtgtgacggaaccttgccccgacagtggtgaacagctgcagccagctcctgtgctgcaggaggaagaactggctcatgagactgcacaaaaaggggaggcaaagtgtcataagagtgacacaggcatgtccaaaaagaagtcacgacaaggaaaacttgtgaaacagtttgcaaaaatagaggaatctactccagtgcacgattctcctggaaaagacgacgcggtaccagatttgatgggtccccattctgaccagggtgagcacagtggcactgtgggcgtgcctgtgagctacacagactgtgctccttcacccgtcggttgttcagttgtgacatcagatagcttcaaaacaaaagacagctttagaactgcaaaaagtaaaaagaagaggcgaatcacaaggtatgatgcacagttaatcctagaaaataactctgggattcccaaattgactcttcgtaggcgtcatgatagcagcagcaaaacaaatgaccaagagaatgatggaatgaactcttccaaaataagcatcaagttaagcaaagaccatgacaacgataacaatctctatgtagcaaagcttaataatggatttaactcaggatcaggcagtagttctacaaaattaaaaatccagctaaaacgagatgaggaaaatagggggtcttatacagaggggcttcatgaaaatggggtgtgctgcagtgatcctctttctctcttggagtctcgaatggaggtggatgactatagtcagtatgaggaagaaagtacagatgattcctcctcttctgagggcgatgaagaggaggatgactatgatgatgactttgaagacgattttattcctcttcctccagctaagcgcttgaggttaatagttggaaaagactctatagatattgacatttcttcaaggagaagagaagatcagtctttaaggcttaatgcctaagctcttggtcttaacttgacctgggataactactttaaagaaataaaaaattccagtcaattattcctcaactgaaagtttagtggcagcacttctattgtcccttcacttatcagcatactattgtagaaagtgtacagcatactgactcaattcttaagtctgatttgtgcaaatttttatcgtactttttaaatagccttcttacgtgcaattctgagttagaggtaaagccctgttgtaaaataaaggctcaagcaaaattgtacagtgatagcaactttccacacaggacgttgaaaacagtaatgtggctacacagtttttttaactgtaagagcatcagctggctctttaatatatgactaaacaataatttaaaacaaatcatagtagcagcatattaagggtttctagtatgctaatatcaccagcaatgatctttggctttttgatttatttgctagatgtttcccccttggagttttgtcagtttcacactgtttgctggcccaggtgtactgtttgtggcctttgttaatatcgcaaaccattggttgggagtcagattggtttcttaaaaaaaaaaaaaaaacgacatacgtgacagctcacttttcagttcattatatgtacgagggtagcagtgtgtgggatgaggttcgatacagcgtatttattgcttgtcatgtaaattaaaaaccttgtatttaactcttttcaatccttttagataaaattgttctttgcaagaatgattggtgcttattttttcaaaaatttgctgtgaacaacgtgatgacaacaagcaacatttatctaatgaactacagctatcttaatttggttcttcaagttttctgttgcacttgtaaaatgctacaaggaatattaaaaaaatctattcactttaacttataatagtttatgaaataaaaacatgagtcacagcttttgttctgtggtaacctataaaaaaagtttgtctttgagattcaatgtaaagaactgaaaacaatgtatatgttgtaaatatttgtgtgttgtgagaaatttttgtcataagaaattaaaagaacttaccaggaaggtttttaagtttagaaatattcatgccaataaaataggaaattataaatatatagttttaagcactgcatcagtgggagttcttggcttatgttagtttatgttagtttattatgaaaacatcaaagatttttttgactatattatcagttaaacaaaaaggagtcagatttaatttgttttttgaagcactttgagaaattaattttaattaacttaatgagcaaatttttattactactttatgttcaataccaggttcttttcatttctctggattattttgcaaatcattggacagagaatttgggaatataaatctgtaacaggtgtttgacaccagtaggtctctttatttctgggaaatgtgtacctgtactttctgatatacagtgttcctaagtaaaaatcaattcaggggatttgtatagtgtctataggaaagtagcccatgtcttgaaatatgaaaaggaatctgaaggtcatgaaaagtccagtggagaaaatctcaatgcttactgttactactaattgattcctactagtttccaggtttggggggatattgtttcaatgacgctccttaagactgttgattgcccataggttccaaatagaaattaagactcatgaacatttttagaaagtagattgttttctcctggttctctaaggaactacttctgcagtcttacatagtctcatccttgtttgttgtggtgcagtcgaactcctcaggcgtttggaaagcatgtggtagaccttcttccacacccacccatacccccgttcactgcgtctggaggtcttcaacagtgaagtagggcagcccacacagcctctcaggagcacctgtccgaggcacccggagcactttgcagagcacgtccagccctcatggggtccctgcatagaaatgtgaacccctgccactgaggaagatgaaggtagaccctgtgtctggaggtgctggagggcagcgggtcacctcttgtattcccaccttagtttggggtgttttgaagaggttcagagactaaatcttaaaccttatttgaataccaacgatagctattttgggaatttcgatcttaaaaagtgacaaaacacatttcccattttcatttttcagctgaattttagtaacttatttttgatgttttaattttatcatggcctcctctttggaggccaaccttcccatgggtctcaaagcagtgacatttggtagtaaatcactgcctctcaggagtcggtatgcacaagcactcagcagccactgttgatgccttctagggaaacctaatttccgttggtaaaggtaggggcctcggaactgttccggatctgctgtagaacttcaccgtgtggaatggtgacagccacacaccgttgaccagtttagaagaggttgcattcaataaaactcttagcttgagcttatgcaatgattggttaagattttggcattgtaagaattaggagatgatcatagaaatatatgtaaagtattcaattttcaatcattttcaaattactgttataaattgtttttgctgagttgtaatacttttgagatacaatgtattccttgtactgaaagaatgaaaaaggactttttcagcatttgaggtaagttctttaacgtttcattaaaaacattttttacaaatattttgtacatgcacttgcagtattgaggttaatcattttaataaattcggaaattaaaacaaaaaaac

SEQ ID NO: 103506 - DNA, 4932 bp, Homo sapiens
cggacgcgtgggggcgcgacggcggcggcggcggccggttgggggcggggggctcggacgctgcggggactcatttttcccgtcagcggagcggagggagcggtgctgcggcccgcgccgccatcttggattttactctccatttttctctggaattatttttggtgattaattttctgggggggactgggacgcggggcccggcggcgcggccccgcatcgcagcggccgggcagcggggcctgggacgcgccccgaggaggagcggggcggcgcaggcggagagaacattgaaagtattctctaagctatttgaagagagtgactaaatgcacctgggtcaggctgtctgtgggtatgaagtggttgggagaatccaagaacatggtggtgaatggcaggagaaatggaggcaagttgtctaatgaccatcagcagaatcaatcaaaattacagcacacggggaaggacaccctgaaggctggcaaaaatgcagtcgagaggaggtcgaacagatgtaatggtaactcgggatttgaaggacagagtcgctatgtaccatcctctggaatgtccgccaaggaactctgtgaaaatgatgacctagcaaccagtttggttcttgatccctatttaggttttcaaacacacaaaatgaatactagcgcctttccttcgaggagctcaaggcatttttcaaaatctgacagtttttctcacaacaaccctgtgagatttaggcctattaaaggaaggcaggaagaactaaaggaagtaattgaacgttttaagaaagatgaacacttggagaaagccttcaaatgtttgacttcaggcgaatgggcacggcactattttctcaacaagaataaaatgcaggagaaattattcaaagaacatgtatttatttatttgcgaatgtttgcaactgacagtggatttgaaatattgccatgtaatagatactcatcagaacaaaatggagccaaaatagttgcaacaaaagagtggaaacgaaatgacaaaatagaattactggtgggttgtattgccgaactttcagaaattgaggagaacatgctacttagacatggagaaaacgacttcagtgtcatgtactccacaaggaaaaactgtgctcaactctggctgggtcctgctgcgtttataaaccatgattgcagacctaattgtaagtttgtgtcaactggtcgagatacagcatgtgtgaaggctctaagagacattgaacctggagaagaaatttcttgttattatggagatgggttctttggagaaaataatgagttctgcgagtgttacacttgcgaaagacggggcactggtgcttttaaatccagagtgggactgcctgcgcctgctcctgttatcaatagcaaatatggactcagagaaacagataaacgtttaaataggcttaaaaagttaggtgacagcagcaaaaattcagacagtcaatctgtcagctctaacactgatgcagataccactcaggaaaaaaacaatgcaacttctaaccgaaaatcttcagttggcgtaaaaaagaatagcaagagcagaacgttaacgaggcaatctatgtcaagaattccagcttcttccaactctacctcatctaagctaactcatataaataattccagggtaccaaagaaactgaagaagcctgcaaagcctttactttcaaagataaaattgagaaatcattgcaagcggctggagcaaaagaatgcttcaagaaaactcgaaatgggaaacttagtactgaaagagcctaaagtagttctgtataaaaatttgcccattaaaaaagataaggagccagagggaccagcccaagccgcagttgccagcgggtgcttgactagacacgcggcgagagaacacagacagaatcctgtgagaggtgctcattcgcagggggagagctcgccctgcacctacataactcggcggtcagtgaggacaagaacaaatctgaaggaggcctctgacatcaagcttgaaccaaatacgttgaatggctataaaagcagtgtgacggaaccttgccccgacagtggtgaacagctgcagccagctcctgtgctgcaggaggaagaactggctcatgagactgcacaaaaaggggaggcaaagtgtcataagagtgacacaggcatgtccaaaaagaagtcacgacaaggaaaacttgtgaaacagtttgcaaaaatagaggaatctactccagtgcacgattctcctggaaaagacgacgcggtaccagatttgatgggtccccattctgaccagggtgagcacagtggcactgtgggcgtgcctgtgagctacacagactgtgctccttcacccgtcggttgttcagttgtgacatcagatagcttcaaaacaaaagacagctttagaactgcaaaaagtaaaaagaagaggcgaatcacaaggtatgatgcacagttaatcctagaaaataactctgggattcccaaattgactcttcgtaggcgtcatgatagcagcagcaaaacaaatgaccaagagaatgatggaatgaactcttccaaaataagcatcaagttaagcaaagaccatgacaacgataacaatctctatgtagcaaagcttaataatggatttaactcaggatcaggcagtagttcttaaaaaaaaaaaaaaaacgacatacgtgacagctcacttttcagttcattatatgtacgagggtagcagtgtgtgggatgaggttcgatacagcgtatttattgcttgtcatgtaaattaaaaaccttgtatttaactcttttcaatccttttagataaaattgttctttgcaagaatgattggtgcttattttttcaaaaatttgctgtgaacaacgtgatgacaacaagcaacatttatctaatgaactacagctatcttaatttggttcttcaagttttctgttgcacttgtaaaatgctacaaggaatattaaaaaaatctattcactttaacttataatagtttatgaaataaaaacatgagtcacagcttttgttctgtggtaacctataaaaaaagtttgtctttgagattcaatgtaaagaactgaaaacaatgtatatgttgtaaatatttgtgtgttgtgagaaatttttgtcataagaaattaaaagaacttaccaggaaggtttttaagtttagaaatattcatgccaataaaataggaaattataaatatatagttttaagcactgcatcagtgggagttcttggcttatgttagtttatgttagtttattatgaaaacatcaaagatttttttgactatattatcagttaaacaaaaaggagtcagatttaatttgttttttgaagcactttgagaaattaattttaattaacttaatgagcaaatttttattactactttatgttcaataccaggttcttttcatttctctggattattttgcaaatcattggacagagaatttgggaatataaatctgtaacaggtgtttgacaccagtaggtctctttatttctgggaaatgtgtacctgtactttctgatatacagtgttcctaagtaaaaatcaattcaggggatttgtatagtgtctataggaaagtagcccatgtcttgaaatatgaaaaggaatctgaaggtcatgaaaagtccagtggagaaaatctcaatgcttactgttactactaattgattcctactagtttccaggtttggggggatattgtttcaatgacgctccttaagactgttgattgcccataggttccaaatagaaattaagactcatgaacatttttagaaagtagattgttttctcctggttctctaaggaactacttctgcagtcttacatagtctcatccttgtttgttgtggtgcagtcgaactcctcaggcgtttggaaagcatgtggtagaccttcttccacacccacccatacccccgttcactgcgtctggaggtcttcaacagtgaagtagggcagcccacacagcctctcaggagcacctgtccgaggcacccggagcactttgcagagcacgtccagccctcatggggtccctgcatagaaatgtgaacccctgccactgaggaagatgaaggtagaccctgtgtctggaggtgctggagggcagcgggtcacctcttgtattcccaccttagtttggggtgttttgaagaggttcagagactaaatcttaaaccttatttgaataccaacgatagctattttgggaatttcgatcttaaaaagtgacaaaacacatttcccattttcatttttcagctgaattttagtaacttatttttgatgttttaattttatcatggcctcctctttggaggccaaccttcccatgggtctcaaagcagtgacatttggtagtaaatcactgcctctcaggagtcggtatgcacaagcactcagcagccactgttgatgccttctagggaaacctaatttccgttggtaaaggtaggggcctcggaactgttccggatctgctgtagaacttcaccgtgtggaatggtgacagccacacaccgttgaccagtttagaagaggttgcattcaataaaactcttagcttgagcttatgcaatgattggttaagattttggcattgtaagaattaggagatgatcatagaaatatatgtaaagtattcaattttcaatcattttcaaattactgttataaattgtttttgctgagttgtaatacttttgagatacaatgtattccttgtactgaaagaatgaaaaaggactttttcagcatttgaggtaagttctttaacgtttcattaaaaacattttttacaaatattttgtacatgcacttgcagtattgaggttaatcattttaataaattcggaaattaaaacaaaaaaac

SEQ ID NO: 103507 - DNA, 855 bp, Homo sapiens
agcaggagaagtatctaccttcatcttcctcagtggcaggcgttcacacttctatgcagggaccccatgcgggctggacgtgctggagggcagcgggtcacctcttgtattcccaccttagtttggggtgttttgaagaggttcagagactaaatcttaaaccttatttgaataccaacgatagctattttgggaatttcgatcttaaaaagtgacaaaacacatttcccattttcatttttcagctgaattttagtaacttatttttgatgttttaattttatcatggcctcctctttggaggccaaccttcccatgggtctcaaagcagtgacatttggtagtaaatcactgcctctcaggagtcggtatgcacaagcactcagcagccactgttgatgccttctagggaaacctaatttccgttggtaaaggtaggggcctcggaactgttccggatctgctgtagaacttcaccgtgtggaatggtgacagccacacaccgttgaccagtttagaagaggttgcattcaataaaactcttagcttgagcttatgcaatgattggttaagattttggcattgtaagaattaggagatgatcatagaaatatatgtaaagtattcaattttcaatcattttcaaattactgttataaattgtttttgctgagttgtaatacttttgagatacaatgtattccttgtactgaaagaatgaaaaaggactttttcagcatttgaggtaagttctttaacgtttcattaaaaacattttttacaaatattttgtacatgcacttgcagtattgaggttaatcattttaataaattcggaaattaaaacaaaaaaac

SEQ ID NO: 103508 - DNA, 1763 bp, Homo sapiens
cggacgcgtgggggcgcgacggcggcggcggcggccggttgggggcggggggctcggacgctgcggggactcatttttcccgtcagcggagcggagggagcggtgctgcggcccgcgccgccatcttggattttactctccatttttctctggaattatttttggtgattaattttctgggggggactgggacgcggggcccggcggcgcggccccgcatcgcagcggccgggcagcggggcctgggacgcgccccgaggaggagcggggcggcgcaggcggagagaacattgaaagtattctctaagctatttgaagagagtgactaaatgcacctgggtcaggctgtctgtgggtatgaagtggttgggagaatccaagaacatggtggtgaatggcaggagaaatggaggcaagttgtctaatgaccatcagcagaatcaatcaaaattacagcacacggggaaggacaccctgaaggctggcaaaaatgcagtcgagaggaggtcgaacagatgtaatggtaactcgggatttgaaggacagagtcgctatgtaccatcctctggaatgtccgccaaggaactctgtgaaaatgatgacctagcaaccagtttggttcttgatccctatttaggttttcaaacacacaaaatgaatactagcgcctttccttcgaggagctcaaggcatttttcaaaatctgacagtttttctcacaacaaccctgtgagatttaggcctattaaaggaaggcaggaagaactaaaggaagtaattgaacgttttaagaaagatgaacacttggagaaagccttcaaatgtttgacttcaggcgaatgggcacggcactattttctcaacaagaataaaatgcaggagaaattattcaaagaacatgtatttatttatttgcgaatgtttgcaactgacagtggatttgaaatattgccatgtaatagatactcatcagaacaaaatggagccaaaatagttgcaacaaaagagtggaaacgaaatgacaaaatagaattactggtgggttgtattgccgaactttcagaaattgaggagaacatgctacttagacatggagaaaacgacttcagtgtcatgtactccacaaggaaaaactgtgctcaactctggctgggtcctgctgcgtttataaaccatgattgcagacctaattgtaagtttgtgtcaactggtcgagatacagcatgtgtgaaggctctaagagacattgaacctggagaagaaatttcttgttattatggagatgggttctttggagaaaataatgagttctgcgagtgttacacttgcgaaagacggggcactggtgcttttaaatccagagtgggactgcctgcgcctgctcctgttatcaatagcaaatatggactcagagaaacagataaacgtttaaataggcttaaaaagttaggtgacagcagcaaaaattcagacagtcaatctgtcagctctaacactgatgcagataccactcaggaaaaaaacaatgcaaagaatcctgaagaaaagggaaggtgtttcccatgatggtgaatgtcactgccatgaattcctgaatctacctgctgctgggagtcagagtccaagcataacccgtgtagcataaaagcagcgctgtagccctattccagtctttttcgttaatgtccagagtgaacaacaagagttagtcaatcattaactgttgactgttgattctcataataaatgcagcataacgacca

SEQ ID NO: 103509 - DNA, 1182 bp, Homo sapiens
  misc_feature (21)..(21): n is a, c, g, or t
gcggcggtgcgggcggcaggncagcggggcgatgaggtgaggacgcccgggaaccggaggcggcaccgcgcggcgcacggacctgggacgcggagtcctgaagccggcggacggttttcgtacgggcggccgtgcgcgaggcgaggagagaacattgaaagtattctctaagctatttgaagagagtgactaaatgcacctgggtcaggctgtctgtgggtatgaagtggttgggagaatccaagaacatggtggtgaatggcaggagaaatggaggcaagttgtctaatgaccatcagcagaatcaatcaaaattacagcacacggggaaggacaccctgaaggctggcaaaaatgcagtcgagaggaggtcgaacagatgtatgtacacacttaaaccttcaatgttctgattgtgatatggggtagtaattctttccagtttgtaatgtgtattctgttttcttttgtcttaaataattttttgcattttcataattaacaatatagtctttttactctcaaagttgtgtcaatttttattctcatcaaactatataaaactcaagtttaatgcttcatataattattttaatcatgcttttctgtctgttactttatattttgtagaatttacctgaatggttgatatgtcttactaaatttttaaaattttaattgaacttcttacaggttaacctgtatttttttaatagatgtaagtataggtatgtacttctttgctaatttccacaaatgtttcatggaataatatgaataatgacgccaactgtaatttacataagtagaatgaggatagatagaactgactgctttagggcagcctcacaaatcatagcaatttattctatttatacagggtagacagttgttcatcctgacagtgaaacactgctgataagttactttatttcctctatacctcttgataggaaagaggctgctttttgagagttcaggaagttgtagatttggtgcgtatttcatagttcctctaaaagtagtaaaatgactgaggacaagtgtatacctaactaggcagctatatgtccaaacgtatgtcatgttaaagaggacagcttttcttctttttctaacgtgaatctagccacctttgaatatccttaattcagattggcattggcctgtttccagggattt

SEQ ID NO: 103510 - DNA, 506 bp, Homo sapiens
ccgtttctcagtgttccttggagagaagggggtgggggagagtcaagcatttgaaccaaattctcacgactacccagaccccattcttgggaacctgctattactacctgctaacgataatactctcagtaatggagatagtttactgcatttggttttctgtcttatgcaaaggttattaaattcttaattactaaaatgattgatttttcagttctttattaccagcttgaatgggcaatgccgctaaagattttaaggcagatttaagtagttttcaatttgagtaatttttcttgcttttgcttttcacaggtaatggtaactcgggatttgaaggacagagtcgctatgtaccatcctctggaatgtccgccaaggaactctgtgaaaatgatgacctagcaaccagtttggttcttgatccctatttaggttttcaaacacacaaaatgaatactaggtaattttcagtctttatcctgaatggaacagatgattatgtt

SEQ ID NO: 103511 - DNA, 5465 bp, Homo sapiens
ggactgaagagctgatctgcgactcctcactcagcgtctacaaactgtggatttgcagctaaactttcttcagagggggaaatgtgttcactatgttgcctcatggttttattttatatcttaaatatttgagcatttttctctcttcctctctccttccctgtctcccttttttctgttccccttcctgttccccacccctccagtcagctcttgattgtgcatgctaatgaagggcacagtagcacagctaatacagtctacaacttttcttcactgccacagtggggagacagaaaaaccaaatagcaagaaaacctgggaagtgagtctctggaaagagtggggaacagatttaggcctattaaaggaaggcaggaagaactaaaggaagtaattgaacgttttaagaaagatgaacacttggagaaagccttcaaatgtttgacttcaggcgaatgggcacggcactattttctcaacaagaataaaatgcaggagaaattattcaaagaacatgtatttatttatttgcgaatgtttgcaactgacagtggatttgaaatattgccatgtaatagatactcatcagaacaaaatggagccaaaatagttgcaacaaaagagtggaaacgaaatgacaaaatagaattactggtgggttgtattgccgaactttcagaaattgaggagaacatgctacttagacatggagaaaacgacttcagtgtcatgtactccacaaggaaaaactgtgctcaactctggctgggtcctgctgcgtttataaaccatgattgcagacctaattgtaagtttgtgtcaactggtcgagatacagcatgtgtgaaggctctaagagacattgaacctggagaagaaatttcttgttattatggagatgggttctttggagaaaataatgagttctgcgagtgttacacttgcgaaagacggggcactggtgcttttaaatccagagtgggactgcctgcgcctgctcctgttatcaatagcaaatatggactcagagaaacagataaacgtttaaataggcttaaaaagttaggtgacagcagcaaaaattcagacagtcaatctgtcagctctaacactgatgcagataccactcaggaaaaaaacaatgcaacttctaaccgaaaatcttcagttggcgtaaaaaagaatagcaagagcagaacgttaacgaggcaatctatgtcaagaattccagcttcttccaactctacctcatctaagctaactcatataaataattccagggtaccaaagaaactgaagaagcctgcaaagcctttactttcaaagataaaattgagaaatcattgcaagcggctggagcaaaagaatgcttcaagaaaactcgaaatgggaaacttagtactgaaagagcctaaagtagttctgtataaaaatttgcccattaaaaaagataaggagccagagggaccagcccaagccgcagttgccagcgggtgcttgactagacacgcggcgagagaacacagacagaatcctgtgagaggtgctcattcgcagggggagagctcgccctgcacctacataactcggcggtcagtgaggacaagaacaaatctgaaggaggcctctgacatcaagcttgaaccaaatacgttgaatggctataaaagcagtgtgacggaaccttgccccgacagtggtgaacagctgcagccagctcctgtgctgcaggaggaagaactggctcatgagactgcacaaaaaggggaggcaaagtgtcataagagtgacacaggcatgtccaaaaagaagtcacgacaaggaaaacttgtgaaacagtttgcaaaaatagaggaatctactccagtgcacgattctcctggaaaagacgacgcggtaccagatttgatgggtccccattctgaccagggtgagcacagtggcactgtgggcgtgcctgtgagctacacagactgtgctccttcacccgtcggttgttcagttgtgacatcagatagcttcaaaacaaaagacagctttagaactgcaaaaagtaaaaagaagaggcgaatcacaaggtatgatgcacagttaatcctagaaaataactctgggattcccaaattgactcttcgtaggcgtcatgatagcagcagcaaaacaaatgaccaagagaatgatggaatgaactcttccaaaataagcatcaagttaagcaaagaccatgacaacgataacaatctctatgtagcaaagcttaataatggatttaactcaggatcaggcagtagttctacaaaattaaaaatccagctaaaacgagatgaggaaaatagggggtcttatacagaggggcttcatgaaaatggggtgtgctgcagtgatcctctttctctcttggagtctcgaatggaggtggatgactatagtcagtatgaggaagaaagtacagatgattcctcctcttctgagggcgatgaagaggaggatgactatgatgatgactttgaagacgattttattcctcttcctccagctaagcgcttgaggttaatagttggaaaagactctatagatattgacatttcttcaaggagaagagaagatcagtctttaaggcttaatgcctaagctcttggtcttaacttgacctgggataactactttaaagaaataaaaaattccagtcaattattcctcaactgaaagtttagtggcagcacttctattgtcccttcacttatcagcatactattgtagaaagtgtacagcatactgactcaattcttaagtctgatttgtgcaaatttttatcgtactttttaaatagccttcttacgtgcaattctgagttagaggtaaagccctgttgtaaaataaaggctcaagcaaaattgtacagtgatagcaactttccacacaggacgttgaaaacagtaatgtggctacacagtttttttaactgtaagagcatcagctggctctttaatatatgactaaacaataatttaaaacaaatcatagtagcagcatattaagggtttctagtatgctaatatcaccagcaatgatctttggctttttgatttatttgctagatgtttcccccttggagttttgtcagtttcacactgtttgctggcccaggtgtactgtttgtggcctttgttaatatcgcaaaccattggttgggagtcagattggtttcttaaaaaaaaaaaaaaaacgacatacgtgacagctcacttttcagttcattatatgtacgagggtagcagtgtgtgggatgaggttcgatacagcgtatttattgcttgtcatgtaaattaaaaaccttgtatttaactcttttcaatccttttagataaaattgttctttgcaagaatgattggtgcttattttttcaaaaatttgctgtgaacaacgtgatgacaacaagcaacatttatctaatgaactacagctatcttaatttggttcttcaagttttctgttgcacttgtaaaatgctacaaggaatattaaaaaaatctattcactttaacttataatagtttatgaaataaaaacatgagtcacagcttttgttctgtggtaacctataaaaaaagtttgtctttgagattcaatgtaaagaactgaaaacaatgtatatgttgtaaatatttgtgtgttgtgagaaatttttgtcataagaaattaaaagaacttaccaggaaggtttttaagtttagaaatattcatgccaataaaataggaaattataaatatatagttttaagcactgcatcagtgggagttcttggcttatgttagtttatgttagtttattatgaaaacatcaaagatttttttgactatattatcagttaaacaaaaaggagtcagatttaatttgttttttgaagcactttgagaaattaattttaattaacttaatgagcaaatttttattactactttatgttcaataccaggttcttttcatttctctggattattttgcaaatcattggacagagaatttgggaatataaatctgtaacaggtgtttgacaccagtaggtctctttatttctgggaaatgtgtacctgtactttctgatatacagtgttcctaagtaaaaatcaattcaggggatttgtatagtgtctataggaaagtagcccatgtcttgaaatatgaaaaggaatctgaaggtcatgaaaagtccagtggagaaaatctcaatgcttactgttactactaattgattcctactagtttccaggtttggggggatattgtttcaatgacgctccttaagactgttgattgcccataggttccaaatagaaattaagactcatgaacatttttagaaagtagattgttttctcctggttctctaaggaactacttctgcagtcttacatagtctcatccttgtttgttgtggtgcagtcgaactcctcaggcgtttggaaagcatgtggtagaccttcttccacacccacccatacccccgttcactgcgtctggaggtcttcaacagtgaagtagggcagcccacacagcctctcaggagcacctgtccgaggcacccggagcactttgcagagcacgtccagccctcatggggtccctgcatagaaatgtgaacccctgccactgaggaagatgaaggtagaccctgtgtctggaggtgctggagggcagcgggtcacctcttgtattcccaccttagtttggggtgttttgaagaggttcagagactaaatcttaaaccttatttgaataccaacgatagctattttgggaatttcgatcttaaaaagtgacaaaacacatttcccattttcatttttcagctgaattttagtaacttatttttgatgttttaattttatcatggcctcctctttggaggccaaccttcccatgggtctcaaagcagtgacatttggtagtaaatcactgcctctcaggagtcggtatgcacaagcactcagcagccactgttgatgccttctagggaaacctaatttccgttggtaaaggtaggggcctcggaactgttccggatctgctgtagaacttcaccgtgtggaatggtgacagccacacaccgttgaccagtttagaagaggttgcattcaataaaactcttagcttgagcttatgcaatgattggttaagattttggcattgtaagaattaggagatgatcatagaaatatatgtaaagtattcaattttcaatcattttcaaattactgttataaattgtttttgctgagttgtaatacttttgagatacaatgtattccttgtactgaaagaatgaaaaaggactttttcagcatttgaggtaagttctttaacgtttcattaaaaacattttttacaaatattttgtacatgcacttgcagtattgaggttaatcattttaataaattcggaaattaaaacaaaaaaac

SEQ ID NO: 103512 - DNA, 2796 bp, Homo sapiens
cggacgcgtgggggcgcgacggcggcggcggcggccggttgggggcggggggctcggacgctgcggggactcatttttcccgtcagcggagcggagggagcggtgctgcggcccgcgccgccatcttggattttactctccatttttctctggaattatttttggtgattaattttctgggggggactgggacgcggggcccggcggcgcggccccgcatcgcagcggccgggcagcggggcctgggacgcgccccgaggaggagcggggcggcgcaggcggagagaacattgaaagtattctctaagctatttgaagagagtgactaaatgcacctgggtcaggctgtctgtgggtatgaagtggttgggagaatccaagaacatggtggtgaatggcaggagaaatggaggcaagttgtctaatgaccatcagcagaatcaatcaaaattacagcacacggggaaggacaccctgaaggctggcaaaaatgcagtcgagaggaggtcgaacagatgtaatggtaactcgggatttgaaggacagagtcgctatgtaccatcctctggaatgtccgccaaggaactctgtgaaaatgatgacctagcaaccagtttggttcttgatccctatttaggttttcaaacacacaaaatgaatactagcgcctttccttcgaggagctcaaggcatttttcaaaatctgacagtttttctcacaacaaccctgtgagatttaggcctattaaaggaaggcaggaagaactaaaggaagtaattgaacgttttaagaaagatgaacacttggagaaagccttcaaatgtttgacttcaggcgaatgggcacggcactattttctcaacaagaataaaatgcaggagaaattattcaaagaacatgtatttatttatttgcgaatgtttgcaactgacagtggatttgaaatattgccatgtaatagatactcatcagaacaaaatggagccaaaatagttgcaacaaaagagtggaaacgaaatgacaaaatagaattactggtgggttgtattgccgaactttcagaaattgaggagaacatgctacttagacatggagaaaacgacttcagtgtcatgtactccacaaggaaaaactgtgctcaactctggctgggtcctgctgcgtttataaaccatgattgcagacctaattgtaagtttgtgtcaactggtcgagatacagcatgtgtgaaggctctaagagacattgaacctggagaagaaatttcttgttattatggagatgggttctttggagaaaataatgagttctgcgagtgttacacttgcgaaagacggggcactggtgcttttaaatccagagtgggactgcctgcgcctgctcctgttatcaatagcaaatatggactcagagaaacagataaacgtttaaataggcttaaaaagttaggtgacagcagcaaaaattcagacagtcaatctgtcagctctaacactgatgcagataccactcaggaaaaaaacaatgcaagtaagtaagggagatttgataagcatatcttttaaaagtattttcacacaatttgctttataaagtgtgcttcagtagttttaaacttttaaatactcagagagactgggacttgtgagctttggctgcacttcaaggctctagacgtgatttgagtagaggcacagtctgtatcccatctctaacttcagtaccgtcctctagactatttttcttgaataccttggtaactggatatgagttcttcatcatatgttccaaggtcatcatatgttttaaacattttcaaggtgttagagactgtgatgatgtcgctaagtcctgcaagaagacaaaaggactgagtagaattaaattagactctatacattccagtgcctagccagtttgttagaaaagatgatggacttggggaattcatagcttctggccttaaggcttccaccttttcattgcttgctgacctttttcaaaacgaactgactcagttcagcagaccaccagtaccagactcagaattgtgatagaggagcattttgaacagtgccgtattgtgacatgctgtattggctactccagaaagtaggagtaaagatggaaaggagaaagaagcaacctctgagattccagtggtgtgtgggggcaagatctgatggaaactgaaaaagagaacgaagactaaacaaagagaaaggaaagagaagaaaccctaaatgggcaaaggaaagcacatcctgtttgcggagctttgaaatattggaaccatttctaattgctcctgtttttctgggtaacaccagttttctgtagttgccactaaagcagtagactcttgagtctcacttgtctctgagagagacagaagttagaaagttttgacttggcgattccgaaagtatgcctttgttggcacttaaatgtccagtgagacttcttggcaccttagagccctctgagatactgattattttaggttcttctccctactttcagatgttttcagcccaacactgggtgctctcttccactacagagaatcctgaagaaaagggaaggtgtttcccatgatggtgaatgtcactgccatgaattcctgaatctacctgctgctgggagtcagagtccaagcataacccgtgtagcataaaagcagcgctgtagccctattccagtctttttcgttaatgtccagagtgaacaacaagagttagtcaatcattaactgttgactgttgattctcataataaatgcagcataacgacca

SEQ ID NO: 103513 - DNA, 3085 bp, Homo sapiens
cggacgcgtgggggcgcgacggcggcggcggcggccggttgggggcggggggctcggacgctgcggggactcatttttcccgtcagcggagcggagggagcggtgctgcggcccgcgccgccatcttggattttactctccatttttctctggaattatttttggtgattaattttctgggggggactgggacgcggggcccggcggcgcggccccgcatcgcagcggccgggcagcggggcctgggacgcgccccgaggaggagcggggcggcgcaggcggagagaacattgaaagtattctctaagctatttgaagagagtgactaaatgcacctgggtcaggctgtctgtgggtatgaagtggttgggagaatccaagaacatggtggtgaatggcaggagaaatggaggcaagttgtctaatgaccatcagcagaatcaatcaaaattacagcacacggggaaggacaccctgaaggctggcaaaaatgcagtcgagaggaggtcgaacagatgtaatggtaactcgggatttgaaggacagagtcgctatgtaccatcctctggaatgtccgccaaggaactctgtgaaaatgatgacctagcaaccagtttggttcttgatccctatttaggttttcaaacacacaaaatgaatactagcgcctttccttcgaggagctcaaggcatttttcaaaatctgacagtttttctcacaacaaccctgtgagatttaggcctattaaaggaaggcaggaagaactaaaggaagtaattgaacgttttaagaaagatgaacacttggagaaagccttcaaatgtttgacttcaggcgaatgggcacggcactattttctcaacaagaataaaatgcaggagaaattattcaaagaacatgtatttatttatttgcgaatgtttgcaactgacagtggatttgaaatattgccatgtaatagatactcatcagaacaaaatggagccaaaatagttgcaacaaaagagtggaaacgaaatgacaaaatagaattactggtgggttgtattgccgaactttcagaaattgaggagaacatgctacttagacatggagaaaacgacttcagtgtcatgtactccacaaggaaaaactgtgctcaactctggctgggtcctgctgcgtttataaaccatgaagctgtgtttccaaggtgttggcgctagtgttggccattcctgctaactgctagaatggccttgtcaacctcagtcaaacctttatcttcctttaaaggagaatttgaaatagaaatgtttccacaaacttattaaaataaatgtatattcctttagttgaacttgagacctaaactcctatcaaaagttgtaaagttatatggaaagcttatttcagatttctataattgttcgtgtttcagatcttatcaacagttaattgactttatcttttggacatttttcagattgcagacctaattgtaagtttgtgtcaactggtcgagatacagcatgtgtgaaggctctaagagacattgaacctggagaagaaatttcttgttattatggagatgggttctttggagaaaataatgagttctgcgagtgttacacttgcgaaagacggggcactggtgcttttaaatccagagtgggactgcctgcgcctgctcctgttatcaatagcaaatatggactcagagaaacagataaacgtttaaataggcttaaaaagttaggtgacagcagcaaaaattcagacagtcaatctgtcagctctaacactgatgcagataccactcaggaaaaaaacaatgcaagtaagtaagggagatttgataagcatatcttttaaaagtattttcacacaatttgctttataaagtgtgcttcagtagttttaaacttttaaatactcagagagactgggacttgtgagctttggctgcacttcaaggctctagacgtgatttgagtagaggcacagtctgtatcccatctctaacttcagtaccgtcctctagactatttttcttgaataccttggtaactggatatgagttcttcatcatatgttccaaggtcatcatatgttttaaacattttcaaggtgttagagactgtgatgatgtcgctaagtcctgcaagaagacaaaaggactgagtagaattaaattagactctatacattccagtgcctagccagtttgttagaaaagatgatggacttggggaattcatagcttctggccttaaggcttccaccttttcattgcttgctgacctttttcaaaacgaactgactcagttcagcagaccaccagtaccagactcagaattgtgatagaggagcattttgaacagtgccgtattgtgacatgctgtattggctactccagaaagtaggagtaaagatggaaaggagaaagaagcaacctctgagattccagtggtgtgtgggggcaagatctgatggaaactgaaaaagagaacgaagactaaacaaagagaaaggaaagagaagaaaccctaaatgggcaaaggaaagcacatcctgtttgcggagctttgaaatattggaaccatttctaattgctcctgtttttctgggtaacaccagttttctgtagttgccactaaagcagtagactcttgagtctcacttgtctctgagagagacagaagttagaaagttttgacttggcgattccgaaagtatgcctttgttggcacttaaatgtccagtgagacttcttggcaccttagagccctctgagatactgattattttaggttcttctccctactttcagatgttttcagcccaacactgggtgctctcttccactacagagaatcctgaagaaaagggaaggtgtttcccatgatggtgaatgtcactgccatgaattcctgaatctacctgctgctgggagtcagagtccaagcataacccgtgtagcataaaagcagcgctgtagccctattccagtctttttcgttaatgtccagagtgaacaacaagagttagtcaatcattaactgttgactgttgattctcataataaatgcagcataacgacca

SEQ ID NO: 103514 - DNA, 876 bp, Homo sapiens
cggacgcgtgggggcgcgacggcggcggcggcggccggttgggggcggggggctcggacgctgcggggactcatttttcccgtcagcggagcggagggagcggtgctgcggcccgcgccgccatcttggattttactctccatttttctctggaattatttttggtgattaattttctgggggggactgggacgcggggcccggcggcgcggccccgcatcgcagcggccgggcagcggggcctgggacgcgccccgaggaggagcggggcggcgcaggcggagagaacattgaaagtattctctaagctatttgaagagagtgactaaatgcacctgggtcaggctgtctgtgggtatgaagtggttgggagaatccaagaacatggtggtgaatggcaggagaaatggaggcaagttgtctaatgaccatcagcagaatcaatcaaaattacagcacacggggaaggacaccctgaaggctggcaaaaatgcagtcgagaggaggtcgaacagatgtaatggtaactcgggatttgaaggacagagtcgctatgtaccatcctctggaatgtccgccaaggaactctgtgaaaatgatgacctagcaaccagtttggttcttgatccctatttaggttttcaaacacacaaaatgaatactagcgcctttccttcgaggagctcaaggcatttttcaaaatctgacagtttttctcacaacaaccctgtgagatttaggcctattaaaggaaggcaggaagaactaaaggaagtaattgaacgttttaagaaagatgaacacttggagaaagccttcaaatgtttgacttcaggcgaatgggcacgacagcccaaaacggtaccgagctcgatt

SEQ ID NO: 103515 - DNA, 259 bp, Homo sapiens
gtcatcagctccacgcatctcagcaacggacactttcgcaacatcaagggagttttccggggccctctcagcaagaacgggaacaaaactctggactatgctgagaaggaaaataccatagcaaaagctctggaagatctgaaggcaaatttttactgtgaactctgtgacaagcagtactataagcaccaggagtttgacaatcacattaattcatatgaccatgctcacaagcaggtaagaaagagatgtgaaaaaa

SEQ ID NO: 103516 - DNA, 920 bp, Homo sapiens
gtcatcagctccacgcatctcagcaacggacactttcgcaacatcaagggagttttccggggccctctcagcaagaacgggaacaaaactctggactatgctgagaaggaaaataccatagcaaaagctctggaagatctgaaggcaaatttttactgtgaactctgtgacaagcagtactataagcaccaggagtttgacaatcacattaattcatatgaccatgctcacaagcaggtgggattctaagatggccatcaagattaccagtacccctaatgtatacacctcatcaatcagacattaatttattttctactgtgaagtaattttgcgatacaattaagatctcaaatcagctaagtttaacattgtcccattggggctaatctaattccctgagctctttaaaaatgtggagttttctgtggctgctctaaaaagaggaagccagagatttgaagcatgagaagaatttgacacatgagaaattccccagtgctggctttgaagatggaaggagcaacataacaaagaatgaggcagcatgcagtagataagggagatctctgactgacagccaacaagaaaacaggtatctcagacctccagccatgaagaactgaatcctgccaacaacatgagtaagctcagaaacagatatttctccagagcttccagatgagaacccagtctttgatcccagtcatatataccctgaggagagaacacagccactgtgcctcacttttcatctatgaaactgtgacaatctatgaaacatggattattttaagccatttagtttctgttaattttttacacagcagtagaaaactagcacattctctcaccatcctgtatttgttatgttaaactctaaaaattacttctacattctcatgtcattgtttctgact

SEQ ID NO: 103517 - DNA, 756 bp, Homo sapiens
gtcattcttaaccacagatcttagcaatctcggcatatgatttcttttctttccttattgagaaccttcaccttttcatttaaagggaacactttacagcttctctttggcatatatgaattgccagagtcactattcttgtactttggggccattaggaagtaaaatagggtgacttgaatacaagcactgtgatatcgtcacagccaatctgataaccaagaaggttactaagtgactaatgggcagggagcgcctacagtgtggttcagctggacaaaaggaggactcacatcctgtgcgggagggagcaggatggcacgagatttcatcacgctactcaaatggcatgcaatttaaaacttatgaattgtttatttctggaattgtccatttaatattttcagactgtggttgaccgaatgtaactgaaacaacgaaaagggaaaccatagagaaaggggagctgctatagttgttttttttaaaccattatgaacacatggatttaaatatctttgaagggtttcattctatcgtaattattatccttaatgaagctcaagttgtcccatcttggccaaaattgcctcttgtgtccccttggcagaactgtagttgtctttgttagcttccttgctatcttgtatgacaagatgctataaagtatatcactgacttttggtaggatgtgatattgacttaggaatagacaaatatgttgatggaaataaggaatgggataattcataaggt

SEQ ID NO: 103518 - DNA, 233 bp, Homo sapiens
acattattgaatcctctccattctcctggctcttatgcagattacacctgttgcctggtctactcctgggtcagattctttgtcattccctctggcaggaaaaccttttgtcttttctccatccgccctgtaaatgcctatttatccttcaaactatggtatcctttcttccaaagacccttttctaatcttctgtttccttcctcccaccaggctagacactgtcagccaac

SEQ ID NO: 103519 - DNA, 393 bp, Homo sapiens
atcaatcattaaaaaaatttttttaaagaaatatggtcttgctacattggccaggctggtcttgaactcctggcctcaagggatcctcccacctcagcctcctaaagagctaggattacaggtgtgagccactgcactggccaaaggcccctttttaactatatggaattggctggccccaaagaaaattgtgaagtagaccaaacctttctaggcatttctaggcctgagtatgcaggcctctttaggaatttgatgctgaggccaggattaaaatcattgcaaggacctttcctacccttcagaccgctttgtatgtgccctatgataaaaattctactaatgtgagtttggtatatttagagctgatctttggtcattcataactaccct

SEQ ID NO: 103520 - DNA, 411 bp, Homo sapiens
cacacgccaccatgcccggctgattttttttttctatttctagtagagacggggtttcaccacattggccaggctggtcttgaactcctggcctcaagggatcctcccacctcagcctcctaaagagctaggattacaggtgtgagccactgcactggccaaaggcccctttttaactatatggaattggctggccccaaagaaaattgtgaagtagaccaaacctttctaggcatttctaggcctgagtatgcaggcctctttaggaatttgatgctgaggccaggattaaaatcattgcaaggacctttcctacccttcagaccgctttgtatgtgccctatgataaaaattctactaatgtgagtttggtatatttagagctgatctttggtcattcataactaccct

SEQ ID NO: 103521 - DNA, 798 bp, Homo sapiens
gtggttcatgcctgtgttcccagctattcaggaggctgaggtgggaggattgcttgagcctaggaggtcgaggctgcagtgggatgtgatcataccactgtactgcagtctgggccacacagaaagactgtctccagaaaaaaaaaagttctttggagaagccacagaccacctgtcttcaggcgcctccttcaactcctgagtcccagccagccgctcccaggggcctgcacacatggagaggcctccctgatcctgggtgcttctcgtggagtacaagccggactgtgctgaggttgggacagagccccctcccctgcagaggcagaaggaagcagcgtgcgtcctgtctccttccaggctgtgggcctgcccttcagttatttatagctggagctggagaggctggctcagatgaggagtgaccccgggggcacacaggctccacactgccacccagcttccaaggctgagtctcctccctaacggggaagtgacggggttttgtctctatcatctcaggcgtcaaccacatgcacacacacactgtcacgttctgtggcgctaacagcatcctgatcctgacggacttcaccggggctctccaggcatctcttctgacaaacactgcaggaggtgagggtgtctgacgtgcactgagggcagaggcccccttattcctgaggcggctacagctcaccgtggggaagatcaactgtggtgatgtttttgggacagtttcttggcaaaggtggccgcgctgtcagtaccaagtagctggaggtggtgatcagatga

SEQ ID NO: 103522 - DNA, 292 bp, Homo sapiens
caaagataacctagaactcctcctgatgaaccattacatcaaaccagggctgaaaaacaacttcaaagaaacggcatttgatattgccaggaggacaagtatctatcactccttctttgtaatggtggaaggctatacaaattcttcacctcagtcttaatggttctagtaattttaggtgtctaagtaccagtggctccttcgtgcaagatataaaatattcccataagacaaagttgatttaaaacgtcttactacaaaaattcagtggtaaggtagttactattatgtt

SEQ ID NO: 103523 - DNA, 633 bp, Homo sapiens
acatcatggtgtctagactcaacgggctgaaggtgttcagaaaggtgagctaaaacaggaagtgggggctgggtgcggtggctcacacctataatcctagcactttgggaggccgaggcaggcagatcacttgaggtcaggagttcaaaaccagcctggtcacatggtgaaacccggtctccactaaaaatacaaaacaattagctgggtgtggtggtgggtgcctgtaatcccagctactagggaggctgaggcaggagactcgcttgaacctgggaggcagagattgcagtgagcggagatcagcccactgcactccaacgtgggcaacaaagcgagactctatctcaaacaacaacaacaacaacagcaacaacaaccaggaagtggggccattgcagaaaaggagcaagactccagctactgggtgacattgggggcaggttttgctgggaaagagaaagagagctcttccctctaccctccagtcgcactccctccagccaggtgccccaacctgggagtcagcataaccgctcttattctcacccgaccggtcccctcttatctacttcctgaggctgcatgggcagcgtctctgtctctcagtcctcactgccactctgcagctca

SEQ ID NO: 103524 - DNA, 169 bp, Homo sapiens
ctcttcacggactctgagatgttagtgatctccaggattctgtcttcggccttattctttagtcattctctgggctctccgtgggctacagcagctatggcttcattagtcattgtagctcactacctgagctatcatctcagaactacacatttccatctgcaagttc

SEQ ID NO: 103525 - DNA, 207 bp, Homo sapiens
agtcagtgatgtcatgtgagaaggtcttgaccaggttgctggatttgaagatggaaggaaactaagcaaaggactctagaagcagggaacagcaagattctctcttggaagcatccaggaaatgcctcctacattctgtagcccaccaagactaagatctttgctgaatgtctgactgacagagctgtaagataataaatttgtgtt

SEQ ID NO: 103526 - DNA, 225 bp, Homo sapiens
gcagaggctactgctcaccactagtgtaggaggaccagtgacagaggtgtcagaagcttccctggcaggacctgctcatcctcctggaccttgtagttttgtggaatccacaaggcaaggcagacagatccagcaaacatcagcttgaaagtaccagggacaagcagagggagtagaggtcatgggctctgttctctaagttcactgttcactttggaagtcaag

SEQ ID NO: 103527 - DNA, 1069 bp, Homo sapiens
cctcaggtctaggtcacatttgtttcatgctttcacagcggtggtgtagtgtatactggttcttcttatccctcaggtgtctcctcacaaggactgctctgtttctgctaagtgttgcattctcaccacccagtggaggctttggcctgtggaagattctaattttggtggccagcctcatgggttgaaaagtaaaggtcaagtagttaaaggaagggcgttccaggcagagggatcagcgtaggtgcagaggtaaggtagggatagctttgagggctccttaggagggagtgaaacccctgagggtcaaggagccctagtttggaaggccttgctactaagggatctggattttgtcctgaagcctagagtagtttctttaagagtctgatctcggcaggcctagagtagtttctttaagagtctgatctcggccaggcctagagtagtttctttaagagtctgatctcggccaggcgcagtggctcacgcctgtaatcccagtacttcggaaggccaaggcaggcagatcacgaggtcaggagttccagaccatcctggctaacacggtgaaacccgtctctactaaaaatacaaaaaattagctgggcctggtggcacgtgcctgtagtcccagctactcgggaggctgaggcaggagaattgcttgaaccggggaggtggaggttgtagtgagcagagatcatgccactgcactgcagcctgggtgataagagtgagactccatctcaacaacaacaaaaaaagtctgatctcagcactgtcctgcctagactgcttctttttttaggacaagtttttattgctacctgctaaaaacgcacttattgtcacggtgcaggctaggttggaggagtaaaactagagacaagaagagttaagaagccactgcagtattcaagacaaatgagtcaagccaaaggctgagatgctgtacaggaaggtctctagggggaccctaaatttagctgggggtggtggtgcaagattcctacgaagtggcactaaaggagggactgagtacttactaaagaccttatgactaaga

SEQ ID NO: 103528 - DNA, 394 bp, Homo sapiens
caggagtgacaaagccccattaacattcttctttgtaggaaacacattatccctatggggtctttctcaccaagactagcagctctagctcttagtatcatgactgacccttgcatacatcttggaaaaatggggattagtaagtgcaaataatgatcaagacttctccggggctgatatataaaggaaatgatgatcactcctgagaaatgctcaactagaggcaattcagtacataatgaatcttacaggtacaaaaagtccactaaacttacatacgtatttgtgtggtttcacttgattttttgtttttttagagatggagtcttgctctgtcacccaggctggagtgcagtggcacgatctcccctacctgcgtgagagagggaagatg

SEQ ID NO: 103529 - DNA, 828 bp, Homo sapiens
gggacactggtatatcagaatggtccatgcagtacttttttaaaaatcttttttctttgtacaagttgagccacatgacttcatattagattgtggactttattttaggtagggagaatatatatttgtctttttctaaagctgagaagtaatttttaaccagatgctaaaagtcatcttgaaaagatgacattttccaagtgctttgatgattttattttgctataaatgaataatttatctgtttaataaaatcttttcatttgacacaatgactataataaaagtgacaataaatatatgcctgcccctcccacattaacaatgccttttgtgtactaatatttagaataactaatataggtagaggaaaacaagtatggtccttgaaggaatcaataataattagatttgagaagaaaagaagtgaaatgaagttttaataatttttgtatgtttgtttgtggtaattttgggcagtataaaggagacatatgcagcatacttgaaacttctatttttatgcctattgaacaggagtagtagaaaaaggtctaagagatagttgagatatgccccagtatgactaggtatgattttccatacattgttagaagaaaagtctgtaagactccctcctaagagggactttcgtattcacaggtgaagcatcatgttttcaatgtgtgctgagcacctactgttgtaccagccagtgttttaggttctggaattctaggagtggccagtatctggtgatatctgattatctccgtagatgacagagaaaagtccttaaacaacatttatacctatttaaacaaatac

SEQ ID NO: 103530 - DNA, 240 bp, Homo sapiens
cctaaagacaaaccaaagccaagaaaaacaaaatcaaaagcattacacaatgctatgaatatatttaatacctctgaaatgtatgcttaaaaattgttaagatgacaaagaggcaagacatttcaccctggagtgatgggaatgttttgcacttacgtagagatgagattgcacaacatcgtggatgtgctaaatgccactaaattgttcactttaaaatgatcgattttatgttctgtg

SEQ ID NO: 103531 - DNA, 485 bp, Homo sapiens
tcaacctctctgtgttcattttctaatgtgtaaattaggggtaataccattacctatttccttgagtaattgtgaaaattaaatgaaataataaatgtaaagctcttagaattgtccttacagtaaatgttagctgcttcaactatttctgctactaccaccaccactactgcttccaccacactaccaccagtctttccaacatcaatagtgaatgcattttgtctaaatactacgatgaatacaaaaaatatggagctcagtgtctgccctctagaaacttaaaatgtagttagggctaacagacaaaaacaaatgcataaataagtcaactatatgaggctgtctaatttgaattgaggcttaagtgatgggtagtatagaaacttagtgcaaggaaaaagtatttttgaattgacactaccatggaaaacttcatggataagattcaggaaactagatggattgtagattttaggtaattg

SEQ ID NO: 103532 - DNA, 310 bp, Homo sapiens
caccctcctcggcctcccaaagtgctgggattacaggcgtgaaccaccttgctcagtcaagatattttaaatggttagttcgtaaggtctttttgaaatgcttaatgtgtctttttgtgtgtactgagcttacttaaataggattcagttatacgtgcaattaaagtatcagactaaaaaaataaaatctaaaaaacctttataatcaagtgatcacatatacctacctgtaatttaggtaattcaaaactggtattttatttactaacttttgcaactataacttatactatgtgaattagttataaag

SEQ ID NO: 103533 - DNA, 344 bp, Homo sapiens
ctcagtgatctctgtaaccggagtagctggggctataggtgtgcaccaccacagccagctaatttttataacatgattttttattcaatatatctgtggaataaagtcctagaattggaattgctgggtgaaagtgtttgtgtattagtccttcagagtattttaccaattaacactctaagcagcgatataaagaaagtgcacaaaatactttcaacaattttaaggagttactgaatttactggctattctgcccattgttatctgtaactatcctgaagaaccaagaatccatttatttgataagcaaaaccaacatttgcattgaggggctcttttctta

SEQ ID NO: 103534 - DNA, 750 bp, Homo sapiens
ctggtctcgaactcctgacctcaagtgatccacctgcctcagcctccaaaagtgctgggattacaggcatgagccaccgcaccaggtcagaaactcactttaaatataatggtataggtaagttaaaagaaaggaaaaaaatacaccatacacacacaaatcaaaagatggagtagctatatgactatcaggtaaaatagacttcagagcaaggaaaaatgccagagataaagagggacattacataacgataaaagtgtagattcaccaaaacgacataattctagatgtgcatgcaacaatcagaattttgaaatatataaaacaaaaatttatagaactaaaaggaaaaatgggtaaatccacaattttggttgcacatttcaacattcttctctcagtaatcagcagaaaagacaatcagcaaaggatagagaaaaatgtaataatactatcaactaactagatctataaatgatatttatactataccccacccaacaatggcagaatacacatgcttttcaagtacaaatggaacatgcaccaagtctgaccatatcctaggtcaaactttgtatgatttaagtttgacctaggtcaaacttacatacaaagggtgttctctgaccacgatgttattatattgaaatcaataacataaatatattataaaatatttatctctgtcttgatacaatctcataaaagtaaagcacgtttcctctgagtctataataatgaactgtt

SEQ ID NO: 103535 - DNA, 267 bp, Homo sapiens
ccctcttcctatccttcctccttcttcttctgtactttttcctgctttttctgtttttcgttttcttttcctatcccgcgtgaaactagaacgtgaactggggtgtatgtttgtgtggatggaggggcacagggaggaggggactctccaaatgccccagcttagcacgaggagaaactccatgttttcatttaaacaacctttccccacatctaggccttcatatatgagagaaaaattcacttgttttcctttccacactttaca

SEQ ID NO: 103536 - DNA, 550 bp, Homo sapiens
atgagattacaatgaatactaaatatttctctggcacttgatgtttttcaaagcaatttcaaatatgtaatttgattttacagcaacttgatagaataagtagtaattgttattctcattttaaaaataatttgacatttagaagagttaaatgactttcttacacagctggtaagtggtggaggtgctacttatactccggtcttccaactccagatcatctaagttttgcattgtagcaccccttaaatagaaggatgggtcaggcacagtggctcatgcctgtcatcccagcactttgggaggccaaggcaggaggatcacttgagcccaggagttcaagaccagcctgggcaacatggcagaaaccccatctgtactaaaaattatccaggtgcggtgacatttgcctgtagtcccagctactcaggagactgaggtgagaggatcacctgagcctggaagtgaaaggctgtagtgagccatggttgtactgtactccagcagcctgggtgacagagtgagaccctgtctcaaaaaaaaaaaaaaa

SEQ ID NO: 103537 - DNA, 508 bp, Homo sapiens
gtttcatgatcttcatgaaaaatctagctcaatattcttctttttcatttttcactgaactttgtctttggaaacgctaaatttacagcctatggattaaagggaccaaaaagcattaaaacactcaaaaattatttattaataatgaggttatttagaagaaaataaaaattacatctgttgaggtgtttcacacatgctttaatttttactacagctttaacatgtaattattattctctttttcaaacaaagaatctgaaactcaagttaacttgcctgactgaggccacatgagtatgtggaaaagccacaaaaagttcagtactagggttctcctatttcaaaatctggattagataaaatgattcaagccagattttaactataagagtatatatccatggtggaaaggttgatgtttgtcattcattgactattagttttaattatgacgttaccttttactaatgaagctatttctataagatatataatttaacctctt

SEQ ID NO: 103538 - DNA, 442 bp, Homo sapiens
atccccataagaagatggccatgtagtgatagagacacaaaaggagaatgccatgtagacacaggccacacttggagctataccgctgcaagctaaggaactccaaggtccagcaaaccaacagaagttaggaagagaaaaggaaggattcttctaccagtttcagcgggaacacggccctgctgacaccttgattttgaacatctagcttccagaaagtgagaaaatacatgtttaaagccaccagcttctggtactttgtcatggctcccctaagaaactaatacactaattttaaattacttttatacactatcactgttgcaataggatactgctccaaaaactttattactttcccaacatgtccattctgccacgttctcttataatttaaaggaaatgcaggcatgtcattaagaaaattggtaaacattattta

SEQ ID NO: 103539 - DNA, 140 bp, Homo sapiens
ccagtgatgcgaaaccaggttcctgccaccctccatgaggaccacaacaaagatgagcccatgatggcaggccagcttagtcccctggccctgtgcccagagcccagccacaggcccaaagcataaacagaacactgcag

SEQ ID NO: 103540 - DNA, 429 bp, Homo sapiens
cccactgcctaactgctactaccagtaggtgtctgccttctcggggggctcatctccccatccacacgatggggggtgccttttagtcctgcctggttctccctttgcaaaccctaaagtgccgagtacacggcaggagctgaggtccaggtctgggctggacagccccagatccctgcccaactttgtcttctcctagctgcatgatgacttcacctctctgagcctcagttgcctcacctatgaaatggggatatggataacaaggccacctctgggggtggttaagggctcaaggagctgatggttgagagggtggcatgcaaattcaacgttcagcccagtatgctcctcactgacacaggcagggctggctgcgcctgggagcacaactgcccactgagtaggtggcacagaggttcaaagtga

SEQ ID NO: 103541 - DNA, 698 bp, Homo sapiens
ttccttgctctgttaactctgactttcggtaaattgcttcagttttctaagcttccatttccttctatgtaaaaaagtgaaaataataccacatggagttgcctgtaggttaaattacatattttatgaaaatcacttagcacagctcctggcaaaaccgaataagtgctatctacgtcagcatttggcgtttgttgccctgggcataaaataccctaggacccctctttctatttcgcctggctcagaagttttgacgtggctactgaaatacaagacaaggcctgctacttactagtgctgcttttagtgaaagtgtgctaaaagtatttatagattttatagctttaataatataaaatgtcaagaacaggcagcaatttggcaagagaaattccagattgcattttacagcttctatgataaatgactgttacataagcaggaaacatacctcattgaaaatggcaactcttttggcatctatagcaaatataatgaaacatgctgtttaatatttcacttggcagaaattgtatttttaagtctttctctgcatataaatgtgctttaaactgtcgtatgttcaaagttcatttttaagtctcttgttcagaattttaaagatatttcttgtcaaactgatgttcccaataggttttcaaaacagtaaatgtaagagttttttgtttgtttgt

SEQ ID NO: 103542 - DNA, 147 bp, Homo sapiens
gcatcagaagacaactgtgaaccagatggacatggattctgttctcaacggaccccagcagctatggcccacgctgggaagccagaggggagagtctggaagtgctggggaagcagagaagagctggatgcagagtccgagggcttg

SEQ ID NO: 103543 - DNA, 519 bp, Homo sapiens
ctctccagtagtccccagtgtctattgttgtatctttatgtccatgagtacccaatgtttaagggagaacatgctgcactgtttggttttctgttcctgtgttaattcactcaggataatggcctccagctgcatccatgttgcctgaaaaggacacgagctcattcttttttatagctgcaagaggaaggcttttctattccctgcttctccatggttattcttactgtgctgtcctggaaggccaaatacttcttccagcagaagggtcctgcccatcccacattcccagattggtcaggcagaagagggataagtggttcaggaaatgaagattggggagtagaaaacattgggagtcagaggcccagttttctttcatagccattattagttggaaatatgtaccaatttctctgtgacctatggcatgtctcgctgagcagaagaatgtgtttctcaaagataggtaaacaccatgggaatgttaaagtaccacccttgcaagcttcttactga

SEQ ID NO: 103544 - DNA, 227 bp, Homo sapiens
aggactgcaacctccatggcagccactgccaagactgaggccactttgcagccggctggctgagttctgctctgacaccaaagcatgtctgccctggctttggccttcattacccggatgggacaggccagggtccagtttgcaatctgtgcatttgggtggtgatggagagcagctgttggccatcctctttctaacaagcatttgtatgcttaacatgcaccctg

SEQ ID NO: 103545 - DNA, 333 bp, Homo sapiens
gatacctacctgctaccacgccggactcaagcgttgctgcagcatctgggacacacctcaaagcgaagccgactccagccctcgggaggatctgcagagacaggaagcagatctgcgcctgcctaggacatggggggcaggaggcaagtactggggggctatggctaaggggtgcaatgtttcttttgggggtgatgaaaaacgttttaaaattgtgttaggccgggcgcagtggctcacgcctgtaatcccagagctttggcgggtcgaagtgggcggatcacaaggtcaggagttcgagaccagcctgtccaacacggtaaaaccccgtct

SEQ ID NO: 103546 - DNA, 275 bp, Homo sapiens
tagagacagggtctcactatgttgcccaggctagcaggctagtcttgaactcctggctcaaacaatcttcctacctcagcttcccaaattgccggatggcaggcatgagccatagcacctgccgcacaccaattttcatcctgaagccagttaattgacacagaaattctgagtcaaggaagtaccctgtcatggcaccacaagcatatgtgatacatatttcctcaactttccccccaaaagacctgtggccacttaccagagtctctgggtat

SEQ ID NO: 103547 - DNA, 498 bp, Homo sapiens
gacagaactgctcaaccattttgctggctgtactgcctctggaatatggtggagtcaagagaagtgggaggtctatgactcccaggaacacctttaagctgcctcatcaatcctgagtctcatcatcattgcctggacttcacaatgtaagtcagcccatcaaggcaacacagtgcatgcaccacattttcaacttgcagaccagtcagtctacagagaaagatgtctatctaatttctgtatatttgtcaaataatggcatgtctgagccatggcaggaaacacatggtcaccctcttaccttgggtttctcaggtgttttggccagcagatatttaggctctgggatcaaagacctccaggttccacatgtgaggatctccagcacaattaaaggaaagttgatcaacatgtctgtttaattaatgtttctaatatttctttaaaaatcaagttttgatgagaaaaaaattaaagacaaattatatccagaatgtt

SEQ ID NO: 103548 - DNA, 685 bp, Homo sapiens
acataactatacacatttgtatatattcactgttaactaaaacttagttttaacagtgtaccttatgatcgaaagtggttgttcaaaaaatgcctgtaaacattcctctgaatatattcctgttattttataatcacattaatattacatactgttacgtttgttttatatgtgagtctggcattataaatgctggctgaatgaattgggctaagacaactacaacagatgtgatcaagaaaccgatagtgattaccagaaattatatttggtgcttactctgatgatgctcttaagttttttacagactatatgaactcctttaattttcacaaccaccctttgaggtagatacatttctaatccccatgtacaaatgagacaaaggcacagaggttagttcacatagctatgaggcacaggcagaattcaaacacaggcagtttggcttcagagaccatgatcttaactgctatgctctgatgtctctccaaaaaagtataaacatgagcagggttaattgtagcagctacttggtttttacgtcaagaatcataaaccacaagaggaaacatgaagtttttgttttttacttttcaagatggagtctcgctctgtcactcaggctggaatgcagtggccctatctcagctcactgcaacctcagcctccagggttcaagtga

SEQ ID NO: 103549 - DNA, 410 bp, Homo sapiens
gtttgaatttctgttatccacccacctctatcattgtgctcagtgatgtttttaaaacaactgtttggttttacagttaaaatattacttaaaaatagcagaacatatgtttctttgaatcagaactccctgtttctactagtatttttcgaagggttgaactccaaagaaatctggtaatctggcctttaatatgcctgctctgttatttagctcttgaaaagcgataagactcttttaggctgggcgcagtggctcacgcctataatcccagcactttgggaagccgaggtgggaggatcaacaggagttcaagaccagcctggccaacaaggtgaaaccctgcctctactaaaaatacaaaaattagccgggcatggtggcgggagcctgtagtcccagctacttgg

SEQ ID NO: 103550 - DNA, 114 bp, Homo sapiens
aatgatttcaatctctttgagttcaacatacagtgatgcttttcaaggtaatgaattagttcattgattagtttatctattataagacagtaaattgatgtaatgagtcactga

SEQ ID NO: 103551 - DNA, 237 bp, Homo sapiens
taatcttgatgacagctggcacaagaaacataaccctgaaccttggaacaaagatggttttctgctcagtgcaagtactattgcagcgttattacagcaagctcagaaagacagccagacttctgaattacattattcctttttaagttgctaaaattgaggctgaggcaggagagttgtttgaggcttccatttgacactgtaaaaaataagaacttcagttcatcaaaagacacc

SEQ ID NO: 103552 - DNA, 461 bp, Homo sapiens
ggctggcttcaaagggacacatgagttgttctgggatgacagattctgcatcctgatggtgatagtgtttgcatgactgagtgcgtttgtcctgtacctaacaggctgaattttactctatgtaaattaaacctcaattaatctaaccttgaaaaatcaatcaatcagtcaatacacaagagagccttgaatgaagaaaatcagaactgtgtgaaacaaacttggtcctcaggacaatcagccacgttgatctagtttggacgtctgtccccttccaatctcatttggaatttggtccccaatgtggggatgtttgggtcatgaggaagatcccacgtgaatggcttggtgcccaccccaaggtagtgagtgagttctggatcaattaggtccctggagagctggctgttcaaatgagcctggcacctccctccgttctcaacaggtggtctctgcatgca

SEQ ID NO: 103553 - DNA, 218 bp, Homo sapiens
atatgatgcaatgaaggggcgcgtcgcctccgtggcattcttccccaaattcataacctcggtgttatcatgagaaagcatgaaacaaacccagattgagggacagtctacaaaatagctgaccggtactcttcaaactgtcacaatcatgcagtgttgtaccaacattcatctcttagtttttgtaactgtaccacagctaaataagatgttaacat

SEQ ID NO: 103554 - DNA, 400 bp, Homo sapiens
ggctcatcctacttcactatgactttatcttaacttaaatagttacatctgtaaggacccaatttccaaataaagtcacaatctgagatactgtgtgttaggacttcaacatatgcccggcatttggttttttaaacataatcttttattattactgaaatcataaatatttattgtataaattaatgacatttacactggcaaaaagaaaataagataaaatgtcacattgtcactatccataaattattgttgttaatattttagattatatttctgtaccatttatatgcaaactacacagatacaaaacaaacatgtgccattatttttactgacttttaaaaataaatgtattagttaaccttttaataaactattttgtaatagttgatttaca

SEQ ID NO: 103555 - DNA, 330 bp, Homo sapiens
ctctcacaaatgctttccaaattttttatatcagtaagtcttgtttctacaaataaattacaaacgtttcatgaagagaaatgcatcttctatttctccaagctccatgcacacatgtcagatggataatatatactttcaattctaaattaagaaataaaattacagtgaggtaaaagaaaggagagaaactgctaataactttaagactttcaagtagacagctgctgtgcaagtaacacacaggagcaggccagagcttgaggtgaaacaaaatgagggaacctgatggtcaggaagagagcttcagcttcaatccaccacttctgg

SEQ ID NO: 103556 - DNA, 461 bp, Homo sapiens
cctgctcacagggggattgctatacccaggtttattgataattggatagttggtgtaaatgaatggggtagaagcccaaggaggttggttgaggcagtgaagataattagggatattattataagggatcaggtttgtcctttaatgttatgggtaattattatctgttttagtgcaggttggattaatcatcgttgaatagaaaataatcggttactaatttgatgactagaggttggaaacagtgggaaacagaatgattaatactactgctggtaggcctagaattgtaggggtagcaaaagagatgaatagatttcgttcattttaattctcaggaagccttgtgtttttgtgttttgattatttttggtgtagggataatataaatgaaatttaataattttaactgaataatggagaataaagttatgattattgacaggataataatggatcat

SEQ ID NO: 103557 - DNA, 916 bp, Homo sapiens
ggaatactggtcgggtatttcatagaatgtccggaaggaagaccacaagagatgaagtgccctttgccatcacgccatatcaagggtacacactatcaacctcattgattaccaatgatgttaattaacctttatcacccggctgagttgtactgtaaagtttcttcactgtaaagttacttcctccacaccccattccttggaagaaagtcactaagctcatactcaatgagtgaggaattaagctccacctcctggggagatgtgtacatatattatatggaattcttttgtatgggagatttgtttactctccatttatttattcaatcatttatttctactaagtatggactcatgaatatttattttatccttggggttataatccagtgctatgttattttgttactcaaactgttctggctttggccattgggagttctttcaggttagctctgtgtttctctgacatacacccaccattttgatttttgagtactttcactttctgacactataggatattccacacacatcttgtatattccctgtcccagccctaaaatcagtgatttctcctaggagccatgaattcttttactggagaatggtgttctgaatccaacatctgggccaggtgcggtggctcacacctgtaatcccaacactttgggaggcagaggtgggcggatcacttgaggtcaggagatcaagaccagcctggtcaacacggtaaaaccctgtctctactaaaaatacaaaaattagctgagtgtggtggcgtgcacctgttatctgagctactcaggaggctgaggtgaaagaatcagttgaattcaacaggcagaggttgcagtgtgctgagactgcaccactgcactccagcctgagcaacagagtgagactctgtctc

SEQ ID NO: 103558 - DNA, 433 bp, Homo sapiens
gcacaggccgtggctttgtcatctccagccctaactgggagcaccgagggttccaaccaggcaaatgcaggccctaacgggctctttgaaaacgggcttttctagaaccaggaacctcaagtaaaaactcccccagctacctctaaggcccatcacactcctgtctcacgcccacctatgagaaaggaaaaggtgatggtcattgagctgggctgcagaggagtgtgaggtgcagacaccatgaggtacccacagccaggaaaacgaggatggtcggggagacgcgccagcgaagagctgggcccctgcgtgggacccctcagtggttcccagggggcgtgggacttgcgcagtcctttcagagggctgtttaccaacaggaaccgtaacattaaacctgctcagaccccttgactcagcaatttcatgtctg

SEQ ID NO: 103559 - DNA, 155 bp, Homo sapiens
cgcagtcctagacacatctgcagagttggcttctgaaggctgggagaggccctggaacctgcatttctaaagctgctcaaatccaggcctttggaggcttaaggctaagcctgccccatttcaaactaaatacagtcaagagagaaagatcccag

SEQ ID NO: 103560 - DNA, 297 bp, Homo sapiens
tgggctgtaatttataaaattccacagtatgaataattctgcctttctcactccaaagaatgcacctggatggcaagcagagtttcagaagaaaaggggttattcctgcatcaaaaactagaactcctctattcttgaataaataaatgatgttacttctttttgtcagtttcattcagtgagtttctgaagcttggtttctatttctgtctcatttatgtcaaccagtttttgtagattatctggtatgtgcaaagcactgtgcattgatttggaggtgaaactattttctgcatt

SEQ ID NO: 103561 - DNA, 508 bp, Homo sapiens
ggaggatgtgggcaccacctgaccctggggacacagatggctcatgactagggctttgtgtgtccagacccagccacatgcaggccctggccattaggtccagagtcacgcgcctggctgccccatgatgcaatgatggttttccttctccggaccaggggtattcactggccatgggacccagaacaagtcacctaaatcctactttcttcttccataaaatcatatagtatctacctaataaagttgttgtggtaaataaaaaaaaaaaaaaaaaaaaaaaaaaaaaaaaaaaaaaaaaaaaaaaaaaaaacaaaaaaaaaaccaaaacacaaaacaaaaacaagaaaaaaaaaaacgaaaagaagcacgcgaacaaggatagacgacagaaggggcagcgagaagaagactcgaaacggaacaaggagagagacgaatagaaaggctagaagacgaaagcagaagcggacgagcaaagagcgaggagggcagagcacgactcgag

SEQ ID NO: 103562 - DNA, 351 bp, Homo sapiens
tttaattgaattcatttgactgtggctgatttttccaattagtctgacccttttccagaagtacactatttcttttaggtaaatgaatgacatcagctcccccgcatccctttttatgttgatttccacattgacctcttccattcagtcatcttctatgtctcaggtccacctcggtgatgctttgcatttttttaaacacttacagtgcacacatactacacacggtgcaggagtcttgtttcctcccatgaattcttgatatgtacttaccagtaggacagcttgaatttttactaatctgggcattgtgcatactttttgggtaatatataatttcagaaataaagg

SEQ ID NO: 103563 - DNA, 267 bp, Homo sapiens
ggcacctgaccctcagccactccaccctgtggcctcttccttgagaaggccattggagagccccaggatgggggattgctgatgacgaggtagaaagcatggtgagggttatttctggaaggggagaggcttctgaagatgcctgtgtctgacatcaggccctcttggttgtcttcccagggtggtgacaataaggccagatcaaggcatggctttggaggagcaggcctggcaccatagtcattctattattattttttgtttttt

SEQ ID NO: 103564 - DNA, 350 bp, Homo sapiens
tgagacagagtttgctctgttgcccaggctggagtgcaagtggcgtgatctctgctcactgcaacctccacttctcaggttcaagcaattctcccgcctcagcctcccaagtagctgggattacaggtgcccaccaccatgccaggctaatttttaaaatatttttagtagagacagggtttcaccaagttgggcaggctgctcttgaactcctgacctcaggtgatccgcctgcttgggcctcccaaagtgttaggattacaggtgtgagccaaccacacccggccatgcgcataatttaaaagatgtacctcacttggactctgatcaccaaattccatcacagcaac

SEQ ID NO: 103565 - DNA, 455 bp, Homo sapiens
ttacagactgcttctcaattgacacccctgccacaagcatcagagccccccaggacaccctgccccctccacactactgtcgcacaggtcttttcaggagagggaggtaggggacatccatattttgtgatgttttaaatctttctgtaacaatgcagcatatatgtatatatacacacacacacacacacacacacacacacacacaccatatatagatatatagatttttttcccctcttcaccttgctcatggtgttacttctgctggaaaaccttccctcttctggcacctggcagaactgagttcaaaactcagaaaagagttcaaaactgagttggctaggagtgtgtgtgtcacgcctgtaatcctaggactttgggaggccaaggtggtaggatcacttgagctcagttcaaaaccagccaagtcaacacagacctcatctccattt

SEQ ID NO: 103566 - DNA, 396 bp, Homo sapiens
taacaccgggtttgcagtcttcaatgaaaactatagtacaagataccaattttctttgtaaaaatctgaattcaggcaaaaagaagtataaagaaccccagatttaaaattattttaaaaaattaacagttcttctgacctcgcaaatcaaaggacaatgtgtccaatacgtcaatattttcagttacaatctggtggtaattcaatgaagacacgttactaagcaggtaaaaaagggttttgagctgtgtgttatcaggctgtgaagacaggagcacagaagttgagtggttctgcaaaatctatgagaatatgacaaagctgtcatatctgatcactgtaatcaacttggatgtggacgtatttttgtttcttttttttttttttttgagacgg

SEQ ID NO: 103567 - DNA, 400 bp, Homo sapiens
aaataatcctttgaaaaactttatgggtcttctgtgatcctattgagtctgttccaccaaataaaagcccacccacacatctcttcaagaccatcccttctctccgctgggcttctgctgagggacaatgcccttaagcttcttagaagctctgttgtttgactgagaagatctttaacatctcttaaaatctttacagagcttttggtctgactgaatagtactctgaggcagcaccgctgaactttctaagatcttgacaaagacttcatagccacaccctccacctcatctttggactatgctttcctgagagtgccatgtataatgaaactttaaggttcctatggtcactgatctagaggctgaattagatacattgtgtttaggggcaagtaga

SEQ ID NO: 103568 - DNA, 424 bp, Homo sapiens
acctgtccttctttggaaggctttccaagcattcaaaggcacttgggtgttgtgctctaagtttctggtcactgcagccccatctgtattagggagcaccccaagcccagtaacaatatggttcttgcagacttatagagatacttcttggtggtcttggatcagatctggaagaattgtctggattaccaggaaaagactcatgttctctttccttacgttctcccaaacagctcagctctgtgctgagctaactaggctagaagagaggtgacacaaatactcctgttgtcaccactattaggactgtgctgggtcagacctgaaactagtatggtactggggtctcacccaagggctgtggttaccactgcctgactatcacctatgctcacccaaatccctagggctctacaatcatcag

SEQ ID NO: 103569 - DNA, 449 bp, Homo sapiens
tttttagttgctttcttgtgttttagtgagagtatagttaccctgtgattaaaattagttaagaatttaaaaaaaatctttcaaatgatcccatattcttttgatgatctgtttttgaatatggatccactgagttttgtactctttcttcgaaagaagctgccatcagctgggtgtagtcgttacgcctgtaatcccagcactttggaaggccgaggcaggtggatcacctgaggtcaggagttcgagaccagcctgacgaacatggagaaatcccgtctctactaaaaatacaaaattagccaggcgtggtggcgcatgcctctaatcccagctactcgggaggctgaggcaggagaatcgcttgaacttgggaggtggaggttgcgctgagctgagatcgcgccattgcactccagcctgggcaacaagagcgaaactccatctca

SEQ ID NO: 103570 - DNA, 749 bp, Homo sapiens
tttgtaatgttaccgtttgtgaggatgtgctttttagtttacaactgaggaagcctgtcatcatcattagtactcattcattcagcatgagcacctgttttatcttaggcactagagatgcgaatatgaataaaacatgattcctgttctggaaaacgctgggggagaaaaataacttagatagttacatttcaaagtgatatgttctatataataaatatgaaaaagtgttatagtaatatacgagagggagcaataaacttgggggaatggtaaggattcaaaggggaagtgacagttgagccaagtattgaaggatgaatgggaattttctatttggagggtagaggagcaggggaggaggcaatacagggtagggaagagcctatgcaaaaactaaaggacatgcatgggacacgctaggaaaggagaaggtcttcagagtggctggataaaaggatgtgtgggaaagaactgagttgaaattaggagttagaattttattctttggtactaaggaatcattgaagattttaaaattagggctgacataatcagatttgagtttggaaacctatagtttgggactggaggaagacaggtgccagacaccagttaaaaagctgttattttctaagcagtagacaaaggtttacactgacaatagctgtggagatagagaaaagctgcgagatttcagagttttccaaggtgtaaacaactaaattttgtgatcaaaatgataaggg

SEQ ID NO: 103571 - DNA, 239 bp, Homo sapiens
gccaggatccatctctctgcctgggcaacagagtgatactccatctctaaataaataaataaataaataaataaacaaacacgaaagagatttaagaagaagaaagggggcattagataagcacttcatataattctctcaactgtaaaagcaagacaatacttaccttgtctaaccaatgccattgctatgaggagcaaataaatcaataaaggtcaaataaaagtactgtaaactgt

SEQ ID NO: 103572 - DNA, 456 bp, Homo sapiens
tggtggagttagagaaagggaggtcagtcaaggtcagccaagtgattgtaacgtgtgtgacccgcattagataacacaggtgtcatggtgaacccagacttgggaggtcaagaaaagtatgctagataaatgtcatgtttaggctgatatttgaagaagaaggattagctaggcaggtcagacaaataacttaaatctataacacacacaccactgtggagccccacagcccgatgactttccccccagaagctgcatcacagggtagcatttcaaaaacagattccattgttaggatagctgaagattctctctctctctctctctcacacacacacacacacacacacacacgcatgcgcgtgcacacacacacacaccacacaacactgcctgggttgtagattgttccttcaaaaatttttttctgttttttttaataaacattctgtgaag

SEQ ID NO: 103573 - DNA, 249 bp, Homo sapiens
  misc_feature (24)..(24): n is a, c, g, or t
gcagcctgcaatacaataacttgnctttttaatagttttgattactcttgatacctacagcacaaatgctggacctgaatcagctcttcaaggaccctagcacaaatgtcaactgatcacctctgggagagtagaaaacttttttttttttgagacgaagtctcgctctgttgcccaggctggagtgcagtggcaccatctcagctcactgcagcgtccgcctcttgggttcaagtgattctcctgcct

SEQ ID NO: 103574 - DNA, 324 bp, Homo sapiens
tcagtcatttctcagagataaagcccagattgtcacaatcttagataccaatgcctccgctgaatcctaatagcagctctgcaacttgacgtgaaataaaaataagaatgccccctccaaagacaaaaccacaatatgtgtaggtaccatgttggggtttagacccttgcaaagtattgttttaaaggaaagagtgcgtgtgtgttgatacacatatacactcatcaccacatttcacagattaggaaacagtttcagaggtgaaataacttgcccaaggccacatcgacagtaagtgacagaactgggactcacatccaggtc

SEQ ID NO: 103575 - DNA, 730 bp, Homo sapiens
tcaagctctgcctcccgggtttacaccattctcctgcctcagcctcccgagtagctgggactacaggcacccgcaccatgcctggctaattttttgtatttttagtagagactaaaaatttcaccgtgttagccaggatggtctcgatctcctgacctcgtgatccactcgcctcggcctcccaaagtgctgggactacaagcatgagccaccgcgcccagcctaaaatgacgtttttaaaaagccctcctacactgctatttttaaagttttattttaaatcttgtgcccttaaatggctctttttcccttccacttagaattatttttccagattaaagttcataactcttttataaaatatatatcataaatatttttgcatattttaaaaaattatatagcaaacagtgatgtttgggagcttttgctagaattataaaggatttttttttaaggaagtccaaagcaaagtccaaagcagagggaagctgctgcagaagggaaaatgatgactttctgcccctctatgatcctggggttggtagatggcttttcatctctagctcactggaactgactgaaggcagaggtcatatgtcttacttggaacatctctatagtggctggtacagggctctgtgcacagggtaggctagaatggcatttatagagaaatcatctcagctgtcacttattaagcacaaacaatgtgctacatcttaccaga

SEQ ID NO: 103576 - DNA, 661 bp, Homo sapiens
cctagttctacagggaggcccagagtgggtcagccctgtactctctgttcctgaggctcacagtgaaaagaatgggtctgcctggcaggcagggggtgttcgtgcatgagacagggcacagatcccaaaaggcggctcacacccccttcgtctcctgccttcgcagttattctggctcacgtcagcccccagcaggcccagccaagccccatgagcaggggacagaaatctgggggtggtcaatttggcctgggttgcagaaagggaggctgaaactaggacatttggaaaacgagttgtgctgggtgaagctggactgggtggccatgtgcccagaggcggagcacctgctcttcccacatcctgtcctcatgcccagagccactgttggacaccccataccgggtctgggtctgagagcaaggttgtgtcttggggattgtggcaggcagagggacgtgcatggtcacgtgctggctggctgattcgggggtttgcaccagggtgggagtagctgagcaggtttgggtttggaatgggagagcactgaccctggggcttatcttgaagttccccttggtgagggagggcttcccaggctctgactcagtgacgccagcactgaaatcagagaggcctgcatggcagccttctgccttgg

SEQ ID NO: 103577 - DNA, 585 bp, Homo sapiens
gctaacatgacgaaaccctgtctctactaaaaatacaaaaaaaaaaaaaaaaaaaaaaattagccgggcgtggtggtgtgtgcctgtagtcccagctactctgtagactgaggcacgagaatcgcttgaacccaggaagcataagttgcagtgagccgagatcgcaccactgcactccagtctggatgacagagcgagacttcgtgtcaagtaataataataaaaaaagatgtgctgtaattgtctccgttttacaaaagaggtcaagtagttgacacaggtcccacgctagtgagggttttgggattcaagcacagaccaccttcgcccctatgctacaccacctcaggctgtcgggagataggcgcccagtcaaaaggcacatggaagaaagcccacgacttctcaagcattgaagcaggagtggcgcatcggtattctcaacttcaaactttgagaacagtcatggtaggaatgcattttattcaagaatgggttcaggtgagggtggatatgggcactgggttcaaaggacaaatttggagaattcatgatccaggagagtgaacaaataaggaagggcta

SEQ ID NO: 103578 - DNA, 662 bp, Homo sapiens
agagtctgctttatccaggctggagtgcaatggcacaatcttgcctcactgcaatctcttggcctcctgggttcaagtgattctcctgcttcagcctcctgagtagctgggattacagtcatgtgccaccatgcctagctaatttttttgtatttttggtggagacggggttttgccatgttggccaggctggtcttgaactcctgacctcaagtgatccgccgcctcagcctcccaaagttctgggattacaggcgtgagccattgcatccagcccgccctcatggcttttacacctcttttcctggtttgcagaaagcaaggctggggtgtggaccctgcatcgaagctggttctgcttatgtccatgtgaagtgctttcaagtaaaatgctgatctgcaaaaagatgctgaaagtcctttgtctctttctggctaagttcaaatgccgaatttgattcagcaaatagttgtgagtgccttgaagtgcaaagaatgatccaggatcaggactccttccctacatatcattattttgatatgtatgtatgtatatatgtttagtgacggagtcttgctgtatcacccgggctggtctcaaattcctggcctcaagccgtcctccaacctcagcctcctcagtcgttggggttacaggagtg

SEQ ID NO: 103579 - DNA, 89 bp, Homo sapiens
gtgaagtgagaaatgatcaggtagttcagtttcccctgcaaatggaccaccagacaattgaaggaattaaatgcttcttaaaagtgcag

SEQ ID NO: 103580 - DNA, 798 bp, Homo sapiens
caaattgcttagaaaaactctggaaagatacatgacacaataataaagtatttacctcttgttgggaggcatgaggactggatagatggtgaatagagtggaaacttcattctgcatcattttatgttttttaaaaaactgtgtaagtatattacctctgagactgctgatttcctctcagtgtccatttttcatttcttccttttacaagtaggacatcccccctgagtttttggagggcatatcctagcctcctctgcagctaagtacattcctgtgactgaatttttgccagtggaatgtgaacacaggtgacttatattatttccatgtcacttccttaaatggaaactaatatcttccactttcttttctttaccctttccatgggctagaatgtggatatggtgctggtgagactgttttgatcagagtagataaggtaacaatcggaaataaacatctaggctgggtgcggtggcccacgtctgtaatcccagcattttgggaggccgaggcaggtagatcacctgaggtcaggagtttgagaccagtctggccaacatggtgaaatctcatctctactagaaatacacaaaaattagccgtgcatggtggcttgcacctgtagtcccagctatttgggagaccggggcaggagaatcacttgaacccaggaggtggagtttacaatgagctgagatcgcaccactgcactccagcctgggtgacagagcaagactgtctcaaaaacaaacaaacaaaaaaccatctatttttctttaaccaatgactctt

SEQ ID NO: 103581 - DNA, 160 bp, Homo sapiens
ctggccaatgcttccaagccaaatattgaagaaatgcagacgtccagttttttgggacgggtgggacacaggagtctgttttttaactagctccccagagcacctgagcagcaaatcatgggctgtcctagccccttttcagatgagaaaggaggaggag

SEQ ID NO: 103582 - DNA, 435 bp, Homo sapiens
ttctggaaatggaactgctatgtcaaaaggtatgatagaaaagatgttacagctattgccaaattgccctcggtagacattttgtgatgcatacccaaatattcaacagcgtctatatcttctcactaataaagtgttagccttaaaaatatttatattttgaagtacctagcataatagctggcacacaaaataacaatcatcattttaatcgtgactagcgctaaactttttgatctttgcaaatgtaaaaggttaaaaaatattccactacagtttcatttgcattttcttcttaagagtaaagctgagtgtatttccatatatttaagcacttattaaaatttttcttgttttgtgaattagctgtttgtatgtacattttgccaatttatctaacgggttgttgattgaaacatttagtataaatgattc

SEQ ID NO: 103583 - DNA, 389 bp, Homo sapiens
agaccctgtctcaaaaaaagaatatacatatatacatttacatatttatatataaatttaaatgtttagtttatataaatgtatatatatgtaatatatataaaaatatatatttgcatatggatagaaaagtccaggagaatagaaggatataaaaagaaaacttaaaggccctcttctcattattaacagtttcttatgtatccttccagaaaatacaaattatatatatgtgagcagaaaatacaaattatgtgagcagatacacatatatattcctttagaagttacataaaaatatgcatgtttagtgcatattttttcattactcaataagtcttagaggccttttgctatcaacatacagagatttactttatttaaaaaat

SEQ ID NO: 103584 - DNA, 644 bp, Homo sapiens
ggataaggtgatgaaaattgttgggaagaagtgtgtactattttaaatcggataaccagggaatatgcccctcagaaggttacatttaagctgaaacctgaatgaagtggaggagactgtagcagctggctctgaagctttgagaatagaaggcgctggagagacattgcaggaggaaacgggtttgcttcctggttgcgatgggcttggataggttcctgcagcacacaagatttcagcttatgccttctccagcatcagactcctgcagtgtataaggtttctccagcacgggctcctgcagtgcttgcagcttctccagggcccagcctctgcagcacgcagcagcctgcagcttcccctggcagcctcttaggcagttgtgtgagagacctctccatcatcagctttcaccagcactccacagggcagtttcctggcaagttccactgctgagcaccacaccagcctctctgcatatctgcaagtcaatgtctgttctcagtcctggttgtggaggaggaggtcttggtggctctatcttagccttggggatagtagctgctcctattatctgtgatttctgtattttcttggtttgttctctttacttctttttattaaactttatctattatctatca

SEQ ID NO: 103585 - DNA, 401 bp, Homo sapiens
ggttattctgtgtgtgtgttgcggggggagtaccgttttctgttgctgtcatgaattctttttcattgggatgcctgaaagctggcattaattattgtagtggtatgtctacccagagatttcctgcagctgcctggaaaaccagatattcgaggagagccagaaaatcaccccagatgtgttctattacagtttagaaatcagcctgtacaaaactgatgtccaatttataatttaatatatttgacaagatctctttttattatgtgtttaaataagggttaccatttttaaaaattgtgtttcctgggactcagaggctttgaaaaatttttggaaatatatcttccattctcttacctaatcacttttttttgacattaatatttgtgtggcctttt

SEQ ID NO: 103586 - DNA, 269 bp, Homo sapiens
aaaggcttggcagtgggatggcagggagcctgacaaagtggaaaatgtgtgggttaaaggagggagggcggggtcctggaagacactgacatcctcctgctacgtgggaggagacacagggctcatctgtagccatagacagacatgccaaggaaacgcgcaggcctgcccgactctccagaagggaaattgtccctggccccagctcaccaagcctgggtggggaattagggcctgaggtctagggaacaggtgagctgttccttcca

SEQ ID NO: 103587 - DNA, 883 bp, Homo sapiens
agaattttttttgtagagacaggatcttgccatgttgcctagactggtctcaaactcctgggctcaaacaatctgtctgcctcagccttctaaagtgctgagattacaggtgtgaggtactgcacctggcaatacgttattttaaaagtaaacgctaagccatttatgactttggttatattcagtcagttggatttagtaactaataactagctttcttccattctaaggtacttttatagtttctagcaattagtttgttacaattagcttatatcagatataacagttcttaatataatgtttataaaaggttttaagtctgttgcctgatttttaaatttatatctagttaacattttaattttaaaattgccaacttttgggagatttcacatattttacctctatattttatttttccaggattggtatggaggagtagtaccttctattcttggtttatttttatttgctagacataatttcttaactacatatgtaagtataaattcataaaaatcacactgaaagaataggttgatttcaaccattttgagggtactggtaggtaacacactgttggggaataaactaaagaatttctgatttctacaatagatttaagtatgaaatttgagtatactgtgtagctgtgtagatcaacttaatgcttaaaaaattacctccttaatgattagattaatagaacagtgttagattatcaagggaagagtttggaatgtaaacataaacatgctgcataggtggtggttatttgtgagtaggactacttttaaatggtactagtaaagatttatcaaacaatgctgctattatgttgctatatttttaataaaatgaaaatcttaaaatcttgcca

SEQ ID NO: 103588 - DNA, 228 bp, Homo sapiens
cgcgttctatggctgcttgtactgtggctgcgtgcctgtcaccgtgcggcccccgcaccctcagaacctcggcaccacactgcccaccgtcaagatgatcgtggaggtcagcaagtctgcatgcgtcctcaccacgcaggctgtcacacggctgctcaggtccaaggaggctgctgctgccgtggacatcaggacctggcccaccatcctagacacaggtgcgtgtcc

SEQ ID NO: 103589 - DNA, 427 bp, Homo sapiens
gtggcaagaggctaccatgttggacagcgccaccctagagccttgctatggcctaaggatgtgcaacgtgtgcgtttcctgggagcctgggagatgtggagaatctcagacgtcaccccagacctgctggatctgaacctgctttttaatacaatctccaggtggtttaagaaacactgggccagccttgaaacctctcagtgtctttccagagacttccaggcagttgtgctggtcaaggatggaaggttcttgctgtcttctttgccttctcagctgttctcacaacctgctgtggttttcaggggacccatgtgtgtgggtccctgtggttaagagatcaaagaaaaaagttctgtagctgtcatcttaggatgaaacgctgttttgtgtattcctcctcataaacctccttaatctctgtatt

SEQ ID NO: 103590 - DNA, 813 bp, Homo sapiens
ggccggtgggacgggggccggcaggtgctccgcagccgtctgtgccacccagagccggcgggccgctaggtccccggagaccctgctatggtgcgtgcgggcgccgtgggggctcatctccccgcgtccggcttggatatcttcggggacctgaagaagatgaacaagcgccagctctattaccaggttttaaacttcgccatgatcgtgtcttctgcactcatgatatggaaaggcttgatcgtgctcacaggcagtgagagccccatcgtggtggtgctgagtggcagtatggagccggcctttcacagaggagacctcctgttcctcacaaatttccgggaagacccaatcagagctggtgaaatagttgtttttaaagttgaaggacgagacattccaatagttcacagagtaatcaaagttcatgaaaaagataatggagacatcaaatttctgactaaaggagataataatgaagttgatgatagaggcttgtacaaagaaggccagaactggctggaaaagaaggacgtggtgggaagagcaagagggtttttaccatatgttggtatggtcaccataataatgaatgactatccaaaattcaagtatgctcttttggctgtaatgggtgcatatgtgttactaaaacgtgaatcctaaaatgagaagcagttcctgggaccagattgaaatgaattctgttgaaaaagagaaaaactaatatatttgagatgttccattttctgtataaaagggaacagtgtggagatgtttttgtcttgtccaaataaaagattcaccagtaaa

SEQ ID NO: 103591 - DNA, 1220 bp, Homo sapiens
ggccggtgggacgggggccggcaggtgctccgcagccgtctgtgccacccagagccggcgggccgctaggtccccggagaccctgctatggtgcgtgcgggcgccgtgggggctcatctccccgcgtccggcttggatatcttcggggacctgaagaagatgaacaagcgccagctctattaccaggttttaaacttcgccatgatcgtgtcttctgcactcatgatatggaaaggcttgatcgtgctcacaggcagtgagagccccatcgtggtggtgctgagtggcagtatggagccggcctttcacagaggagacctcctgttcctcacaaatttccgggaagacccaatcagagctggtgaaatagttgtttttaaagttgaaggacgagacattccaatagttcacagagtaatcaaagttcatgaaaaagataatggagacatcaaatttctgactaaaggagataataatgaagttgatgatagaggcttgtacaaagaaggccagaactggctggaaaagaaggacgtggtgggaagagcaagagggtttttaccatatgttggtatggtcaccataataatgaatgactatccaaaattcaagtatgctcttttggctgtaatgggtgcatatgtgttactaaaacgtgaatcctaaaatgagaagcagttcctgggaccagattgaaatgaattctgttgaaaaagagaaaaactaatatatttgagatgttccattttctgtataaaagggaacagtgtggagatgtttttgtcttgtccaaataaaagattcaccagtaaaaaaaaaaaaaaaaaaaaaaaaaaagaaaaaaaaatgaaaagaatctgcgaaaaatataaataataatggagacattgggtaaaggaaaagagaagaagaaggggggcgcctgaacaactcacaggaggccccagacatatcacacaccacgctcttatttatgagaggggccacaacaggaggagcttcaataaatacacgaaggaggggcgggctcaaacaaacacagtgcgtagtgaagaaacatcgcagcggcatagtgtgtggagagaaccccccacttgtggggggggcagaacatgagaacaccacatgggatgttaagtagccgagagtaaaaaaatacggagatgtggggacaagcacatattgtggggagaatgtgccgcgggtataaaaataggtga

SEQ ID NO: 103592 - DNA, 2333 bp, Homo sapiens
ggccggtgggacgggggccggcaggtgctccgcagccgtctgtgccacccagagccggcgggccgctaggtccccggagaccctgctatggtgcgtgcgggcgccgtgggggctcatctccccgcgtccggcttggatatcttcggggacctgaagaagatgaacaagcgccagctctattaccaggttttaaacttcgccatgatcgtgtcttctgcactcatgatatggaaaggcttgatcgtgctcacaggcagtgagagccccatcgtggtggtgctgagtggcagtatggagccggcctttcacagaggagacctcctgttcctcacaaatttccgggaagacccaatcagagctggtgaaatagttgtttttaaagttgaaggacgagacattccaatagttcacagagtaatcaaagttcatgaaaaagataatggagacatcaaatttctgactaaaggagataataatgaagttgatgatagaggcttgtacaaagaaggccagaactggctggaaaagaaggacgtggtgggaagagcaagagggtgaggattcacctttaagttatatagaaggttatgaaaaacacttagaaatgaagaaattaaatcaataggctaatgagtcgttaattacaaatatgacatatcaggagagttttaagcagttctagtttatcctgtgaagactaaatacaacttagaaattcctaaagacctaaaatctaaaactgaacccaattatattatctatatgatgggttcaaatctgtttcaaaataaatccagccaggcgcagtggctcacacctgtaatcccagcacctttgggaggctgaggcaggaggatcacttgagcccaggagttccagaccagcctgagtaacatagggataccccatctctattaataaaaattttaaaaaatttgttctaaaaaaagaagaaatataaatcctcactgagagattagttatttgtggattttaaataaccattacaagaaagtctcccagagataaccactgtttaacatttcagggaatgctgtaggtactctctgggctggtacagatgtgtgttatgcatatatataattttacttagaatttgattatttttcacccaacaggaagttggaaatagcttttcgtgtcaaatctacatctgtatctttttaagtggctacaagctgttttattgcgaataattatttatttaaccaatccccttttggtggacacttagattatttcctgtttttcgcaactaaaaacatttctgtgatacatcttttagtattcatctttgtatagttgtccagcaatgagttctgcttctgattgacataacagagaatgtatcctcattaaaaaccaaacaagggaattcttcccctctcttggcaaccctttttatgtttaacagccattagaaatgtttttttatcttacctaaatctcactagctttttaaggctggagagactggctcccattttgtcaggtttagcgttattagtcagattgtggcttacagcttcttcctcctcctttaaccatttttctttgttgcattttcacttgaacatctccggggggaccaggagggcttccagttagtccatcctgtctttccagacactctggtgaaaggctttggataagagagaggatggaactactgatttataaaagactggagggtacctatgggtgtgttaccttgtttcccatgagcagagatgattgagacctgggtccatctgattacatattgctgttgattttgtgagcataatcgttggctggtttatgcactgaacctccttgctctgggatcataatcatatttgagtataagttatggtattcacatttgtatttgctacccaatacatttatttgttatatctgacaagcactgggaaatgaaaataattatttgcattacaaactcattattcatgtactttgaaagctttatctaacagcagtttttatatgggctatctgaatcttatcttctaaataaaaactagatttgtgaaagttgcctattctttttgtacaagcggcttaactattttaattgtagcaagtgaagacaaccagcatcactatctcaacccaagtgcctacttagaaaacttgtcctggctgccagtgctgatgctccttactaataaagctgtttgagacagggctgaatacatccttacagccctggtcagtggcattccctcgtacaattcatttcttaagactgatctatagtgttttcagatgttgccatcatcatgttataagcagcttttatatctctt

SEQ ID NO: 103593 - DNA, 589 bp, Homo sapiens
  misc_feature (42)..(42): n is a, c, g, or t
  misc_feature (46)..(46): n is a, c, g, or t
  misc_feature (48)..(49): n is a, c, g, or t
  misc_feature (62)..(62): n is a, c, g, or t
  misc_feature (70)..(70): n is a, c, g, or t
  misc_feature (72)..(72): n is a, c, g, or t
  misc_feature (88)..(88): n is a, c, g, or t
gggggagcccgacactggcacggccgcgttctggtctttatncccngnnccttcggggtgcnaattaccngncttcgcgctttccagnggagacctcctgttcctcacaaatttccgggaagacccaatcagagctggtgaaatagttgtttttaaagttgaaggacgagacattccaatagttcacagagtaatcaaagttcatgaaaaagataatggagacatcaaatttctgactaaaggagataataatgaagttgatgatagaggcttgtacaaagaaggccagaactggctggaaaagaaggacgtggtgggaagagcaagagggtttttaccatatgttggtatggtcaccataataatgaatgactatccaaaattcaagtatgctcttttggctgtaatgggtgcatatgtgttactaaaacgtgaatcctaaaatgagaagcagttcctgggaccagattgaaatgaattctgttgaaaaagagaaaaactaatatatttgagatgttccattttctgtataaaagggaacagtgtggagatgtttttgtcttgtccaaataaaagattcaccagtaaa

SEQ ID NO: 103594 - DNA, 595 bp, Homo sapiens
  misc_feature (46)..(46): n is a, c, g, or t
  misc_feature (48)..(48): n is a, c, g, or t
  misc_feature (60)..(60): n is a, c, g, or t
  misc_feature (73)..(73): n is a, c, g, or t
  misc_feature (76)..(76): n is a, c, g, or t
  misc_feature (81)..(81): n is a, c, g, or t
  misc_feature (87)..(87): n is a, c, g, or t
  misc_feature (93)..(93): n is a, c, g, or t
cgggagggccggccctggacaggaggggtttaggttctttttaccngntttatctttgtnttacttataacgntgnctggngctttncacganaggagacctcctgttcctcacaaatttccgggaagacccaatcagagctggtgaaatagttgtttttaaagttgaaggacgagacattccaatagttcacagagtaatcaaagttcatgaaaaagataatggagacatcaaatttctgactaaaggagataataatgaagttgatgatagaggcttgtacaaagaaggccagaactggctggaaaagaaggacgtggtgggaagagcaagagggtttttaccatatgttggtatggtcaccataataatgaatgactatccaaaattcaagtatgctcttttggctgtaatgggtgcatatgtgttactaaaacgtgaatcctaaaatgagaagcagttcctgggaccagattgaaatgaattctgttgaaaaagagaaaaactaatatatttgagatgttccattttctgtataaaagggaacagtgtggagatgtttttgtcttgtccaaataaaagattcaccagtaaa

SEQ ID NO: 103595 - DNA, 404 bp, Homo sapiens
atctttagtccatcagtatatttttgggtttttgaccataatgtagcattgaacagctcatttagagaacaagccatggggggaagaggtaatcttttgattctgtcctcagcgcagtatttaacggacttcatctgaatacatttacagaccaaatttctttgtagacctcacagtgattttccattgtgttttctttccagtatgctcttttggctgtaatgggtgcatatgtgttactaaaacgtgaatcctaaaatgagaagcagttcctgggaccagattgaaatgaattctgttgaaaaagagaaaaactaatatatttgagatgttccattttctgtataaaagggaacagtgtggagatgtttttgtcttgtccaaataaaagattcaccagtaaa

SEQ ID NO: 103596 - DNA, 800 bp, Homo sapiens
attttcattaaggaggtggcagccgtctgtgccacccagagccggcgggccgctaggtccccggagaccctgctatggtgcgtgcgggcgccgtgggggctcatctccccgcgtccggcttggatatcttcggggacctgaagaagatgaacaagcgccagctctattaccaggttttaaacttcgccatgatcgtgtcttctgcactcatgatatggaaaggcttgatcgtgctcacaggcagtgagagccccatcgtggtggtgctgagtggcagtatggagccggcctttcacagaggagacctcctgttcctcacaaatttccgggaagacccaatcagagctggtgaaatagttgtttttaaagttgaaggacgagacattccaatagttcacagagtaatcaaagttcatgaaaaagataatggagacatcaaatttctgactaaaggagataataatgaagttgatgatagaggcttgtacaaagaaggccagaactggctggaaaagaaggacgtggtgggaagagcaagagggtttttaccatatgttggtatggtcaccataataatgaatgactatccaaaattcaagtatgctcttttggctgtaatgggtgcatatgtgttactaaaacgtgaatcctaaaatgagaagcagttcctgggaccagattgaaatgaattctgttgaaaaagagaaaaactaatatatttgagatgttccattttctgtataaaagggaacagtgtggagatgtttttgtcttgtccaaataaaagattcaccagtaaa

SEQ ID NO: 103597 - DNA, 822 bp, Homo sapiens
ggccggtgggacgggggccggcaggtgctccgcagccgtctgtgccacccagagccggcgggccgctaggtccccggagaccctgctatggtgcgtgcgggcgccgtgggggctcatctccccgcgtccggcttggatatcttcggggacctgaagaagatgaacaagcgccagctctattaccaggttttaaacttcgccatgatcgtgtcttctgcactcatgatatggaaaggcttgatcgtgctcacaggcagtgagagccccatcgtggtggtgctgagtggcagtatggagccggcctttcacagaggagacctcctgttcctcacaaatttccgggaagacccaatcagagctggtgaaatagttgtttttaaagttgaaggacgagacattccaatagttcacagagtaatcaaagttcatgaaaaagataatggagacatcaaatttctgactaaaggagataataatgaagttgatgatagaggcttgtacaaagaaggccagaactggctggaaaagaaggacgtggtgggaagagcaagagggtttttaccatatgttggtatggtcaccataataatgaatgactatccaaaattcaagtatgctcttttggctgtaatgggtgcatatgtgttactaaaacgtgaatcctaaaatgagaagcagttcctgggaccagattgaaatgaattctgttgaaaaagagaaaaactaatatatttgagatgttccattttctgtataaaagggaacagtgagaccctcttttgtctgtccagtaagttcgggggagggcgcgaggggcggggg

SEQ ID NO: 103598 - DNA, 554 bp, Homo sapiens
ctactactactaaattcgcggctgctggcagtatggagccggcctttcacagaggagacctcctgttcctcacaaatttccgggaagacccaatcagagctggtgaaatagttgtttttaaagttgaaggacgagacattccaatagttcacagagtaatcaaagttcatgaaaaagataatggagacatcaaatttctgactaaaggagataataatgaagttgatgatagaggcttgtacaaagaaggccagaactggctggaaaagaaggacgtggtgggaagagcaagagggtttttaccatatgttggtatggtcaccataataatgaatgactatccaaaattcaagtatgctcttttggctgtaatgggtgcatatgtgttactaaaacgtgaatcctaaaatgagaagcagttcctgggaccagattgaaatgaattctgttgaaaaagagaaaaactaatatatttgagatgttccattttctgtataaaagggaacagtgtggagatgtttttgtcttgtccaaataaaagattcaccagtaaa

SEQ ID NO: 103599 - DNA, 895 bp, Homo sapiens
ggccggtgggacgggggccggcaggtgctccgcagccgtctgtgccacccagagccggcgggccgctaggtccccggagaccctgctatggtgcgtgcgggcgccgtgggggctcatctccccgcgtccggcttggatatcttcggggacctgaagaagatgaacaagcgccagctctattaccaggttttaaacttcgccatgatcgtgtcttctgcactcatgatatggaaaggcttgatcgtgctcacaggcagtgagagccccatcgtggtggtgctgagtggcagtatggagccggcctttcacagaggagacctcctgttcctcacaaatttccgggaagacccaatcagagctggtgaaatagttgtttttaaagttgaaggacgagacattccaatagttcacagagtaatcaaagttcatgaaaaagataatggagacatcaaatttctgactaaaggagataataatgaagttgatgatagaggcttgtacaaagaaggccagaactggctggaaaagaaggacgtggtgggaagagcaagagggtttttaccatatgttggtatggtcaccataataatgaatgactatccaaaattcaaggtaggaatttatgtgtgtctatatttatttacttcgttaaatattggagcttttacttctgcaactgtaaacaggcagtcttcttaaaacatgttgccattaataggcctgcagaatatctgtagttaactacaaattaatgtagtcatttaaagcagcaacacttaaattatttaaaatagctactttccccttgtatgttcagtgttctaaaatggcatttatctaattgttgctttttattatggaaattttcatacacacacaaaagtagtaccataaa

SEQ ID NO: 103600 - DNA, 755 bp, Homo sapiens
ggccggtgggacgggggccggcaggtgctccgcagccgtctgtgccacccagagccggcgggccgctaggtccccggagaccctgctatggtgcgtgcgggcgccgtgggggctcatctccccgcgtccggcttggatatcttcggggacctgaagaagatgaacaagcgccagctctattaccaggttttaaacttcgccatgatcgtgtcttctgcactcatgatatggaaaggcttgatcgtgctcacaggcagtgagagccccatcgtggtggtgctgagtggcagtatggagccggcctttcacagaggagacctcctgttcctcacaaatttccgggaagacccaatcagagctggtgaaatagttgtttttaaagttgaaggacgagacattccaatagttcacagagtaatcaaagttcatgaaaaagataatggagacatcaaatttctgactaaaggagataataatgaagttgatgatagaggcttgtacaaagaaggccagaactggctggaaaagaaggacgtggtgggaagagcaagaggtatgctcttttggctgtaatgggtgcatatgtgttactaaaacgtgaatcctaaaatgagaagcagttcctgggaccagattgaaatgaattctgttgaaaaagagaaaaactaatatatttgagatgttccattttctgtataaaagggaacagtgtggagatgtttttgtcttgtccaaataaaagattcaccagtaaa

SEQ ID NO: 103601 - DNA, 727 bp, Homo sapiens
attttcattaaggaggtggcagccgtctgtgccacccagagccggcgggccgctaggtccccggagaccctgctatggtgcgtgcgggcgccgtgggggctcatctccccgcgtccggcttggatatcttcggggacctgaagaagatgaacaagcgccagctctattaccaggttttaaacttcgccatgatcgtgtcttctgcactcatgatatggaaaggcttgatcgtgctcacaggcagtgagagccccatcgtggtggtgctgagtggcagtatggagccggcctttcacagaggagacctcctgttcctcacaaatttccgggaagacccaatcagagctgagataatggagacatcaaatttctgactaaaggagataataatgaagttgatgatagaggcttgtacaaagaaggccagaactggctggaaaagaaggacgtggtgggaagagcaagagggtttttaccatatgttggtatggtcaccataataatgaatgactatccaaaattcaagtatgctcttttggctgtaatgggtgcatatgtgttactaaaacgtgaatcctaaaatgagaagcagttcctgggaccagattgaaatgaattctgttgaaaaagagaaaaactaatatatttgagatgttccattttctgtataaaagggaacagtgtggagatgtttttgtcttgtccaaataaaagattcaccagtaaa

SEQ ID NO: 103602 - DNA, 203 bp, Homo sapiens
ttaaatcttcgcttcaacacttactagctctgtaactttgggcaagttaatgaaactcttgtacctcaggttccccgtttagaaaatatgtcaagtgtgtatacagtgcctgacacgtggtaagcacttagtaactggtagctagtaggttgaaactagaagtgaagattgtacattggtggagttaatagttggagattaat

SEQ ID NO: 103603 - DNA, 326 bp, Homo sapiens
atcaaacagcctgttctgacaaatgaaattgctaagcattgtagtaagtatataaatgagctggagccttgttgaaggctgtacaatcaatctcactttgaaatgaatgggttatcttgataatagttttgtttgtgtgtttgatactcagctgaatctgttagtataagtaaaacttggaagtagacaccaaatctctttttttttccttgaaaatcaaacatcttgttgatgaactggctttcagaactaaatttaatttatttagtttattagcatcaaacttataactcataggaagaaaaaacaaaaaaaaagtcaagact

SEQ ID NO: 103604 - DNA, 397 bp, Homo sapiens
gtcttttaattccagactgataacgatggaactgataaaaagaaaacactccatgcaactgggttaaggctgattaaatgttatgttcactattattattattaaacatttcgtaaatatatgctttacaataaatttacctaaccacacttcccaacatcaaattgaaaactggaagttaagggtcaggcatggtggctcacacctgtaatcccagcactttgggaggccaaggcaggcggatcatgaggtcaggagattgagaccatcctggctaacacggtgaaaccttgtctctactaaaaatataaaaaatagccgggcgtgggccgggcacctgtagtcccagctactggggaggctgaggcaggagagtggcgtgaacccaggaggtgga

SEQ ID NO: 103605 - DNA, 483 bp, Homo sapiens
gacggagtctcattctgtcgcccaggctggggtgcagtggggcgatttctgctcactgcaagctccgcctcccgggttcatgccattctcctgcctcagcctcccgagtagctgggactacaggtgcccaccaccacacccagctaatttttttgtatttttagtagagacgggatttcaccgtgttagccaggatggtctcgatctcctaacctcgtgatccgcctgtctcggccgcccaaagtgctgggattacagacgtaagccaccgcgcccggccacggactgctattcttagggacgttattctgaactgtctctcctttgtcctaaaaagacctaggagagaaacaaagtaatgtccgcgaagttcctgcttaaagcaactgttgtttttttttttaatggtcatagctgtagaaaacaacatacttcttgtttgttttctatagctatgaccgttacaaaaaaaaaaagggttag

SEQ ID NO: 103606 - DNA, 114 bp, Homo sapiens
gggagccaaaggactagccccagaaggatgatagaaatttggggatggttattcaccatttgccccagattggaagattaaggggaaaaaaaaaatcagaaggcagagtttatc

SEQ ID NO: 103607 - DNA, 283 bp, Homo sapiens
gggctgttcaaaagccctaaagtggagggagttggctgccccttcctgctgatatcaaaggcagaaagtagacttaatagatattggaaaaaaatacttttccaacacaaagcaaagtctgtgtattgttgctattaagtaacggttttactctgcatgtggcaaggcagattaatgagacatttctgcctcttcgataaccaaaagagagaccagatccaaaatgatctctagcttaactcagtttcaccttggataaagaaagccatttgttaaatgtaga

SEQ ID NO: 103608 - DNA, 637 bp, Homo sapiens
cctaaaatcaagctattgctggagccacattcctcttggaggctgtaggggagaatctgtttccttgcatttaccagcttgcagaggctgcctgcgttccgtcacttgtggcatcttcctccattttctagccaattgtggaggatctttaaatctctttactaaagaccctggtgattactttgtgtccacctggataatccaggataatcccccaactcaaaaatgcttcatttagtcacatctgcacagtcccttttgccatgtaaaatttataacttcaggggattaggatatggacatatctggggagctgctattcagcctaccatgactataaatatcattaacctaattaaaatggcctaaattagctggctgtggtggctcacctataatcccaggactttgggaggccaagatgggaggatcgcttgagctcaagagttcaagaccgaccagcctggtcaacagagtgagaccccatctacacacacacacacaaaaattagctgggtgtggtggcccacagctgtagtcctagctaattgggaggctaaggcaagagaatcacctgagttcaggagatggaagctgcagtgagttgtgatcaggccacttcactccaccctgggtg

SEQ ID NO: 103609 - DNA, 494 bp, Homo sapiens
tggcgtctagaggatcccgataagagcatcccctctctttggaatatctccataacgttattgtggaaggtgcaacgagaggctcagtaactgcctgcagaatttgttacaaatttgtattcgttcctttccagattttgaatttacacacacccacaactgcacccacacatatatacatcacacagattataaaccaaaaattgactgaggcatgtctcaatcattttagagggttattttgccaaggttgaggatgcacctggggaagggggaaaaaaacaatcacaggagcatctgtaatctgtgcttttcccaaagacaattttgaggacttcaatatttaaaggggaaagagtaagcaggaggggaaggaggaaagtaaataaaagcgggaggataggcaatggagacaagtgggttacagtcttgtgaggctttgattagcactcagggaatctacgttttacgtgtaaacaggtgggtagaggaaa

SEQ ID NO: 103610 - DNA, 395 bp, Homo sapiens
aacaatgagtacacatggatgcaaagaagggaacaatggccaccagggcttatttgagaatggaaggtgggaggagggtgagaatcaataaactacctattgggtaaccatcatcaccatccatctccagaacttttttcatcttcctaaaatgaaactctgtacccactaaatagtaactgcctactacccccaacccctggccgctggcaacctccattgtaccttctgtctccatgaattgtgatgactcccggtgcggtacgtaagtggaaccatacagtatttgtctttttgtgactggcatattttacttagcgtaatgtcttcaggcctcatccatattgtagcatgtgttagaatttcctcccttttaaggctgaataatattctgt

SEQ ID NO: 103611 - DNA, 352 bp, Homo sapiens
ttagtttctgatctgctggtgaagagcccgttgccaccccctagctcctcttcgccatgtgacctctgcacaggctggatcccttcaccttcccccatgagtggaagcagcatgaggccctcaccagatgcaggtgctggtgccatgctttttatacagcctgcagaaccatgaaccaaatagacctcttttcttttcaaatcattcagcctcaggtgttccttaatagcagcaccaatggactaagatgagccctgtttatttctggatttaacttattgtcaagacccctaaaaatctatctcgaaagcttgtttctcttttctatctctgctaagcagaaattgaaata

SEQ ID NO: 103612 - DNA, 841 bp, Homo sapiens
aaaataacaagtgttggcaaggatgtggagaaaattggaacccttgtgcactgttggtgggaatataaaatggtgcagcctcaatggaaagcagtatggaggttcctcaaaaacctgaaaatagaattaccatatgacccagcaatactacttatgcatataaattcaaaagaattgaaagtgtgatttgaaagaaatgcttgtacacccatgttcattgtcgcatttttgtaatagccaagaggtgaaagcagttccagtgttcattgtcagatgaacaaaccaagaaaatacagtgtatacatatgttggaatatcattcagccttaaagaaggaaatcctgttactggaactttgaggacattatgctgagtgaaataagtgagtcaagaggacaaattactgtgtaattccacttatgcgtggtaccttgagtagtcaaattcatagagaaaatggaatggtcgttgccaaggaccaggaggacaaagggataaggagttagtgttaagtgggtatagcatttcagttttgcaagataaaaaagttctagagcccaggtgcagtggtgcatgcctgtaatcccagcactttgtaaggccaaggtggatggatcacctgagctcaggagtttgagaccttggccaacatggtgaaaccccgtctctactaaaaatacaaaaaaattagctgggtgtggtggcgcacacctgtaattccaactacttgataggctgaggcaggagaattgcttggatctgggaggcggacgttgcagtgaaccgagatcacacaattgcactccagcctgggtgacaagagcaagactccgtctcagga

SEQ ID NO: 103613 - DNA, 407 bp, Homo sapiens
aaaggggtgagggataaaagactataaattgggttcagtgtatactgctccagtgatgggtgcaccaaaatctcacaaatcaccactaaggaacttactcatgtaaccaaatatcacctgttccccaaaaacctatggaaataaaaaattaaaaatattaaatatggatctcataaatatttatctattaggatgtacctatgcttctttcattcgacacttatttactgaatgctgaattacctgtatgttaggaggcattacttaaaatcatgagaaactgggactggaaaagtgtgaacacagcaaactggttaaataaattctgcatacaataaaatacaatgtagccattaaaaatgctacagaagctgggcacagtggctcacgcctgtaatcccagtact

SEQ ID NO: 103614 - DNA, 288 bp, Homo sapiens
ctcccctctactctccccctctcccttcttccctctgtctggaagttcaagttgccatctccttctctggatcagagaggaagatgaggatcatgaaactggtgaagatcatagctcactcccagagagtgcttctgcctctccaagccttccacatgtgttagccacactcatggctttctttggaagggctggtgggtcccttttaccaacccatttcatgcatgctccgggaaagtgccagagctggtaggagccttctgcagctctgacctttgggtgagatcc

SEQ ID NO: 103615 - DNA, 257 bp, Homo sapiens
ttgggaaggctgaggcagaaggatggcttaagcccaggagttcaaggctgcatggtacaattacagcttatggcagcctcaatctcctgggctcaagcaatcctcctgcctcagcctcccaagtagctgggactacaggcactacaccagcttctgagaactgtgtctgtaggtagttctgattagtactttggtgatattctttctggaaagatcagactattgataggactataccatgccgggctaattttgtt

SEQ ID NO: 103616 - DNA, 113 bp, Homo sapiens
gacatccggcccgggtccctcgccgcgcccgccgcccgccgcccgcttcggcgccgcagcccgggagccggccacccctacacgcgccagggctgtcccctgccctcccctcc

SEQ ID NO: 103617 - DNA, 117 bp, Homo sapiens
gtctgcgtcgagttcccatgtgcccagagtggttcttctcttccacagactccaaaccaccacatggctcttcaggacacacctgtaccagacatgagctcacctgcctgtttcctg

SEQ ID NO: 103618 - DNA, 430 bp, Homo sapiens
aaaaaaaaaagcctcttccatgtaacattcttcatctcattcacttacctgctctgaaggtgcatctagtcacgtcgtagtaagacagctgcatcttttaaaatcataacaaagagactgaaaactcccaaggttaaatctgaggaaattcagtgcattaagcatatttgcactgttgtgcagccatctcaccctagccattcctagaacttttcattatcccaaacagaaactgtactcatgaaaacagtagctccccattcttccctcccccagctctggaaacaaccatgctactttctgcctctgcgcatttgactactctaggtacctctgtaagtggaatcctagtgagaggtgaagccagctgggcttctgggttgagtggggacttggagaacttttgtgtctagttaaaggattgtaaatg

SEQ ID NO: 103619 - DNA, 479 bp, Homo sapiens
gcaacctctgcttccgggttcaagtgattctcctgtctcagcctcctgagtagctggaactacaggtgcatgccaccacaccaggctaatttttgtatttttagtagagatggggtttcaccatactggtcaggctggtctcgaactcctgatgtcaggtaattcaccctcctcggcttcccaaagtgccatggtcctttctcttaaagaccaatggcaatggctgtatcgctgcatgtgttcatgcattcagtcaacaaacattcattaagggttttctctgtgcaagataccgcattaggcattggggctacaaagatgaaaagacatcggttctactttcaaggagctttctcttctgtggaggtatagacataaaaacagacagtagtacaacgtgatgtcaacattgacaagaactgagttgagaagaatgaaagctgagtgtagagtatgtattttcaagagcagaaaccagt

SEQ ID NO: 103620 - DNA, 252 bp, Homo sapiens
tttattgtgtcatgccttatggtgggtacctgggatagaaatgacttgagcaggttctctgttaaagtctaatgaaggagataaatatggaaacatcactggtcttataatgatatgaacaaaatgctatgggggcaaaagggaaaactagtagctactgctgcttacagacagagaaggcctcaagaggaaataacccctgagcttagtcttggaaaataagtagaaatttgccttgagatgagggagaaa

SEQ ID NO: 103621 - DNA, 688 bp, Homo sapiens
ggaggcctggcgggcaccgtaaccagcgccgcggacaccggcaccggcgccacggactccgcaggaccccgcgcccgccgccgccgctatgctggggctgctggtggcgttgctggccctggggctcgctgtctttgcgctgctggacgtctggtacctggtgcgccttccgtgcgccgtgctgcgcgcgcgcctgctgcagccgcgcgtccgtgacctgctagctgagcagcgcttcccgggccgcgtgctgccctcggacttggacctgctgttgcacatgaacaacgcgcgctacctgcgcgaggccgactttgcgcgcgtcgcgcacctgacccgctgcggggtgctcggggcgctgagggagttgcgggcgcacacggtgctggcggcctcgtgcgcgcgccaccgccgctcgctgcgcctgctggagcccttcgaggtgcgcacccgcctgctgggctgggacgaccgcgcgttctacctggaggcgcgctttgtcagcctgcgggacggtttcgtgtgcgcgctgctgcgcttccggcagcacctgctgggcacctcacccgagcgcgtcgtgcagcacctgtgccagcgcagggtggagccccctgagctgcccgctgatctgcagcactggatctcctacaacgaggccagcagccagctgctccgcatggagagtggg

SEQ ID NO: 103622 - DNA, 186 bp, Homo sapiens
gaatgaggacgtctactctgcgtggacttctgacaccgctctctctggccgtctgttctcctgtgtgctccggtacaggctggaggaagcgccacataagtgtaaccatcattagtatttcggcctccaccatctcctctctgcctcacatggtggccttggccctgaggacacagaacagctcaa

SEQ ID NO: 103623 - DNA, 357 bp, Homo sapiens
tggtggtgcacgcctatagtccctgctactcaggaggctaagacaggaggattgcttcaacccaggagttcgaggctgcagtgagccataatcactccactgcattccagcctgggcaacagagggagaccctgtctcagagaaaaaaaaaaattaaacactgtatgactcaagtaaagccaaatttccctctggtgctgaaggattgcaacatgaagttagtaaaacagaactctcaactgtggttcctctcatccactcatcccttctcccacccatcctgccagcccgccatgtgtgaatgtatatgtgaagcatcttctgcttgccagacgcaaggtgaagcactgggcccat

SEQ ID NO: 103624 - DNA, 103 bp, Homo sapiens
caactgaaataatcagacagaatacatgaaacagtggcttccaagaccccgacatcaggcaaaattaaatgcggtgatcccagagagaaaggaaacaagcaag

SEQ ID NO: 103625 - DNA, 551 bp, Homo sapiens
cagctttctgagggttaactgacggctgatgggttcaagaaggaggacacgggcacagggactcaggggcagtgaggggcagcagggccgatggtgtgaggagcaccagggagcaggagggaacgggcctggggcgtgaatctggccctactgtcggatgagttctcttccgccacccaaatctggtccgaccgttaacagcgtggccttcggcaagtgactaaagggcttcctgcctcagctttcccacccataaacagaggataacaggccaggcgcggtggctcacgcctgtaatcccagcactttgggaggtggagatgggtggatcatgaggtcaggagatcgagaccatcctggctaacacggtgaaaccccgtctctactaaaaatacaaaaaaattagccgggcgcggtgacaggcgcctgtagtcccagctactcgggaggctgaggcaggagaatggcgtgaacctgggaggcggagcttgcagtgagccgagattgcgccactgcactccagcctgggcgacagagcaagactccgtctc

SEQ ID NO: 103626 - DNA, 449 bp, Homo sapiens
atttccatcccctccctcctagaggaaactgtataaacaagtgtgatgtttgcacttaaatatttatgactcctttaaaaaataagctttaaaataagctgctttatgtgtggatttgtttttagcttgctgaactgacattgtgctagagatactgttttgtttcttttttcattcaacaatatactttttagttatggtcgtgtctctatgtgtagaattagtttattgcttctaacagcagcacagtattccattagtaggcatctatcacattttgcaaggatggtcactgtgttacttccaactccctgatgtcataagcaaacctctctatgtgtaattcttattagctctacatctaaagtgttaccttgaatctgccaattcaagttaacttttttccttttgtttactctttctcccatgggctgtctccatagagcagc

SEQ ID NO: 103627 - DNA, 782 bp, Homo sapiens
tgggccacatcatcctaaatcctgtaatgagcaagttattagagttggttgatggccccagctgagttttatctcttgactacttccctccaattatgtctaaatacctgtgtgcctgttccctatttcctctcagttttctttgttagaaccaccagtctccagaattattgcattaccattgctggttcatgttttagggacttttaaaatgaaagtgtcagttctctaaatagccctttatgtagtttctctttgaaacatgtctaggccctgagaatctctgaagtgtttgtcagtggctggtgatcgctgcagttgagggcttgggattccagggaaaggtgcaaggtgtctagccaggaaaacttacatctttattcgctatgagtactacagcacttgagaagaaaaggaggtagaattctgttttctatttgtaccttttgcctgatctaatcattccaaatgatatgcctatagaaaacatttcacctcttgcaaattatcaatagtgtacaaagtagaagggaatatagagatcttttattcaatcatgtgtctatagaggtttcattgaacacattctcatgcacatctaggtgccagataaatttaagactcttgttggttttcagaaagcttgcagtcttaatggaagagacagtggcagagagttgtaggtgacattgaggtaattaatacaaagttttactgaagttccatgggaacacccttatagggcactatacccagtagggatatcctctgagagcagttct

SEQ ID NO: 103628 - DNA, 425 bp, Homo sapiens
agccaatcagccatgcatttcttattgttggaaaattcactctggtcagcaattaagcttttcacatacttcacattgaagtgaatctaaatgaattgttctaagtaaaataatttttggaacacaaatatttggcttctggttatataagccatcatcctcagacatagattttaaaaattatattagagtttattttaacttgtatcaaccataaaataaaaaagagctcaaaacatacacagttggaatgagaccttcattctgaaagcagcaaggaactagtgaaagttaacattgttcactcgaatggagaataacctttttttgcatgttaaattttaggatttaaatgataaattgagcctcaccactactgctgatctgggaagaatctgacctagtaaaggttttcaaatgtcttt

SEQ ID NO: 103629 - DNA, 312 bp, Homo sapiens
tacccatttttccttaggatcacaacaataacagaaaccatcatttcactatgtgtatacccaagtgttgaaatagaggattcatgataatcataatgactttagcacaccaattccagtctccataatggccttccaggactgcagggggccaatcagcgccttcctcctggagaaaacagtgattctaaagtttggaaaggctctcaaaagtagtaaaataggtcataaaacagagttaaatatgttttatatagcttcacagactgatgtgccgtagaatttattgaggtacttaaatggattttgggc

SEQ ID NO: 103630 - DNA, 228 bp, Homo sapiens
ggccttgcctggccttgtgtggagtggcctgcctgccttgccatcctcctcttcctctctcactgagccctgagcccactggccggtggtcctggaaggccatgtgcattgtcgcctgtgccggtgcacgtgtgctgcttctgcccctggagcaagctcctcctttccctgggcatcctccctcccgggtcgggctggatacctcttcattaccacctgaagggccag

SEQ ID NO: 103631 - DNA, 635 bp, Homo sapiens
tgctgactcttctcttcctaggccttggtctgcaccttatactttcctttctactgcgggctgatcccccccgagttcagaggggagactgcccctccaccatcacggtgtcgcccttccatgggacagtggacatctgcccccagagcacctcccccaacctgcatgagctgaacgtcttcaacttcagcttccaaatctccactgagaacttcttcctggggctcatatgtctcataccccccagcctcgaggtagtggccgacaactgcagacaaggctacctggatgccctgaggttcctggagagacgtggactcaccaaggaaccagtgctatggacgctggtgtctaaggaacccccagccccggctgacggaaactgggatgctggctgtgaccaacgctggaaggggggcctgtctctcaactggaaagtgccccatgtgcaagtcaaggatgtacccaactttgagcagctctcaccagagctggaggctgcactgaagaaagcatgtacgagggatcccagccggtgggcccgcttctggcactcggggcctggacaggtgctgacgtacctgctgctaccctgcacactgcccttcgagtacatctacttccgcagcagaagg

SEQ ID NO: 103632 - DNA, 1180 bp, Homo sapiens
atttgggcccagccccgtccaaggctgcatcccggccctatcccgggtcacggagtgacccttcctcgtcccgatcaccccgcccggtccacccgccatgggcttcttagaggaggagggcagatggaacctgtccttctccggcgccggctacctgggcgcccaccacgtgggcgccaccgaatgcctgcgccagcgagccccgcgcctcctccagggcgcccgccgcatctacggttcctcgtctggggcgctcaacgcagtcagcatcgtctgcggcaagtcggtcgacttctgctgctcccacctcctgggcatggttgggcagttggagcggctgagcctaagcatcctgcacccggcctacgcgcccatcgagcacgtcaagcagcagctgcaggatgctctgccccccgacgcccacgtcctggcctcccagcggctgggcatttcgctgacccgctggcctgacggacgcaacttcttggtcactgacttcgccacctgcgatgagctcatccaggccttggtctgcaccttatactttcctttctactgcgggctgatcccccccgagttcagaggggagcgctacatcgatggggctctgagcaacaacttgccctttgcagactgcccctccaccatcacggtgtcgcccttccatgggacagtggacatctgcccccagagcacctcccccaacctgcatgagctgaacgtcttcaacttcagcttccaaatctccactgagaacttcttcctggggctcatatgtctcataccccccagcctcgaggtagtggccgacaactgcagacaaggctacctggatgccctgaggttcctggagagacgtggactcaccaaggaaccagtgctatggacgctggtgtctaaggaacccccagccccggctgacggaaactgggatgctggctgtgaccaacgctggaaggggggcctgtctctcaactggaaagtgccccatgtgcaagtcaaggatgtacccaactttgagcagctctcaccagagctggaggctgcactgaagaaagcatgtacgagggatcccagccggtgggcccgcttctggcactcggggcctggacaggtgctgacgtacctgctgctaccctgcacactgcccttcgagtacatctacttccgcagcagaagg

SEQ ID NO: 103633 - DNA, 612 bp, Homo sapiens
atttgggcccagccccgtccaaggctgcatcccggccctatcccgggtcacggagtgacccttcctcgtcccgatcaccccgcccggtccacccgccatgggcttcttagaggaggagggcagatggaacctgtccttctccggcgccggctacctgggcgcccaccacgtgggcgccaccgaatgcctgcgccagcgagccccgcgcctcctccagggcgcccgccgcatctacggttcctcgtctggggcgctcaacgcagtcagcatcgtctgcggcaagtcggtcgacttctgctgctcccacctcctgggcatggttgggcagttggagcggctgagcctaagcatcctgcacccggcctacgcgcccatcgagcacgtcaagcagcagctgcaggatgctctgccccccgacgcccacgtcctggcctcccagcggctgggcatttcgctgacccgctggcctgacggacgcaacttcttggtcactgacttcgccacctgcgatgagctcatccaggtgtggggcggggggtgcccagggcttggctggtgggcgggctccatctagtccagagtgacatccaggtacttccccgtcagacgttt

SEQ ID NO: 103634 - DNA, 202 bp, Homo sapiens
tggaggtaccaaaggaccaaagatgtttggagagatataaactaatttggtagagaattaatgaaataatatgaaagccttgattcaggatgagtagtaagcattatgtaacgtaaaggtactggatcgtaacatggaagattctccccatcccactccaagacttcataccatatttaaaggggataattgactggtgagg

SEQ ID NO: 103635 - DNA, 1494 bp, Homo sapiens
gggacgcggccttcctgcctcccacactcccaaatccatgccttgtttatctttttagaatggatctctgatgcctgcccaccacgcggctggagtggcgccagcatccccagggcacgtctgtgatgaccgatgaggtccaccacctctaccccagaccctcccatacccaaaggctccctctgcccagtgaagtccccttcgccccagcattcctgcaccaggcacatcccaagggtggccccgtgtcctgcaggtggcaggagagtgcaccctcctcagacaccagtctgatatgtcaccaggagagagcgggcggtcctcagtgtatgctcttttcttgtctctggggagcttgttttggctcctcaagaagaccttggaaaaagcacaggttgtagaggcggcattcgccgggcagaaccatgtcccaagacaactggttagtgaggccaggcgtgacaatcataatcggagcagcaactgtgcaatggcataggcaaagggggccgaaggcgcagcagccaccaccattatagtcagactgggcaccgtttcctaaatgtcacacatccttccagccccttgatctttgcttatgaaaagggtcattccctctacaatcctctagaactctttgtaggtttttgtttgttttccaaacactgtacttgcttctttatctgtctctctatgaaccgtgagtcccagaggacctcgtggtcctcaattatccttgcttctctgtggcctgtgccatggggctgaatgtttgtagcccccagaatccatatgtggaagccctaatccccactgtgctggtattaggaggtggggcctttgggatgtgattagggttagatgagggcatgagggtggggccctcataatgagattagtgaccttatcaagaggatgagacactagatcccttgctccctctctgcctgcaatcaccagtgaaaggccaagtgaggacataatagaagccatcccttcccagaacccagccatgctggcaccctgatctctagcttctcagcctccagaactgtgagaaataaatgtctgttgtctactccacccaggtcgtggtcattcattatagcagcacaaacagactaagacagtagggaacagtgattgttacattataggtgcttagctaacttgctcactgatcggctgaggtctctcccctgccattaaacagtgaaccaacaattagttagcaaatgcaatttcagcttctactgagggaaagataatacacccagcagtgtgaagaaatttctttgcagaaccaaactaaaggtccaggttactaaacacagcattagtttttctcaaatcagtatgtgttgttatacaggcaagcctaattaatcatatttccagggtatacactgaataatctgagagaagaaatcaattacctaaattcgtggttctcataattcgaagcagtcgaatttcaaagtgtaggttttaaat

SEQ ID NO: 103636 - DNA, 385 bp, Homo sapiens
agggcagggactgtgctggcttcactcgccagcacagtgagcactttacacagaggtaagtgttcatgttaaaaagaaacaaaccaggctgggcatggtggctcacgcctgtaattccagcactttgagaggctgaggcaggcagattgcttgagcctaggagttcaggaccagcctgggcaacatggcaaaaccctgtctctacaaaaaatattaatacaaaaattagccagatgtggtggcgcattcctgtggtcccagctactcgagaggctggggtgggaggatcatctgagcctggggagattgagggttcagtgagctgtgatcacaccactacactgtagcctgagtgacagagcaagaccctgtctcaaaaaaaaga

SEQ ID NO: 103637 - DNA, 516 bp, Homo sapiens
catggcagacggggttcaggaaacttatgatcatagcagaaggcgaagcaaacaaatccttctttacatgggcagcagcaagaagaagtgccgagcaaaagggggaaaagacccttataaaaagacccatcagatctgtgagaactcactcactatcacaagaacagcagcatgggactaactgcccccatgattcaattacctcccaccaggtccctcccatgacacatggagattatgggaactacatttcatgatgagattgggatagggacacagccaagctatattagcttcactgctgctgaattctacaaacatttacagaaaaacaaatatgaatccaaacttttccaaaaatggaagaggaaagattacttccaaatgcgtaaccctgatgccaaaggcagacaaacacctcaaaagtaaagaaaatggggcgaggtggcgggtgcctgtagtcccagctactcaggaggctgaggcaggagaatggcatgaaccccggggggtgga

SEQ ID NO: 103638 - DNA, 438 bp, Homo sapiens
ccagggtcacagagacagtacctggggcatctgagcccaggtgtaacagagtccggacgctgggcttcgctaagccacaaggctatggaaagtgccctcgccacctgaccagcatccagtccctcttacctcttctttaataacataatcctgattttgtttggggcagtcacgtgtccaggtaaaactgctcactatcccagccccccttttgcagctagaggtggccctgcgacacagttctgccaacgagaatcccagggaagagtgtccctcccacacccatataaaataataaaacttcactagaacaaggctctcagcccttccttcttcctgactggaaaattgatgtgatggctgaaggcacagcagccctctgccaccacgaggagagctgcactgaggactgccagtcaaaaagacaggaggtcccag

SEQ ID NO: 103639 - DNA, 289 bp, Homo sapiens
gtcataactgaactgtttttatattgaagtcaaatgtattcacagtttatagtttagaggaaatagttctatgtaccttaacctaggtacacattaataatttacacattgggcagcaatgcctgatttgcacattttaaaaatgattgaaaatttacaaaagaaataaaaagcacaactgtttgcacatagattaatttgctattggaagaaaatctgcacaaagctacctatgccatgaggaaaacattctaacttctgtcagaatgaaaggactttataggttgtg

SEQ ID NO: 103640 - DNA, 139 bp, Homo sapiens
tcttcgtcttagagtggagccagggcaaaagaggaattcaagctggaacaaggagtccgagaagacgcgactgctggacagaacaagcgatgaagccagtccccaaactgatgagcccgcagctccatccaaattaaat

SEQ ID NO: 103641 - DNA, 734 bp, Homo sapiens
gggtacagctgcctgggcttttggcacatcttgatctttagttacagagagtcaggacaagactgagatcttttgtggctgagaaacgattcaagggctgggtgcagtggttcacgcctgtaatcccagcactttgggaggccgaggcaggtggattacctgaggtcaggagttggagaccagcctggccaacagggtgaaaccccgtctctactaaaaatacaaaaattagccgggcgtggtggcacacacctgtaatcccagctacttgggaggctgaggcaagagaatcactggaacccagagggcagtggctgcagtgagccgagattgtgccactgcattccagcctgggtgacagaatgagactcttgtctcaaataataataataataataataataataataataatgtgtacaactcattggtttttagaatgttcagagttgtgcagtcattaccatagttggttttagaacattttcttcttcctagaaaggaaccccatacccattagctgtcacttcacattttctctcactgccattagtccctgggaaccactaatctgctttctgtctctctagatttgcctgttctggacatttcatataaatgagattatacaatgtgtggtcttttgtgtctggctgtcttcactcaacataatattttcaaggttcatccatgttggagcatgaatcaatacttcattttatgatcaaataatg

SEQ ID NO: 103642 - DNA, 295 bp, Homo sapiens
gctgggtatattcaaaattagaaaattacagctatgaatagttgttttccacttgattggtctaaagtcaactgaattctagagaaaactcctttgaaagtgtgttgccttggaaatggatgatcgtagcagtataatagcttttaccgtatttgaaattccagcagtttaggtgacagttgtgtctttctgaagggtgtgggcagattctgaacgggcttttcccgttgctcatcagcttggccatggctgctcttattacagcagtcactcattttcacagatgtctttaaaa

SEQ ID NO: 103643 - DNA, 208 bp, Homo sapiens
ataaatgtgtgcagctatcaattcatccatccatctatccatccaccaacagtattttactgagtgcctactatgttccaggctgtatactggcactgggcttacggtaatgagcatatactcatgagcaatgcagacatagaccctgcccccatggaacattcagtctagtaagacagactgaatacagaaaacagtcatacaaata

SEQ ID NO: 103644 - DNA, 354 bp, Homo sapiens
tgagtttatgtcttgataacctggatcttggttatacatttctctgtacaattttcatcgagttgccttggaggagttcaatgcctgtttgtataatagcttttcattgtttcagtgaacctctcatcattatcaaagggtttttcagaaaagagttaagtctgatagcctgagcattaatgaactaaaccaaaaatagatttaatcaggcatgtgcatgccgctgttcataaataatgtctattcattgctgagttaaactagatgtcaagtttttttccctttaatcttgtacatgattctgcacatagggccaaggaaaccacacctatgctgtatacttttctctgtgtc

SEQ ID NO: 103645 - DNA, 418 bp, Homo sapiens
actttttccctgtaacattcctgtcacataatctagctgccacattcagtgcagtagagaaatgatgacgaagacaggagcagatgtttgttgtaacttactatgagccaccttttaagtatttcccatgtatcaactttcttaatccttacaatgactctaagagtccttttactctcctcattaagagatgaggaaattgagccacagagatgttaagtaatttcttcaaggtcacacagccagcgaagggcagagcttttaatcactaagccgtttgcaatgattctttcatttctaggtgatattgttaggaaaatgttttaagcttcatctggaatctgccttcaagtgcctgtgatccgctggtcctaattatcatcatttcagaacaaaataagcacgttactctaaatgg

SEQ ID NO: 103646 - DNA, 487 bp, Homo sapiens
  misc_feature (37)..(37): n is a, c, g, or t
  misc_feature (98)..(98): n is a, c, g, or t
acgagcttatctctcgacatcctgtgaccctcacccngcctggctcttcctctgaccctcagcccgcctgcccttcctctgaccctcaccccgcctgnccttcctctgagactctacaatggcttttcatccaacccagcagggtctgccattcccgcaaggtggaggcatctcagaggccctgcttggccttgccctgtccaggcaggcgggccgtgggttgacctccatgagacagcagggctgggcctgctcctttgggttttaaccaacataaaggtggcaggcaattgaggacctgcacctcttaagaataatcccccaaagctgagaacaccagcatctctgcagagagcacaagttgcagggaagtagctgaaccactgcctgggtgggggaggcaccggtgggaagccctctggcacagtgacccccgccagcagtgatgccacctggcttcctgcgccaggccctgcaggaatggagt

SEQ ID NO: 103647 - DNA, 464 bp, Homo sapiens
ctctcctggcaaaataaatttttgttatagctgtttaagaaggaaactggcagataatcagaactggacggcaaagtgttttgtgatcctcctgcagattccagggtttcagtatcacctccagccatgctgatttaaccagacagacagacagcactatcacaaaagagcacacctgcagcttcctttcctggtaagcaaatggtcctctacgcagtcctctgcactcatctctgcctctcagctccctattctattcttattaaacctgagaaggaactatcacaagggcaggtagagtccaacaattctaagcacacagagctcagtataaaattctacaaaaaataggaactgctgatgctcgacagagctgaaactcagctgccacctgggccggggccggccagttgctgggcctccaccctaggtgctgctgcacacccttcagagcacagttactt

SEQ ID NO: 103648 - DNA, 358 bp, Homo sapiens
gactcctctgctgctcacagatgcattgggtgaccctggaagccctgttctgggccttgggttccccttctgatggccagggtcccttccaacccagtcgacaaactgagtatttctgcagcagacacctctacctgtgtgtgaccctgcaggcggggttgtggggaggaagagaatggacacattggtgaagggatggggcagtgggcccagaaacacacacctgcccacgtctggcccctcctttcccactcagctgtgagctcccaaaggaccaggcagtagacagtgagtggtgggcacgtaggagtccatcctattcactgcgaccctcctttcctggcccccgtgcctggct

SEQ ID NO: 103649 - DNA, 100 bp, Homo sapiens
tgtgtgcccatggcataatttcattactatgtttgccattctgcctgatttttttgtatctacccttctgaagtagatggaggtggaattttctagtgtt

SEQ ID NO: 103650 - DNA, 890 bp, Homo sapiens
attttaatacacaatattttatgtcaaatgttattggaaattatattgtgatttaccataaaatccatatgttgcttagtagaagaaatatttttttagttttacagatcaccactcattgtttttccaaccttttagaaaaatttgctactcatttattgaagaaactaggtcatttgttttatagcttcccgtgttcagatttttactgtttgcctcctgtggtgtcacttaatgtttaacttattgccaatgtcattgaaattttatttcaatgtaaatttcccctctctttcctgtaaattgatggttaaatctagaggcttgatcagattttggcgagagattttttggcaagaatacttcacaagtgttgctgtgtacttccatcagcaaacatgtaacaacgagttatttttttctgatgttagccatcaatgatctttgtctacatcttagttaattaagatttgaaaaatggtgaaagtctattgcagtcaatattactgaaaaagtaaggttctccgtgtcagctatatgactgctacataagtcgaattcaatcagaaaaaggtagaataggctggatgaggtggctcatgcctgtaatcctagcactttgggaggccgaggcgggtggatcacctgaggccaggagttcgagaccagcctggccaatatggcgaaaccctgtctctactaaaaatacaaacattagccaggcatggggatgcatgcctgtagtcccagctacttgggaggctgaggcaggagaatcgcttgaaccgaggactcagaggttgcagtgagccaagatcacgccactgcactccagcctgggcgacagagtgagattcaaaaaaagactgtctcaataaataaataaataa

SEQ ID NO: 103651 - DNA, 540 bp, Homo sapiens
ttacatggcactcctaaaatcctgatatgtcttagtatatgccattagtaatatgtgtattatgttaaattgttgtatgccacagaaataaccagatttccttgacaattgtatatttaatgtgtctttgactagaatgtcttaaaaattttatcatctacaattattgttttattggattcttctcaaaaagcggcttacagtcaactacagtccaaaatttgctccttggaagactcctgaatgcaggtttctgatgatgtcagaaagactgtgctgttggattagacagaaaacttctaggactctaattaaaaggctgatgtggtcataaagattgctaacccagtatgaagcaaaacaagagttaattgcatggactgagctaatagaggactgaactgattcttttgtggcttttttggtttgaaacattgctgattctttttgttgttcagtgtcaaattttttttctcttgagctatttgtagcccttaacaattgagtatactcttgtaaataaaatttaaagcagaaaac

SEQ ID NO: 103652 - DNA, 211 bp, Homo sapiens
gtgctgggcatggctgccccttggccttgttggtggctgccctgcagctctgggaggaaagtccctctaaagccaccgtgaaggcacctgtgattccagccacgctcagcagatagtgaattctcctggtaaaatgcagtgtctgcatctgagacatcatccacctggcacaccgaccgagaagctgctgcgccatgcactaggaatcgag

SEQ ID NO: 103653 - DNA, 243 bp, Homo sapiens
tgtctgtgccaggtgagtgatactggatcttggtcactgcactccgctccgggttcagcattctcctgaatgtgtatgcaacatttctttattaaagtagaaaaggtcgtaacatcacaaggaaaggaaaacagaagccatctgggagacaagctacatctaacaataaaaaataacaaaatttaggccaggcacagtggctcatgcatgtaatcccagcactttgggaggccgagctaggcg

SEQ ID NO: 103654 - DNA, 113 bp, Homo sapiens
gcacttgtaaatgtatgcagagactattaaacagaaatagcacgcaataaaaacaatgaatatataataaacataatgtctttccataattatttcccatcagcttgaaaggg

SEQ ID NO: 103655 - DNA, 226 bp, Homo sapiens
ggtgattcttaaagggccaccgcacaattagccccctcagcaaggcccctaatgatacgtctaattagcagccccctaattagcaacaacttaggcataattacaaacccaccaggatccaaagcaaaggctcatgctcccttctccctccgcctccctggctttcaggagaaacaggggccagccgggagtcaggaattcttctaaagcatcaaaccaaaccccg

SEQ ID NO: 103656 - DNA, 291 bp, Homo sapiens
gtagttttaatgttaaaaacaatttaggaatagctgatttccaaccatccccagtggactgatctcagatttctatcttgaaacaaagaggttggaaatctgagatcagtccactggggatggttggagggacaggagtgattttaggaattggttttacttaagatctctcttgccaggtgcggtggctcacgcctgtaatcccagcactttgggaggcctaggcgggtggatcatgaggtcaggagatcaagaccatcctggctaacacagtgaaaccccgactctact

SEQ ID NO: 103657 - DNA, 611 bp, Homo sapiens
aggcgcacgcttggcgacgtcgaaggtccgtccgcagttaaggaagcttttgcagccggacaggtcgcgaagcacacatggggcagggtccgcgctctccacacaaggtggggcgccggttcccagctggtggcaaacgggggcgcggggccaaggggtcggggcgccccttaccaggccgtaagcggcaaccctggccgcctccggatgggcgctcggagccggctccagattcgcacccgcacctgagcccggaagctctgggatatttccgccgggcgctgtcagcattgaaagaggctcccgagactggggaagaacgagatctgatggtgcacaatataatgaaggaagtagagactcaggccctagctttgtccacgaacaggactggcagtgagatgctgcaggaactgttgggattcagtcccttgaaaccgctttgtcgcgtgtgggctgctctgcgctctaacttgcgcactgtggcctgtcaccgatgcggggtccatgtattacaaagtgctttgctacagctccctcgattgctggggagtgctgcagaggaggaggaggaggaggaggaggatggaaaggatggtcccacggagacc

SEQ ID NO: 103658 - DNA, 406 bp, Homo sapiens
acttctatgtggtgatgtctaagttggaagtgtttccagtcaggagtttggggtggaaatggctagttagctaatatttgttatgcatctcttatgaaaccagcccaattgtcactgctatacacggtgagcttttgaaagatgtgtaagtcatgccaccaactgtaacatgaggcagacgaacctagcagagttgaattgcattcaggaaaaacgtatttcacggtaggtgcaagctactgtgccagagatgacaaaatgagcaagacacaaccttaaccttaatggaacttgcagaacagagaggggaaggcaaagtatttcaaataagcatgcatgttgctttctagttataccaggttttctcttctatattcatgattaatggcactacttttcagccaga

SEQ ID NO: 103659 - DNA, 298 bp, Homo sapiens
ggtgggcgttgttcttgctctctgttgtctcatccagaccattaatactcccttctccagctgaatgctttgaggttcatgtctctaacctttcctattgatgtaatcaccgtctcattcattgacgattggagttcgtagattataaccttcctcttatgctctttgtctgttagcactcttagtgattttgatacctgtgtggatgagtcatccaaaaccttaacctcttacctccttaacctctttgtctcctgtgaacatttcttaactcttccctgattacaggctagaccct

SEQ ID NO: 103660 - DNA, 507 bp, Homo sapiens
tgaatttagattctcacgtgttttaaacatgtgtggtaactctattaggtaatcctttcattgctataaagaaatacattttaaatgaccagatcttgtgtaaactcagagcaagagcacacttatcaccaagaagatggcccaagtcattcatgagggatccatcctcatgaccaaaacaccatccaccaggccacacctccaacactgggcattacatctcaatatgagatttgagcaggaacaaatatccaaaccatattatttaacctctggcctatcctaaatgtcatatcgttctcacattgcaaaatacaattcatgccttctcaatagtcccccaatagtcccattaaattccagtatgaactcaaatacccaaagtccaaagtcttatctgagacaagacaagtcctttccacctatgagcctgtaaaataaaaaacaagttagttactttcaagataaaatgggggtgtcagcactgggtaaacattcttcttccaa

SEQ ID NO: 103661 - DNA, 384 bp, Homo sapiens
ctctgagcctttactgtgtgccggggacttcactttcatggccccagggaatacagaatcttagcctcatttcacaaatgagaaaattggggttcagagaagctcagcaagtggtggccgcttgtccaacataacacagccacactaggccgtctgggtccaaagtgtgtgtttggaaagcaaaatatccatctgtggctcctcgggctaagtggaatgtttggctccaactgagccagagaagtaggaacacatggatttgctctcaactcgggacagaggagacgggccaggcaggcgtggaggagaccctcaatgcagaggctctcaagaggtgctgccttcttcttcgaggacgggatgtttctgtaagcctttcttatc

SEQ ID NO: 103662 - DNA, 199 bp, Homo sapiens
tgattatttggtttttaggtcatcattaataggaaatataaaatttgtcagacaagattctatcttgaagttaaataagggcaaattgttacaatctgttgagactatttctacacaagcaggcaggcgagtcaacccccaacactcagtcacatgaccagaaatggtgaagcaggaccccacctgcctgcagtctgtg

SEQ ID NO: 103663 - DNA, 1147 bp, Homo sapiens
taatcatatttaaggagtgtccatcaggacagcttcacctccttgaggattaaagcctaacagtactgagctatttgtctgtcaaaatgtctgcaaaattgggaaagtcatcatcactcctaacacaaacttcagaggagtgtaatgggattctgacagagaagatggaagaggaagagcagacctgtgatccagactctagcctccactggagcagcagctacagcccagagaccttccgccagcaattcaggcagtttggctaccaggattcacctgggccccatgaggctctgagccggctctgggaactttgtcatctctggctgaggccggaagtgcacaccaaggagcagatcctggagctgctggtgctggagcagttcctggccatcctcccaaaagagcttcaggcctgggtgcagaagcatcatccagagaatggagaggaaactgtgactatgctggaggatgtggagagagagcttgatggaccaaagcagatcttttttggacgaaggaaggacatgattgcagagaagctagcaccttcagaaatcactgaggaattgccaagtagccagctcatgcccgtgaagaagcagctccagggagcatcatgggagcttcagtccttaagaccacatgatgaagacatcaaaactacaaatgtgaaatctgcttcaaggcaaaagacttctttaggcatagaactgcattgcaatgtttccaatatccttcatatgaatggctcccagagttccacatatagaggaacctatgaacaagatggtaggtttgaaaagagacaaggaaacccttcttggaaaaaacaacagaaatgtgatgaatgtggcaaaatctttagtcagagctcagcccttattttacatcagagaatccacagtggaaagaaaccttatgcatgtgacgagtgtgcaaaggcattcagccgaagcgcaattctgattcagcatcgacgaacccatactggtgagaagccctacaagtgtcatgactgtggcaaagcctttagtcagagctcaaatctttttagacataggaaaagacacattagaaaaaaagtcccataagtatcatgagggaatcaaagcatttactcagagctatttcagcacaagggaag

SEQ ID NO: 103664 - DNA, 610 bp, Homo sapiens
cctctccagtggcactggcaaggtgaaaagaaagtcagaaccaactctacagaatgctctgcagacaacccagtcccctacaaaagaaattctaagtgtgagcctgactcatatctgctcaccattttatcgagctctcaggctgcagcctaaatactttaaccacacggaggatggcctgtgttttgtaggtgtcatgatgtgaggcctggtggatgtgaagagggtaagagcggggaggaacaatgtgcagatgactagctaatcacatcctatagctctgggtgtctgaagggttagaggagcagttcctaaagggtcgacgtaaactagataaactcccagggtccatctcattgttaggagctgttgtaggtctaaaagatgacacaactaaaagcagtgaagctgtttctcccactgggctggagtaatgaccccccccccaatcctcatggctcccccaaaatgcaaaaatccagcttaaaaccacaccactgtgccctgcaatcagccagctttccatgtggaggggcctacattccagctaggtttatgaagcaaggtaataagtgaagggcttgccatttcccgaatggtggcggcagca

SEQ ID NO: 103665 - DNA, 493 bp, Homo sapiens
gctactctgactaattcctatgtagtaggccatgattctcagtcatttgttgattaagaaagtgtataatttcagaagctactgtgagttcagaactgtctttaaaattaatttatattatcacagattattttttatatactggaaaagtggactaggacctagtttggctattgcatattaacgcatagggcaaaatatgtttggtgtatatggattttaagagttttgtagcaaattcaagccccccccgccccgcctgcctcacacacacagacacttccatacctcccctcagtagaaactactgtaattaggggatactggttttaaagcagagtccttgaagatagcagatattttgatatttgtcagatgaattttggttaatgtattaagaggcttttagtggagtccaacccaagatttctatatcaagatcaactgttgttgtttgataaaaggcagagttgttagattagatgtctcttaa

SEQ ID NO: 103666 - DNA, 416 bp, Homo sapiens
agtctcactctgtcacccaggctacagtgcaatggcatgatcttggctctctgtaacctccacttctgaggttcaagcgattctcctgcctcagcctcctaagtagctgggattacaggcatgtgccaagctgcctagctaatttttgtgtttttagtagagacaggtttcaccacgttggcccggctagtcttcaactcctggcctcaagtgatccacctacatgggcctcccaaagtactgggattacaagtgtgagccaccgtgcctggcccctagaggttttttgattaagttcacccaaaccttccagaggcagaaagcactcaggttgtactgcacagaatacagaaaaaggtaaccatttctaaattgatctcacaaagcaagcaataatcctaatttgaaaatagagt

SEQ ID NO: 103667 - DNA, 377 bp, Homo sapiens
aattctcccacctcagcctcctgagtagctgggactacaggcacctaccaccagagtccagctaattttttttaatttttgtagagacagagttttgccatgttgcccaggctggtctcaagctgctcggctcaagcattctacctgtcttggcctcccaaagtgctgggattacaggtgtgagccactgcacacagcccactttgtgcttttgaactcattttctcttcctggatcacccttccattcctaaactcctgcacgaattctttccacatttcaattatttgtctgtgtctttctcaacattaaaatgaaccctttctattttatgagtttgcaactcttcagtgtgatgccaagtttaatgtaaagaa

SEQ ID NO: 103668 - DNA, 470 bp, Homo sapiens
tgaaatagtaattgcataaggaaggaaatcaatctaggtgtgtgtcagtggcaacacaaattctatcagtagcactggtgtaggtactgatacttcctggaatatcagaatcacatggagggctggttacaacacagattgctggacgtcatggccaaggttcggattctgtggatctggagtgggcctgagaatgtgcatttctaacaagttattggctgattcaggtgctgctggtatggggaccatatttggagaaccactgctgtaggcaatgtaattcttttcccaaggttgttagtgactgataagcttccaaactacagtacagtttttgtgtttcaggaaattgtgccaaaaccatgaaaatatactgtgtgtgggtgtctgtatatacagatatatataataatatataataatggagttctaatttctaggctcagatagttaataggacaggctttgta

SEQ ID NO: 103669 - DNA, 762 bp, Homo sapiens
gttgacaaagatgtggaccagataagtagatgctagtgtttggggtggaggactgttcaggtaggcactaatgttgtgtcttagtctgttttcttttaattctggaggctgggaagtccaagttggaggggctgcttctggtaagggttttcttgctagtggggaatccgcagtgcaggacatcacctgtcaagggggttcacgagggacagccaaactgacttgtaaaacagctccactctcacgataactaacccgttccctcaataacccattaatccatcaatccttgaatgcatcaatccattcatgagggtagagctctcatgacccagtcacctcccaaaagttctgcctctcaacactgctgcagtggggaccaagtttctaacacaagaattctagggaacacactcaaacttagcacattacaagtagtcagctcatttgtgactttctgtgacattaaaacttttgttttcctgcagcaactgagacagtgaccactgtttacagaagtcaccctgtatttgtaacttataggtttgtctcccctgaaagaccaggcatttttggggggaggcagggatctgggtttatttggacactgtcagcatttcagtattgaatgaatggcccacatagaactcactttttgtgtgtctcttgactagaatttctccaaaactttgtcaggatccttgaattcctctccacatcatggccctgctctctgagatcctgcctcagtcctcaggcctt

SEQ ID NO: 103670 - DNA, 355 bp, Homo sapiens
gaataggctcatcgaaaggcccaggactagcagtctgaagaaatgacatcaacaagggcagggacacagtcaatctggtacccagtgtcacgctgtgtttgctgaatgagtaagactaaattagcttcagcacacttatttataaaaagtagagggcaggcgcggtggctcacgcctgtaatcccagcactttgggaggccgaggcgggcggatcacgaggtcaggagatcgagaccatcctggctaaaacggtgaaaccccatctctactaaaaatagtaaaaattagccggacttggtggcgggcgcctgtagtcccagctactcggggggctgaggcaggagaatggcatga

SEQ ID NO: 103671 - DNA, 2199 bp, Homo sapiens
  misc_feature (1111)..(1111): n is a, c, g, or t
  misc_feature (1162)..(1162): n is a, c, g, or t
  misc_feature (1206)..(1206): n is a, c, g, or t
  misc_feature (1308)..(1308): n is a, c, g, or t
  misc_feature (1328)..(1328): n is a, c, g, or t
  misc_feature (2032)..(2032): n is a, c, g, or t
caaatgcagaaagagaaaaccaaatacctcatgttctcacttctttgttgttgttgttgagacagactctctgttgcccaggctggagtgcagtggcgctgtcctggctcactgcaacctctgcctcccgagttcgggtagttctcctgcctcagcctcccaggtagctggggctacgggcgcccgccaccacgcccagctaattttttgtgtttttagtagagacagggcttcaccgtgttggccaggatggtcttgatctcctgacctcgtgatctcccctcctcggcctcccaaagtgctgggattacaggcgtgagccaccacacccagccatgttctcactttgaagtgggagctaaacattgggtattcatggatgtaaagatggcaacatcagaccctgggattactaggaaggagagaggggagggagcaagggctgaaaaactatgtattgggcactatgctcactacctgggtgatggtatcatttatattccaaaccttagcatcatgcaaaatccctatgcagcaaacctgaatctaaaataaaagttgaaattattattttaaaagaaaatttacatataaccaggtatttggttcactgagcacacatgtagtaaaatcttccctagagccaggcaaagcttttcagtttttagtgaggagtgcggtgttctctcaccaggttcctagagcacatgatccagcttggactctcccaggatctgttggagaaacatgtaggctcacgatactgaatgagaggagggaccttctatgtacacaataaatacatcaatccttgttttcttacaatctgtttcaagtgaaatgggttcctggagcacaatgggttgagagacgctcttctgtgcggatgttccctccccatatctcattttgaaaaatgatcctggatcccctccccattgcatctttaaagcaaagtgacattaatgggataccactggagccggggcattatgcagaccagagtaaagcatgcctctcctatgctttgttgttactattagcttatccactcacgtagagagactatttttgctgcgtggagtctaccctcctgaaccattgtcacagnactcaaggaaggatgcttcggcgtgatggaaacaaaatgtgtgaattccanttctgccacctagttgcagaatgaccatgttagattagttgttncatgtctaagatcctcattatcttcatttgaaaaataggaataataatagcttcttcttagacctgatgagattactaaaatagatcagcagttttcaaacnttctggtttcagggtccctntgtactcttaaaaattattgagaaccgcagagagcttttgtttatatgagttatagcaatcattatgtatcatatgtcaagttaaacagaaaattatgaaggtttattcattttaaaatgacaactattatgctaacatttttctgtgagaaatatcttccaaaacaaaagaattactgagaatagtgtttttgttttaaatttttgtaagtctctttaatgtctggatttatagaagacaactggattttcaaatatgcttctgaattcagtgtgtcatgttatgttttagttggattatgtagcaaaaataaagcttcacatagatacgtaattggtaagagaagggtatttcgatacccttctcagttaaatgcggatgttcttatttgattaatcagtaaactttgataattgatgttgtcttaaaagttgtgatgtgcaatcagaagccatattgtgaactttatgtactcaatgacataaaatccattggtttaccttgcacttggaatgacttttttgcttttaaaacagtgtcattggccatttggaaaatattagttacctagattgtacagatctcctgaaaattgactcattttatcaaaccatatcaaaaaatcataattcttaatattaccactagtctcatcagataagtcttcagtattgagaagctgtcaagcttaggatggcagatntatgttttccaaaatgctaatttttgcttgaaaactcaaattttatcattggcaacaagtgttgttttcctggaagtgacaggctcacttcattcatttcagtaatatatctgccaaatgctcaagtctgaataaccacagtttatctaaaactgttctttcaagtt

SEQ ID NO: 103672 - DNA, 996 bp, Homo sapiens
gctatctgatctgttccctgcgggccttggccattcctgtcctggcctttactggcagtctctattctaaaatgtgggcatcccacatgaggtccagcttctcctgagatccccggaggtgcagctgctgtgatggtgaccttgtttagcagatgctccctgcagtccaaactcccacccatcgtcctgccctttgatccatttcccatgaactgcttacctcagttttctcatctgtaagatggagagataactgtaagtgcttagcacagtgtttactagcacagactactgctattactgtcaagtcacttttcctttgctgccaataggtcattttctgtttatggcttcttcagtatgaactgatcaactgtaacttgaaaatttccagacttaggacttttggactcatagtgaaaggatcctttcccaattcccttgatcggtttttcctttaaaaaaaaaaaagatatttgacatcttttcactttcaagttcagtttctcttctcctttttttctgggtgatggtttattatttaaaaaatttctatgtatatgtgatttaaaagtaaacccacgtagctgaaaatgtctcataggtttttcttgcattttcagttgacccattcactttgcaaatctttagagtattatatttaagacagcttgcagctgttttcttatatatattttacatgacaaaattatatttaaaacatattaaactttaaaaaaccatagtttataatttataagccatgtagcatatttctatttttgagacaggatcttactctgtcacccaggctggagtgcagtggctcgatcatggctcactgcagccttgacctcctgggctcaagtaatcctcctgcctcagcctcccaagtagttgggactacaggcacatgccaccatgcccagctaatttttatattttttgtagagatggggtttcaccacgttgctcaggctgtaatttttaaaaact

SEQ ID NO: 103673 - DNA, 428 bp, Homo sapiens
ggttgggtcacttgcttgctgtctgttcacctcctaaaatgtagtcctttgtctttttcatggcatctgatagcagcacccactgcagtgcaggacagacacagcactgtgcaaacagccatggatggtggattcaggtatcaccctggacatgagaccccgcctgagccttgccctgccctgctctcggccagcacattgtctcccagagtccacctcatctctgttggaacagacagcaaatccatgccaatgacaacccatgccaatggcaaatctgtgcaaaggccttccagagagaagcaaggcaggtcccagacgccgcccccaccccatttcatgacagtctctgcatctgcccccatgctgcagatacggacaaactggaaagacaaatgttctgagctgtctcaggaaacctgggaggg

SEQ ID NO: 103674 - DNA, 422 bp, Homo sapiens
tgagaaaattctttgacttccaaccattgtagaaatctttcctgttagttttgatagtagggtctttcggctatataattccaagcctgatcaactggcattattaagttttctgtcatggctagttcagcaactggagtagatatagatttatatgtggataattagctccagtttgataagtaaacaaagataatgtcatgggctgatggaataactgagttttggaaacttttgctatattgagtttggctatgctggtcataacgcattagagctggcggtgtccacaggagcacagtcactcagggctcgattttcttatgcaaaagacaaacgtgtcaacgggaacagcaattgtgataaggaagtaaaatatgggagggatctgtttcctgttggtgattgctcctacgttacct

SEQ ID NO: 103675 - DNA, 141 bp, Homo sapiens
cccctctcactgctccaacggccatgccccttcattcactagccttgtcttatcccaccctgaccctctgaacccttccatggtttactggagtctctgattccactccacttccacccttccctctaactttccacaatt

SEQ ID NO: 103676 - DNA, 247 bp, Homo sapiens
tgggttaaacatcttgagttccttcaactatacctctttgtgaagttttaaaaatcccttctccttcttgttggctctgtttggaatatgcttccatttatctgtatttttcttcaagtatgccctaaacacacacagcactaatgcaggttggtttcaccaatgtggatttataattctccttgttctacaacattctgtgtttcttttaaggcaccttaagaccaaagaaagttgttaacaggct

SEQ ID NO: 103677 - DNA, 686 bp, Homo sapiens
tctctgtagtcacttgttccagggagcagacaggctgttggactgtaagaatcaggtgcagccaggtgagactgtagagtccaggagtgtgccaaaagagatgcccctttgcatcatcaccattctctggtcctgatctgtctgtgatgcaggacatgggtgagacacatgctgcactggcatcccagcctgctcttacttgctggagggtagttaataacctcatgtaacacaggccaaggagcagctaaaccaaagtttaagaagaagaaacacatgcccatgcagtgaccagaagctttggcacccggctcatctcagttgctgcattgcacaatccccacaatttaaggtgatgggttggcccagtggggctcttgcatggtgcctatgactcagtttttgctagaaagatggcatggccccactccaggctggcacataggaggtgctcggcaagttttgaataaataaaccccttgggactgaggaaagaatgcttctttcgctttgcggagttcttcagtgctcagccagagccagattgtgaatctaggcagtctggcttcagggcctgtagactcagccacttaatttatacatgcaaggtattgggttttattgggggagtggtggtggtggtagtggtattattttttataaaagtaaaaaaaaaaaaaaaaagc

SEQ ID NO: 103678 - DNA, 134 bp, Homo sapiens
tcaggctacattttagctactcatctcaattgtcatctcaaatttactcatctcaattttcacaagagaacgtgactcctatctttaacttagtgaattgtttgggtcttcaaaagaaaaagctgctctggatc

SEQ ID NO: 103679 - DNA, 663 bp, Homo sapiens
gtcccttaacaggttcagcagtccatttctgaagcctgtgtcagaaaggcaggccccagggtacaaggatgtggtgaaaagacccatggacttaactagcctgaagagaaatctctctaagggtcggattcgcaccatggcccaattcctgcgagacctgatgctgatgttccaaaatgctgtaatgtacaatgactctgatcatcatgtataccatatggctgtggagatgcggcgagaagtcctggagcagattcaggtactgaatatctggttagacaaaagaaaaggctcaagtagtctggaaggagaaccagctaacccagtggatgatggaaaacctgttttctaacctggagctgctatcctgactttttctagagtttgaatctctcccggaactctgacctagagaggatcctggtacttctttgccatgtcctcattttcttttccaacaagaataataccttaactcacaaccaacgagtcaaagatgcatgtggacataatataaagaaaaaaaggggaagctgaggtttggatttatgccataaatgttgcccacatctttgttccatcggcttgatttaaagacaattccattagatcttttctaagccttttactctataaataaatgtatttacacaataggaatat

SEQ ID NO: 103680 - DNA, 723 bp, Homo sapiens
ctcgaactcctgacctcaaatgatctgcctgccttggcctccctaagttgttgggattacaggcgtgagccactgtgcctggtcaagaaatggaactcttacacactgctggtgggaatgtgaaatggtaagccacttcggaaaacagtttgacaatttcttatgctaaaaatacacctatcagatgatttagccacttctaggtatttacttaagaaaaaataaggcatacatccatatgaagacttgtaaataaatgttctcattatttttatttgaaatagctaaaactggaaacaacccaaatatccatcagcaagtgaatggataaacaaattgtaatatttgtatgcaatataacaccactcagtaatatgaaaatgaactactgatgtatgcaaaaacgtgaaattcaaaataattatgctgagtgacagaatccagacaacaaataatacataatgtattattctatttacataaagttttagaaaatccaaactaatctaagtaacaaagcataccaatggtatatggggcttggggcaggtgagacggattatagagaaaaaagtaggaggtgatagacatgtttagtttttttgcttgtttgtttttactgtggtaatggtttttcaagtgtgtatgtcaaaacttatcaaattgtacctaatttattgtagttttattgatacctcaataaaattaatagttacatacata

SEQ ID NO: 103681 - DNA, 97 bp, Homo sapiens
agggccaccatgcggatcccagggcttcaaaactctcagccagctgctcaccccttgtttcctgaactggagctgcgtattttcacagtgactaacg

SEQ ID NO: 103682 - DNA, 444 bp, Homo sapiens
cagggattgtgaagaccctgtttcccaagctgtgaagctgcaaggtcactagacagataaattcaagtcacaaaacaggtttttccttgaaaagaagtccacatataaaatcgtgtgtgaaactattctatttgaggtgtatttctgtgccctaggatccagatataggtactcaaatttctacaaactgacaacataatatgcttacttgaaaatattaccagaataattgaagttgataattaaaaatgaaagataaaaaatatgagaattgctgaagccttgtggtgggtatgtatgataaatgttagtttataattctccctatgtttgctaagattttttattttcataatatcttttaaatatataatttaagaattttatggaaactttcacatactgtatattagccttgttttacaataaaacaagtcaaacatc

SEQ ID NO: 103683 - DNA, 500 bp, Homo sapiens
agaactactctgtggatattgttctttccactgaataagtttaatttcaaaggacgcaagttatatcaggacctgtgtaaactgtctagtccagtacctgggcacagagaaagcattcaaaatgttcatgcttttctccttcctttcttggcattggcaaatttgttaactttacacaaagcttattttgggagatatatagaacttggacctattttacttatctaaaccggatgagtcattttgatagaattgatagagtcacttcttccctcatgagataatacagcttctcaagcactttgatcctctgatattaggtgaaaactgaaaaaggtttttttggaactcagctttctaattttaactttaacctgcccaattactaagtgtgttgagttctatggataaaactacagggtcagtttgtggatttcagggctcctttctgtattagaggattggaaagacaatagactaatctggagaattgcatctga

SEQ ID NO: 103684 - DNA, 181 bp, Homo sapiens
aaggctggatacctagtgtgggagatttactgcgaagctaatgggcgcttgaaaggctgagtgtggaggggaagccaggttgctattagaatacatctcaggtaagttgtgcatggagatcaaaagggagagaagccagtctccaagattccagtaatgtgccgtggtttccgaaacttaa

SEQ ID NO: 103685 - DNA, 491 bp, Homo sapiens
aacatgtgtgagacatgatgcagctcatcaagtaattattgaatacttggtgtgtgtagcttcctgttctaggcactggagattcaaagatgactcacgatgtgtttcctgcccttggactcaaaatttaactagtaaaactggttaaaacaaacacacaaaaaattaatgcaataactgttatagtggaaagaaatgagctcacagctaaaggagtaaatcactccaggagtatctcatttcagctgggtctaaaggattagcaaagcattaacaagtgacacgaagacatgtaaggtgaagagccatgatcaaaggcataaaagtctacaagagtatttgggggacagcgagtcatcttacaccattggatgagggtgtagagtagtgatgctaaacctttaaagacatttggaaagctttcattgtctgccaacatcaactgccaagcctaaccacttctaacatttaaattttttttttccccaaga

SEQ ID NO: 103686 - DNA, 579 bp, Homo sapiens
gtgactacaactgtgtgattgtccaacttcagtgtccattcatgtctcttagattcttgaagtagaggccagttggcccagcttctcctttaggcaagcccacatttcagaggtcctagcagatgtgcttgagccagccctggcccaggaggccgcccggtgcagcccctgggcccagagccatggtgaggcgatccttagcccagagggaggcgggcatggacagtgctctgtggtggcctttccaccctccaaaagtgattgcttcttgatttctctttccctgagtctgcctcccaacttcccagactttaagctgaaaccttctcctatttcattgaaaaaaacagaagcctttagtcccccaaccctcacagtacggagccacccctcgcccccagtgccatcttcctacctcctcttgttgagttcaaagggtcctttgcctctcgaaggcaggtctgtccattcagcttcttgtcttgctcctacagagacctcttcttttttcagtgtcagggttttctcccattctattagacccctcaaacatcattctctagtttcgcttattattta

SEQ ID NO: 103687 - DNA, 372 bp, Homo sapiens
aaacataaactctgtagataaaggatttatgtatcaaaactaaaattatagaattcttagtaaaaataatgaacatcttttagacttcaggactgagaaagatttcttaaggcacacacaaaaatttgactaaaaaaacattgatttgattgtgttaaaattaagaacttttgctcatgaaaatgcatcttaaataaaaagacaaggtataaactgggagaagatattcacaatacataaaatcagcaaaagataagtagaaagaatatattaaatatcctatagatcaataagaaaaatacaaccaatctgacagaaagacaaaaggccgggtgcggtggctcacacctgtaatctcagcactttgggagg

SEQ ID NO: 103688 - DNA, 244 bp, Homo sapiens
tattttttttgtagagacaggaattcaccatgttgcccagcctggtctggaactcctgggctcaagcgattcacccacctcagtgtccccaagtgttgggattacagacaggcacgagccaccacgcctggtccacgcatgtttatttgaaagtattttgacacattgcagccccaagtatttcagcattctcttataaataagagcaaaatgttgttacataaccaccataccatttccccac

SEQ ID NO: 103689 - DNA, 1128 bp, Homo sapiens
atttgaagtaaatggcaaagtttactgactcctatgtcagttagtgataaaaaccaaagggaaaaacctacattccgggttactttgcagaacagtggtagattcttaggcctacaagggaggcatagactatactcaggagaaaagctgtttaataaataagattcaaggtgaggagtaggtagaaaagacagagttatttgattttcattttttaaggtattaaaattttttactttatatatgaaaatgtcatgaaatttataagcaataatgtattgatactcaaatttttaaaaatttttaaattttaaaatatttaatcaacttctattatttttcctcttctgggatgaattaagtggcaaacttggccattctaatatttactcactgatagccaaattttatagcgtctctatctaaagaagacagtaccagattccatttgatctagggagatagcactacaaaacttttttccttgaaaaaatattcctgaaggccggacgtggtggctcacgcctgtaatcccagcactttgggaggccaaggtgggcagatcacttgaggttagcagtttgagaacagcctggccaatatggtgaagccctgtctctactcagaatacaaaaattagccagatatggtggggtgtgcctgtaatcccagctacttgggaggctgaggcataagaatcagttgatcccaggaggtggaggttgccatgagctgagatcgtgccactgcactccagcctgggagacagagcaagactctgtctaaaaagaagaaagaaagaaaaaaagaaatattcctgagacattaactggatcccttggttgaaacagcagaggaagcagatttttgaacctgaagaaaaggcacatagaaaccaaaaaagttctcaacattattttacccccttgcagaagctagaatctcccagtttcagctgttttctcttctcccagcttcctaatgtacttactccctgagccagatattctccaactttggaagttcctcagaactcctgggaagcatgattacaaagtcagaattgtaagtagagggtggtcccagacagcaggctaccggaaccatcagacctcactggaagaaaca

SEQ ID NO: 103690 - DNA, 407 bp, Homo sapiens
attggcaataatgtgcactcaggagaatataaaagggaattctcacatgctgctgttggaagaaaagttcagtaaaaccactctggaaaacaatttggccttttctactaacaacataccttatgaccaagagatttcgatcttagatatatatccaacagaaatggcttcacatgtgcattaaaaaacacatatgaggccgggcacggtggctcatgcctgtaatcccagcactctgggaggctgaggcaggtggatcacctgaggtcaggagtttgagaccagcctggccaacatggcgaaacttcatctctacgaaaaatacaaaaattagccaggcacagtggcgggtgcctgtcatcccagctactcaggaggctgaggcaggagaaccacttggaacccgg

SEQ ID NO: 103691 - DNA, 332 bp, Homo sapiens
gacaaaataaaagcaataagaagtggaacaaagatacacaagatgaataagagcttattaattgtaaatcaaagttattataatcatcattgtctaataatcatgtatacagaattaaataataaatcttcatctctttaagttgtatcttaaacattaaatcctttttaaagaaataagagccactatttattgcatgcctgtcacatgccaggcactctttcatatattatctcaatactcaaaaccactagagagagaaaaatattatatcttagctattatagttgagggaaccagggctctcaaagtttaagtatacggcctctata

SEQ ID NO: 103692 - DNA, 519 bp, Homo sapiens
gagaatgccttctcgccgggctctctggtgcaccccccggtgatttccgggctcccctatgtaccccgcgttgatttccggcgaggccagggctgggtggtactcagtggggagcccgaggcggcgggcggatggagaaggggcgagccgaatgagaaactaccccgacagcctccaccccacacacagccggctccgcgggatacccggggagtggctgtttagccctggaccccgggtgctcggctgactttttcctagcgggggcgggtgtgaagggtgtggagggagggaggtggggtaggatggatggatcctctgcgggcaggaaggaggcaggtgctagcatagaggcggaccgttctaaacgccaccggtaaactccccactcctctgggctggaccggcctggccgtagagtagcccgacacgtgggatctcccgggattttcggggtcgggaccccctctcccagcggttctactgagcaaggcgggaggacgatcgtggagacgaggg

SEQ ID NO: 103693 - DNA, 124 bp, Homo sapiens
ggagtgagaatggaagaaaaggctttgggccctgggagtgaagcccaggactcagaacaaactcaggtagtggggagaggggatgtgtggaaaacacacaggtatagaagtctgaacacgaacg

SEQ ID NO: 103694 - DNA, 747 bp, Homo sapiens
aggcatgagccaccgtgaccggccagctgtcattatttttaacattaacaattcatctattaccttagctatggatggtgctatgtaatttgccctgcctgctccttcaccttcacatcctgccactctcccctgttaagtcagaaactgtgaagtgtcttagagtttgtccttcttgcaagctaataggttagcttgccacagtttcatatacatatactgccagaagacaccagactgctgggctggtgccataaaagatttgctactgaaagcacaaagcatttacaacaccttgtgtcatttccccatgccccatttcccgtaaggcaacagatgtttcctgtgcagtgggttgcatcacaggagaagaatcttaaatttagaagcctccaagcttttatcaaagctgctggtgacctacccattcctcccattcaggagagaaattattcattatcttgaaatgtaagtgaatttcctctgggaagaggaagaaggcccctctaggtttatcaccctggaatgtaacacactctggggtttgggaggtggatattaatatcattatgcgctttctcacctacagaagactagtctgaacttgtggcaggaacctagccagcttgattgcctgctaaaacaaaaatatcaacattcttaataggatttaaataagatccagcatctcaaaacagaatattcaaaatatccatgatacggtccaaaattacaaagcaaacaaac

SEQ ID NO: 103695 - DNA, 548 bp, Homo sapiens
tcaaattatgaggctgggaatcatttttaatctctctaatgctgattttaatacattaacctatataacatcaacttcacagtaccagtcatattctttccacattctcctataagtttaggtttaaaaaatcagctaagacctttgatcacatcagagcacagagactgatctaattttttttttttttttttttttttttgagacagggtcccactctgtcacttagactggagtgcagaggcgtgatctcggctcactacagcctcgactttgtgggctcaagcgatcctcccacctcagcctgctgaatagctgggaccacaggtgtgcaccaccacacccagctaattttttttgtattttttctagagatgggtctcaccttgttgcctaggctgattttgaaatcctgggctcaagcgatccattcccctcagcctcccaaagtgccgggattacaggtgtaagccagcacgcctggcctaaaaatgtttttaatctgactttatttctatcaacagtgaagggagcataactcagttaca

SEQ ID NO: 103696 - DNA, 106 bp, Homo sapiens
actgctctccagtctgggtgacagcgagaccccgtctcaaagaaaaggtatctataaaaacattagattctatcttgtctgaaaaaattcaaagcaaaaaagtttg

SEQ ID NO: 103697 - DNA, 478 bp, Homo sapiens
agttagaggcaggtaaggcgcctgcttcagggtaaaactagaacaaaataggattcaaaaggcagatcacaagtcaggaatgtaatatctggagttgttatgtacctgtctgcatttgttagtggttcttccaccatttgaccctgctctgtagattaatgcctcccttgctagcctttctgcttccctatggaaaatcttagcaacaaaacattgagtgcatctgagaaatatgaaaagttgagcattcagtgtttaggaggggtggtaaccaaggcagctctgtagacacaatgattgaagcacttggaaccttcagacactgtgagtctccattaagatgtttcaattcccaggataaaaatgtctgattattccaggtttcttcctagatgaatcaggtatttcttggagtgaaggtagggggtgggatgtcatgtagcacagtagggacactgaaggcccatcttatgcatca

SEQ ID NO: 103698 - DNA, 363 bp, Homo sapiens
tagaggttaaaaaaaaggtcccacattatgaaatgttaaaaatactggacttaatattcaaaatatcttttaaatgcatcgttgagctgacaagaggtaaggaaactttccagaggcccagaacaagaaatcttgaatccagggaggtaagttagtagtgatactggctcccgtgctgagggttctggtatttgtaagtccttcaaaacccagaactttggcttttgcagggtggccatagggtaccagacggtgtctagggatcaagcagttgctaagtaagatccagagacctttgtgtaaagctgaagctccctgaaagctgtcagtgggtttaactaggaaaaagcaaaaaacctatcc

SEQ ID NO: 103699 - DNA, 641 bp, Homo sapiens
gggactacaggcgcctgccaccatgcccggctaatttttttttgtatttttagtagaggcgggtttcaccgtgttagccaggatgttctctatctcctgacctcgtgatctgcccgccttgacctcccaaagtgctgggactacaggcgtgagccaccgcgcccggcctcgtgtgatttttaacaaaactttaaaatttggaataatcaataacttcaaatccataggaagctataaatatagtacacgaaaaaaaaaaaaaaaaaaaaaaaaatttttgggccgcgggacccttggaaaaagctttttcaagaaaccattgcgtttggggcgccgcgggggccccagtgaggttaggtgtgaaccctgtggatcatagacgcggtgtttccccagagggaaaaaccggggggcacacaggaaccagagtggctctgggaattcctcccccaattaaaaaagccccggcggggggcacaccggaagctgctttctgaaacaaattcccaaaagggaagtcccggggaggctccataagcgcagatcctctcaacagggagtttcaagacggagactcccaatataaatttagcccgcagacggcgggaaacagaccaagacagcagacacacacaaagagc

SEQ ID NO: 103700 - DNA, 369 bp, Homo sapiens
aacttaatgaattatgacattatagtatataaaattgatatagttttagtctccagtgtatagtgggtttcatttctatgtcagcctgcagaattattcaaataccacattctcatcctcccacgggaacaaaggaaaatcttaccctcttgatgctacagtgtgccattcaaaaatattcgtgatcatggatttaggaaagattctatgatatgacaatacaagcactaggaacaaagaaaaagtatgtaattgagactgcattgaaattttaaacttttttgtgtttcaaaggacaccacaccaggaagacattgaaaagcatatagccatgccagcctgaatgcacctgatcttttttgatctcag

SEQ ID NO: 103701 - DNA, 617 bp, Homo sapiens
gactctgtctcaaaaagagagagagagaaaggagggaaggagggaagagaaggaagggagaaggaaaggaagaaagagagagagaaaataaatatattgtaaaaattcaggatcatatattcccatgtccttaatggcaaataggcatggtctgaataagtgatttgttaaatatcatagatttgggggtagttactggaccaacactcagatttcttggcttcagaccaagcagtcttactctattttcatccaagtgattttttaaagttttagtgttgttaatgattgctctattttccgtttatggttagctttattttattctagtcatttaaaatatatatagattagcattgtgtcatagccagtgttttgccttaccagctcttactagctgacaagagccgaatctgttaaacttttaggaatttagcaagtatggttgacatcacactgatatcttaaaattggctattatgagctgggcactgtggtttatacttgtagtcccagctacttggaaagccaaagcagaaggatcacttcagctcagtagtacaagtccagcctgggcaatgtagccagattgcatctctaaaaaaaaataaataaaa

SEQ ID NO: 103702 - DNA, 628 bp, Homo sapiens
gaggccaagttctcaattccacattctctgtctccagtggtgcagctgtggctctgaaaatgctgttctgatttgaaacatagggagtttgtttggaacacatcttaagtggaattagccctcttagtctacatttagatttgttttatgaagctctaatatggcgagcagccccatccatttatgaatcatgaaagcagcattatcaaggagctgggatgctgcttctggtgacagtctggagaagatatggggcagtaaattttcaggtcttaaattgtaccaggaggagtcttgtgctgccagagggcatgacttagtagtctaattaagtgtgcaatgcctggcctcccaagtccttagttaacatctctagtagcccaggggctgggaaagaaaatgacgcatggtcctctggccagccctgcattgactgtcttactcatgtaaatgagggggcatcctggtgcagataacggcttttatttctctttggcttcgggtgtgtcatagttgggggtgttttattacatccatttattggattcatccaccaaatatctttgcttcccaattgttttgtaaaaacagattcatagtaagtttaatctgccttctatcataaaaa

SEQ ID NO: 103703 - DNA, 278 bp, Homo sapiens
gtggatagagggatggatcggtagatagatggacagggggatgcgtggacagacgaatgaacgaacaaactttctgagtgggaaccactgtggtaggctggacccttggctcaagatctcagggaagggagcagctctttgggctcctcaagcaggctgggacacgctggccggagctgccccacctcgaccgccactccattatcaggcaagctcagttatgcagtaggctctcttaccctcttgctttgtgggctctgggatagcaagagaccccc

SEQ ID NO: 103704 - DNA, 105 bp, Homo sapiens
actcaaaacaatcccgacagaaattccagccagcttttttgtagaatgtgacaagttgattctaaaacagaaatgcaaaggacctaggactggtaattgttgaag

SEQ ID NO: 103705 - DNA, 470 bp, Homo sapiens
tcatgggacatcaaactgtctgagataatatcttaaaacactcatatacacatgatagcccccaaccccttcccagcctcaggtgggagtgtcaaacctgcttgggttatttttttccccgggctaaatgtttctaggtcacttccatcctcccccactgagagctcccatacaggaaacgctaaggattccactccagtccccgagcctccataattaatgggatcactggaaaccagccggaaggatgctaggggcgaggggtcttatctctctggtctccaggcagagaagcttctcgccagatgagatgctgagtctatgcaggccctcgggccacatctgctgacactgatccagctccttactagcccacctggggctggcagtctcggggcctctttctcttcctgccccaccaccctctggagctgtctctttctataattcttccctcgtcgagtctatta

SEQ ID NO: 103706 - DNA, 655 bp, Homo sapiens
aaaaatacttcagtaaattcaagtaagaataaataattcttattctgtaataagttcaaaaccaaggaaaactgtgtgtgtaaggatcaatatacagttgtcctcagctggttccaggcccccccccaccccttaccaaaatctgctcatactgaagtcccgaagttagccctgcaaagaccctacagaacctgcacttaggaaaaggcagccctctgaataccagggattcgagtccctgaccatggatatgtgggtccacgtggttcaaacaagttttttttttgagacagtgtctcactgttgcccaggctggagtgcagtggtgtgatctcggctcactgcaacctccacctccgcctcccaagtagctgtgcctacaggcgtgtgccaccacacccagataatttttgtatttttagtagagaccaggttttaccatgttggccaggctggtcttgaactgctgacctcaggtgatccacccacctcagcctcccaaagtgctgggattacaggtgtgagccaccacgcccggccaagtttgtcattttgaaaacatatccttgttggattataaaagtaacttgtgcattatagaaattgtgaaaaataagacgggcacagagacagcaccctcagtcataattccccc

SEQ ID NO: 103707 - DNA, 776 bp, Homo sapiens
aagggggtatgttctgagaattgacttattaggcaatttagtcgttgagcaaacattatagaatatatttacacaaacctagatggtagagcctactacacacctaggctagatggtgtagcctattgctcctaggctacagacctgtatagcatgttactgtactgaatactgtagacagttgtaacataatggtaagtatctgtgtatcgaaacatagagcacagtaaaaatatggtattataatcttctggggctactgtcgtgtatgtggtccgtcattaattgagatgtcatgtagtgcatgacagattgctctgggttcattcttggttaggaaggacttccagtaagaggtatataagaaaaatgggatgatatggggatatgtggggaagtggatgtgtttctgcgagagactgtgttgacctcgggatgccaggttcaagggcactgcctctataaagatggatctgacctgtccttgtagatcctatattgtgacaatgtaaggattgtccaaggatgaatagcacattaatctcccataaccttaggtgcctcactaagtatgattaagtcttaggagtgagaataattttcattattttggtctgtagtcagcttctgatcaccaccacaatttcaaaagatctcgatttagtgtttccctgcttctgaataggccgagtgactgccttctttctcctcagtcttatcttgccagcattttaaatgtaattgatatcacctgcaattttatgccgtcctaaaca

SEQ ID NO: 103708 - DNA, 479 bp, Homo sapiens
tggcagttctcaggagctgggtggaggaataagagaggaaatgagttgcttaatggatcattaaacaggcccacatatacacaatactgtatataaaaacctcaaatgttttcaagattcttcagtttagctgaggttaaattgtccttcattcctatccatgtgactgtaacaagttgcattttctttcatgacatttgaacgtaaaacttgaatgtctcacatcacaaaaaccctgttttatggtcagacacgtatggagagagttggtcctggagatggaagataagtggaaaatgatgcttacttatgtcagagagacatgtgcctaatctatgaacatttacacataccagtgagtagaaaattcaatatcacataacaaatgctatcttatttctgaggactagcaggtaagtaaagtcactctgtatataggccactaaatccaaaaggtaggagacattatccctgtcctg

SEQ ID NO: 103709 - DNA, 326 bp, Homo sapiens
cggattcagcaccatggacagcgggcccatgacgccttgcctctgagtcactgccaccagggatgagagctgagacatcagagctgccccaaaatctacagcatttattctaatgtttaagttggggcaattccaatacatgagcaagtattttccttggttatggcccaaagcactgccttcttcactgagaggatacacaacttacatctactaaaatctgtttcagtgttcacctttacaataaagccatgagacttttgtaaaaatagaaatgattctgccattgacacaggaactgaaataatcaaaactgatacacagaa

SEQ ID NO: 103710 - DNA, 635 bp, Homo sapiens
gcagtaggccagagatttgctgggcagggatcagtacataccgtgtaagccctgggaggattgcttaaacttaggagtttgagaccagcctgggcaacacggtgaaaccctgtctctgtaaaaaatttttaaaaagctgggcacggtggctcaagcctgtaatcccagcactctgggaggccaaggtgggtgaatcacgaggtcaggagttgaagaccagtctgacaaacatggtgaaaccccgtctcaactaaaaatgcaaaagttagccaggtgtggtggcacgcacgtacaatcccacctccagagtagctgggaatacaggcatgcgccactacacccggctaatatttgtatttttagtagagacgaggtctctccctgttggtcaggctggtctcaaactcttgaccttaggtgaatcacaatgatctttataaaagaaagagggtaggagagtcagaactggagcaggagatgtgatggaagccgaggtcagagagggagatttgaagatgcttcacttctgactttgaaaatggagtaaggggccatgatccaaggaatgggggtggcttctagaagctggaaaagccaagagaaaatgttagagcctagagccttcaaaaggaatg

SEQ ID NO: 103711 - DNA, 685 bp, Homo sapiens
gcagtaggccagagatttgctgggcagggatcagtacataccgtgtaagccctgggaggattgcttaaacttaggagtttgagaccagcctgggcaacacggtgaaaccctgtctctgtaaaaaatttttaaaaagctgggcacggtggctcaagcctgtaatcccagcactctgggaggccaaggtgggtgaatcacgaggtcaggagttgaagaccagtctgacaaacatggtgaaaccccgtctcaactaaaaatgcaaaagttagccaggtgtggtggcacgcacgtacaatcccagctacttaggaggctgaggcaggagaatcgcttgaacctgggaggtggaggttgcagtgagctgagatcacaccactgcactttagcctgggcaacagagctagactcttgtctcagtaaataaattaaccgagtgcggtggtgtgcagttactaattccagttactacagaactagactccatctcaataaattaaataaataaataaataaatgaataaataactgagtgtggtggcatgcacctgtagttccagttactagggaagctgaggtgggaggatgttttgatctggggactggggaggcttaggttgcagtgaggtaagattgtgccactgcactctagcctggataaaagagccagacactttctcaaaaaaaa

SEQ ID NO: 103712 - DNA, 366 bp, Homo sapiens
atccctgaaaaaaaaatgctcataacagaatcacttgaaatagtcaaaagctggaacaaaccatttgcctatcaataatataatggataaaaattatggtgctttgatacaatgggttattgttatacagccatgagaataaaccagccagatctataaggatgaatatgacaaatataatgctgaatggacagaagccacacactaaaagcacatactctatgattccatttgtataaagttcaaaaaaaggcaaaacaaatctatggtgatgaagtcggaatagtgattacctttgggcatggcgattttggggggacatcacgaaggaggcctcttgggtgctgtcaacattgtatatctcta

SEQ ID NO: 103713 - DNA, 328 bp, Homo sapiens
aagaaaatgtcagcagggagaaaagtgcacaagtttcagtagcagagggagacattaatcctaacacaaatcaattaccgtacgaactttacatgtgattactgtaccattagtggtgctatttgtaatcacaccagcctcctagactttagcaaatttattatctgtaatgtatccccctttggccctgtctaaccctgtttgaggcaatactcaggacagttcctatactagcggcctcacagagcctcctgatatgccctgcacaagccctgagcacgtcggggaaagagaggtcctaacagcacggtagttccatattgccagt

SEQ ID NO: 103714 - DNA, 352 bp, Homo sapiens
tgtgccttagcctcccgaatacctaggaatacaggtgcatgccaacatgcccagttaatcttttaaatttagttttattttttctactttctttaatttttatttttgctctttcagcagaatcattttctaacaattttttatagagatggtatcttgctgtgttgctcaggctggtcttgaactcctggcctcagcactgggattataagtatgagacaccacacttagcctcacccgtctttttaaaactttaaagtacttggctgcaggaaacacttttatggaaagcaaaaggtaaatgctggaataaattcagggaacagtcataaaattttctactttccttctg

SEQ ID NO: 103715 - DNA, 441 bp, Homo sapiens
tttttttgagaaaaagtctcactctgtaccccaggctggagtgcagtggcgtgatcttggctcaccacaacctccgactcccgagttgaagcgattctcctgcctcagcctcagcacaccactgcacccagctaattttttgtatttttagtagagatgggatttcaccatgttggccagactggtcttgaactcctgacctcaggtaatctgcccaccttagcctcccaaagtgctaggattacaggtgtgagccaccacacccagcctcaaatatcctttaaccttttcagagacacgaaatgaaaggcattaccatcctctttacttctctccaaagtgagagctgttgatgacacagcatcacctcctacatctaggcttttatttggggttgttttttttttgtttttgttttttttttaataaaagagatggagt

SEQ ID NO: 103716 - DNA, 424 bp, Homo sapiens
caccccagggccaaatattaagacattatagctacaaaacttaattgacaaaccacataaaagatcgtaaagcaaagaatagtggagagagatgatttatgaaagctaatcgtgtccagaaaagccgggcctcccagggctggtctgggctgcctgaaagcagcccagtggacaggttccttgttcggtgcaaccaattcaccagcaccatcgccaaaccttcacaggggattgtggagaaattgaaatatcctgagtgtgtaccagataggtccagaagtgcctggggagagcaacagacattaatctctcaagtagttcactgaatgcccactatgtggcaggaactgctccaagctccctcggggagtcctctcggggaggacctcagaagttcttgtgtttgtttgttttatttttattt

SEQ ID NO: 103717 - DNA, 370 bp, Homo sapiens
aagggtttgcctgagactcatagccaaagctctgtgactttcaaaatgagactggggaaataatcccctgctgttactatgtgattcaaggcacctggtcactttctttccttactttctttgtaacactaaaggacagtcttctcttcttgttaacctttcatgtaaatataagttaatgtatgtatttgtattaggagtaagcaagtgtgtgtgtaatgaatttgtctttcttgaaatgcaaagggatgttagacttaactattatcaaaatgtaacttccaaaaagaaattttaaatagtacacattgtctttactatggtaagcaaactatttcttggaagggatccatggatcttgacttacttt

SEQ ID NO: 103718 - DNA, 2434 bp, Homo sapiens
  misc_feature (1718)..(1718): n is a, c, g, or t
  misc_feature (1751)..(1751): n is a, c, g, or t
  misc_feature (1820)..(1820): n is a, c, g, or t
taaaaaaaaaaaccttgtggcaaatcactttgcaaagcagacttactttataaatatgttgcccttttgttttaaagccagattttaaagtacggcttgaaaataggttatatttcagaagttagtttagatgaggtatttggaacttggaaagaattttacaggtaagtatcagtaattcgtcttatgggtaaactgtgcatccatctagaattagtatgttttaaaagaagaatcatgaaaataaaaattaaagttttcagtgaagtagaaaaggtaattcagacgattagaattatccttaagatttcaagtaatatataggtaatgagaaatgaaactgtttgaaaaataaatagaaatgataggaattttgaattatcagaagttgggagtacttttacatttcctgcttaataaaatgggcctgagttacacaaaatatttcagcttagtcaaatttttgctaggttgggaattataatctctgtaaatggggcctttgtgtcagcaagagcttaagacgtaaaagctcctctgttccttgtaataaccgagcggggcaggttctggccttacctccattttacacctgaggaaactgaggcacagaggtccagaccttggcaaggtcatgctgttcctgagctcgggtttgaagccagctgttggagtcccaggtgtgtgctcccacgctcttactgtcacctccactcttagtgggtgagggatggaaaatagggctccaagtgctgtatgattaagcctgattagtggcgaatgaaacccgcacttcccagataaactgcaggagtcccaggaagtgccctaccagccccttgactggctgggaacattccccttccagtgaccttggcaggaccgacgcccttggatgagcggctccaggtgtagctcaggcatttattccagccccattgccagggcactgccatctcgaggggttctgaaatgctgcttggagaggagagaaaagtgttgaagtcggattgtttagatcagtgctggccaatagacaaagcaagccccatgtgaaattttcccttttctagggaccatgttaaaagagtaaagagaaacaggggaaaactgattctaataatatgtcctaaatacaattttgaaatgtaatgaatatttaaaaattgagatattttacattcttttttcataccaaatctttgaaatcaagtgtgccttttacactgacggcacctctcaattcacacgagccctgttttgtgtgctcagtaattgcatgtgactcgtggctcccacactgatcagtgtgggtttagatagtagctaaatggtgacataacagccccactaatgctgaccatccccttcccctagatggcaagagacttctggggccccagtggctggactatgactgtgaccgagctgtgatcgaggactgggtgttcagggtcccccatgtggccatattcctgagtgtggtcatttgcaagggctttctcgtcctgtgctcgtctcttgatctgactaccctggtccctgagcgtcaagtggaccagggcaggggttttgagagcatcctggatgtcctctctgtcatgtacatcaacgcccagctgcctcgggagcagcggcaccgctggcgcctgctcttttcgtctgagctccatggacacagcttctcccagctctgtggccacatcactcaccggggnccctgtgtggctgtcctcgaggaccatgacaancatgtgttcggtgggtttgcctcttgctcttgggaggtgaagcctcagtttcaaggtaagacttggtgncctgaaccttgacgagtggcacagcacgggcaaagagctctggagaaagggagagggtgggggtgctaaatagggctctcccatcttctccaagtgtttctctagacgcagtcggggcgataggaaaatgtgatgctgctctgtggtgtttatcacatcagggttcttcaggacaggccgtgtgacccccagttttcaggtgagggcacgggcccagttattacacggtgccgggtctatggggcgtgggagaagtcaagccacagatgcctccgaggggaccaggagatggtaattggttcagatcggacattttccttccctgggccttcctgcccctgcccccaccgccacgcgtttgcttgttggaatttggaagctttgtgcatgaccttgaatgcactggatgaaaggttctaagtaaattcttttccttccctcaaggaagaatactctgatgaaaagagtcctttaaaaatatttaaaacacaggccaggtgcagtggctcacacctggaatcccagcattttgggaggctgaggcaggaggatcacttgaacccaggagtttgagaccagcatgggcaacatagtgagaccttgcctctatctta

SEQ ID NO: 103719 - DNA, 1672 bp, Homo sapiens
  misc_feature (956)..(956): n is a, c, g, or t
  misc_feature (989)..(989): n is a, c, g, or t
  misc_feature (1058)..(1058): n is a, c, g, or t
ctctcgagaggagcccgtgggctgctggaccggaccggacagcaccaggaagcccggcaggagaattctgccagatatcaggacagatggggaacagcagaagccgtgtggggcggagcttttgttcacagtttcttcctgaggaacaggcagagattgatcaattgtttgatgctctgtcatcagataaaaacagcccgaatgtctcatccaaatccttctctctgaaggcactacagaaccacgtcggggaagctcttcccccagagatggtcaccaggctgtatgatggcatgcggagggtcgacctgacagggaaggcgaagggacccagtgagaacgtgtcccaggagcagttcacagcatccatgtcccacctgttgaaaggaaactccgaggagaagagtctcatgattatgaaaatgatttctgccacagaaggtcccgtgaaggccagagaagtccaaaagtttacagaggatctggttggctctgtggtgcacgtgctaagccacagacaggagctgagaggctggactgggaaggaagccccagggcccaacccccgggtgcaggtgctggctgctcagctgctctctgagatgaagctgcaagatggcaagagacttctggggccccagtggctggactatgactgtgaccgagctgtgatcgaggactgggtgttcagggtcccccatgtggccatattcctgagtgtggtcatttgcaagggctttctcgtcctgtgctcgtctcttgatctgactaccctggtccctgagcgtcaagtggaccagggcaggggttttgagagcatcctggatgtcctctctgtcatgtacatcaacgcccagctgcctcgggagcagcggcaccgctggcgcctgctcttttcgtctgagctccatggacacagcttctcccagctctgtggccacatcactcaccggggnccctgtgtggctgtcctcgaggaccatgacaancatgtgttcggtgggtttgcctcttgctcttgggaggtgaagcctcagtttcaaggtaagacttggtgncctgaaccttgacgagtggcacagcacgggcaaagagctctggagaaagggagagggtgggggtgctaaatagggctctcccatcttctccaagtgtttctctagacgcagtcggggcgataggaaaatgtgatgctgctctgtggtgtttatcacatcagggttcttcaggacaggccgtgtgacccccagttttcaggtgagggcacgggcccagttattacacggtgccgggtctatggggcgtgggagaagtcaagccacagatgcctccgaggggaccaggagatggtaattggttcagatcggacattttccttccctgggccttcctgcccctgcccccaccgccacgcgtttgcttgttggaatttggaagctttgtgcatgaccttgaatgcactggatgaaaggttctaagtaaattcttttccttccctcaaggaagaatactctgatgaaaagagtcctttaaaaatatttaaaacacaggccaggtgcagtggctcacacctggaatcccagcattttgggaggctgaggcaggaggatcacttgaacccaggagtttgagaccagcatgggcaacatagtgagaccttgcctctatctta

SEQ ID NO: 103720 - DNA, 1920 bp, Homo sapiens
  misc_feature (1204)..(1204): n is a, c, g, or t
  misc_feature (1237)..(1237): n is a, c, g, or t
  misc_feature (1306)..(1306): n is a, c, g, or t
ctctcgagaggagcccgtgggctgctggaccggaccggacagcaccaggaagcccggcaggagtcttgctctgtcacccaggctggagtgcactgttgtgatcttggctcactgcgacctctgcctcctggttcaagcgatcttcccacctcagcctcctgaatagctggaactatagtcacacgccaccacacccggctgagagaattctgccagatatcaggacagatggggaacagcagaagccgtgtggggcggagcttttgttcacagtttcttcctgaggaacaggcagagattgatcaattgtttgatgctctgtcatcagataaaaacagcccgaatgtctcatccaaatccttctctctgaaggcactacagaaccacgtcggggaagctcttcccccagagatggtcaccaggctgtatgatggcatgcggagggtcgacctgacagggaaggcgaagggacccagtgagaacgtgtcccaggagcagttcacagcatccatgtcccacctgttgaaaggaaactccgaggagaagagtctcatgattatgaaaatgatttctgccacagaaggtcccgtgaaggccagagaagtccaaaagaaatcttttggagaaaggattttagaggaaaatgagtctcagggcttgggttttgtctgatctgtcatgtccagaatggtttattcctagtcagatatgtttttagtttacagaggatctggttggctctgtggtgcacgtgctaagccacagacaggagctgagaggctggactgggaaggaagccccagggcccaacccccgggtgcaggtgctggctgctcagctgctctctgagatgaagctgcaagatggcaagagacttctggggccccagtggctggactatgactgtgaccgagctgtgatcgaggactgggtgttcagggtcccccatgtggccatattcctgagtgtggtcatttgcaagggctttctcgtcctgtgctcgtctcttgatctgactaccctggtccctgagcgtcaagtggaccagggcaggggttttgagagcatcctggatgtcctctctgtcatgtacatcaacgcccagctgcctcgggagcagcggcaccgctggcgcctgctcttttcgtctgagctccatggacacagcttctcccagctctgtggccacatcactcaccggggnccctgtgtggctgtcctcgaggaccatgacaancatgtgttcggtgggtttgcctcttgctcttgggaggtgaagcctcagtttcaaggtaagacttggtgncctgaaccttgacgagtggcacagcacgggcaaagagctctggagaaagggagagggtgggggtgctaaatagggctctcccatcttctccaagtgtttctctagacgcagtcggggcgataggaaaatgtgatgctgctctgtggtgtttatcacatcagggttcttcaggacaggccgtgtgacccccagttttcaggtgagggcacgggcccagttattacacggtgccgggtctatggggcgtgggagaagtcaagccacagatgcctccgaggggaccaggagatggtaattggttcagatcggacattttccttccctgggccttcctgcccctgcccccaccgccacgcgtttgcttgttggaatttggaagctttgtgcatgaccttgaatgcactggatgaaaggttctaagtaaattcttttccttccctcaaggaagaatactctgatgaaaagagtcctttaaaaatatttaaaacacaggccaggtgcagtggctcacacctggaatcccagcattttgggaggctgaggcaggaggatcacttgaacccaggagtttgagaccagcatgggcaacatagtgagaccttgcctctatctta

SEQ ID NO: 103721 - DNA, 628 bp, Homo sapiens
ctctcgagaggagcccgtgggctgctggaccggaccggacagcaccaggaagcccggcaggagtcttgctctgtcacccaggctggagtgcactgttgtgatcttggctcactgcgacctctgcctcctggttcaagcgatcttcccacctcagcctcctgaatagctggaactatagtcacacgccaccacacccggctgagagaattctgccagatatcaggacagatggggaacagcagaagccgtgtggggcggagcttttgttcacagtttcttcctgaggaacaggcagagattgatcaattgtttgatgctctgtcatcagataaaaacagcccgaatgtctcatccaaatccttctctctgaaggcactacagaaccacgtcggggaagctcttcccccagagatggtcaccaggctgtatgatggcatgcggagggtcgacctgacagggaaggcgaaggtagtgtaacagatattacctggtctgaacaacagagagaaaaaatattttaaaaaaaatgaacagagcctcagggactttgggaatgatacccaaatgtctaacatttgtgtcatcagaggtcctgaaggagaggagaaagagtgtggggcataaaatt

SEQ ID NO: 103722 - DNA, 136 bp, Homo sapiens
atgaggagatggaggcaagagaggggaagtgacttgcccaagctctcatagccagcacttgtaatgaagatttgaacccaggtagtcactccagaggcttcatgcttaaccacctccaagactgaaaatcttgtag

SEQ ID NO: 103723 - DNA, 115 bp, Homo sapiens
ggtagagggtagttaggatgatccatgatctccatcatgatgatgatggtattgatgatgtaagtcactgaaaatatttggtgttataagaataatttcttcctgattgtcagtt

SEQ ID NO: 103724 - DNA, 306 bp, Homo sapiens
catgggacaaaagaatctgaacaacagccttcagccctagaacttccctctgacagaggctacccaaatgagaagcaaccagaaaaccaaccctggtaatatgacaaaacaaggctcttcaatgcctccaaaaaaatcatactagtttaaccagcaatggctccaaatgaagaagaaatccctgatttacctgaaaaagaattcaggaggttagttactaaactaatcagagagggaccagagaaaggcaaagcctaatgcaaggaaatccagaatatggtacaagaaatgaagggagaaatattc

SEQ ID NO: 103725 - DNA, 2005 bp, Homo sapiens
tagtatgtatcaaaatttccttccttttttaaggccaaataatattcagttgtatgtatatagcacattttgtttacctatctgtcagtggacacttgggttgcttgtgcctttgggtaactgtgaataatgctgctgtgaatatgggtatacagatacctctgtgaccctgctttcagttcttgtgggtatatacccataagtggaattgctggagcacacagttattctaattttttcaggatcagccgtactgttttccacagcagccatactagtctacagtaacagcacacaaggatttcaacttttccacattcttgcctatacttgttattttttatttttttttaaatagtggccatcctaataggtgtgaagtatctcagtgtggttttaatttgcatcttcctaatgattagtggtgaacataatttcatgtacttgttggccatttgtatatctctttggagagatgtctcaagtcattttgaatgagttaaatcattcaaatgggttaaatcccttaaaatggttaaggtggtagatgggtattaaaaaaataggttgtttgctcttttattgttgaagttccttgtatattctagatgttaacctcttatcagatgcatgatttgcaaatattttctcccattctgtaggctgcctttttttttttttttaaatgcacaggggttttgcattttggtgtagtctagtttgtttttacttttgttgcctgtgcttttggtgtcatacccaagtcaccgctgactccaatgaagtttctcctgtgttttcttctaggagttagagttttagcttttaaattatgtctttgatctattttgagttaacttttgtatatggtgtgagtgtccagcttttttgcctaaggatagctggttttcccaacaccatttgttgaaaagatgttctttccccattgaatggtcttggcatcctgtggaaaatcatttgaccatatatgccagggtttatttctgggcatgctattctattctgcacttctgtctgtacatatttatgccagtgccacattattttgattactgtagctctgtaataataagctttgaaatcaggaagtatgcgacctccagctttgttctttttcaagattgttttggctacctggggttccttgagattcgatgtaaatcttaggatggatttttctatttccacacacaaaaaaatcagttgggaatttgatggggggggggtacattgaatctgtagctcacttttgatagtactgtcatcttaacaatattaggtctttcaatccatgtgcgcaagatgtctttccattttttggcattcttaatttctttgcagcaaaattttgtagttttcaatatacaagacttttgcctctttggttgtttattcctgagtattttctttatgatgctactgtacatagaactgtttccttaatttcctttggagattgttcaacaatggtgggttgttttttttttaaacttttagaaatacatttaattcaattctataaatattagtcattcaaaatctggccacaatcttaggaatacaaaagtaaaatcccagttctttttttcctaaaatgtcacaatgtaatagatctaacattgcatatatttctgatgtgatgaaatgttgatatatattttctatcgtgcaaactacagctctaaaatttttcaaagatagtacatgtattatgttttctataatacttacaccatcattattgttttaccttttatatctcatattctattttaattatggaatggtattattacatatccctgataaaaatattaaaatgtgctatgggaaaattaagaaaagacatattaaataaaccttgttatgtagtagcagggacgtgggaaagctccttggaagaagtaaggttcatcactcagaagtcaacctatttaatacagagataatgattcaactttacttcagagaatttaaatctgca

SEQ ID NO: 103726 - DNA, 1035 bp, Homo sapiens
tccttatctttttaaaaaaattattcttcacttttttgcctcctattacttgttagggagacccaatggtagttttattccttggggatacatagtaaatacttcattaaagtcgagtacagaatttgatgaaaagtgtggatgtgtgggatgtactgccgccttcagaagtccacacactgcctggagggagagaactgctgtttattcactgattaagcacttgctgtgtaccaactacttttcatgtcttatcttaattctcataacagtcatttgatattttaaaaaaccccagaaatctgagaaagagataaagtggtttgctcaaggttatagaacagactaccatgtgttgtatttcagattttaattcatgtttgtctgattttaagttttgttcgcttgccagggtaccccacaaaaatgccaggcagggcattttcatgatgcacttgagatacctgaaatgacagggtagcatcacacctgagaggggtaaaggatgggaacctaccttccatggccgctgcttggcagtctcttgctgcatgctagcagagccactgtatatgtgccgaggctctgagaattaactgcttaaagaactgccttctggagggagaagagcacaagatcacaattaaccatatacacatcttactgtgcgaggtcattgagcaatacaggagggattttatacattttagcaactatcttcaaaacctgagctatagttgtattctgcccccttcctctgggcaaaagtgtaaaagtttgctgctacaaagaatacagaaaactcagaaagaaatgctaacatacacatttagctggccctatggatatatcatattaactgcttatcgttaggggctgtatatttgtaaaataaaagaattttgggagttccatctctcggctttggagcccccctccttttgtctctgtatggaggagcttcgtccttctgcctttttctttacctgttaaattctccactccttaaaactaaaaaaaaaaaaaaaacaaaaa

SEQ ID NO: 103727 - DNA, 811 bp, Homo sapiens
tccttatctttttaaaaaaattattcttcacttttttgcctcctattacttgttagggagacccaatggtagttttattccttggggatacatagtaaatacttcattaaagtcgagtacagaatttgatgaaaagtgtggatgtgtgggatgtactgccgccttcagaagtccacacactgcctggagggagagaactgctgtttattcactgattaagcacttgctgtgtaccaactacttttcatgtcttatcttaattctcataacagtcatttgatattttaaaaaaccccagaaatctgagaaagagataaagtggtttgctcaaggttatagaacagactaccatgtgttgtatttcagattttaattcatgtttgtctgattttaagttttgttcgcttgccagggtaccccacaaaaatgccaggcagggcattttcatgatgcacttgagatacctgaaatgacagggtagcatcacacctgagaggggtaaaggatgggaacctaccttccatggccgctgcttggcagtctcttgctgcatgctagcagagccactgtatatgtgccgaggctctgagaattaactgcttaaagaactgccttctggagggagaagagcacaagatcacaattaaccatatacacatcttactgtgcgaggtcattgagcaatacaggagggattttatacattttagcaactatcttcaaaacctgagctatagttgtattctgccccttctttggccagggggttgctggtccacagaatccggaactcagaggtggttccttccct

SEQ ID NO: 103728 - DNA, 1034 bp, Homo sapiens
tccttatctttttaaaaaaattattcttcacttttttgcctcctattacttgttagggagacccaatggtagttttattccttggggatacatagtaaatacttcattaaagtcgagtacagaatttgatgaaaagtgtggatgtgtgggatgtactgccgccttcagaagtccacacactgcctggagggagagaactgctgtttattcactgattaagcacttgctgtgtaccaactacttttcatgtcttatcttaattctcataacagtcatttgatattttaaaaaaccccagaaatctgagaaagagataaagtggtttgctcaaggttatagaacagactaccatgtgttgtatttcagattttaattcatgtttgtctgattttaagttttgttcgcttgccagggtaccccacaaaaatgccaggcagggcattttcatgatgcacttgagatacctgaaatgacagggtagcatcacacctgagaggggtaaaggatgggaacctaccttccatggccgctgcttggcagtctcttgctgcatgctagcagagccactgtatatgtgccgaggctctgagaattaactgcttaaagaactgccttctggagggagaagagcacaagatcacaattaaccatatacacatcttactgtgcgaggtcattgagcaatacaggagggattttatacattttagcaactatcttcaaaacctgagctatagttgtattctgcccccttcctctgggcaaaagtgtaaaagtttgctgctacaaagaatacagaaaactcagaaagaaatgctaacatacacatttagctggccctatggatatatcatattaactgcttatcgttaggggctgtatcagggctgcttatgcgctctttctaccaagtgggcaaggaagttcgacccccctccttttgtctctgtatggaggagcttcgtccttctgcctttttctttacctgttaaattctccactccttaaaactaaaaaaaaaaaaaaaacaaaaa

SEQ ID NO: 103729 - DNA, 1187 bp, Homo sapiens
ctcccaagtagctgggactacaggcgcctgccaccatgcccggctaatttttatatttttagcagagatggggtttcactctgttggccaggctggtctcaaactgctgaccacaagtgatctgcccacgtcggcctcccaaagtgttgggattacaggcggtagccactgtgcccagcttgtatacacgtttaatagaccttgccagtgatttttagtatctgcttttctcactggggaaagaactatatctgaactttttaaattttagtcttccttggtgatgtgatacatcgtaggcatccaaatgtttgccttgaatttttactgctatcacttggttgctactgacacccaaaccaatcagacctactaaatatcatatattattatctttatacctgtaattttcctataccatttccttttctctaaattatcagaattttcttcggtgctatcttaagaataattcccttatattatattaatcttgaatcccattgacttttcctgaaaaaaaattaactcccatttccacatggatcttaatagttcaactctttatttacatgaatttttctcaaaactttgtgattccatgtagtagaaatgaaatataagtccaaatgatacacttcaaagacaaacccaagatacatgagtaaggaatcctgctcatcaactatctttatatgttaatcacattatactagtatttatttcaaagagatatatggactggaaggatacactttataatagagtacctcttgaaggggttgagtggtcaaagaaggaatattacttttatttgtaatgttttaatatttatatgagggacaataaatacataggtacatatgaacataccacataatttaagtacctacattgcaaaaacaatggaggctgggcagtggctcacacccataatcgcaacactttgggaggccgaggtgggaggatcacttgtcatgacttgagaccagcctggacaatatagatacagcgtgtttcttcaaaaattttaaaaaattagccaggcgtggtggtacatgcctgtgattcgagctactcgggaggctgaggtgggaggatagtttaagcacggaagattgaggctgcagtgatctttgatcctgccattgtactccagcctggcaacagagtgagaccctgtctcc

SEQ ID NO: 103730 - DNA, 481 bp, Homo sapiens
caggtgttgggcttgactacatgccacctctaagagtctgggccatgcagagaagaaaacaatcccttcttaggaacttcagtgacacctaaacaagcagggcagctctggtaactggttaacaagcattctccagaaagcatttcctgacacccacttgcagtcctgtctccccccttgcagcacaggtggtcctgcatcaccacagcttttctcttgcctatacctgtttctggacaggaagccctttgggggtggggatgggttggtgtgtagctgtgcaagggacatcacagctctcagcaaggagagcttgagtgggtgggacttccctcagatgtctgcctagtgttggagcacaatgtcggggtcacatccttgaccagaccctaagctgcttgaaggctggtactccagtttctccctctctctgtagcttccccatgttctgggaaggggctggcctggcacccagcaggcg

SEQ ID NO: 103731 - DNA, 412 bp, Homo sapiens
aggcacaaaggaagtgattccctggtgagattgcagcaaagtaaagaacattagtgcactccaacaccaccagtagtacctcctcaccttctcactacagcctgaggctctgtgtttatcctcctcaaagccaaagtcggagaagcctatgtaaattaggtttgagattttcccaaaaacctaaattgctaggagagccgaggatggtgaacccgaagttatggcctgctatttttcctgctatttagaggccttgcataaaatgcacgtccaaaacaaccctgcataatttcagaggccaaatcttgcagagattattgatggacaattagaagccagaaattctatttcaagtttatttttattttttaaacttatatttgtcatgtgtctgaactctgctaagcatttt

SEQ ID NO: 103732 - DNA, 730 bp, Homo sapiens
gcaaaagttacccaactcttgtagactttttgtgaatgtaagttggcaggctgttttctatacagacatctcagctgaaattttattggctaaatccccactgaaagaagtttaccctttgcctttcttctcagcaaagctcggagcatctttatttttctgtttccagggccagtgactctattcctattttgtggagggagatgttttggctcagaggcacagtgctttggcctgaggaatgataggcagaatcaagtcgaagagggctttctgccctagagatctttcctaggctgcaagaatagccatgctttattggccagtatgacaagatgaagaggtccctgtcagatttggaagggcctgccccttaggcaagatctttagaagttaaagctgggccaggaggattggaaagagcaagaatttgaaaaaggctttactaggccaggtgtggtggctcacgcctgtaatcccagcactttgggaggctgacgcaggaggatcacctaaggtcaggagttcgagaccagcctggacaacatggcaaaaccccatctctactaaaaatacaaaaattagtcaggcatggtggcacacacctgtaatcccagctacctgggaggctaaggcaggagaattgcttgaactcgagagacagaggttgcagtgagccaagattgtgccactgcactccagcctgggtgacacagcaagactctgtctc

SEQ ID NO: 103733 - DNA, 421 bp, Homo sapiens
taatgtgacaggtgctaccacagtctgaaaggacagaacagcagctgacaaaggggcaaagaatcccgtggctaggcttggctttgtctatttgatacgtgttttatttgtggtgggggctgagggagggggtgaggttggtcaagggatacatttccattacatagaaagaattgagagatctattgtacaacatggtgactacagttagtaacaatgtattgtattcttgaaaattgtgaagagagtagattttaagtgtcctcaccaacaaaaaaaaagttatgtgacttcacataagtaattcacatatgtattacttaatacatatgttaattagctcaatgtagccattccacagtatttacatatttcaaagcaacatgttgtacataaatatatacaatttttatttgccaat

SEQ ID NO: 103734 - DNA, 407 bp, Homo sapiens
cagccttttggagattccaaggattttagaaattgtatgtcaggaaatggggatgaaaaccaaatatatatttcacaatatcacagctatccaaagtgttaataccttttaatacactgcagagcaagagtttgtcgatgttccccactcccacaatagtaatagtaataattcttttacatttttatccaactgggtagatgaaaaatggtatctcagtccatttactccaatctcagacaagtttctaaaatgtttggttgtgtgcttgccaaacccacagtagatcagaagcaggaactttggaagaagaaagatgcactgatatagtcaagtccactggcagcagcatgagtaatagcagacagaccaacagtgagcaaggatacaagaaaccccccacacag

SEQ ID NO: 103735 - DNA, 372 bp, Homo sapiens
ctgaaaaatcagaacacaggcccttcattcattcatttgttaattctgcccctactgattgagttcctgctgtatgctaggcatagttaaggcactaggaaatcgaaagtaagtgaggcaaaatcccagtcttcctggagcttaaagcctaggcgggagagataaaaacataactagtaaaacaaataaatttatgtgtcaggcgatgtattgtagaaggaaataaggtagagtcagaggtttaagaggtgtaggaattgaagtaggggcatccaatatatgtagggtggtccaaaaaggccttaaaaaactaagagagtggataaaccaagtggatgtcaagggagagaccatttcagagacaaggaacag

SEQ ID NO: 103736 - DNA, 290 bp, Homo sapiens
aacagcagtagcactggtcataacaatgatgaagaacgcatatttttgccaggtcgctgaacattttaaagatcctcccacagtgctgggtttacaggcatgagccaccatgcccgacctcacaggatttttttataaccatttcaagcccaggaactacatctacatgacctgatggtgttcttgaatcccacagtgtgtgtgttagtctcagctttgtagatggcattcatagaagacatgaaacaaggtagtatggtgagatggagtacaggctttattatcatacc

SEQ ID NO: 103737 - DNA, 374 bp, Homo sapiens
gaacatgcgttcagaaactcgcaattctaaacagttgcagcaggacgaggcattctcattttcaaatgggctttttgctcaacaagtattttccactctaagaatgattaattattctcctgattaataatttcaacacaatctacagtcagaagggagcacagctttactgaccaagatgtgtttctaattaacacaaaagcctgtcatttctaacagggggtacaaaagagacacctcattcatttgcaggtaatatatttccagtctcattataggtactgagtcatacattaaacatagtcttggaaaatcagacaggaagtttattctcagatgaaacaaatcatgaataaaaaggaactaaatattac

SEQ ID NO: 103738 - DNA, 238 bp, Homo sapiens
tttaagacaaagtttcacttttgtcacccaggctggaatgcagtggtgcgatctcagctcactgcaacctcagcctcccaggttcaagcgactctcccgcctcagcctctttaatagcttatccctatgctttttaagagaagcagttgtatgtttgaagacccgtctgggtgatgctggctcaacaagtaggagttgacatgactgagtgctgtactcatgtgaggactaggtatgg

SEQ ID NO: 103739 - DNA, 357 bp, Homo sapiens
gaaagtacaagtggggatattgtattcctatataaattatgattgaggccaggttaattttttctaggttacatatggatgagagaaagggtgtgtgcatttttatgaggtcatggacggtcagggcttactaatgtctctgaataagtatcttatgcatggcatttaaccctctcccagctacctcttggagaaaaaaccaaacaggtggacagccacccacagcctgccattcctgtgtcagagcccttgctggaaaatccactctcccatgtggaggaaggtccatgaacttgctcctcatggcacagaatgactgatagtcaccctcctgtctcttggatgctgggtcaaaca

SEQ ID NO: 103740 - DNA, 1427 bp, Homo sapiens
gtgttttctgaggcctgtgtttgagtgactattgagagcgggcacatggggcatatgttctgcaccgttttccttatggtgggtctgagtcacctggaaccagccatgatctctggtacactgagcttgtgctcagtgatgggaactggccggatgtgggattaacacaattaattggcctgcataaagattcaattattaaccttaaattcaacacatttttattggatttctttttctttgtttttttgagacggagttttgctcttgttgcccaggacggagtgcaatagtgcgatcttggctcactgcaacttccacctcccaggttcaagtgattcttctgcctcagcctcccagctattcgggaggctgaggcaggaaaatcgcttgaacccgggaggcggaggttgcagtgagctgagagcgtgccattgcactccagcctgggcaacaagagcgaaactcagtctaaaaaaaaaaaagataaaaagataaaaagacagccattactggcacaacataaatggtaataatcactatcatttattgagcacttactgggtgctaggtactgttccaaggaatttaatgtttaatctaccaacaagtatggaagagaccaaattcatttctttttcctcctagacacagagacttcatttctcagcctgctttgacataagtgggtccggggtattgtgcaaagtgtattgcctttaggtctgatccataacccctcccctcatccacccagctcttctccagatgatcttcctctatctggcagttagcagaaccacaaaatggaaggaacatgaactgaatttccatgtggaaggttgcccattgaatactcatttggactattttacacgtggagtcaacctttattatactaagccaggaagattcaagggttcatctgttaaagcagctagagtccctacctaattgcacaagcccacaagtagtgctattactattgtcattttcaaataaggcttttcaagcagagagtagctttcccaaggcctcaacgagtaagtaccagagtcaagattcaaatccaagccatttggtgccaaagcctatgctggtagccactagttctctcctataaggagtagtggggatgaatgagataatgcatacacagtgttagcatagtgaaggaagcatggccactgttaaataaagtcaactcaatgtacttgttcatgattattatgaatgtcctgaggtccttcgtagactcttcttccagtcccatcctgatgccccaaccctcaatgtgggggcacatttctgtcacctgaagaaaaggagccatgaaaaaataggcaaatttgtattctaataaaccctaactcacacctattatgtgtctctgaccaactatagggaataaaatatttgctaccttt

SEQ ID NO: 103741 - DNA, 533 bp, Homo sapiens
ctcacattccagtccttcctttggattatccttcctccttccccaccctcagactaggattgctggatctgattcaaaatgtggtctctcgcactgggctggagcaagaaatgagctgcaagaaaattccagagatcaacgggaccctcaacatgcctttcactcaaacaccccacacacttttctcatgttagcatgaaccaggagaggctagttcacagctcaccttaggcaccattcctgaatccagcagcacttcgaaccccaaatccccctgttgtctaatcccagttcttgtctacatctcaagtcagtttcctcctcccattgtcagcaaagatggggaaagcaatattataggttccaagtaattcttactactcaagtgctggcaagtcagcgctgagtgcttcttcagccttctctgcaactgattctatacctgattcttcactacacctgattctttcaccttgttttgttggccctccttgaaaaatcttttagtcttaataaccataattatctcttat

SEQ ID NO: 103742 - DNA, 841 bp, Homo sapiens
agaaaaacgttttgaggaagcatgaccagaggagggagatgagtccagaagccttcaggattgtccaggggagagataaggagggtttggaccaagggaaaagcaaagagatggagagaagctggggcttgcgatgtctcggggaggaagaacgatgtggggaaggagggtggccgaagagtgcagagtggccatcagtctcctgacttggaagatggcagcatgggtaaaatggccttcttggagaaagggagagatggggcactcagggtgggggcagctctggaggtcagttcagaacaggttggcaaagagtccagtaggtggatggatggatgcgaatgtaacttagaaagaaaattccactttagtcaaacaggcaaatacaaaactacacaacagaaatcgccaatcacataagtggaaatggagagaaatgaacaggtttgcaaaagaattactcattcagtaaaagggttctttataaagttccatctaagttaaattatatctggtataataaaatgtgattcatttacatatttcatttccacagagaaattgttgggaatgtggctgtcacattatgcttggtctgacatagacaagtgactatgtgtggcaatatttttgtcgcttttggcaaaggttctcttatcttttccttctccatttctggcaaaataattgttcacttattgactgaattcttgttccagtgggtaaagtctttccttcacaatcaggagtaacacttcatgccggtgctcctaggagaagagttggtggcagccattcacactgtagtataaatgactaaagagcaaagtctgatgaaggg

SEQ ID NO: 103743 - DNA, 206 bp, Homo sapiens
cgactgaagtctgcgttcaaggactcagactacgtttacccctcactggagtcagctggagaagaacgtggttgaagccttcaagaccatgcacaagtgcgtgaagcagtttaaggacatgccaggtagggagccaagccggccaatcccctcctccctgcctctgccgcctgcctctcatgcgtttctgtcttacccggcagcct

SEQ ID NO: 103744 - DNA, 158 bp, Homo sapiens
aaaggatgctcatggccagcacctgaggctcagcctgggggccttattctggcttcaggagtcccttacccagtgtacaaggccagtgcaaagtgctacagagtggctccccccacccactcagcagacccagcctgtgagggaaactactttgggag

SEQ ID NO: 103745 - DNA, 372 bp, Homo sapiens
gggttcttagccaaagaaattgccagtgacacagtgacaaaggctgtaaagtagaaggatgcctgagctgaactaaggatagcaaggggtccagaatgccagaggtgaataagaaaaggcatagacagtggaaagggggcaaagtcagagaagcaatgtgggtgggcaaagcacccacattttcccaagagctttgtaggcattgggaaaactttggtttttcattccaagtaaaatgggaaggaactgtatgtctttgcattgaggtgtgatatgatctgactggatttaaaaggactattctgcgaggtcaggagttcaagaccagcctgagcaatatggtgaaaccccgtctctactaaaaatacaaaa

SEQ ID NO: 103746 - DNA, 433 bp, Homo sapiens
gcctctaggcagagtggggacacagaaacttcctcacaacaatctaagcagagaacatcttcttcctttacctgctggtgcatttgtcaatatatttggttgaattaatctgcttaataatctagcctgcagctacctcagactcactcttgaaacacaaaacacaaccttctctttcaggcaaggtgcttccaactcctggtagttatgagtagtgggaaaagaagaaatgcattttgctgcatgttttgttcccaggacacaggttcaagcttgcccttcacccccaagcaagttttattctctggaaatcttccttgaacattggcaggctcagagaatctctgttctcgatgagctataaactggcatttctggcctgatgagaagtttgttattgtctagatgttgctcataaaatggatttgttgtg

SEQ ID NO: 103747 - DNA, 834 bp, Homo sapiens
attatggctggacagttaagggagagtgacctaaataaagttcatattggcgggagagcagcttgccacagggttacacagaataggcagtggtggtaaaggcagcatttgaatccaggtccatttggctttggaatgtgctgttatagcagcagagggcaagtgtgaaacataattcaaggaaataattgctgtagccatccagaccagaggaggatcgctttgatctaggaaaacatctcagtagtctttgaaaaaatgtacagaatatgaaagatattataggtcttttcctcctataatacaaccaggaaattattcaggctaattttttcagaaaaattattacaataaattatgatctccctttgaaaggtataatgtattcaaacctttttaattagctaatcttttcctgtgaaatcttaaatatttgcacgtataattggtaattttagcttttatgtaggtatgtttccccctggtgttacttacaaaacctggcttactcaaggcccaaagtccaccccactagtaaactctctcgtctctgttcctgtgccaagtgctcttcctttgttaccaggtccacataattaatagctttatcatatgaggtaattcagttactcagcaaaacaaatgatatacacttttagaaatagctctagaaagtaaacttgaacgtaaaattgtttagtaagaggaaatttctgtttgtctttaattaagagaaactgtatggaaatgtaagctaaggatgcattaatcagagaagttggcattgcactgttcttcatttttatttggcatagattgcatgggtgctcatta

SEQ ID NO: 103748 - DNA, 693 bp, Homo sapiens
gacttaatcagccatttcagcagaaggtaggagtagagatatattataccagcaaatacacttccagtttgaactgaaggagacagagaaagcaggacagaatgagaaaaggatactggactttctggattctacagaaccagaccatagagctatttggctgtgaatgtgtactattcttcagggaaaggaaagaatgcccccaaaagtgatacagaagtcatcagggttgccacttccaccacagacccagaggccaaggcagtttcctttttggtttcaaagggcaaaactgtctctctggttttagtgagccctcaggatgaccctgcctagtgtctcagaagcagagctatcctcacagaaagctgtgtggatggagcccttagagagagcaggctgtcttgcagagccctagaacctgccattccgtggacctggaaggcagagcatcaaaccaaacagagctattctcaagccttataagccttaagatgtgacagaatttaccttaataagttttggatttgcttgggacccatcacccttgctttctttcctatatctcctttttggaataagacgtccatcctatgcctgtcccaccattgtattatggaaaagaaacatgtagctcaactggtttcacaagttcacagctggtgatgaatttgccttatcatgaatcacacc

SEQ ID NO: 103749 - DNA, 467 bp, Homo sapiens
gtggggagcattgcagggaaggtgtgaatgtggaaatgggaaaaaccaagacaggtgcccctcctctttcaccatattgctaagcagactaaggggacattcctaatctcaacttttcttcagggagacgagaataaagtttctataatttccatcctgcccacataagggggaaaattaagggtctagcctggggagaggacaggggtggttgtgttccctgagtcttgtctggggcccatctccccattccaggctaaggtctccagtccctttctcacccctccatgcaacttctctcccatccctctgatttctgagaccctggaaacccctgtcccatgcaggcacttcctcctctctccatttccccaggacccaggcaagtggggtggggagacactggccttctctgctctgtaatactccactgtgaccatgaataaaatgcccttgcaaactgtcct

SEQ ID NO: 103750 - DNA, 390 bp, Homo sapiens
atttcagttaaggaagaaaagaaagtgcctacttcctaagacccaaggattaaacaatctcatcctttcattcatcattactgacccagttttaggacttcatgtacttagaatatggacttctgttcatctctatctaagaggcttagatgacttgaaaccaatgttgactgttttaattgaattaatggtatcaaatcaaacacttaggtttgggcactgattcctgactattttcagagactcttatttattggaaattgacagaccccaggcaggattcaagctaaccagtggtcccagaccttatacttctaagtgggaactgcataataacaatctaaaatatataacatatagaaacaaatctgggacaaagtctaaggaaac

SEQ ID NO: 103751 - DNA, 800 bp, Homo sapiens
  misc_feature (710)..(710): n is a, c, g, or t
  misc_feature (784)..(784): n is a, c, g, or t
  misc_feature (797)..(797): n is a, c, g, or t
ggtgcttgtagtcccagctactcctgaggctgaggcaggggaatcgcttgaacccgggaggtggaggctgcagttagccgagatcgcgccaccgctctccagcctgcgagcctgggccacagagagaaactccacctcaaaaagataaatagaaagcagcatttaagaaatatctgagctcctatgatttttttcctccaaaactgcctcttcttttcattaagtatcttctcattaaataccactattcatccatcttattaagtgcaggccccattctaggtgccaagaacacaatgcacatcaaagggagccgggggtccctgttctaatagagctcactcttgtggtggagtggggggtgtgatgaaccaaactgtgagtgttctttgcatccctgctactactggtggtctaagcttcctgacccctcatgtggatgacaacacattaagtgtttttcctaactttcttgccagccctccagaaaaacctgccagagaaattagatcacaagtcagatgagatccatctgttactcaaaacccttctgcgaccctccattgcacttggactcaaacccaaactcctctctatggctgacaaggccttgcaggatctgcccgcccccagccctagacatcacctcttcccatcttcacacagtcctctaggcttgaaatattcccctacctgatcacttgactggntcatctcaggtctcactcacgtcatttaaacaggacctctcggctggcacagcggctgacacctgtaatctcancactttgggaggncaa

SEQ ID NO: 103752 - DNA, 546 bp, Homo sapiens
ttcttttttctttttttctcttcttttcttttctcttttcttttcttagagatagggtcttggtactttgctcagactagtctcaaattcctgggctgaagcaatcctccaaactcactcctcagagtagctgggactagaggtgcacacccccgcacccagctaagaattgctgggtcacagggtatgtggatattttttaaggctttaaagatacacattgtcaagctaaaggtaaagcttagaaacagtagtggaaagtttttttatgaagcatccatactacagtattactggaagacttttcattaaagcattttttcagtctcttaataaaaattgcttttgagtggctggttgtggtggctcacaccactttgagaggcttaggtgggaagactgcttgaggccaagagttcaagactagcctgggcaaagggagagaggctgtctctacaaaagaaagaaacaatacaagatagggatctttaacaatacaacagaaaagcatctttaaggtgccaaaagatagaaactgtctatcta

SEQ ID NO: 103753 - DNA, 691 bp, Homo sapiens
gactgtacacattggccaaatgtacaccctctttagggcatctttcttctcatttaagtccccgatgccaccttttcagcaaggccattcctgccctctcaactcagagtggccccttgccatcactttgtcttctgttgctctgtttaaaaggttcaactttgagatataatttatatagagtcaaatgaaccattgtaagtgtacggtttgaaaagatgtgacaagtttacatacttaacgtgataatcaccacagttaaggtacagaagggaaccatcgctggcagaagttcctcagcccctgctccaggaaggcacccatctgcttcctgtcactgtagatgggatttgatttcccgaagtttcatatacaggagtcccttcttatccgtggggcatgcgtcccaagacccccagtggatggttgaaactgtagatggtaccacaccctctgtatatgatctttttttcctgtacatacatacttttgataaagtttataaattaggcacagtaagagactagcagcaataactaataataatatggatcagttataacagtgtgttagcatcaccactctcgtgctgtggggctattattaaataaagggaaggtcacctgaactcaagcactgtgatgctgcagtagtcggtctgaccactaaggtggctactgagtgactcagg

SEQ ID NO: 103754 - DNA, 352 bp, Homo sapiens
agagagagagaacaggattgcaatgctgaatcattataatgaagtctagtaatcagaaaaccatactattatcttcactaataaaatttttaatcaaaacctcataaaacactatcatctagaaaaaggagaatatgcccctcataaaaaatacatatctcgaaacaaaaccaacatcacagtgggacaaaaatgaggtatttctatgagtctgaaaaaagtaacaatgagtacactatcattatttctattatgatctcttccataacttagtgcaatacattaagaaaactatatgtaagtacttaaactgaggacacagaattatcattagttacaaataatataacgg

SEQ ID NO: 103755 - DNA, 453 bp, Homo sapiens
gttgtaggagaaaagagaaaatccagttctgcttccataggatgtgctgcgcgatcatcaatgtcattgttccttaacttgtatccatgggatccagctgatgatgttttcaatattggagccttttgtttcccagcatgatgggatgatggagcactttgtacatctcatcaggagtatctgattcatgtttctcctaactgtgccagcaagaattacttatcagaatttttttccctttactgtagtaaaaagttgctgttagcacagttgtgaaatttcttctacccgtgttgagtttgaggcctctgattctttttactcatcgaatgggtttctgttttatatgtttatggtaaccatggaaccttgtctagagcctcatgtgtaagattgcagactctgtttgtgaggtgttctcaacatcgttgattttgagacaatgtgtgaggg

SEQ ID NO: 103756 - DNA, 140 bp, Homo sapiens
cacggggacggccagccgcatgcagtatcatgcgcctctctcatccatgatgggaagaacaggcatgccctctgatttcacgcccgcctgggacacattttcccaagagaagagcaaggaggcagcgccccaggtgagag

SEQ ID NO: 103757 - DNA, 802 bp, Homo sapiens
aagggacgcagccagcccacgctgctcatctccagagcttcaccgcctgttttgctgacatctagggggatgctgagttagacacgcctgcctttgggacctggtaccggtccagatggtcacacggagtcaggcctctgggtgtgaggttaaccatagtggtgctggtgacagacagcactgacagcctgaaatttggtttccagcactgctcacacagcagcagcatccccaacaccatccttcccaagattccaggatgccggcatgttcagggaccctggagggagcttacagtcggttccagttgagtggctgtcccagctttctcagcccggctggcccctgcatcactcagtgctttaggctccagggtcctgctctgcccacccacctgccctcccctggcctgctcagctttgccaacaggtggtagtgcccaggaccaggcagggtgggtagatgtgagtggtgaaggagatccaggaaaacccccagctcagcccagccccatgtcccagcacatggaaccaacccctcgagtggcagccccacccaggggtctggagcatcctaggtcacctgctaagtgaagccagccctagaagagaacctccagttcacccggcccacctccacagtcagaggcaactgacacccgggggccggtgatgcccaactcgacagggcaggccggtgacggggttcctgccctacagatctggaaaggggacagtcattgtaaaaatgtcaaagcccacttggaaaagctgactctgtcctgggcactgtgactcctgag

SEQ ID NO: 103758 - DNA, 352 bp, Homo sapiens
ctgcagattccagctggaaatggaaactccaggagcaaaggcagcacttgaaccactgagactgccgtggccgctgtgttcacctcgatccccagaaagcagccacttccagcatctcaccccctcctgggggctcccatcatggaagcctaagggccaggcccaaggagtaatgggtgacattcccccagcccacccagagcctggtctgtggaggccacacggctggagggtctggtggaatcacttagaaacacttgaatgttgcgaagatattctgcctggccctagttgcagggacagagcaaggctcacaccgggatggggattatttgtcaggatagtgtgagtt

SEQ ID NO: 103759 - DNA, 342 bp, Homo sapiens
taagagagaggtatgggtttaaatacaactggggcaggtgaaatttgatacctttcccaagagtagagataggatttcaaaagtcatttacaaagaagggagagatttggcaaagggcacgttaactgaaaaaagctctgagctgggcaccttaacacggaacaaaggggtcccaagaggaagataagaattagaatcagtacctgtatgcgacactggtcatactcccgcttggtgggaggctcctggctgggagaagagggaacaggacctggctctggtgccactgggggtggctgagagcccacactgccaccatactaaagggcaaagtaaaacagt

SEQ ID NO: 103760 - DNA, 268 bp, Homo sapiens
gcaccccatcccctctccacctgcccttctcttccctctccatccaccatctccagccctgtgaagggaatgtactttcggtcttatacccccattacccattacccaaaagttaccttttttttttttttttttttttttttttttttttttttttttttttttttttttttttttttttttttttttggggggggcccccccaaaaacccccggggggggcgcaagggggggggggggggggataaaaaaggggggagagggaaaa

SEQ ID NO: 103761 - DNA, 207 bp, Homo sapiens
tcccggtcctcacctcacctgcatcctgtgccctccatccccaccaggagggaggagaaaaccaaccccaatggtgcccgcatctggaattatctccctggcgctcaggtcaacagcctttccaagaacactcgatgtgagcatctgcagcctttgcttctcatttcctcctaagaggagcccctgggatgctatgaaggaaagcat

SEQ ID NO: 103762 - DNA, 745 bp, Homo sapiens
gcacagtggcatgtgcctgtagtcccagccattagggaggctgagacaggagaataggagaattgcttgatcctggaagttccaggctgcagtcagctatgatcgtgccactgcattccagcattagtgagacctgatctcaaaatatatatatattttacatcattagctttatacaagctatatattaataaattaccagaaatgtacatatagaccagcaagactttctgtcaaatgagtatcagtcacaggattattttattgattctgtctaaagttttatcagaatagtttctgattgtctcttttcattgtatcaaagagagaacagagtatggttataattttatgctaatcattccccacattagattaaaaacctagcattttattcttttcctgtctccatcatcattcacatgaaggagaagtaagagttggcaagcaactccataaccaaactaccctgaggcagtttccttcaaatcactcccaagaatagatatttatggctttcaaataaagggtctttggtagcaaattaatttgttagtgggagagggagttatggggaacattttaaattattactgcctggatgtgatgaagaaataaaaagtagtataatccaatagctgactatcctgcatttctttgcttctctctatacagtcatttgggaataagagtacccctgaacgtaatagcagtaatatttcaagagaactcaaattgttattgg

SEQ ID NO: 103763 - DNA, 420 bp, Homo sapiens
agtttgaggtcagcctgggcaacatagcaagatattgtctctacaaaaagtaattaaaaaaaattaagccagacatagtggctcatgcctgtagtcccagctacttgggagattgaagtgggaggatcatttgatcctgggagttcgaggctgcagtgggctttggttacaccactgcattccagaagggttacagaaggagaccttgtctcaataacaacaacaacaacaacaacaacaatgaaacaaacaaatagctgggcatggtggtgcatccctgtggcccaacctatctaggaagctgaggtgggaggatggtttaagtccgggaattcaaggttgcactgagctgtgatggtgctgttgcactccagcttgggtgtcagagaatgaccctgtctctaaaaacattaaaaaaaa

SEQ ID NO: 103764 - DNA, 320 bp, Homo sapiens
gggtcatagaaatacaccacgccgacctgccctctgtggatgtccaagacggagcaacgggcaggaaggcctccaggggacgctgtcaccctagaaaaccaaacagcaaggttttcctaaggattctaagccctagtttccccagcaaagcaaaaccaagccagacttgagaattataagaggagaactgcttcaagacaagttttatataggtaagagtgaggaagacagcggcaagtctgagtgttcgccctgtgaggtgatggactgatctgggtcccaaaaaatggtcacccagggccaacctgtgcttcagaggc

SEQ ID NO: 103765 - DNA, 811 bp, Homo sapiens
gctggtctcgaacccctgatttcaaatgatctgcctacgtcggcctcccaaagttctgggattacaggcatgagccgccctgcctagatattttggtttttggtttaattggctcaggtgagtccatgggctgaggggcttcatcacacctgtttcctcacctgtgagtggggaggggtggtcacctggcagggcggtggtgaggccggcccgtgcctgcccttccctccactgttcagagttgggccagggctgaaggaggcgtggccagcttcagaggaaggtgtgggagccgcagctctgcctggcactgacatctgggctgcaaattctttctaattctcaacttctcccccactactgccagccagccccttcagcttcatttaaaagttcagacaggattcaaaagtaggttgatatataaagacctattaaaactcaatactaagaaaacaactcaattaaaaaatgggcaaaagacctgaacagacacttcgccaaagacgatacacagatggcaaatatatatgtcacgtcatatgtcatcagggaaatgcaaattaaaacagcaatgagataccactgcacatctatcagaatggcccaaatccaaaacactgacaaccccaaatgctggtgaggctgtggagcaacaggaattctcattcagggctggtaatacaaaatgctatagccacttgggaagacagcttggcagtttcttacaaagctaaacatacttttaccatacgatccagcaatcgtgttccttggcatttacccgaattagttgttggaaattgtgtcc

SEQ ID NO: 103766 - DNA, 153 bp, Homo sapiens
atgaggatattgacaaccaggaggtggaagtcacagccaaggacacatcttgagtcatgaagagaaactgtcaactcactggcctcccgaccctgtttgcatctcaccctcaaagggttttggcctcagcgcttgcccgccggtctctggaac

SEQ ID NO: 103767 - DNA, 726 bp, Homo sapiens
gtatgtattataatttttataccatagatagtctaggtagtatagcaaggcagaaaaagaatgggttatcagcaagaattagccatgtgcagctaaattattagtcatgaaattattacaggactcttcttaacacataaaagcagtaataagaaccagacattaggacccctaaatctcaataaattgagttgacattgtgtggtactctgtagtccaactttggtggttgggagggacgtttcttaggctaatgaagtcaaaagttagctggcatcagaatcacctgaaagataaattttgctgctcttcacatggtgcagaatatctgactcagtagtgtgagatggagcccaagaattttcatttttgacaagttttgagttgatgctctgcatgctgctagttagggggctatatatactttgaacaccactggcctagtagttcccaaacctgacataaaaaaaaaagcaaaaaaacgaagaccctggagattttctttttttgcttttacggaatcttagaccctataattatctactgaatcgaagtaacttaattggctgtatgtgtcagtgtacactgtacaatcagggctcattggaccatttttcatttctgaattatttcgagcagttctgtttgtaaggattgaaatttcatgacttattctttcttagggatcttcaaaagaataaagaaaactgagctatatttctcata

SEQ ID NO: 103768 - DNA, 195 bp, Homo sapiens
ggaaagagctctcaacatcttgccccagcaccacccagacccccagcaggtcaagggcacctggcagtccaggagggtttgacctggccactgggtcctgcccgacttcccctacccccaccaagccctggctggttccccttccctctctcggccgctgctgttcctgggccccatgcccctgccctgcttgcc

SEQ ID NO: 103769 - DNA, 394 bp, Homo sapiens
acagatcagaaacgcctcccttcgcttccctggcttttacggcagcccgtgatgttattctcgtggaattccgtgtgcagagtccctgggtgctggccgtaccagccagggctgtatctggagggagcaagaccatctgtgtgcttctgttccacaatttaatgaaaacgcaagtgttagattttttccctgctccctatttcagaactatccttaaagctctttagaaaatccttttaatgtttctaatttgttctatatccccaggaagaaaaaaacatcttttggaaatatttgcaagctcaaattgagcaagagctgaaaataaaaacctggcatgcagttggtaagttggctttcaagaagtgcacaaatgtacttcctggaaactata

SEQ ID NO: 103770 - DNA, 409 bp, Homo sapiens
ttgtagttctccaaatagaatgttatcacagcctttacaatcatttctcttttatctaatggacatagttaaagcagaataggtataaagtcatttagtcattaaagaattacatgaagagactgggcacggtggcttatgcctgtaatcccagcactttgggaggccgaggccaggggatcacctcaggtcaggagttcaagaccagcctggccaacatggcgaaatcctgtctctgctaagaatacaaaaaaattagctgggcatggtggcaggcgcctgtaatctcagctgcttcaggaggctgaggcaggaggattgcttgaacccgggaggcagaggttgccatgagccaagatcacaccattgcactccagtctgggcgacaagagaaactcttgtctcaaaa

SEQ ID NO: 103771 - DNA, 154 bp, Homo sapiens
ccatctgtgcacctccttgtaaaatctgctttatccaaaaactcatttagtaagaacccctctccctcagtagctgatcaaccgtgacatctgatcaagttcctcatcctccactatcccacaggtaataaatcaccttgttctgtttttagca

SEQ ID NO: 103772 - DNA, 317 bp, Homo sapiens
ctgccagttaaaaactattacaagaattaggggtcaatcatggaatgaatgcatattgctcttcccactacaaaaaagctaatttgacaaccttaaacactgtgatagagaacttatccagagtgataatccagcaaagtatctgcccttttcctcctaatgaaaatgtaagctcactatcctaaaagttactttgaaaaatccctaatgctggccagactcagtggttcatgcctgtaatcccagcactctgggaggcccagatgggagtattgcttgagaccaggagtttgagaccagcctgatctaaatagcaa

SEQ ID NO: 103773 - DNA, 373 bp, Homo sapiens
tgccagtgattggagggtgctcccccaaggcccaggagtggacatggaaatgggggtcacttctctactcccagcactgcagagcacagcaataaatgtgaggaaagacagaggagcagcccagctgccaagtttgagcctatttactggacattactcttaattgccatctactggatcacagtccaagctacaacaccaaaaatattttgcttatatactcccctatgaaacaatgggcaagagttcagccacaaataaagaccctgtgcagagggttggccacttgaaaatatccagaaatgaatacaattgactataatataacttttcacaaggatatatcatggctatgaaatagccattatattca

SEQ ID NO: 103774 - DNA, 413 bp, Homo sapiens
ctttaaagaaaaatacaaaaatgaaaaatactacataggctttatagtagaacggttaaaagactctagagtcactgtctttgaatcccagctctgccacctagctgcgcaaatgtaggcagattactttatctctgagcctcagtttcctcatctataaaaggaatataatagtgtctacctcagagaatgttggcttaatattattattaaatgagctaacacatataaagttgcttagaagaatacctaatggataccaagaacccagtaaatattagcttaattaatatcaaaccagtatcacaggggagtagaggatactcaaaggatatgggactgattaataaactgcccttagactataggttactgtcattcaaaaagtatatatattagcataataattctgc

SEQ ID NO: 103775 - DNA, 564 bp, Homo sapiens
gtaccagtgatgtttctagagagtgcatggttagcctacactcttcctgtcttcacagatcccacctcacgtggaaataggtactcaaaaatccattgtgcttctgtaatggattaagcttcgagcccaccccatcggctcccatcacatcaactcaccaaacattggctcagggagtacctgggccagcctgggtgcccactaaccatccctgggacgggacgacctcgactagcccgctatgtcatgttttcttattccatgggcataaggcttggcagaatgcggagattctgagctcagaagtttctgacttttccttaaaaaagaactgaaacattagagctttaggctgtgcttccaccatgcggatccacattggttcccatctgtgtggtccagcagaagcagctccctgatcactgtgcaggttcctgtggccgagatggtcggcgtttgggtcaggcggctcccagcacaggagtgggagctggcaggagtgccctgtgagtgccttaatgagatgccactgcattcacccttcatttgccctgtgccgatgga

SEQ ID NO: 103776 - DNA, 138 bp, Homo sapiens
gtacaagactatagtcccatatacttggggggctgaatttggagactcacttgagcccagggtgggggtcgaggctgttgtgagctacgattttgccactgtatttcagcctgggtgacagagtgagactttgtctca

SEQ ID NO: 103777 - DNA, 364 bp, Homo sapiens
agatgtggtcttggtccttgaacagctcaaatccatagccgtcgtgttcctggtcacctggggtcatctacatctgagttcttcagagtatcaggggccaagtaaggaagacagctgtgccctggtcaggtgatggagatggggtgacctaaaagtggtggttcctacatagctcatgaattccagctgggccctggagctgcagagctgagaaagcaagaccagcttaaagacagaccctgatttgcttcggcttagtacaggtgaagaaggtaaactggggtagaggaggagccttcttcacttcaaaggatagcaattcctctagaattgtgagttgtcaaagctggaaaggaacacagaa

SEQ ID NO: 103778 - DNA, 264 bp, Homo sapiens
tgctccctctgtggggatcctacagggttatttgccattcattctttatctagagtctctgactatacatttacttcacttcagactcttggcaacttcagactaaaggactcctgcagtcagcatgattttcaatccctcctcaccagctacactctacttctctcccaagaaaggtaatgctaagaaatgaacttagcatgatggtggggagtggggagattctggtgacaggaggaaaggggcaggaaacagcaagaccaa

SEQ ID NO: 103779 - DNA, 253 bp, Homo sapiens
ggtgcccatatatcaataccatttttgtatgcatttgtctctatcatactatgagattacagaaccatttatctacctttgtatcctcatgtgctgcatcttgttctgtcttcactgaataggtgcttaaataatgtttatcgaattaaatcaatgttggtggtcacttatcctccttgttgctaaattttataatgtgtgtataagaaaaatacttggctcattgaaggataagtctagttagtcatataca

SEQ ID NO: 103780 - DNA, 381 bp, Homo sapiens
tttgagacagagtctcgctctgtcagccaggctggagtgcagtggcacgatctcggctcactgcaagctccatctcccagttcacgccattctcctgcctcagcttcccgagtagttgggactacaggcgcctaccaccacgcccggctatttttttgtatttttagtagagacggggtttcactgtgttaggatggtctcgatctcctgacctcgtgatccgcctgtctcggcctcccaaagtgctgggattacaggtgtgagccactgcacccggccacaaagtgacaattctaagaacaaaagcaaaaccacaccaggaaggccagggaatcccagcagagagaacctggatctgcagcaaagtcccctgcttcaggg

SEQ ID NO: 103781 - DNA, 422 bp, Homo sapiens
ggatatactccaaaatgctaatagccgcttgccaatgagcgatagatttactggtaattcttattttctctatttcttcttttatttgtccaaaaaagtattactttggtgatttaaatatattttaaaagactcaaaatggtatatatgtcagcaacagaaataacagaaaattgataatcaattataaagcggaatactatgcagctatcaaaactaacgatatagatctatagatgtctatatatagtgttaaataagaaacaggatgggcacagcacagtggctgacatctgcaattccagcactttgggaggcagaggcaggaggattacttgagtccaggggttcgagaccagtctgggcaatatagtaagaccttgtctctattaaaaattaaaaagaattagctgggtatggtg

SEQ ID NO: 103782 - DNA, 389 bp, Homo sapiens
ttgtttcctttaatctggaactgtccctcagcctttctttgtcttttaccacatcaacatttttgaagaggatagcagttgttctctagaatgtctgatcctttgtcgtgattagattcggattatccatgtggggcaggaacactgaatccattatgttatattcttctcagtgcatgacatcgtaaggccttgatgttgctttgtcccatgctgggtgatgctcactttgatcacttgactaaggtggggtataccatgtttctgcactatgaagaaatttttcccctttgtttttactaagtgatctgtgggagatactctgctctgaatcaccaatgaaatactacctatagatttttagatccattagtgatttttacctgaat

SEQ ID NO: 103783 - DNA, 535 bp, Homo sapiens
ggtttattgaaagatgtaggaaaatgccatgggggtgaggtgcaagtagggttggggggcagtgggagtaatgtatattctttcctagaaagggtatttgccacaacttgagagaaatttcttctttctgatcacctgaagggcacggaaaatccaaactcttaggaggctgatgtctaaggctgggttgaggggctttgcagagtgactgcaacccaagtttaggtacccacctgggctcaccaaggctttttcatacagaggaaatggagtgggatctacaaacccatcaaatcaagtagaggaaacaacacatccaagccatttaaccatttccttatcacatgctgactcaaccctcagtttcctccagtggaagtaagagggaaacttggaaccaaaattatgcaaatagcagagctaagccccaggtagaggcagagcactacctcacactttgtttctggggctgagaaatggctatctgggtggacaaaaaaacccaaatcgtagtttctcctaagagtctcccctt

SEQ ID NO: 103784 - DNA, 751 bp, Homo sapiens
gggtgatacccacattggaaagcatcaaggtcaaaatatattttatgagtcaactttaatttgattaataacttaaaaccctctaccatagtatatgctactttattttcataactactcatgagtatggaatggaaaacattaatttatctttctaagaaaagtatttggctggaggagaaaagaatattaaagtgtcatggacattataaaatttggtagcacagtcttttttcccctacatttttagtttcagttcactgtttctgttgtttctaaatattttaccactaatgaaaaccttatttaggtaaaacgttttcttttgatttaaaagatttttgttgaattccttgcccagatgtgagagaagtgtctacatctattcaaactttaactttgggtcttagaggtgatgaatcacttggcagaacaaccatgagatgttgaataatctcatgatttggttgacttatttttagaagccactccctattaactcatttaattcctgttatacgggaagagggacagggaaaggattggaagaagaggtcagtcatatacaggccttgccctcctaaagcttctgaacttattttttgtttgttttttgagacagagtcttactgtgttgcctaagctggagtggcgccatctcagcttactgcaacctctgcctcccagctactcaggaggctgagcggggaggatagcttgagcctgggaggtcgaggctgcagtgagctga

SEQ ID NO: 103785 - DNA, 452 bp, Homo sapiens
gtgatccacccacctcaacctcccaaagtgctgggattacaggcgtgagccactgcacccggcctggaaagacatttagatgttagatgtgtagaagggaggctcagtagggtcaggtgactgatttgatgtcagggacgggcaggaggaaggcatttcagcctattcatagatctccagcttgtaggattgaatgtgcggttgtgctgcttcctgggagaggaaacacagaatgtggggcaggcttgagaagggagcgttatctgctggagctaacaaggatacccaggcctgcaagcccaggctgctgtcagcaactgccgatgcagccacagaggagatccgggagcctctgcccttccaggccaagagtcctccaaggccggggcctcgtgcctgaggtctctctttgcccctccagtacctttagaagctgtagaaatatgtctaga

SEQ ID NO: 103786 - DNA, 333 bp, Homo sapiens
tgtagagatagggtatctccctgttgtgtaggatagtctcaaatgcctggcctcaagcaatcctcctgccttagctctccaaagtgctgggattatgggtgtgagccactattcatgcccagccaaacccaagagtttgagaccagcctaggcaacagagaccacatgtcaaaaaaaaaaaaaggaggggtatgcagggggaataatgatgagattagatatccagcaaagtaactacctcttatcataaacaatcaaggtaaactgtgacatcatctcatatttcaaaagaaaatgaaaatcttccaaagtttaatgtgttactttgagaat

SEQ ID NO: 103787 - DNA, 823 bp, Homo sapiens
ctaacaatatttaaacacgcaaagaaaagactattttaacagcaattatgctactttctaatgcttgcttatttatgtttaggttaaaacaatagttagggtgcaaatgtgaatgataaatactattcaactagttaactgaaaaaaagtgaaaattttggaaagccaattataattaagatagtcattgtatctaagatattaaataataaagcagtgagttttaaattcactcaagaattagaaagcaaaaaaattacaaaaaaataattagaaagcaaagataaatactagcaacataacacttagtgagtggtcaatgaatattaactgaagaaattttttaaaagaggtaaataaatgtataaacaatcctaaattaaatggttaacagaccccctgaactcaccgccattcccaagtgattattttcttttctgaaataatatacctaatatagaaatagtaagaaggccattttggggaactctataatcatctatcaaaactggagaaaaagataaagtgaataaaattttaaaaaggtagacagaatgagaaaagttcatatgtctttttttggctaattatagacaacactggaaagctcttagaaatttactaacattcaaccatgatttccataagagctcttcaggacaggtagaaaggaaatgttgagaaactacacagaattctgaaaaccagagggcaagaaaactcacacagtgagtctttcgttttctctagagtaagacactaatggacttgaactattaaaaacatcatctaagactatatccactgccgtcacactccccca

SEQ ID NO: 103788 - DNA, 556 bp, Homo sapiens
ttcatccgcaagaaaagcagtgtccctttaaatagaaattgaattcagtccaccggtagagaaagacaacaggttcatggggcaacttactatcatagcttccccaagtcgatttgtgtacgactgttattttctggttcttctcagaatgttacttgtaaatggtatttgccttgatacagatttcggtggagaagtaattagtttacaaagaagaattctcagcatgtggatgtaggcttaattgagtcctcatggtgttttacaattagcttctctagctgtgggatttcaagaaatatgtgaggtagctgatgacacccaagttgtcttaacataactgtacaccttgcacatgctcttgtttacagatgtggaatgattgctttccacaagcagctgactgatgtaaacactggggattttcttcaagtttaaaagcattaaggaatcaaagtaaaaatttcttgggtatattcttataaaatgagccatagagcataggagtaattcattcattcatcagttatatatactatgtgccaggaacatttct

SEQ ID NO: 103789 - DNA, 409 bp, Homo sapiens
tactgtgaacactttagttttaagaattagctagaaaaaataatacatttattttattcattgtaataagatagaatcatttttaaagagaattctgaaagtgaatttaatttgtctgttttcccatttttttctgtcttcctctatttctttgatctgtgtttaaacattactagaaatcaccataacaatatcataagcaatccaagtgtatttaaagagtaatacaatccaaacaacattgtgtggagctttgtgtatttttaatgacactactagacttgcttcagacaagttgagactttcctaaggtaatagtgggtcctttgctgattgccttaattttagcatttaaatgcatttagcaatcacttctttgaaaactgaatttcagtcactgattcaaaaa

SEQ ID NO: 103790 - DNA, 700 bp, Homo sapiens
aggttgcccaggctggtttccaactcctgggctcaagtgatccacccacctctgcctccccaagtactgggattacaggtgtgagccatcgtgcccggacttgtctcacagatactaaacacagaacgctcaaacctgctactcctgcaggcttcctctcctcaccattcacctacttgctcgggaggctgaggcggcagaattgcttgagcctgggaggtggagggttgcagtgagccgggattgcgatcctgcctaaaaaaaaaaaaataaaaaaaaaaacaaaaaaaaaaaaaaacaacccgtggtgtggtggagggggatacccccctgtggtgggcccccacccctctttggggggaggcgtgagcgggggaaaaaactcgctgtggaaaccccgcgggaggaagaaacgggagagggggggggcgggaaaattgtgacccatatgtggatgtatccaggacacggggcacgaaaagagagtgaaatgggtcaacaccacagcaacaaagaagagcagcagcgtggaacaacgcttaaaaaacagcaacaagcaaacgcaacaacaaaaatgggggggccaccccgagagaagcgtatagatcatagagcacccagatgaaaagtgcccccacaagaggtatgcgaggataaacaaacaggcagggagagaacacacggggcacggacatagacc

SEQ ID NO: 103791 - DNA, 1733 bp, Homo sapiens
ctaggaggcagtccccaacttccagagccagggtataggctacttctatgtgtcccatggtactgccacagaagagtctcagctctctccaggattcagttctaaggtcagtgcctaagataaaaatggagtgtaattaaaattcctcttagaaatctaaggaaggtgccctattgaagaccaacatcttgaggtcccatgtagtcatttcttgcccatgtgggaacacattactgtttggttgagtaccaggtgaagtgattggcctgcagttagggctgtgttgtgcaaaaatcacttgttttggggtgttagaaccacatttaggcgagaagatcacttttggggagcttgggaactgaggcaggccgcaggtgcagcagaggcatgagcttgcccgggcccgccctcttgtctatgctcatggagtgaaggaggggccagcggaatggcccaaacaactgatttgtttttctttttttaaatctttttcagacaaataccattgtgtttaagcgaaatgtgtgtataatgccaaatcactgtaccccacaaccctgcacacctctacactggactgtaatttcttgttcctagtttgtcttgctagactgtaagctccgtgagagcagggaccgtgtctgcttgttgagtgggctttcccctgtgcctgccagcatgcctggcatctagcaggtcttctgtaaagatgggatgagtttgtaaaccctccagcctcaggagtggctccatcctctgaggctctggggccctctggcaggctagtcatttttctgccatgtacgtacaatgctttattttcatgttgtattttcctttctagccagtaagcaagctcctaatgagcaagtttctttgtggtgttatctctgtatcctttcatcaggccagcccagagtaagtagtgcttcgaaagtgtttggtaaatgaatgaattatggtaacccagcccagttctggcatcactgtctgcaggttagtctaattccagatgaaagccccagattcgaaaaagggaagattattcagaagtgcatatggttgtataagaaaaaaaaatctcattaaatagacctgagtaaacttcaaattttgatgatctggccatgtcggagctgaagcttaccagctctctaaagcatttgctagggaatcatgcagatggtccaaaatattttttagaaaagcattcatctgtcccgggatagaagtagaggaagctggtaggcaggcgctagaccctaaagaaggactgctgagccagttcttaagcctgtggtcctgtcggtgaggaaagtgagagcagtccagagcaggtgaaaagagcagagctcattcctccagtggctcttttgcctaaagcagcattcctcaaacttctcactcgaagcattaagttacggtgagatgctaacacacgctttagacttaagtcaaaatttactgtgaagccacagcaaaccatggcttcacagatgaattagttgctacacaaataagttcgatacataagtacagtaattgcttttaaaccttataataagcagtaaattagaagttaaaccatgtttttcttttacgaactgaaagaagagaatgcttttgatactgagaatcgcacactgtgtccaggaagattgttcttgcataaccagacccacaataaatatctacaacttttcttacatgtttataaaataaatcttagaaga

SEQ ID NO: 103792 - DNA, 1910 bp, Homo sapiens
ctaggaggcagtccccaacttccagagccagggtataggctacttctatgtgtcccatggtactgccacagaagagtctcagctctctccaggattcagttctaaggtcagtgcctaagataaaaatggagtgtaattaaaattcctcttagaaatctaaggaaggtgccctattgaagaccaacatcttgaggtcccatgtagtcatttcttgcccatgtgggaacacattactgtttggttgagtaccaggtgaagtgattggcctgcagttagggctgtgttgtgcaaaaatcacttgttttggggtgttagaaccacatttaggcgagaagatcacttttggggagcttgggaactgaggcaggccgcaggtgcagcagaggcatgagcttgcccgggcccgccctcttgtctatgctcatggagtgaaggaggggccagcggaatggcccaaacaactgatttgtttttctttttttaaatctttttcagacaaataccattgtgtttaagcgaaatgtgtgtataatgccaaatcactgtaccccacaaccctgcacacctctacactggactgtaatttcttgttcctagtttgtcttgctagactgtaagctccgtgagagcagggaccgtgtctgcttgttgagtgggctttcccctgtgcctgccagcatgcctggcatctagcaggtcttctgtaaagatgggatgagtttgtaaaccctccagcctcaggagtggctccatcctctgaggctctggggccctctggcaggctagtcatttttctgccatgtacgtacaatgctttattttcatgttgtattttcctttctagccagtaagcaagctcctaatgagcaagtttctttgtggtgttatctctgtatcctttcatcaggccagcccagagtaagtagtgcttcgaaagtgtttggtaaatgaatgaattatggtaacccagcccagttctggcatcactgtctgcaggttagtctaattccagatgaaagccccagattcgaaaaagggaagattattcagaagtgcatatggttgtataagaaaaaaaaatctcattaaatagacctgagtaaacttcaaattttgatgatctggccatgtcggagctgaagcttaccagctctctaaagcatttgctagggaatcatgcagatggtccaaaatattttttagaaaagcattcatctgtcccgggatagaagtagaggaagctggtaggcaggcgctagaccctaaagaaggactgctgagccagttcttaagcctgtggtcctgtcggtgaggaaagtgagagcagtccagagcaggtgaaaagagcagagctcattcctccagtggctcttttgcctaaagcagcattcctcaaacttctcactcgaagcattaagttacggtgagatgctaacacacgctttagacttaagtcaaaatttactgtgaagccacagcaaaccatggcttcacagatgaattagttgctacacaaataagttcgatacataagtacagtaattgcttttaaaccttataataagcagtaaattagaagttaaaccatgtttttcttttacgaactgaaagaagagaatgcttttgatactgagaatcgcacactgtgtccaggaagattgttcttgcataaccagacccacaataaatatctacaacttttcttacatgtttataaaataaatcttagaagaaaaaatattgtagctttttttttttttttttttcaatgaagctctatgaacatttcacagaactttgttcctgggagtagttagggaaatgctgcttcaaaaagccaattttaagtagttgtgaggcatccgagtggaatttggctgcactatccataaaacttgagagtataggcg

SEQ ID NO: 103793 - DNA, 196 bp, Homo sapiens
ggagaaacgcggagttctcaactgaagctcaaggtggagagcgagagaaggaggcggattcatgaaatatttcggagagaggagccacggggccctgagggcggcagaagctgcggccgagaggaaaagcaccaagaacaccgccctgccgggaactagttttaaatccacgtccaggttttgtatgagcctcgct

SEQ ID NO: 103794 - DNA, 715 bp, Homo sapiens
aaatataaatgtcgtggacattcttaagtgccctcaaaactggccccattcttggaagattcagattattacatgatagagggattattattcaatcattatgggttgttttctttttgccatgaaaatagccataatcccctgcattagttaagttgaggaagaggctgaaagttacacagactcactctctgatgtccaagtcatgtccaagtaaccccatatctacagttcagaaactgtgacataaactgtgtcatagacttcacctgtgtaagcccattggaaattccagctttcactggacagtgatgactgcatactcattccttccaatcatgttccttggcttaaaatattagggatgacatgtgcattacaattaccagctttgtgaggcaaagatccaggtcaagatatattttcggcttgaattatccaggattattgcctctgttttctacattgccaaatagaaacagcagattggttggtaattctgccaactgaatgatatgtgttttcatacatgccatctttattgtacattacaatcaacaaaggatcttgaaaatgcaaagagaaaaaaatgtggtgcagagaataaactttggtttaagggtccaaggataggcattccttaaaaagcattatgtacaatacataaaaatgttgactaaattccatctttctaaaatcaatgactattttataa

SEQ ID NO: 103795 - DNA, 268 bp, Homo sapiens
tttttgtgtttttagtagagacagggtttcaccatgttggccagggtggtttccaactcctgacctcaagggatcctccagcctcagcttcccacagtgctgggattacaggtgtaagccaccatgcctggccataaacttgtatttttttaataacacagagtctccctttgttgctgaggctgatctcaacctcctgtgctcaagggatcctctagcctcagcttcccaggtagctgggaccacagacatgtaccatgtgcctggc

SEQ ID NO: 103796 - DNA, 339 bp, Homo sapiens
ctccgatgctgtcctgtttggctttggtggtgacaaggtctctgcctcctctctaaatgcgtcgtgcctctccaccctataatggctgacttcatggatcattgggtatccctaatgccacctaacagccccactgactgtgtgcagggctgtgcttagcgatttccacatgggaactcatgcttcacgacactccaaaggaggtacgatatcagaccccatttcacagatgaggaaactgaggcacagagaagccagggaactcgcctaaagtcacacaccttgtaagcggtagagctgggatttgaacccaagtggcctgcactcttgtccagtgtc

SEQ ID NO: 103797 - DNA, 450 bp, Homo sapiens
gttgtcatagaccataaatttctagtcacttatgaaatatatataatagaaatatataatgggtaaatttcaaaggtgctctttcctgtatcctgagcttaagggccatatttccagctgtcaattgaataccactttggatggagtgctgagctccacccttgacatatctggagtactgaccatctcctctcacctccaaaccaactttccaccctatttgcccaatcttgataacggtaccatttttccaggctcaatatctgagagctgcctaccctcctttctttcaaacaatacaggtagccacagagcttggctgttcttgcctttgaagtgttctaacatcttttgattttcattttcattgcctccacctggtcctgattcatggcatttccattgtcataatagcaggctaatttctctccctgttttctaaatgtaccc

SEQ ID NO: 103798 - DNA, 377 bp, Homo sapiens
ggtagaggtcttagatctgagcaagagagaaatggctccttccacatggtaactttatggtgagcaccatttatatcttgcctcagggagagcacacatattacacataatgggccttctggatctcattagagaggttaaaaccaaaattgcaacagaggtatcctgcctatgatggcactcaaatgtatcccaagtctgtacatttgctaaactaacagggatgaggagcttacaccaaggtaacattaattccagttgccttggtctgtggtatgcacttgtgtttgaaaccttgaaccttcttcagaaaaactgtttgaaaaatatttagttagccgggtccattggttcacgcctgtaatctcagcactttg

SEQ ID NO: 103799 - DNA, 800 bp, Homo sapiens
ggtcgcccgggagggcgggctgcactccctccacgtacctggctggcagagcgtctccagggacaaaaggtgccctgggatcaaagccgagcccccgcccccgcgaggatgctgccctccggaaggaggggcgctgcccccaaggtactctccccgggcacccagggggaggttccatttcaacctccgatgaaaaacacggccctcccgggtacttaggagggtctgagggtaagtgccaagatggagaaaacacgccggcccctcacagagtatctcctgaggaatgagaactatctagcgggcaaggagggcttcctgcatagcagagggcaccccctctgatcccccaaggccaagggaaaaaaatcactcttcaccggcgcccctgagccaggacaggctccagtgcagccacccaccttataattttccgcggatgctgccttgatcagatgtctgaagatgactttaaggactacaagcaaatctcaagggaaaaattcagaccttgaacaacagccttgaactttttcagggttagacaagtactccccagtggagtttctgcccttatttcttcgttcttctcttaattcttccatattttaacagaacacagacctgccgaaacgacacaggatggctctttgctttttgttagttctccaaccttccaaacccttggggcacatgcaagcactgtggaaaaacttcattaaaccaagagtcatcttactccagatcccagactgcttgggaagttggacatgcatattcccaaagagaacagtgttgga

SEQ ID NO: 103800 - DNA, 1217 bp, Homo sapiens
aaagtatcccgcgggcaatactcgctcggaaccgcagcggcgcttcccgggcaacaaaaaaatactgaactaatggatttaagacagcaaaaccaagcattggaaaagcagttagaaaaaatgagaaaatttttagatgagcaagccattgacagagaacatgagagagatgtattccaacaggaaatacagaaactagaacagcaacttaaggttgttcctcgattccagcctatcagtgaacatcaaactagagaggttgaacagttagcaaatcatctgaaagaaaaacacagacaaatgcagtgagcttattgctctctaacagagccagcttcacaaggtgcatataccaagacaaggaatgagagcaacatcagcagcaacactgtgagttcagcagtaaagaggaactgggcagcaaggcagcatatcgttgtgacgtgcaggcataccttttcaacaacggtcagcaggaccgacccaacgagcgttagcgagcgtgtagcaagctgaaaccgagcaatagtccactagcaagtcacaacatcgcacgggctgaacgaaggcatgccataagaccagcaacggcaagcacacgaggcatgcacaacagcttagcaagagccaatcagcacacagtcacgagcacgcaaggaacgtggggacacacagtaaaggaactgcaacggaaagtgcgaaccagagtaagcatactgcacagatagacaaactcacaaggaaaaaacggaccgctaacctaagccggccctaccgcacgaaagctcgcaaccagggacaaagccaactgaagcgccacgggcatggcaatactggggccaagcaaacgaccaggggacaacctgggccaacgtcaccaggaaaccagtgaacgagcccactgagcccagctcaacggaaccaacgaaggcggcacaataaggggaaaaactagggatcacaaatccaaaaccggcaaaaacgaagcgacgaaacaccgcaaccaaagagaaaacaggcacaccagggcaccgcacaagcctccgagacacgcaaacagaaaacagagtacccacgacgaatacacaaggggaaccaggcacaaacaaacaggaccaactcgataaaggtcaccctcgacacccccagacgggcaacctgccaggaagcaaacaaacaaccaaaccgcgcgcaacacacacagacacaagaaacag

SEQ ID NO: 103801 - DNA, 678 bp, Homo sapiens
gtaattcttaattataaaattagcatagtagtatcgaaaaagttgatgtagcatccagaagtaatggttcctgtcctttccttgaggggcttaagaaggaagagaactaacatttattgctctttgctggttgtttttcctttgcagacctctaaatacctgattcctcagtccttggggtttatttctgtattttaggtctttatctttgtatctttcaataccaactataagctgataacttccagttttctaccttcggcccacaccgttcccagactcctgtatttcattccaaactcagtctttttacttgcatgcctcactagcacctcagatttaatatataaaataggacctgatcctccccacaacctctcttccattttttcattatctgtttaaatagtccaattgcatccagcaactcaagccagaaacttggagtaattatttacactcctcatcctctacatctagaccaccactaagtccttttttttttcttttaaagagacagggtcttgctccatctcccaggctggagtgtgatggcacagtcatagctcaccgcagcctcggactcctaggctcaagcaatcctcctgcctctgtctccagagtagctgggactacagacatacaccaccgcacacagctaatttttaaattttttaa

SEQ ID NO: 103802 - DNA, 1196 bp, Homo sapiens
agcgggatagtacgcgccggctcgcctggcccggctgcagtggatgttgctggaacccacgcggaggaaggaagagacgcaggcaggctgcggttacccaagcggccacccgggcctcagggaccccttccccgagagacggcaccatgacccagggaaagctctccgtggctaacaaggcccctgggaccgaggggcagcagcaggtgcatggcgagaagaaggaggctccagcagtgccctcagccccaccctcctatgaggaagccacctctggggaggggatgaaggcaggggccttccccccagcccccacagcggtgcctctccaccctagctgggcctatgtggaccccagcagcagctccagctatgacaacggtttccccaccggagaccatgagctcttcaccactttcagctgggatgaccagaaagttcgtcgagtctttgtcagaaaggtctacaccatcctgctgattcagctgctggtgaccttggctgtcgtggctctctttactttctgtgaccctgtcaaggactatgtccaggccaacccaggctggtactgggcatcctatgctgtgttctttgcaacctacctgaccctggcttgctgttctggacccaggaggcatttcccctggaacctgattctcctgaccgtctttaccctgtccatggcctacctcactgggatgctgtccagctactacaacaccacctccgtgctgctgtgcctgggcatcacggcccttgtctgcctctcagtcaccgtcttcagcttccagaccaagttcgacttcacctcctgccagggcgtgctcttcgtgcttctcatgactcttttcttcagcggactcatcctggccatcctcctacccttccaatatgtgccctggctccatgcagtttatgcagcactgggagcgggtgtatttacattgttcctggcacttgacacccagttgctgatgggtaaccgacgccactcgctgagccctgaggagtatatttttggagccctcaacatttacctagacatcatctatatcttcaccttcttcctgcagctttttggcactaaccgagaatgaggagccctccctgccccaccgtcctccagagaatgcgcccctcctggttccctgtccctcccctgcgctcctgcgagaccagatataaaactagctgcc

SEQ ID NO: 103803 - DNA, 847 bp, Homo sapiens
catagggagtagccaccatggtctacacctcccactacaaatcccctgggcgcagacccctgaagactcaccccaccgtgacctactggagggtcaatgaaggtctggtgtttgtgggtgtcctcctcccttccctacacacccgccggcccactttccctctcttttccccttccctctgtggcctggccacctgggctttcgcagaatatgtagacaggacacgagggagaagtgaaggacaagagggcaagggtcttcaggcctcaggtttgcagtgggtctacctctctcccccttcctcatttcccatatcctcgttgctaggactgctgttttaaggaatgttttccaaggaactgtcgaggcaggaaggcagctatgacagacatttactaagtgtgtgccagggcacagggttcgcgtctgggtttgtttcggaggatgcattgatttgcaagacctgctgggatctctgtcctcagagagctgactgtatagacaagtgattggacaactaccacacagtgacacaaacacagtgacagatgcctcagcaccttacctaacccacctaacagtcagggaaggcttcctggaagaagcggtatccacactgagtcccaaaggataggcatgagttagtctggtgaagaggcaggaaaatgagtgtttaaggctgaaagaatagaatgtgcaggggctcacaggcaagagaatacatggttgaaaaaatatacttgggttgagaacctgatcgggggaggaatgtatagcggggctggagggtgctgcgcagggaggccgcggaggctttcttaagaaacttgaacttgagtgaagggca

SEQ ID NO: 103804 - DNA, 4786 bp, Homo sapiens
agcgggatagtacgcgccggctcgcctggcccggctgcagtggatgttgctggaacccacgcggaggaaggaagagacgcaggcaggctgcggttacccaagcggccacccgggcctcagggaccccttccccgagagacggcaccatgacccagggaaagctctccgtggctaacaaggcccctgggaccgaggggcagcagcaggtgcatggcgagaagaaggaggctccagcagtgccctcagccccaccctcctatgaggaagccacctctggggaggggatgaaggcaggggccttccccccagcccccacagcggtgcctctccaccctagctgggcctatgtggaccccagcagcagctccagctatgacaacggtttccccaccggagaccatgagctcttcaccactttcagctgggatgaccagaaagttcgtcgagtctttgtcagaaaggtctacaccatcctgctgattcagctgctggtgaccttggctgtcgtggctctctttactttctgtgaccctgtcaaggactatgtccaggccaacccaggctggtactgggcatcctatgctgtgttctttgcaacctacctgaccctggcttgctgttctggacccaggaggcatttcccctggaacctgattctcctgaccgtctttaccctgtccatggcctacctcactgggatgctgtccagctactacaacaccacctccgtgctgctgtgcctgggcatcacggcccttgtctgcctctcagtcaccgtcttcagcttccagaccaagttcgacttcacctcctgccagggcgtgctcttcgtgcttctcatgactcttttcttcagcggactcatcctggccatcctcctacccttccaatatgtgccctggctccatgcagtttatgcagcactgggagcgggtgtatttacattgttcctggcacttgacacccagttgctgatgggtaaccgacgccactcgctgagccctgaggagtatatttttggagccctcaacatttacctagacatcatctatatcttcaccttcttcctgcagctttttggcactaaccgagaatgaggagccctccctgccccaccgtcctccagagaatgcgcccctcctggttccctgtccctcccctgcgctcctgcgagaccagatataaaactagctgccaacccagcctgtggccaggtcactgtctaccccagcccagcccagccctctgccgcttgtacatacgccatggggaccctgaggaactgaggccacgtcaatccctgtgccgccccattcgcccgttacatcttccaaactgggacggtcaaggctgaaggctcctctgggtttgagggtccaagggacaaggaggagaagcctagcaggatttcagatgcaggagagagacccaggaagcccggcagagccctgagccccactgcaattcctcctagggctgcacaatcatgtggccttagggcacactgtcctgcatccagtctgtgtcctcctgtctttctcatccaggtcaggcattgacactttgtaagaaagggggtaggggacacagctgggcaggtggagtgggtgggcaggatggctgtcccagtctgcccatcttctcttggctctgggaccagcggcttgttctagggatttggacctggaggccaagggcaataggagagggtctgaagcctgtgctgtctgctgcttgctgtgaatggccctcccgggtcatgacagagctcttttggggcaggaggtgagggcagggggccccgctccttggtaagggcctgccctggggctcccagggaagtgggagctggggagccaatccacccagacccgcgtccacctgggaggcatttggggttgcaggaccgagacccacatcctctcactcacttctccacccgccaggcagctgccacaggcctaaggctgagtgaggtgtgattgggccctccggctggatgttctgggggaggaggcaatcgctgtagctgccaggccagccccatctggaaggagtccctgctctgcctcagccctaacccgaggctgtgtgggagtcccttctgcacctcttatttcctaaacccttcctgtcagctgctgtttgctggctcgtccccagccaggcctcctgaggtcttcatagttggcacagtccacatctcttctagcttcactggccactcactcagcccagagtccctaagtgctcccccacttatctctgcatctctccaatttggaagccatccagctgatgctaacagccagggccagtccctccagctggtcccatgtaatgaggccagggctccttatcagcttccaggcggctgggatctcaggcagggtgtgcgtcagccctccaacccccagaggggcgcctgtggggagggaaccaggaggccacactgggggagcgtgcagccagcatgtgcagtggccaactccaggccagtggaaagttactgtgtggatacaggaaggctctgagtggctagcaggaccctcccttggttcgccctcctcctcttctctctcccctgtgctgggagctccgtctgccttgggaagggagacgaggtgtgctgttccttcccagccccatccctccccacccttcctactcccagctttcaagaaacattgcagaagcatttgaagttttgttccatcttggatatttgaagagaaaaggagccaagaactggcgggtggtgtgtgtgcagcaaaggcattgggggcacgggtgagatgcccactgtgtgctggtctaaattaatccatcgcagtgatcctccagagacagcgctctgctcatgtccgtagcagagggaaaagccgaggtgctcagaaaggctcggtaatgagtcccaggtcatacggctagcgagtggcgggcctggggttcagacccacagctgcctcaagcaaacagggtatcacgcttgcccctgggcctgggtgggggccggaatgagaccacatgagagcgcagagaggtgggtggtcaggccctgatgtcctggggatttcttgtcctcagtgccacccggcctcccgtctttcctgaaacccctcgccagattttgcactctgaggtttctatcttccagacaagagctgggaggcaagatttctggtttctggttcctagcctcactgccagcgggctcctgctattaggtgagggtttcttgctgtctggaattcagtttttccatctgccacatggaagttcatagccaggatagggcgggagaggcaccagaacatttctctccactgactttctcacccggttcccaccctcctccacctcctctcctccgggcccctcagtttcctctcctcatctctggcctcagttccagagggttagccccagcaccccactctcctgccactgtcagatagccttggtcatgcttcctagaatctacttgtccaagttctcctctccctgggataagttactgcagaaactggggatttagaagcttattcagggctgagtgccaaaagcttgggggaggagggacaggtcctcggcaataaacagtgtcacacacgcatcacagccatttgagaaatggcttctttgcagagctggggaagccgggcagaagatgccgcagcctcctactctgggtcctgagggggggtggcaggtaccacagtgtaggcagcagggtcagggccaaagtctatgcgttccatctccaatccaggcagtgaggaatcctgaaacaccaggagaggcgtcagaagtaggaagggcaggggaacaggaatgcaagattaaggaaaccgcagctgagcaggtgtcacaagctgtaaaggaggaagggagtctgcaggcccttcacatttttggcctgggtggggctgggcccaggaaggggtgggctggattttgtaaagctggaggcagccaggaatctgactgtccggaatgtgagttgaggggtctcccactgaagtcctcttctggaagctgcagatgggggcccgggaggcacacacgagtctgggactcattcccgggcacacctatggctccttcggtatcacctggggaagccccggaatcttagttcttccattccctactcttccttccgagggagtcaggatgggacagacacccattttccaaaaggctccttgcctccttccctggcccacctgaagccaagtcccaggtgtcctggctgctctcctgggcggggtgggatttttgcataagcactttgctgccctccagtggctgcttgaggaaacgcagggcctggtttgggagagtcaccgagggcccatgtggctggaggttgggggcaggatctggcccgagctctcctcagacctccccagacctgtcttctcatcagccaccgctgttttcttttgccgaacgatggttgcatctctcggacacagtgtaccccctcccaagccctccctgagccgttctcctgagtccctgagggcagacacagctccagggacccaggccggctgccacacccccgacactcctgctgtccactggccttagctcctgcaagttccccagtgtccgcacctgttcccttccctgacctcaccttcctggggtctgtgactgactggagataaaaataaaagcaattgtgacacctgagacttggcttcaggtgggccagggaaggaggcaaggagccttttggaagctgggtgtctgtcccatcctgactcccgtcgac

SEQ ID NO: 103805 - DNA, 4531 bp, Homo sapiens
catagggagtagccaccatggtctacacctcccactacaaatcccctgggcgcagacccctgaagactcaccccaccgtgacctactggagggtcaatgaaggcagcagctccagctatgacaacggtttccccaccggagaccatgagctcttcaccactttcagctgggatgaccagaaagttcgtcgagtctttgtcagaaaggtctacaccatcctgctgattcagctgctggtgaccttggctgtcgtggctctctttactttctgtgaccctgtcaaggactatgtccaggccaacccaggctggtactgggcatcctatgctgtgttctttgcaacctacctgaccctggcttgctgttctggacccaggaggcatttcccctggaacctgattctcctgaccgtctttaccctgtccatggcctacctcactgggatgctgtccagctactacaacaccacctccgtgctgctgtgcctgggcatcacggcccttgtctgcctctcagtcaccgtcttcagcttccagaccaagttcgacttcacctcctgccagggcgtgctcttcgtgcttctcatgactcttttcttcagcggactcatcctggccatcctcctacccttccaatatgtgccctggctccatgcagtttatgcagcactgggagcgggtgtatttacattgttcctggcacttgacacccagttgctgatgggtaaccgacgccactcgctgagccctgaggagtatatttttggagccctcaacatttacctagacatcatctatatcttcaccttcttcctgcagctttttggcactaaccgagaatgaggagccctccctgccccaccgtcctccagagaatgcgcccctcctggttccctgtccctcccctgcgctcctgcgagaccagatataaaactagctgccaacccagcctgtggccaggtcactgtctaccccagcccagcccagccctctgccgcttgtacatacgccatggggaccctgaggaactgaggccacgtcaatccctgtgccgccccattcgcccgttacatcttccaaactgggacggtcaaggctgaaggctcctctgggtttgagggtccaagggacaaggaggagaagcctagcaggatttcagatgcaggagagagacccaggaagcccggcagagccctgagccccactgcaattcctcctagggctgcacaatcatgtggccttagggcacactgtcctgcatccagtctgtgtcctcctgtctttctcatccaggtcaggcattgacactttgtaagaaagggggtaggggacacagctgggcaggtggagtgggtgggcaggatggctgtcccagtctgcccatcttctcttggctctgggaccagcggcttgttctagggatttggacctggaggccaagggcaataggagagggtctgaagcctgtgctgtctgctgcttgctgtgaatggccctcccgggtcatgacagagctcttttggggcaggaggtgagggcagggggccccgctccttggtaagggcctgccctggggctcccagggaagtgggagctggggagccaatccacccagacccgcgtccacctgggaggcatttggggttgcaggaccgagacccacatcctctcactcacttctccacccgccaggcagctgccacaggcctaaggctgagtgaggtgtgattgggccctccggctggatgttctgggggaggaggcaatcgctgtagctgccaggccagccccatctggaaggagtccctgctctgcctcagccctaacccgaggctgtgtgggagtcccttctgcacctcttatttcctaaacccttcctgtcagctgctgtttgctggctcgtccccagccaggcctcctgaggtcttcatagttggcacagtccacatctcttctagcttcactggccactcactcagcccagagtccctaagtgctcccccacttatctctgcatctctccaatttggaagccatccagctgatgctaacagccagggccagtccctccagctggtcccatgtaatgaggccagggctccttatcagcttccaggcggctgggatctcaggcagggtgtgcgtcagccctccaacccccagaggggcgcctgtggggagggaaccaggaggccacactgggggagcgtgcagccagcatgtgcagtggccaactccaggccagtggaaagttactgtgtggatacaggaaggctctgagtggctagcaggaccctcccttggttcgccctcctcctcttctctctcccctgtgctgggagctccgtctgccttgggaagggagacgaggtgtgctgttccttcccagccccatccctccccacccttcctactcccagctttcaagaaacattgcagaagcatttgaagttttgttccatcttggatatttgaagagaaaaggagccaagaactggcgggtggtgtgtgtgcagcaaaggcattgggggcacgggtgagatgcccactgtgtgctggtctaaattaatccatcgcagtgatcctccagagacagcgctctgctcatgtccgtagcagagggaaaagccgaggtgctcagaaaggctcggtaatgagtcccaggtcatacggctagcgagtggcgggcctggggttcagacccacagctgcctcaagcaaacagggtatcacgcttgcccctgggcctgggtgggggccggaatgagaccacatgagagcgcagagaggtgggtggtcaggccctgatgtcctggggatttcttgtcctcagtgccacccggcctcccgtctttcctgaaacccctcgccagattttgcactctgaggtttctatcttccagacaagagctgggaggcaagatttctggtttctggttcctagcctcactgccagcgggctcctgctattaggtgagggtttcttgctgtctggaattcagtttttccatctgccacatggaagttcatagccaggatagggcgggagaggcaccagaacatttctctccactgactttctcacccggttcccaccctcctccacctcctctcctccgggcccctcagtttcctctcctcatctctggcctcagttccagagggttagccccagcaccccactctcctgccactgtcagatagccttggtcatgcttcctagaatctacttgtccaagttctcctctccctgggataagttactgcagaaactggggatttagaagcttattcagggctgagtgccaaaagcttgggggaggagggacaggtcctcggcaataaacagtgtcacacacgcatcacagccatttgagaaatggcttctttgcagagctggggaagccgggcagaagatgccgcagcctcctactctgggtcctgagggggggtggcaggtaccacagtgtaggcagcagggtcagggccaaagtctatgcgttccatctccaatccaggcagtgaggaatcctgaaacaccaggagaggcgtcagaagtaggaagggcaggggaacaggaatgcaagattaaggaaaccgcagctgagcaggtgtcacaagctgtaaaggaggaagggagtctgcaggcccttcacatttttggcctgggtggggctgggcccaggaaggggtgggctggattttgtaaagctggaggcagccaggaatctgactgtccggaatgtgagttgaggggtctcccactgaagtcctcttctggaagctgcagatgggggcccgggaggcacacacgagtctgggactcattcccgggcacacctatggctccttcggtatcacctggggaagccccggaatcttagttcttccattccctactcttccttccgagggagtcaggatgggacagacacccattttccaaaaggctccttgcctccttccctggcccacctgaagccaagtcccaggtgtcctggctgctctcctgggcggggtgggatttttgcataagcactttgctgccctccagtggctgcttgaggaaacgcagggcctggtttgggagagtcaccgagggcccatgtggctggaggttgggggcaggatctggcccgagctctcctcagacctccccagacctgtcttctcatcagccaccgctgttttcttttgccgaacgatggttgcatctctcggacacagtgtaccccctcccaagccctccctgagccgttctcctgagtccctgagggcagacacagctccagggacccaggccggctgccacacccccgacactcctgctgtccactggccttagctcctgcaagttccccagtgtccgcacctgttcccttccctgacctcaccttcctggggtctgtgactgactggagataaaaataaaagcaattgtgacacctgagacttggcttcaggtgggccagggaaggaggcaaggagccttttggaagctgggtgtctgtcccatcctgactcccgtcgac

SEQ ID NO: 103806 - DNA, 1426 bp, Homo sapiens
cccgctcagagccagtttctcccgctcagagccagtttctcccgctcagttccagagggttagccccagcaccccactctcctgccactgtcagatagccttggtcatgcttcctagaatctacttgtccaagttctcctctccctgggataagttactgcagaaactggggatttagaagcttattcagggctgagtgccaaaagcttgggggaggagggacaggtcctcggcaataaacagtgtcacacacgcatcacagccatttgagaaatggcttctttgcagagctggggaagccgggcagaagatgccgcagcctcctactctgggtcctgagggggggtggcaggtaccacagtgtaggcagcagggtcagggccaaagtctatgcgttccatctccaatccaggcagtgaggaatcctgaaacaccaggagaggcgtcagaagtaggaagggcaggggaacaggaatgcaagattaaggaaaccgcagctgagcaggtgtcacaagctgtaaaggaggaagggagtctgcaggcccttcacatttttggcctgggtggggctgggcccaggaaggggtgggctggattttgtaaagctggaggcagccaggaatctgactgtccggaatgtgagttgaggggtctcccactgaagtcctcttctggaagctgcagatgggggcccgggaggcacacacgagtctgggactcattcccgggcacacctatggctccttcggtatcacctggggaagccccggaatcttagttcttccattccctactcttccttccgagggagtcaggatgggacagacacccattttccaaaaggctccttgcctccttccctggcccacctgaagccaagtcccaggtgtcctggctgctctcctgggcggggtgggatttttgcataagcactttgctgccctccagtggctgcttgaggaaacgcagggcctggtttgggagagtcaccgagggcccatgtggctggaggttgggggcaggatctggcccgagctctcctcagacctccccagacctgtcttctcatcagccaccgctgttttcttttgccgaacgatggttgcatctctcggacacagtgtaccccctcccaagccctccctgagccgttctcctgagtccctgagggcagacacagctccagggacccaggccggctgccacacccccgacactcctgctgtccactggccttagctcctgcaagttccccagtgtccgcacctgttcccttccctgacctcaccttcctggggtctgtgactgactggagataaaaataaaagcaattgtgacacctgagacttggcttcaggtgggccagggaaggaggcaaggagccttttggaagctgggtgtctgtcccatcctgactcccgtcgac

SEQ ID NO: 103807 - DNA, 281 bp, Homo sapiens
cctgcatcgatagcgctcgtggacgctacgccgcgacgagtaggagggccgctgactgcataccaacgccgcccagtctgtgtcctcctgtctttctcatccaggtcaggcattgacactttgtaagaaagggggtaggggacacagctgggcaggtggagtgggtgggcaggatggctgtcccagtctgcccatcttctcttggctctgggaccagctggcgttggatagccgtacgacttgcaatcaaatgcatgcaagaatgcatccaacgccgatga

SEQ ID NO: 103808 - DNA, 4683 bp, Homo sapiens
agcgggatagtacgcgccggctcgcctggcccggctgcagtggatgttgctggaacccacgcggaggaaggaagagacgcaggcaggctgcggttacccaagcggccacccgggcctcagggaccccttccccgagagacggcaccatgacccagggaaagctctccgtggctaacaaggcccctgggaccgaggggcagcagcaggtgcatggcgagaagaaggaggctccagcagtgccctcagccccaccctcctatgaggaagccacctctggggaggggatgaaggcaggggccttccccccagcccccacagcggtgcctctccaccctagctgggcctatgtggaccccagcagcagctccagctatgacaacggtttccccaccggagaccatgagctcttcaccactttcagctgggatgaccagaaagttcgtcgagtctttgtcagaaaggtctacaccatcctgctgattcagctgctggtgaccttggctgtcgtggctctctttactttctgtgaccctgtcaaggactatgtccaggccaacccaggctggtactgggcatcctatgctgtgttctttgcaacctacctgaccctggcttgctgttctggacccaggaggcatttcccctggaacctgattctcctgaccgtctttaccctgtccatggcctacctcactgggatgctgtccagctactacaacaccacctccgtgctgctgtgcctgggcatcacggcccttgtctgcctctcagtcaccgtcttcagcttccagaccaagttcgacttcacctcctgccagggcgtgctcttcgtgcttctcatgactcttttcttcagcggactcatcctggccatcctcctacccttccaatatgtgccctggctccatgcagtttatgcagcactgggagcgggtgtatttacattgttcctggcacttgacacccagttgctgatgggtaaccgacgccactcgctgagccctgaggagtatatttttggagccctcaacatttacctagacatcatctatatcttcaccttcttcctgcagctttttggcactaaccgagaatgaggagccctccctgccccaccgtcctccagagaatgcgcccctcctggttccctgtccctcccctgcgctcctgcgagaccagatataaaactagctgccaacccagcctgtggccaggtcactgtctaccccagcccagcccagccctctgccgcttgtacatacgccatggggaccctgaggaactgaggccacgtcaatccctgtgccgccccattcgcccgttacatcttccaaactgggacggtcaaggctgaaggctcctctgggtttgagggtccaagggacaaggaggagaagcctagcaggatttcagatgcaggagagagacccaggaagcccggcagagccctgagccccactgcaattcctcctagggctgcacaatcatgtggccttagggcacactgtcctgcatccagtctgtgtcctcctgtctttctcatccaggtcaggcattgacactttgtaagaaagggggtaggggacacagctgggcaggtggagtgggtgggcaggatggctgtcccagtctgcccatcttctcttggctctgggaccagcggcttgttctagggatttggacctggaggccaagggcaataggagagggtctgaagcctgtgctgtctgctgcttgctgtgaatggccctcccgggtcatgacagagctcttttggggcaggaggtgagggcagggggccccgctccttggtaagggcctgccctggggctcccagggaagtgggagctggggagccaatccacccagacccgcgtccacctgggaggcatttggggttgcaggaccgagacccacatcctctcactcacttctccacccgccaggcagctgccacaggcctaaggctgagtgaggtgtgattgggccctccggctggatgttctgggggaggaggcaatcgctgtagctgccaggccagccccatctggaaggagtccctgctctgcctcagccctaacccgaggctgtgtgggagtcccttctgcacctcttatttcctaaacccttcctgtcagctgctgtttgctggctcgtccccagccaggcctcctgaggtcttcatagttggcacagtccacatctcttctagcttcactggccactcactcagcccagagtccctaagtgctcccccacttatctctgcatctctccaatttggaagccatccagctgatgctaacagccagggccagtccctccagctggtcccatgtaatgaggccagggctccttatcagcttccaggcggctgggatctcaggcagggtgtgcgtcagccctccaacccccagaggggcgcctgtggggagggaaccaggaggccacactgggggagcgtgcagccagcatgtgcagtggccaactccaggccagtggaaagttactgtgtggatacaggaaggctctgagtggctagcaggaccctcccttggttcgccctcctcctcttctctctcccctgtgctgggagctccgtctgccttgggaagggagacgaggtgtgctgttccttcccagccccatccctccccacccttcctactcccagctttcaagaaacattgcagaagcatttgaagttttgttccatcttggatatttgaagagaaaaggagccaagaactggcgggtggtgtgtgtgcagcaaaggcattgggggcacgggtgagatgcccactgtgtgctggtctaaattaatccatcgcagtgatcctccagagacagcgctctgctcatgtccgtagcagagggaaaagccgaggtgctcagaaaggctcggtaatgagtcccaggtcatacggctagcgagtggcgggcctggggttcagacccacagctgcctcaagcaaacagggtatcacgcttgcccctgggcctgggtgggggccggaatgagaccacatgagagcgcagagaggtgggtggtcaggccctgatgtcctggggatttcttgtcctcagtgccacccggcctcccgtctttcctgaaacccctcgccagattttgcactctgaggtttctatcttccagacaagagctgggaggcaagatttctggtttctggttcctagcctcactgccagcgggctcctgctattaggtgagggtttcttgctgtctggaattcagtttttccatctgccacatggaagttcatagccaggatagggcgggagaggcaccagaacatttctctccactgactttctcacccggttcccaccctcctccacctcctctcctccgggcccctcagtttcctctcctcatctctggcctcagttccagagggttagccccagcaccccactctcctgccactgtcagatagccttggtcatgcttcctagaatctacttgtccaaataaacagtgtcacacacgcatcacagccatttgagaaatggcttctttgcagagctggggaagccgggcagaagatgccgcagcctcctactctgggtcctgagggggggtggcaggtaccacagtgtaggcagcagggtcagggccaaagtctatgcgttccatctccaatccaggcagtgaggaatcctgaaacaccaggagaggcgtcagaagtaggaagggcaggggaacaggaatgcaagattaaggaaaccgcagctgagcaggtgtcacaagctgtaaaggaggaagggagtctgcaggcccttcacatttttggcctgggtggggctgggcccaggaaggggtgggctggattttgtaaagctggaggcagccaggaatctgactgtccggaatgtgagttgaggggtctcccactgaagtcctcttctggaagctgcagatgggggcccgggaggcacacacgagtctgggactcattcccgggcacacctatggctccttcggtatcacctggggaagccccggaatcttagttcttccattccctactcttccttccgagggagtcaggatgggacagacacccattttccaaaaggctccttgcctccttccctggcccacctgaagccaagtcccaggtgtcctggctgctctcctgggcggggtgggatttttgcataagcactttgctgccctccagtggctgcttgaggaaacgcagggcctggtttgggagagtcaccgagggcccatgtggctggaggttgggggcaggatctggcccgagctctcctcagacctccccagacctgtcttctcatcagccaccgctgttttcttttgccgaacgatggttgcatctctcggacacagtgtaccccctcccaagccctccctgagccgttctcctgagtccctgagggcagacacagctccagggacccaggccggctgccacacccccgacactcctgctgtccactggccttagctcctgcaagttccccagtgtccgcacctgttcccttccctgacctcaccttcctggggtctgtgactgactggagataaaaataaaagcaattgtgacacctgagacttggcttcaggtgggccagggaaggaggcaaggagccttttggaagctgggtgtctgtcccatcctgactcccgtcgac

SEQ ID NO: 103809 - DNA, 3209 bp, Homo sapiens
aaaaactaggctagtacgaggcccgtgtgggtgggcaggatggctgtcccagtctgcccatcttctcttggctctgggaccagcggcttgttctagggatttggacctggaggccaagggcaataggagagggtctgaagcctgtgctgtctgctgcttgctgtgaatggccctcccgggtcatgacagagctcttttggggcaggaggtgagggcagggggccccgctccttggtaagggcctgccctggggctcccagggaagtgggagctggggagccaatccacccagacccgcgtccacctgggaggcatttggggttgcaggaccgagacccacatcctctcactcacttctccacccgccaggcagctgccacaggcctaaggctgagtgaggtgtgattgggccctccggctggatgttctgggggaggaggcaatcgctgtagctgccaggccagccccatctggaaggagtccctgctctgcctcagccctaacccgaggctgtgtgggagtcccttctgcacctcttatttcctaaacccttcctgtcagctgctgtttgctggctcgtccccagccaggcctcctgaggtcttcatagttggcacagtccacatctcttctagcttcactggccactcactcagcccagagtccctaagtgctcccccacttatctctgcatctctccaatttggaagccatccagctgatgctaacagccagggccagtccctccagctggtcccatgtaatgaggccagggctccttatcagcttccaggcggctgggatctcaggcagggtgtgcgtcagccctccaacccccagaggggcgcctgtggggagggaaccaggaggccacactgggggagcgtgcagccagcatgtgcagtggccaactccaggccagtggaaagttactgtgtggatacaggaaggctctgagtggctagcaggaccctcccttggttcgccctcctcctcttctctctcccctgtgctgggagctccgtctgccttgggaagggagacgaggtgtgctgttccttcccagccccatccctccccacccttcctactcccagctttcaagaaacattgcagaagcatttgaagttttgttccatcttggatatttgaagagaaaaggagccaagaactggcgggtggtgtgtgtgcagcaaaggcattgggggcacgggtgagatgcccactgtgtgctggtctaaattaatccatcgcagtgatcctccagagacagcgctctgctcatgtccgtagcagagggaaaagccgaggtgctcagaaaggctcggtaatgagtcccaggtcatacggctagcgagtggcgggcctggggttcagacccacagctgcctcaagcaaacagggtatcacgcttgcccctgggcctgggtgggggccggaatgagaccacatgagagcgcagagaggtgggtggtcaggccctgatgtcctggggatttcttgtcctcagtgccacccggcctcccgtctttcctgaaacccctcgccagattttgcactctgaggtttctatcttccagacaagagctgggaggcaagatttctggtttctggttcctagcctcactgccagcgggctcctgctattaggtgagggtttcttgctgtctggaattcagtttttccatctgccacatggaagttcatagccaggatagggcgggagaggcaccagaacatttctctccactgactttctcacccggttcccaccctcctccacctcctctcctccgggcccctcagtttcctctcctcatctctggcctcagttccagagggttagccccagcaccccactctcctgccactgtcagatagccttggtcatgcttcctagaatctacttgtccaagttctcctctccctgggataagttactgcagaaactggggatttagaagcttattcagggctgagtgccaaaagcttgggggaggagggacaggtcctcggcaataaacagtgtcacacacgcatcacagccatttgagaaatggcttctttgcagagctggggaagccgggcagaagatgccgcagcctcctactctgggtcctgagggggggtggcaggtaccacagtgtaggcagcagggtcagggccaaagtctatgcgttccatctccaatccaggcagtgaggaatcctgaaacaccaggagaggcgtcagaagtaggaagggcaggggaacaggaatgcaagattaaggaaaccgcagctgagcaggtgtcacaagctgtaaaggaggaagggagtctgcaggcccttcacatttttggcctgggtggggctgggcccaggaaggggtgggctggattttgtaaagctggaggcagccaggaatctgactgtccggaatgtgagttgaggggtctcccactgaagtcctcttctggaagctgcagatgggggcccgggaggcacacacgagtctgggactcattcccgggcacacctatggctccttcggtatcacctggggaagccccggaatcttagttcttccattccctactcttccttccgagggagtcaggatgggacagacacccattttccaaaaggctccttgcctccttccctggcccacctgaagccaagtcccaggtgtcctggctgctctcctgggcggggtgggatttttgcataagcactttgctgccctccagtggctgcttgaggaaacgcagggcctggtttgggagagtcaccgagggcccatgtggctggaggttgggggcaggatctggcccgagctctcctcagacctccccagacctgtcttctcatcagccaccgctgttttcttttgccgaacgatggttgcatctctcggacacagtgtaccccctcccaagccctccctgagccgttctcctgagtccctgagggcagacacagctccagggacccaggccggctgccacacccccgacactcctgctgtccactggccttagctcctgcaagttccccagtgtccgcacctgttcccttccctgacctcaccttcctggggtctgtgactgactggagataaaaataaaagcaattgtgacacctgagacttggcttcaggtgggccagggaaggaggcaaggagccttttggaagctgggtgtctgtcccatcctgactcccgtcgac

SEQ ID NO: 103810 - DNA, 516 bp, Homo sapiens
agcagtaaaaaatacccctcaaattgtaaagactgttgattatgtaaaagtcaccaactgaataatagatactgtttttaaaaatcaagcatttccgtatctgttatgtcaattttaatgttttctttttttctctttcattccaatgagctttcatttggctttttatatataggaattttatttatagtcagaatctttcgttaatttctttaattattcataaaatgttttaattccgtggacatcttatttttcttttgagaaatttaacaaatattaggacatttccagaatgatattgtaaacatcaagtacattaaacagtgtacattaagctatatatatgtgtgtgtatatacatatatgtgtgtgtgtgtgtgtatatatatatgtatatgtaaaaaatactgtcgggtgtgtctgtagttcagctactcaggaggctgaagcaggagaatcacttggggccgggagtttgaggatgtggtgtattatgattgtgcctgtgaatag

SEQ ID NO: 103811 - DNA, 779 bp, Homo sapiens
ctcagtgttttcatagatagaatttgtttcattttagcctcaaaaaagagtatatgcacttcctatcttgtaaaattttattttgctatagaagaaactctccttagtttcttttttcttttctttctttcttttttttttaacctgagtttgacttaactgaagtagccaaggtgactcagaaaaattaagaaattcatgaggatgaggattagcttgctatgtcccagatgttcagttttcagcctagtattcttttatttatttctttttttttaacctgagctggacttaactgaaatagccaaggtgacccagaaaaattaagaaattcatgaggatgaggattagcttgctgtgtcccagatgttcagttttcagcctagtacatagggccaccccaggactctgcagtcagtgaaaatgtcaactgaggcatgaggccaggactctgagctccacactcaatttgaaagtggtgtcagtgggaacttacaaaagaggacaatctgggtggaatgacaggaggatcttcatgacctgggttcagggtcaattgccagctttattatttacttgcttcaggaacctggtcacatttcttaaccacttcatgccccagttgcttcatttttgtcaaataagcataaaatagtgcccacctcattgggtgaggtgtgaggagtaaatgaaataatgtataccaatgcttagaataatggctggcacattactctaagcgttggcatacattaaaccatcaagaattctttttggag

SEQ ID NO: 103812 - DNA, 115 bp, Homo sapiens
gattggtctgaggggttgagagccactgccttgccagggagctcgctgcccctgctcaggagccttttgaggctcccctctgcctgcagcagaagtcctgaccccttggcctggc

SEQ ID NO: 103813 - DNA, 445 bp, Homo sapiens
tttttttttttgtagagatgggactgtcactatgttgcctaaattgatctcaaatttctggcctcaagcaatcctcgtgccttggtttcccaaagtgctgggattacaggcatgagtcactgcattcaacctacattttgtttaaaatccttccatttgtattcggcttccttgtttacagtttttcacatatatctcataactggattatgagaatcaagggccaattagaagaagtaggtattgttacttattttatataaagagaagaattatggcttaaagaagtgagcaactgaaagtcaaacaacaggagcttgaaattaagcctatgtcattagattccgtagccaatgcactatcagatggtttcctacataaagctaaatttcttgggaaattttacaaagacgggatatatgtatcctcaatggaattagcataa

SEQ ID NO: 103814 - DNA, 729 bp, Homo sapiens
ctttgatccatgggctatttaaaagtatactattagtttccagatatttgaggaatttctggatagggtcctgttctgtattttttttctaattaaattccattttgatgatgtaaaacctttcaaattcattgagacttcttttatagtctctctctctcctctctctctttttttttttttttttttgagatggagtcctgctctgtcgcccaggctggagtacagtggtacaatctcagctcactgcaacctccacctcccaggttgaagtgattctcctgcctcaggctcctgaatagctgggactacaggcgcacgccaccacgcccagctaatttttgtatttttagtagagacagggtttcaccatgttggccaggctggtctcaaactcttgacctcaggtgatccacctgccttggcctcccaaagtgctgggattacaggcctgagccatcatgcctagcttgttttatagtctctctaaatgatctgtgggcttctgaaaacaatgtctgttccactgtgttattccattacatcaatcataaccctgtgatttcatagttttataaatggagacacacaataacttcgtgggtgatagcttactaattgatgccaggaggaaaaaaaatctttatttaactaccagttgagtttcttgggaactcagtgaccttggttgtgtcattcaccattctgagtcttattgctgcctcttcc

SEQ ID NO: 103815 - DNA, 359 bp, Homo sapiens
cacggacacacacagacacacacacacacacacaccactcaatgttctgtttttattttaaatgcaaaaccacagatgagtcacgagtctttggttctgcccatcaagcctatattattccctaagtctgcccattatccactatctgagatgacgacttcacacctcctccccttctcgagccatttaccccttgtctactgcatctgtttctagctcttgacctcgtttcctatttcactaagaaacaaacactcataattgccacatatcccatcaacacatccacccgtcacactcctctgagccccaagactctgcctccctgtccccaagaccctcagagaccagatctccat

SEQ ID NO: 103816 - DNA, 558 bp, Homo sapiens
gaggtcagcacttgggcccactgacagtgactgactgggggagaaggtcctgcagcccccttcccctgggtgtgttctggggacctgtggtttgctggcggaaacaagtgatgaggctggttagcggatgtgggaggctgtgaccccagggggccatagggtgcggtggaactgcaggccctgcagatgacggcagccagctgcttccaggaaccaggtgtccaaggccacctctgcaggggtttcctcttcagcctgcctggggtgagaggtcagtgcaccacagccgaggctggagcacagggagcttctgttgttctgatctatctctggaaaaccagccattcctcctccctgcagtcagaattctttgccctgtctgacctgaacttgcttagggagtcatgccactccccactgtggccatagtttctcttcctgtaaaattttattattttagttttttgtttttgagatatgcttcttctcttcctgtggttccatccgaaggattgtggtgagccccgtgccttcagttaataaagatttgtattgtga

SEQ ID NO: 103817 - DNA, 1871 bp, Homo sapiens
gaggtcagcacttgggcccactgacagtgactgactgggggagaaggtcctgcagcccccttcccctgggtgtgttctggggacctgtggtttgctggcggaaacaagtgatgaggctggttagcggatgtgggaggctgtgaccccagggggccatagggtgcggtggaactgcaggccctgcagatgacggcagccagctgcttccaggaaccaggtgtccaaggccacctctgcaggggtttcctcttcagcctgcctggggtgagaggtcagtgcaccacagccgaggctggagcacagggagcttctgttgttctgatctatctctggaaaaccagccattcctcctccctgcagtcagaattctttgccctgtctgacctgaacttgcttagggagtcatgccactccccactgtggccatagtttctcttcctgtaaaattttattattttagttttttgtttttgagatgtagtctcaccctgtcgcccaggctggagtgcaatgccgtgatctccgctcactgccacctccgcctctctagttcaagcgattttcctgcctcagcctcccgagtagctgggattccaggcgcccgccaccacgcctggctaattttttgtatttttagtagagacgggattttatcatgttggccaggctggtctcgaactcctgacctcaggtgatctgcccaccttggcctcccaaagtgctgggattacaggcatgagccactgtgcctggccccttcctgtaaaatttttaaatggagaattgggtgcgagatgtggtttccagcctggtgcctggggtgctgagctagtgagtggtgcagtccaggacacctttgctttatgtcacttacacggtcacctggagccggctcaagtggctaaagcatcctggggcccagagccaggtgataggtccctctggccaactggacagttgaggcctgtggttacccgaagcccagctggggccctggtccagcctcgcctcccagactctgcacctgctagcacagctgtccacgtctgtgtgagctgctctaggccgagggcctcagtttcaagagtgtgttggggtgggatggggcaggccgtggtcctccagcatgaagaaggagccatgaggagttcccatgacctcccgagacttgccataagtgttctagtccacatataagggtagggttgggattaccatttactgaccacatctgtgaggtgccgagctgggtgcttgacatcatttgcttggagaagcagctgctagtagacccattttacaggtgagagaaccaagtctcacagaggcctgggttcaagtcccacctctgccactaactggcatgtgaccctatctatccttcactgctctgagcctagaccctggcccctgcctggctccctgccaggctccctgccacccctcacgacctctgatggtcgttgtgggggtctcttgcctggctcccagggctagggttagggctctggaggtgctttcactcaaccaagggggccacagcactggggagtgaaactgccccgcctcaccctgcgttgccctctgggtctgtgagggtgggctggcaggaggcctaggccttgccctaggggcagtcctgcttcctcattttatagatagggaaactgaggctttgggaggactcactgacatacctaccttcaagatgagttcaggtgggctcagttctggggcttgggaaaagggccccagtggctttgggaagcacccccagcccagggtgaaacatgcttcttctcttcctgtggttccatccgaaggattgtggtgagccccgtgccttcagttaataaagatttgtattgtga

SEQ ID NO: 103818 - DNA, 1852 bp, Homo sapiens
gaggtcagcacttgggcccactgacagtgactgactgggggagaaggtcctgcagcccccttcccctgggtgtgttctggggacctgtggtttgctggcggaaacaagtgatgaggctggttagcggatgtgggaggctgtgaccccagggggccatagggtgcggtggaactgcaggccctgcagatgacggcagccagctgcttccaggaaccaggtgtccaaggccacctctgcaggggtttcctcttcagcctgcctggggtgagaggtcagtgcaccacagccgaggctggagcacagggagcttctgttgttctgatctatctctggaaaaccagccattcctcctccctgcagtcagaattctttgccctgtctgacctgaacttgcttagggagtcatgccactccccactgtggccatagtttctcttcctgtaaaattttattattttagttttttgtttttgagatgtagtctcaccctgtcgcccaggctggagtgcaatgccgtgatctccgctcactgccacctccgcctctctagttcaagcgattttcctgcctcagcctcccgagtagctgggattccaggcgcccgccaccacgcctggctaattttttgtatttttagtagagacgggattttatcatgttggccaggctggtctcgaactcctgacctcaggtgatctgcccaccttggcctcccaaagtgctgggattacaggcatgagccactgtgcctggccccttcctaattgggtgcgagatgtggtttccagcctggtgcctggggtgctgagctagtgagtggtgcagtccaggacacctttgctttatgtcacttacacggtcacctggagccggctcaagtggctaaagcatcctggggcccagagccaggtgataggtccctctggccaactggacagttgaggcctgtggttacccgaagcccagctggggccctggtccagcctcgcctcccagactctgcacctgctagcacagctgtccacgtctgtgtgagctgctctaggccgagggcctcagtttcaagagtgtgttggggtgggatggggcaggccgtggtcctccagcatgaagaaggagccatgaggagttcccatgacctcccgagacttgccataagtgttctagtccacatataagggtagggttgggattaccatttactgaccacatctgtgaggtgccgagctgggtgcttgacatcatttgcttggagaagcagctgctagtagacccattttacaggtgagagaaccaagtctcacagaggcctgggttcaagtcccacctctgccactaactggcatgtgaccctatctatccttcactgctctgagcctagaccctggcccctgcctggctccctgccaggctccctgccacccctcacgacctctgatggtcgttgtgggggtctcttgcctggctcccagggctagggttagggctctggaggtgctttcactcaaccaagggggccacagcactggggagtgaaactgccccgcctcaccctgcgttgccctctgggtctgtgagggtgggctggcaggaggcctaggccttgccctaggggcagtcctgcttcctcattttatagatagggaaactgaggctttgggaggactcactgacatacctaccttcaagatgagttcaggtgggctcagttctggggcttgggaaaagggccccagtggctttgggaagcacccccagcccagggtgaaacatgcttcttctcttcctgtggttccatccgaaggattgtggtgagccccgtgccttcagttaataaagatttgtattgtga

SEQ ID NO: 103819 - DNA, 2126 bp, Homo sapiens
gaggtcagcacttgggcccactgacagtgactgactgggggagaaggtcctgcagcccccttcccctgggtgtgttctggggacctgtggtttgctggcggaaacaagtgatgaggctggttagcggatgtgggaggctgtgaccccagggggccatagggtgcggtggaactgcaggccctgcagatgacggcagccagctgcttccaggaaccaggtgtccaaggccacctctgcaggggtttcctcttcagcctgcctggggtgagaggtcagtgcaccacagccgaggctggagcacagggagcttctgttgttctgatctatctctggaaaaccagccattcctcctccctgcagtcagaattctttgccctgtctgacctgaacttgcttagggagtcatgccactccccactgtggccatagtttctcttcctgtaaaattttattattttagttttttgtttttgagatgtagtctcaccctgtcgcccaggctggagtgcaatgccgtgatctccgctcactgccacctccgcctctctagttcaagcgattttcctgcctcagcctcccgagtagctgggattccaggcgcccgccaccacgcctggctaattttttgtatttttagtagagacgggattttatcatgttggccaggctggtctcgaactcctgacctcaggtgatctgcccaccttggcctcccaaagtgctgggattacaggcatgagccactgtgcctggccccttcctgtaaaatttttaaatggagaattgggtgcgagatgtggtttccagcctggtgcctggggtgctgagctagtgagtggtgcagtccaggacacctttgctttatgtcacttacacggtcacctggagccggctcaagtggctaaagcatcctggggcccagagccaggtgataggtccctctggccaactggacagttgaggcctgtggttacccgaagcccagctggggccctggtccagcctcgcctcccagactctgcacctgctagcacagctgtccacgtctgtgtgagctgctctaggccgagggcctcagtttcaagagtgtgttggggtgggatggggcaggccgtggtcctccagcatgaagaaggagccatgaggagttcccatgacctcccgagacttgccataagtgttctagtccacatataagggtagggttgggattaccatttactgaccacatctgtgaggtgccgagctgggtgcttgacatcatttgcttggagaagcagctgctagtagacccattttacaggtgagagaaccaagtctcacagaggcctgggttcaagtcccacctctgccactaactggcatgtgaccctatctatccttcactgctctgagcctagaccctggcccctgcctggctccctgccaggctccctgccacccctcacgacctctgatggtcgttgtgggggtctcttgcctggctcccagggctagggttagggctctggaggtgctttcactcaaccaagggggccacagcactggggagtgaaactgccccgcctcaccctgcgttgccctctgggtctgtgagggtgggctggcaggaggcctaggccttgccctaggggcagtcctgcttcctcattttatagatagggaaactgaggctttgggaggactcactgacatacctaccttcaagatgagttcaggtgggctcagttctggggcttgggaaaagggccccagtggctttgggaagcacccccagcccagggtgaaacatgcttcttctcttcctgtggttccatccgaaggattgtggtgagccccgtgccttcagttaataaagatttgtattgtgaaaagattttttcttttttttttgggacacagtctcactctgtcgcccaggctagagtggattggcgtgatctcggctcaatgcaaatctccagggttcaatcgattctcctgcctcaccctcccagctacttaggaggctgaagcaggagaatcgcttgaacccaggaggcagaggttgcagtgagccaagattgtgccactgcactccacactccagcctggcgacaaagtgagactgtctcaaaaaaaaaaaa

SEQ ID NO: 103820 - DNA, 1646 bp, Homo sapiens
gaggtcagcacttgggcccactgacagtgactgactgggggagaaggtcctgcagcccccttcccctgggtgtgttctggggacctgtggtttgctggcggaaacaagtgatgaggctggttagcggatgtgggaggctgtgaccccagggggccatagggtgcggtggaactgcaggccctgcagatgacggcagccagctgcttccaggaaccaggtgtccaaggccacctctgcaggggtttcctcttcagcctgcctggggtgagaggtcagtgcaccacagccgaggctggagcacagggagcttctgttgttctgatctatctctggaaaaccagccattcctcctccctgcagtcagaattctttgccctgtctgacctgaacttgcttagggagtcatgccactccccactgtggccatagtttctcttcctgtaaaattttattattttagttttttgtttttgagatgtagtctcaccctgtcgcccaggctggagtgcaatgccgtgatctccgctcactgccacctccgcctctctagttcaagcgattttcctgcctcagcctcccgagtagctgggattccaggcgcccgccaccacgcctggctaattttttgtatttttagtagagacgggattttatcatgttggccaggctggtctcgaactcctgacctcaggtgatctgcccaccttggcctcccaaagtgctgggattacaggcatgagccactgtgcctggccccttcctgtaaaatttttaaatggagaattgggtgcgagatgtggtttccagcctggtgcctggggtgctgagctagtgagtggtgcagtccaggacacctttgctttatgtcacttacacggtcacctggagccggctcaagtggctaaagcatcctggggcccagagccaggtgataggtccctctggccaactggacagttgaggcctgtggttacccgaagcccagctggggccctggtccagcctcgcctcccagactctgcacctgctagcacagctgtccacgtctgtgtgagctgctctaggccgagggcctcagtttcaagagtgtgttggggtgggatggggcaggccgtggtcctccagcatgaagaaggagccatgaggagttcccatgacctcccgagacttgccataagtgttctagtccacatataagggtagggttgggattaccatttactgaccacatctgtgaggtgccgagctgggtgcttgacatcatttgcttggagaagcagctgctagtagacccattttacaggtgagagaaccaagtctcacagaggcctgggttcaagtcccacctctgccactaactggcatgtgaccctatctatccttcactgctctgagccttgccctaggggcagtcctgcttcctcattttatagatagggaaactgaggctttgggaggactcactgacatacctaccttcaagatgagttcaggtgggctcagttctggggcttgggaaaagggccccagtggctttgggaagcacccccagcccagggtgaaacatgcttcttctcttcctgtggttccatccgaaggattgtggtgagccccgtgccttcagttaataaagatttgtattgtga

SEQ ID NO: 103821 - DNA, 871 bp, Homo sapiens
tagtagacccattttacaggtgagagaaccaagtctcacagaggcctgggttcaagtcccacctctgccactaactggcatgtgaccctatctatccttcactgctctgagcctagaccctggcccctgcctggctccctgccaggctccctgccacccctcacgacctctgatggtcgttgtgggggtctcttgcctggctcccagggctagggttagggctctggaggtgctttcactcaaccaagggggccacagcactggggagtgaaactgccccgcctcaccctgcgttgccctctgggtctgtgagggtgggctggcaggaggcctaggccttgccctaggggcagtcctgcttcctcattttatagatagggaaactgaggctttgggaggactcactgacatacctaccttcaagatgagttcaggtgggctcagttctggggcttgggaaaagggccccagtggctttgggaagcacccccagcccagggtgaaacatgcttcttctcttcctgtggttccatccgaaggattgtggtgagccccgtgccttcagttaataaagatttgtattgtgaaaagattttttcttttttttttgggacacagtctcactctgtcgcccaggctagagtggattggcgtgatctcggctcaatgcaaatctccagggttcaatcgattctcctgcctcaccctcccatgtagctgggattacagctgcctgccaaatttttgtatttttagtggaaccggggtttcaccatgttggccaggctggtcttgaactcctgacctcaactgatccgcccaccttggcctcccaagtgctgggattacaggcgcgagccacggcgcccag

SEQ ID NO: 103822 - DNA, 405 bp, Homo sapiens
aaggtatatgttcaaacaatgcatccttaattttttttagagacagggtctcgctgtgttgcccaggcaggtcttgaactcctgacctcaagcaattctcccacctaggcctcccaaagtgctgggattataggcatgagccaccacgcctggccatccttaatttttaagactccaaattaagttggaatagactgatatatctaaatcagatgaagcatgtttctctttaaaggagggaacttacaaaacagaagtatttttgttacatgagctaagaggcaataaagccttatttgacagtgtgctaggtacccacgatggcagcatgaagacaaaaacaggaggaatcaaagcaattgtactgtgcagataacatggttctttagggtcaaaggaaggctt

SEQ ID NO: 103823 - DNA, 277 bp, Homo sapiens
aaataagccaaacgccctccctcacatttgaaaactgacaattatttttatttgtgcaggcttaagatggaaataagaacttctaaaagaatttgaaaaataccctacttaccaaaaaagcttaaatcatttcctctgaaagtttccttccatctaaggtttgcttcggttccacagaccagcctcctcctgtcctcaatctgagggggaggaacgtgaccttcagtttccgctgatactgattttagggtcccacaagggtctctgtacttgccct

SEQ ID NO: 103824 - DNA, 534 bp, Homo sapiens
tgaggcagagtgtagatctgtcacccacgctggagtgcagtggtgcgatcttggctcactgcaacctccacctcccaggttgaagcgattctcctgcctcagcctcctgagtagctgagattacaggcacccaccaccacacccggctaatttttctatttttagtagtagagacagttttcaccgtgttgcgctgtctggtcttgaactcctgacctcatgatccaccctccttggcttcccgaagtgtttggattacaggtgtgacccactgttcaggtggggcattcaaaatgttaattcagcttgttgtggtttcttaaatttgagtgcacaactccgctaatatgcctgaaaaagatacaacaaaaattacccagataagagaagctgaggcaaaatggtgcagtgcataagaataggaaatgagagcggatggcaggtgtcctgggtgcagcctggagaagagactcctggatgattcccatgcacagccctgggggagaacagccttattgatgctgatcagcagag

SEQ ID NO: 103825 - DNA, 305 bp, Homo sapiens
tcgaagtgaatcaggtcaaagaaaaacctgaaataaggcccaaggaatactagtaaataattgatggcatctcagtttatctaagctgctgattatcactctgactgaattaaagaatgtagaaataatctggtttcagtaacatgaaaatacactcagtaaaagaaaccaaatgattaataggcctgtaatctcagcactttgggaggccgaggcaggaggactgcttgagcccaggaatttcagaccagcctgggcaacacagcaagaccctgtctctacaaaacgcaaaggaaaaaaaagga

SEQ ID NO: 103826 - DNA, 782 bp, Homo sapiens
gtattccagatcatttctctccattccaggaagtttgcatagctccctggacttctgctttgcactgccctgcaggagtgggtggggaaaggaagtggctttgaggcacacagaggggcttggtgaggccaccggaggaagcttctgccaccaatatgggacctgtgcccagcctaccagaagagagcatctgaaaacatgtatcgacatggtaacccctctgcttgaagcctcacatggctccctattgccttggtgctgaacaccctatggctgaccgtggcccagcctctgcaacagctctgcctcctctccagtggtgaagacccagcctgctgagactcctcctgcagttcctcaacatgcctgcatttctgctgcctcagggcctttgcgaaggttgttccttgtaactggaatgcccttccatcccttttttattcaaaaggctgcaattttaattgaagaaagttcccttccaaggttcatgagttgcctgacttgcccaccggtttcctgcaagatcccttggcctggcacttagtgctcaggaaatatttggtgatgggccaactgagtgagaaggtgggatctggtgggaaggaaagcggaaaggtagaaattctgctcacttcctcattcccacctcccaaggaacccctggtgtccctgtggaacccgctttgggaaccggtggttcaggtcagccttttcactttgtactcaaagccacatcgcattgaagccacaggtggggcaaggtcatgcatgacctgagtctc

SEQ ID NO: 103827 - DNA, 626 bp, Homo sapiens
aaggggttctgggtggcatccttggggtaccaaccctgcttccatcctgcgctctgaatttcctcacagcccttttctgtctctggtagaaggtgcagaaggtaggctttgccaccttccctgggcctggcaccaagctcgggggtcttgtacacactttcccttctctaactggggtgtgggcccatttcctagatgagcttgctgagaatcaggacagctggtatcagagccaggacttcccagtcttgcacaaacaacctgtgcatttttgagtccaccaaataaggcctcctgcctggtccggctcacccctgccagcccccagcaaatgcagcctggtgcgtccccacccctgccaagagcccaggagtgctctggcagagaagtgcagggatgaggaaggaggctgtgccctccaggggactcagctgcgttagaggaggtgctgctgcagtggcaggggtctccagacatcccacgcaggggtcctttcagatcaggcatctcttcaccagaccaccgtattcctttttcagccctcgtctcttgcacgtgggggtgcagtgtttggctctcacatccccacattccagctggtgggggtttgagctgggtgttccttc

SEQ ID NO: 103828 - DNA, 443 bp, Homo sapiens
  misc_feature (415)..(415): n is a, c, g, or t
  misc_feature (422)..(422): n is a, c, g, or t
atcacaaatgattaatgagctatcagtttatttttctgacagttgatatcaagctactcggtgtgtcatttccaaattttttatttcttttgaaaaccaggtttgtttgtttttttttttcctacttccaattttctttctcagtgattcttttgagattactggtaatggtactgcaactcagagggttgctttgacaggactagagacttcatcctggatttcactttcttcttagccatggatatgtcatcctttttaattttttgcctgttctctttgctaaagctaaaaataggattggactagacctgttttctctctcttacagcttaacttcacccagtgggcctattgcttcttgcctcttcagcctctcaacatcccacgagggatcagaaattcttcgaagtangtagtantaagccggccggtcttagaag

SEQ ID NO: 103829 - DNA, 580 bp, Homo sapiens
tggcaattagctgatccaagtgaaaaaggtagagaatgtgctctcaactggaaaatgccaattaaggaagcagctctgacttcccacccgccctggctaagctgggagcttatcttccccgagaagaatctgctgggataagggggcttgggaaacaccgagggcagggctgcctcctcacctcctcagcttcctctgagagcagattagccgtggccttgtgccagcagggcctgggtgccacaccgggtggcagcgggtggcagagccgggccccgctccggcactgggatttggggtggcgggacccagtggggcacccgcttgtgggcagcactgagggcggtgacgtaggcagcgggtgccggtgtctgcccctccatctggccgggctccccaccctgctcctgcagccctggacctcagggcccatttgcggtgcaaggcggctcttggtcggtctccactcctaaacatttatgcgttgaaaatgcccatttgtttgttttcttgtgttccatttatgtgttctgtatccttttttacttaatttaaataatttttaaatgtgaaatcgtta

SEQ ID NO: 103830 - DNA, 936 bp, Homo sapiens
tcacccttcgtggccatggaagcatcccaacaggtggagattaattccatcctgactgcccaaggaagatcaatagcaaacacagatcacccttcgtgactgcgaggcgactgtttatacatgaaagcatccatgatgaggttgtaaacagacttaaaaaggcctatgcacagatccgagttgggaacccatgggaccctaatgttctctatgggccactccacaccaagcaggcagtgagcatgtttcttggagcagtggaagaagcaaagaaagaaggtggcacagtggtctatgggggcaaggttatggatcgccctggaaattatgtagaaccgacaattgtgacaggtcttggccacgatgcgtccattgcacacacagagacttttgctccgattctctatgtctttaaattcaagaatgaagaagaggtctttgcatggaataatgaagtaaaacagggactttcaagtagcatctttaccaaagatctgggcagaatctttcgctggcttggacctaaaggatcagactgtggcattgtaaatgtcaacattccaacaagtggggctgagattggaggtgcctttggaggagaaaagcacactggtggtggcagggagtctggcagtgatgcctggaaacagtacatgagaaggtctacttgtactatcaactacagtaaagaccttcctctggcccaaggaatcaagtttcagtaaaggtgttttagatgaacatcccttaatttgaggtgttccagcagctgtttttggagaagacaaagaaaattaaagttttccctgaataaatgcattattatgactgtgacagtgactaatccccctatgaccccaaagccctgattaaatcaagagattccttttttaaaaatcaaaataaaattgttacaacatagccatagttactaaa

SEQ ID NO: 103831 - DNA, 869 bp, Homo sapiens
caaatctactggccccagagcgtttttccaccggaaacgcccaccctcctctgagggccccgggaaaatcaagttccgctcctaagggcggagaagaaataaatctcccaggggacgtgaatcttcaaggtctgaaaccaaggggccaaacttggtgacggcatccaccccttatcctcggcctgccctccgcgagctccccggccctcggccccggccccgtccacggccgcgacccccggccccgatgccactgccgaaacctccgcggaagccaccgcggttccccatcccagggccaccagggcccccgggcccccccgctgcaccggcgtcatccgccatttggtgcaagaatgaagaagaggtctttgcatggaataatgaagtaaaacagggactttcaagtagcatctttaccaaagatctgggcagaatctttcgctggcttggacctaaaggatcagactgtggcattgtaaatgtcaacattccaacaagtggggctgagattggaggtgcctttggaggagaaaagcacactggtggtggcagggagtctggcagtgatgcctggaaacagtacatgagaaggtctacttgtactatcaactacagtaaagaccttcctctggcccaaggaatcaagtttcagtaaaggtgttttagatgaacatcccttaatttgaggtgttccagcagctgtttttggagaagacaaagaaaattaaagttttccctgaataaatgcattattatgactgtgacagtgactaatccccctatgaccccaaagccctgattaaatcaagagattccttttttaaaaatcaaaataaaattgttacaacatagccatagttactaaa

SEQ ID NO: 103832 - DNA, 393 bp, Homo sapiens
  misc_feature (18)..(18): n is a, c, g, or t
  misc_feature (33)..(33): n is a, c, g, or t
cctattaaatttttcctnttgtcctttctcccnaaaaaacagtgcggaacacctcaaattaaggatgttcatctaaaacacctttactgaaacttgattccttgggccagaggaaggtctctacttgtactatcaactacagtaaagaccttcctctggcccaaggaatcaagtttcagtaaaggtgttttagatgaacatcccttaatttgaggtgttccagcagctgtttttggagaagacaaagaaaattaaagttttccctgaataaatgcattattatgactgtgacagtgactaatccccctatgaccccaaagccctgattaaatcaagagattccttttttaaaaatcaaaataaaattgttacaacatagccatagttactaaa

SEQ ID NO: 103833 - DNA, 617 bp, Homo sapiens
agtcaataaacctccaatttggggatatgtacatgtgcaagcaggatctggccatgcactgattgagcagtggaatcccgtaggcctggttggaatcatcacggcattcaatttccctgtggcagtgtatggttggaacaacgccatcgccatgatctgtggaaatgtctgcctctggaaaggagctccaaccacttccctcattagtgtggctgtcacaaagataatagccaaggttctggaggacaacaagctgcctggtgcaatttgttccttgacttgtggtggagcagatattggcacagcaatggccaaagatgaacgagtgaacctgctgtccttcactgggagcactcaggtgggaaaacaggtgggcctgatggtgcaggagaggtttggagcaatggaaatgagaagatactctgctgttgtcacatatgctcctgatatcacaaatgaataaaagttattcacatggaagctgattttaaagtgcacttaaggaaatcgatgatcaaaagatcagtaataaatgtatgtctaaggctgggcacagtggctcacgtctgtaatcctagcactttgggaggctgaggtgggtgaattgcctgagctca

SEQ ID NO: 103834 - DNA, 217 bp, Homo sapiens
gatctgctacattttaaaagtgggcatgaaaatcttctgttatgtatgtactgtcattaattctgttattttttcccactagtactatcaactacagtaaagaccttcctctggcccaaggaatcaagtttcagtaaaggtgttttagatgaacatcccttaatttgaggtgttccagcagctgtttttggaggtagcacctggggatcctgataga

SEQ ID NO: 103835 - DNA, 2369 bp, Homo sapiens
tatcattaattagaaaactttaatttgtaatctaccaaaacagtgaaaacaaccaacccttcccccgccccccaatacaaaccctccgttgcctactccagggacaagaggcgtcaccatcgctgaggagctggttaggaatgtcggctctccgaccctagcccagacttactgaatcagaatgtgcatttaccacgacgaccaggtcattacacgcattttacagtttcagaacccctgctatagcctactgtacttcagcgccaatattttgctgaaaagaattcccagctggaactgtggctcccggagtctttcaccagatggcagcagcccactcctccctgtagcactcccattgttccaggcaggattcagccgcaggctcctccggaagaccaggggcagacggggcggtggcggggtcgtgcccagtgggaggggtcgggtctgcccaatgggttctcccgggcggggggcggggctctatttcagcagctctcagggccttgggctcatcccgagtcccgggctcagtatgtggcgccttcctcgcgcgctgtgtgtgcacgctgcaaagaccagcaagctctctggaccttggagcaggcctgccgccttcatgtccactctcctcatcaatcagccccagtatgcgtggctgaaagagctggggctccgcgaggaaaacgagggcgtgtataatggaagctggggaggccggggagaggttattacgacctattgccctgctaacaacgagccaatagcaagagtccgacaggccagtgtggcagactatgaagaaactgtaaagaaagcaagagaagcatggaaaatctgggcagatattcctgctccaaaacgaggagaaatagtaagacagattggcgatgccttgcgggagaagatccaagtactaggaagcttggtgtctttggagatggggaaaatcttagtggaaggtgtgggtgaagttcaggagtatgtggatatctgtgactatgctgttggtttatcaaggatgattggaggacctatcttgccttctgaaagatctggccatgcactgattgagcagtggaatcccgtaggcctggttggaatcatcacggcattcaatttccctgtggcagtgtatggttggaacaacgccatcgccatgatctgtggaaatgtctgcctctggaaaggagctccaaccacttccctcattagtgtggctgtcacaaagataatagccaaggttctggaggacaacaagctgcctggtgcaatttgttccttgacttgtggtggagcagatattggcacagcaatggccaaagatgaacgagtgaacctgctgtccttcactgggagcactcaggtgggaaaacaggtgggcctgatggtgcaggagaggtttgggagaagtctgttggaacttggaggaaacaatgccattattgcctttgaagatgcagacctcagcttagttgttccatcagctctcttcgctgctgtgggaacagctggccagaggtgtaccactgcgaggcgactgtttatacatgaaagcatccatgatgaggttgtaaacagacttaaaaaggcctatgcacagatccgagttgggaacccatgggaccctaatgttctctatgggccactccacaccaagcaggcagtgagcatgtttcttggagcagtggaagaagcaaagaaagaaggtggcacagtggtctatgggggcaaggttatggatcgccctggaaattatgtagaaccgacaattgtgacaggtcttggccacgatgcgtccattgcacacacagagacttttgctccgattctctatgtctttaaattcaagaatgaagaagaggtctttgcatggaataatgaagtaaaacagggactttcaagtagcatctttaccaaagatctgggcagaatctttcgctggcttggacctaaaggatcagactgtggcattgtaaatgtcaacattccaacaagtggggctgagattggaggtgcctttggaggagaaaagcacactggtggtggcagggagtctggcagtgatgcctggaaacagtacatgagaaggtctacttgtactatcaactacagtaaagaccttcctctggcccaaggaatcaagtttcagtaaaggtgttttagatgaacatcccttaatttgaggtgttccagcagctgtttttggagaagacaaagaaaattaaagttttccctgaataaatgcattattatgactgtgacagtgactaatccccctatgaccccaaagccctgattaaatcaagagattccttttttaaaaatcaaaataaaattgttacaacatagccatagttactaaa

SEQ ID NO: 103836 - DNA, 1866 bp, Homo sapiens
gaaaaaaaaaaaaaaaaaaaaaaaaaaaaaaaaatatgtggcgccttcctcgcgcgctgtgtgtgcacgctgcaaagaccagcaagctctctggaccttggagcaggcctgccgccttcatgtccactctcctcatcaatcagccccagtatgcgtggctgaaagagctggggctccgcgaggaaaacgagggcgtgtataatggaagctggggaggccggggagaggttattacgacctattgccctgctaacaacgagccaatagcaagagtccgacaggccagtgtggcagactatgaagaaactgtaaagaaagcaagagaagcatggaaaatctgggcagatattcctgctccaaaacgaggagaaatagtaagacagattggcgatgccttgcgggagaagatccaagtactaggaagcttggtgtctttggagatggggaaaatcttagtggaaggtgtgggtgaagttcaggagtatgtggatatctgtgactatgctgttggtttatcaaggatgattggaggacctatcttgccttctgaaagatctggccatgcactgattgagcagtggaatcccgtaggcctggttggaatcatcacggcattcaatttccctgtggcagtgtatggttggaacaacgccatcgccatgatctgtggaaatgtctgcctctggaaaggagctccaaccacttccctcattagtgtggctgtcacaaagataatagccaaggttctggaggacaacaagctgcctggtgcaatttgttccttgacttgtggtggagcagatattggcacagcaatggccaaagatgaacgagtgaacctgctgtccttcactgggagcactcaggtgggaaaacaggtgggcctgatggtgcaggagaggtttgggagaagtctgttggaacttggaggaaacaatgccattattgcctttgaagatgcagacctcagcttagttgttccatcagctctcttcgctgctgtgggaacagctggccagaggtgtaccactgcgaggcgactgtttatacatgaaagcatccatgatgaggttgtaaacagacttaaaaaggcctatgcacagatccgagttgggaacccatgggaccctaatgttctctatgggccactccacaccaagcaggcagtgagcatgtttcttggagcagtggaagaagcaaagaaagaaggtggcacagtggtctatgggggcaaggttatggatcgccctggaaattatgtagaaccgacaattgtgacaggtcttggccacgatgcgtccattgcacacacagagacttttgctccgattctctatgtctttaaattcaagaatgaagaagaggtctttgcatggaataatgaagtaaaacagggactttcaagtagcatctttaccaaagatctgggcagaatctttcgctggcttggacctaaaggatcagactgtggcattgtaaatgtcaacattccaacaagtggggctgagattggaggtgcctttggaggagaaaagcacactggtggtggcagggagtctggcagtgatgcctggaaacagtacatgagaaggtctacttgtactatcaactacagtaaagaccttcctctggcccaaggaatcaagtttcagtaaaggtgttttagatgaacatcccttaatttgaggtgttccagcagctgtttttggagaagacaaagaaaattaaagttttccctgaataaatgcattattatgactgtgacagtgactaatccccctatgaccccaaagccctgattaaatcaagagattccttttttaaaaatcaaaataaaattgttacaacatagccatagttactaaa

SEQ ID NO: 103837 - DNA, 3891 bp, Homo sapiens
tatcattaattagaaaactttaatttgtaatctaccaaaacagtgaaaacaaccaacccttcccccgccccccaatacaaaccctccgttgcctactccagggacaagaggcgtcaccatcgctgaggagctggttaggaatgtcggctctccgaccctagcccagacttactgaatcagaatgtgcatttaccacgacgaccaggtcattacacgcattttacagtttcagaacccctgctatagcctactgtacttcagcgccaatattttgctgaaaagaattcccagctggaactgtggctcccggagtctttcaccagatggcagcagcccactcctccctgtagcactcccattgttccaggcaggattcagccgcaggctcctccggaagaccaggggcagacggggcggtggcggggtcgtgcccagtgggaggggtcgggtctgcccaatgggttctcccgggcggggggcggggctctatttcagcagctctcagggccttgggctcatcccgagtcccgggctcagtatgtggcgccttcctcgcgcgctgtgtgtgcacgctgcaaagaccagcaagctctctggaccttggagcaggcctgccgccttcatgtccactctcctcatcaatcagccccagtatgcgtggctgaaagagctggggctccgcgaggaaaacgagggcgtgtataatggaagctggggaggccggggagaggttattacgacctattgccctgctaacaacgagccaatagcaagagtccgacaggccagtgtggcagactatgaagaaactgtaaagaaagcaagagaagcatggaaaatctgggcagatattcctgctccaaaacgaggagaaatagtaagacagattggcgatgccttgcgggagaagatccaagtactaggaagcttggtgtctttggagatggggaaaatcttagtggaaggtgtgggtgaagttcaggagtatgtggatatctgtgactatgctgttggtttatcaaggatgattggaggacctatcttgccttctgaaagatctggccatgcactgattgagcagtggaatcccgtaggcctggttggaatcatcacggcattcaatttccctgtggcagtgtatggttggaacaacgccatcgccatgatctgtggaaatgtctgcctctggaaaggagctccaaccacttccctcattagtgtggctgtcacaaagataatagccaaggttctggaggacaacaagctgcctggtgcaatttgttccttgacttgtggtggagcagatattggcacagcaatggccaaagatgaacgagtgaacctgctgtccttcactgggagcactcaggtgggaaaacaggtgggcctgatggtgcaggagaggtttgggagaagtctgttggaacttggaggaaacaatgccattattgcctttgaagatgcagacctcagcttagttgttccatcagctctcttcgctgctgtgggaacagctggccagaggtgtaccactgcgaggcgactgtttatacatgaaagcatccatgatgaggttgtaaacagacttaaaaaggcctatgcacagatccgagttgggaacccatgggaccctaatgttctctatgggccactccacaccaagcaggcagtgagcatgtttcttggagcagtggaagaagcaaagaaagaaggtggcacagtggtctatgggggcaaggttatggatcgccctggaaattatgtagaaccgacaattgtgacaggtcttggccacgatgcgtccattgcacacacagagacttttgctccgattctctatgtctttaaattcaagaatgaagaagaggtctttgcatggaataatgaagtaaaacagggactttcaagtagcatctttaccaaagatctgggcagaatctttcgctggcttggacctaaaggatcagactgtggcattgtaaatgtcaacattccaacaagtggggctgagattggaggtgcctttggaggagaaaagcacactggtggtggcagggagtctggcagtgatgcctggaaacagtacatgagaaggtctacttgtactatcaactacagtaaagaccttcctctggcccaaggaatcaagtttcagtaaaggtgttttagatgaacatcccttaatttgaggtgttccagcagctgtttttggagaagacaaagaaaattaaagttttccctgaataaatgcattattatgactgtgacagtgactaatccccctatgaccccaaagccctgattaaatcaagagattccttttttaaaaatcaaaataaaattgttacaacatagccatagttactaaaagatgagttaggtggatttttattatgtcaactagttgtacatggctttttaaaagttaatgattattttgtaattagaaaaaaatagtacgtaccagggtaggaatttgggaaaatacagaaccgaggagaaaacagaagtctttgcagtagatacagggtgtctcctgaccaagtgaaggattcaggggcggggggtgaatattgcttgacattacccacctatggcatgtgttggatgtcgtgtgattgaaagggggatgcattcccctgtatgcttggaccacagttcagtattcatgtggaataacttgcagtgcttaaaatgacaacaggcattcatcacagttatggctcttgcttatgaaggctgtgtcaacttggaagagatttctggggtagacagattttgttcctgtgctggagtctgccacctgctggaggactctgaggccaaaattgcctgtgcagagttgtatagaaaatgcgtctggaggctgggcaaggtggcttatgcctataatcccagcactttgagaggccgaggcgggtggatcagtagaggctaggagtttgagaccagcctggccgatatcgtgaaaccccatctttaccaaaaaatacaaaaattagcccagtgtggtggcaggcacctgtaatcccagctattagggaggctgaggcaggagaattgtgtgaacccaggaggcagaggttgcagtgagcctagattgtgccactgcctgggcaacagtgagatcctgtctacaaaaaaaaaaaaaaaaaaaagtgcatctggatttttttatacaaccttagaccaccttctttagctttaggcgtctgcggttgcccttggatctgttctcaatcctcagtgtgtgtggcagcatgtggtcatagagagctgggcaaagttcactttctctttgctgacagtctcaccttttctcactgggaagctgcacaggagcctttgggctggttcagcccagaggcccctgttctcctgccttcctggcattctctgctccccttctgcatggcacccctctactcctgccaggttagaatggagcagaggcctttgaacaagatgacatttgtagacaacctgatccatcaggatgtggagagatctggacaaatggcaaataatttggggttgaattatggcccagagaagtaagcaaatgaaaaactaaacaattataaatgtatctgggaagcaaaggtattcataatatgtcccatggccagctgcgagcagtatttaactagacatgctgttgtcaatattgaacatgaatcaagccaaatactgatatagctattgagagaaggttggcaggaagaaatcatgggtgagggtatgtgggagtgataatcttagctatagattttaggtaaaactgattctgaaagctttctttgaaacaaatttataatttttcttctacatgtttctagcacaaggactcaatttttttggttataatgttcattaaaacatatgccttca

SEQ ID NO: 103838 - DNA, 4545 bp, Homo sapiens
tatcattaattagaaaactttaatttgtaatctaccaaaacagtgaaaacaaccaacccttcccccgccccccaatacaaaccctccgttgcctactccagggacaagaggcgtcaccatcgctgaggagctggttaggaatgtcggctctccgaccctagcccagacttactgaatcagaatgtgcatttaccacgacgaccaggtcattacacgcattttacagtttcagaacccctgctatagcctactgtacttcagcgccaatattttgctgaaaagaattcccagctggaactgtggctcccggagtctttcaccagatggcagcagcccactcctccctgtagcactcccattgttccaggcaggattcagccgcaggctcctccggaagaccaggggcagacggggcggtggcggggtcgtgcccagtgggaggggtcgggtctgcccaatgggttctcccgggcggggggcggggctctatttcagcagctctcagggccttgggctcatcccgagtcccgggctcagtatgtggcgccttcctcgcgcgctgtgtgtgcacgctgcaaagaccagcaagctctctggaccttggagcaggcctgccgccttcatgtccactctcctcatcaatcagccccagtatgcgtggctgaaagagctggggctccgcgaggaaaacgagggcgtgtataatggaagctggggaggccggggagaggttattacgacctattgccctgctaacaacgagccaatagcaagagtccgacaggccagtgtggcagactatgaagaaactgtaaagaaagcaagagaagcatggaaaatctgggcagatattcctgctccaaaacgaggagaaatagtaagacagattggcgatgccttgcgggagaagatccaagtactaggaagcttggtgtctttggagatggggaaaatcttagtggaaggtgtgggtgaagttcaggagtatgtggatatctgtgactatgctgttggtttatcaaggatgattggaggacctatcttgccttctgaaagatctggccatgcactgattgagcagtggaatcccgtaggcctggttggaatcatcacggcattcaatttccctgtggcagtgtatggttggaacaacgccatcgccatgatctgtggaaatgtctgcctctggaaaggagctccaaccacttccctcattagtgtggctgtcacaaagataatagccaaggttctggaggacaacaagctgcctggtgcaatttgttccttgacttgtggtggagcagatattggcacagcaatggccaaagatgaacgagtgaacctgctgtccttcactgggagcactcaggtgggaaaacaggtgggcctgatggtgcaggagaggtttgggagaagtctgttggaacttggaggaaacaatgccattattgcctttgaagatgcagacctcagcttagttgttccatcagctctcttcgctgctgtgggaacagctggccagaggtgtaccactgcgaggcgactgtttatacatgaaagcatccatgatgaggttgtaaacagacttaaaaaggcctatgcacagatccgagttgggaacccatgggaccctaatgttctctatgggccactccacaccaagcaggcagtgagcatgtttcttggagcagtggaagaagcaaagaaagaaggtggcacagtggtctatgggggcaaggttatggatcgccctggaaattatgtagaaccgacaattgtgacaggtcttggccacgatgcgtccattgcacacacagagacttttgctccgattctctatgtctttaaattcaagaatgaagaagaggtctttgcatggaataatgaagtaaaacagggactttcaagtagcatctttaccaaagatctgggcagaatctttcgctggcttggacctaaaggatcagactgtggcattgtaaatgtcaacattccaacaagtggggctgagattggaggtgcctttggaggagaaaagcacactggtggtggcagggagtctggcagtgatgcctggaaacagtacatgagaaggtctacttgtactatcaactacagtaaagaccttcctctggcccaaggaatcaagtttcagtaaaggtgttttagatgaacatcccttaatttgaggtgttccagcagctgtttttggagaagacaaagaaaattaaagttttccctgaataaatgcattattatgactgtgacagtgactaatccccctatgaccccaaagccctgattaaatcaagagattccttttttaaaaatcaaaataaaattgttacaacatagccatagttactaaaagatgagttaggtggatttttattatgtcaactagttgtacatggctttttaaaagttaatgattattttgtaattagaaaaaaatagtacgtaccagggtaggaatttgggaaaatacagaaccgaggagaaaacagaagtctttgcagtagatacagggtgtctcctgaccaagtgaaggattcaggggcggggggtgaatattgcttgacattacccacctatggcatgtgttggatgtcgtgtgattgaaagggggatgcattcccctgtatgcttggaccacagttcagtattcatgtggaataacttgcagtgcttaaaatgacaacaggcattcatcacagttatggctcttgcttatgaaggctgtgtcaacttggaagagatttctggggtagacagattttgttcctgtgctggagtctgccacctgctggaggactctgaggccaaaattgcctgtgcagagttgtatagaaaatgcgtctggaggctgggcaaggtggcttatgcctataatcccagcactttgagaggccgaggcgggtggatcagtagaggctaggagtttgagaccagcctggccgatatcgtgaaaccccatctttaccaaaaaatacaaaaattagcccagtgtggtggcaggcacctgtaatcccagctattagggaggctgaggcaggagaattgtgtgaacccaggaggcagaggttgcagtgagcctagattgtgccactgcctgggcaacagtgagatcctgtctacaaaaaaaaaaaaaaaaaaaagtgcatctggatttttttatacaaccttagaccaccttctttagctttaggcgtctgcggttgcccttggatctgttctcaatcctcagtgtgtgtggcagcatgtggtcatagagagctgggcaaagttcactttctctttgctgacagtctcaccttttctcactgggaagctgcacaggagcctttgggctggttcagcccagaggcccctgttctcctgccttcctggcattctctgctccccttctgcatggcacccctctactcctgccaggttagaatggagcagaggcctttgaacaagatgacatttgtagacaacctgatccatcaggatgtggagagatctggacaaatggcaaataatttggggttgaattatggcccagagaagtaagcaaatgaaaaactaaacaattataaatgtatctgggaagcaaaggtattcataatatgtcccatggccagctgcgagcagtatttaactagacatgctgttgtcaatattgaacatgaatcaagccaaatactgatatagctattgagagaaggttggcaggaagaaatcatgggtgagggtatgtgggagtgataatcttagctatagattttaggtaaaactgattctgaaagctttctttgaaacaaatttataatttttcttctacatgtttctagcacaaggactcaatttttttggttataatgttcattaaaacatatgccttcaatttgttcctcttatttcttttttgctgatttagcagatataaatcacttgttagtatttttaactatccaagttaaaatgtacatttgtaagtgttattactggtcttatatttgaaggtgcaaggggtcttgtgctgctcattactggttatcttgagcatttcataactgctgcctcctcctaaatcctgtgttccaaccgctactgctggcaatgcccagcctccattgtggatgcggggaattgtgttcagcatgcttgcttctgccacggcactaaagcctaacttgcttaggatcttgctgtacttggagagagcatccattcgctgagcctagcagccaggctcttgtgactccctgggaagtgggtgaagacctggctcctggctgcagcagtgaggaggcaggccctccaggtgaagacttctcacaatggagggaaggcagttttctcaaaggaaattgagtgctattatgtactctgcttcctactttctctttcagggtgggaatctgttaagcctcctctctctcttgctctgcaaccacagaacacttctttttttttggtgtctcagttttgcccacactgcgagtgcagtgctagattgtgccactgcctgggcaacagtgagatcctgtctacaaa

SEQ ID NO: 103839 - DNA, 4098 bp, Homo sapiens
tatcattaattagaaaactttaatttgtaatctaccaaaacagtgaaaacaaccaacccttcccccgccccccaatacaaaccctccgttgcctactccagggacaagaggcgtcaccatcgctgaggagctggttaggaatgtcggctctccgaccctagcccagacttactgaatcagaatgtgcatttaccacgacgaccaggtcattacacgcattttacagtttcagaacccctgctatagcctactgtacttcagcgccaatattttgctgaaaagaattcccagctggaactgtggctcccggagtctttcaccagatggcagcagcccactcctccctgtagcactcccattgttccaggcaggattcagccgcaggctcctccggaagaccaggggcagacggggcggtggcggggtcgtgcccagtgggaggggtcgggtctgcccaatgggttctcccgggcggggggcggggctctatttcagcagctctcagggccttgggctcatcccgagtcccgggctcagtatgtggcgccttcctcgcgcgctgtgtgtgcacgctgcaaagaccagcaagctctctggaccttggagcaggcctgccgccttcatgtccactctcctcatcaatcagccccagtatgcgtggctgaaagagctggggctccgcgaggaaaacgagggcgtgtataatggaagctggggaggccggggagaggttattacgacctattgccctgctaacaacgagccaatagcaagagtccgacaggccagtgtggcagactatgaagaaactgtaaagaaagcaagagaagcatggaaaatctgggcagatattcctgctccaaaacgaggagaaatagtaagacagattggcgatgccttgcgggagaagatccaagtactaggaagcttggtgtctttggagatggggaaaatcttagtggaaggtgtgggtgaagttcaggagtatgtggatatctgtgactatgctgttggtttatcaaggatgattggaggacctatcttgccttctgaaagatctggccatgcactgattgagcagtggaatcccgtaggcctggttggaatcatcacggcattcaatttccctgtggcagtgtatggttggaacaacgccatcgccatgatctgtggaaatgtctgcctctggaaaggagctccaaccacttccctcattagtgtggctgtcacaaagataatagccaaggttctggaggacaacaagctgcctggtgcaatttgttccttgacttgtggtggagcagatattggcacagcaatggccaaagatgaacgagtgaacctgctgtccttcactgggagcactcaggtgggaaaacaggtgggcctgatggtgcaggagaggtttgggagaagtctgttggaacttggaggaaacaatgccattattgcctttgaagatgcagacctcagcttagttgttccatcagctctcttcgctgctgtgggaacagctggccagaggtgtaccactgcgaggcgactgtttatacatgaaagcatccatgatgaggttgtaaacagacttaaaaaggcctatgcacagatccgagttgggaacccatgggaccctaatgttctctatgggccactccacaccaagcaggcagtgagcatgtttcttggagcagtggaagaagcaaagaaagaaggtggcacagtggtctatgggggcaaggttatggatcgccctggaaattatgtagaaccgacaattgtgacaggtcttggccacgatgcgtccattgcacacacagagacttttgctccgattctctatgtctttaaattcaagaatgaagaagaggtctttgcatggaataatgaagtaaaacagggactttcaagtagcatctttaccaaagatctgggcagaatctttcgctggcttggacctaaaggatcagactgtggcattgtaaatgtcaacattccaacaagtggggctgagattggaggtgcctttggaggagaaaagcacactggtggtggcagggagtctggcagtgatgcctggaaacagtacatgagaaggtctacttgtactatcaactacagtaaagaccttcctctggcccaaggaatcaagtttcagtaaaggtgttttagatgaacatcccttaatttgaggtgttccagcagctgtttttggagaagacaaagaaaattaaagttttccctgaataaatgcattattatgactgtgacagtgactaatccccctatgaccccaaagccctgattaaatcaagagattccttttttaaaaatcaaaataaaattgttacaacatagccatagttactaaaagatgagttaggtggatttttattatgtcaactagttgtacatggctttttaaaagttaatgattattttgtaattagaaaaaaatagtacgtaccagggtaggaatttgggaaaatacagaaccgaggagaaaacagaagtctttgcagtagatacagggtgtctcctgaccaagtgaaggattcaggggcggggggtgaatattgcttgacattacccacctatggcatgtgttggatgtcgtgtgattgaaagggggatgcattcccctgtatgcttggaccacagttcagtattcatgtggaataacttgcagtgcttaaaatgacaacaggcattcatcacagttatggctcttgcttatgaaggctgtgtcaacttggaagagatttctggggtagacagattttgttcctgtgctggagtctgccacctgctggaggactctgaggccaaaattgcctgtgcagagttgtatagaaaatgcgtctggaggctgggcaaggtggcttatgcctataatcccagcactttgagaggccgaggcgggtggatcagtagaggctaggagtttgagaccagcctggccgatatcgtgaaaccccatctttaccaaaaaatacaaaaattagcccagtgtggtggcaggcacctgtaatcccagctattagggaggctgaggcaggagaattgtgtgaacccaggaggcagaggttgcagtgagcctagattgtgccactgcctgggcaacagtgagatcctgtctacaaaaaaaaaaaaaaaaaaaagtgcatctggatttttttatacaaccttagaccaccttctttagctttaggcgtctgcggttgcccttggatctgttctcaatcctcagtgtgtgtggcagcatgtggtcatagagagctgggcaaagttcactttctctttgctgacagtctcaccttttctcactgggaagctgcacaggagcctttgggctggttcagcccagaggcccctgttctcctgccttcctggcattctctgctccccttctgcatggcacccctctactcctgccaggttagaatggagcagaggcctttgaacaagatgacatttgtagacaacctgatccatcaggatgtggagagatctggacaaatggcaaataatttggggttgaattatggcccagagaagtaagcaaatgaaaaactaaacaattataaatgtatctgggaagcaaaggtattcataatatgtcccatggccagctgcgagcagtatttaactagacatgctgttgtcaatattgaacatgaatcaagccaaatactgatatagctattgagagaaggttggcaggaagaaatcatgggtgagggtatgtgggagtgataatcttagctatagattttaggtaaaactgattctgaaagctttctttgaaacaaatttataatttttcttctacatgtttctagcacaaggactcaatttttttggttataatgttcattaaaacatatgccttcaatttgttcctcttatttcttttttgctgatttagcagatataaatcacttgttagtatttttaactatccaagttaaaatgtacatttgtaagtgttattactggtcttatatttgaaggtgcaaggggtcttgtgctgctcattactggttatcttgagcctagattgtgccactgcctgggcaacagtgagatcctgtctacaaa

SEQ ID NO: 103840 - DNA, 2283 bp, Homo sapiens
tatcattaattagaaaactttaatttgtaatctaccaaaacagtgaaaacaaccaacccttcccccgccccccaatacaaaccctccgttgcctactccagggacaagaggcgtcaccatcgctgaggagctggttaggaatgtcggctctccgaccctagcccagacttactgaatcagaatgtgcatttaccacgacgaccaggtcattacacgcattttacagtttcagaacccctgctatagcctactgtacttcagcgccaatattttgctgaaaagaattcccagctggaactgtggctcccggagtctttcaccagatggcagcagcccactcctccctgtagcactcccattgttccaggcaggattcagccgcaggctcctccggaagaccaggggcagacggggcggtggcggggtcgtgcccagtgggaggggtcgggtctgcccaatgggttctcccgggcggggggcggggctctatttcagcagctctcagggccttgggctcatcccgagtcccgggctcagtatgtggcgccttcctcgcgcgctgtgtgtgcacgctgcaaagaccagcaagctctctggaccttggagcaggcctgccgccttcatgtccactctcctcatcaatcagccccagtatgcgtggctgaaagagctggggctccgcgaggaaaacgagggcgtgtataatggaagctggggaggccggggagaggttattacgacctattgccctgctaacaacgagccaatagcaagagtccgacaggccagtgtggcagactatgaagaaactgtaaagaaagcaagagaagcatggaaaatctgggcagatattcctgctccaaaacgaggagaaatagtaagacagattggcgatgccttgcgggagaagatccaagtactaggaagcttggtgtctttggagatggggaaaatcttagtggaaggtgtgggtgaagttcaggagtatgtggatatctgtgactatgctgttggtttatcaaggatgattggaggacctatcttgccttctgaaagatctggccatgcactgattgagcagtggaatcccgtaggcctggttggaatcatcacggcattcaatttccctgtggcagtgtatggttggaacaacgccatcgccatgatctgtggaaatgtctgcctctggaaaggagctccaaccacttccctcattagtgtggctgtcacaaagataatagccaaggttctggaggacaacaagctgcctggtgcaatttgttccttgacttgtggtggagcagatattggcacagcaatggccaaagatgaacgagtgaacctgctgtccttcactgggagcactcaggtgggaaaacaggtgggcctgatggtgcaggagaggtttgggagaagtctgttggaacttggaggaaacaatgccattattgcctttgaagatgcagacctcagcttagttgttccatcagctctcttcgctgctgtgggaacagctggccagaggtgtaccactgcgaggcgactgtttatacatgaaagcatccatgatgaggttgtaaacagacttaaaaaggcctatgcacagatccgagttgggaacccatgggaccctaatgttctctatgggccactccacaccaagcaggcagtgagcatgtttcttggagcagtggaagaagcaaagaaagaaggtggcacagtggtctatgggggcaaggttatggatcgccctggaaattatgtagaaccgacaattgtgacaggtcttggccacgatgcgtccattgcacacacagagacttttgctccgattctctatgtctttaaattcaagaatgaagaagaggtctttgcatggaataatgaagtaaaacagggactttcaagtagcatctttaccaaagatctgggcagaatctttcgctggcttggacctaaaggatcagactgtggcattgtaaatgtcaacattccaacaagtggggctgagattggaggtgcctttggaggagaaaagcacactggtggtggcagggagtctggcagtgatgcctggaaacagtacatgagaaggtctacttgtactatcaactacagtaaagaccttcctctggcccaaggaatcaagtttcagtaaaggtgttttagatgaacatcccttaatttgaggtgttccagcagctgtttttggagaagacaaagaaaattaaagttttccctgaataaatgcattattatgactgtgacagtgactaatccccc

SEQ ID NO: 103841 - DNA, 3838 bp, Homo sapiens
tatcattaattagaaaactttaatttgtaatctaccaaaacagtgaaaacaaccaacccttcccccgccccccaatacaaaccctccgttgcctactccagggacaagaggcgtcaccatcgctgaggagctggttaggaatgtcggctctccgaccctagcccagacttactgaatcagaatgtgcatttaccacgacgaccaggtcattacacgcattttacagtttcagaacccctgctatagcctactgtacttcagcgccaatattttgctgaaaagaattcccagctggaactgtggctcccggagtctttcaccagatggcagcagcccactcctccctgtagcactcccattgttccaggcaggattcagccgcaggctcctccggaagaccaggggcagacggggcggtggcggggtcgtgcccagtgggaggggtcgggtctgcccaatgggttctcccgggcggggggcggggctctatttcagcagctctcagggccttgggctcatcccgagtcccgggctcagtatgtggcgccttcctcgcgcgctgtgtgtgcacgctgcaaagaccagcaagctctctggaccttggagcaggcctgccgccttcatgtccactctcctcatcaatcagccccagtatgcgtggctgaaagagctggggctccgcgaggaaaacgagggcgtgtataatggaagctggggaggccggggagaggttattacgacctattgccctgctaacaacgagccaatagcaagagtccgacaggccagtgtggcagactatgaagaaactgtaaagaaagcaagagaagcatggaaaatctgggcagatattcctgctccaaaacgaggagaaatagtaagacagattggcgatgccttgcgggagaagatccaagtactaggaagcttggtgtctttggagatggggaaaatcttagtggaaggtgtgggtgaagttcaggagtatgtggatatctgtgactatgctgttggtttatcaaggatgattggaggacctatcttgccttctgaaagatctggccatgcactgattgagcagtggaatcccgtaggcctggttggaatcatcacggcattcaatttccctgtggcagtgtatggttggaacaacgccatcgccatgatctgtggaaatgtctgcctctggaaaggagctccaaccacttccctcattagtgtggctgtcacaaagataatagccaaggttctggaggacaacaagctgcctggtgcaatttgttccttgacttgtggtggagcagatattggcacagcaatggccaaagatgaacgagtgaacctgctgtccttcactgggagcactcaggtgggaaaacaggtgggcctgatggtgcaggagaggtttgggagaagtctgttggaacttggaggaaacaatgccattattgcctttgaagatgcagacctcagcttagttgttccatcagctctcttcgctgctgtgggaacagctggccagaggtgtaccactgcgaggcgactgtttatacatgaaagcatccatgatgaggttgtaaacagacttaaaaaggcctatgcacagatccgagttgggaacccatgggaccctaatgttctctatgggccactccacaccaagcaggcagtgagcatgtttcttggagcagtggaagaagcaaagaaagaaggtggcacagtggtctatgggggcaaggttatggatcgccctggaaattatgtagaaccgacaattgtgacaggtcttggccacgatgcgtccattgcacacacagagacttttgctccgattctctatgtctttaaattcaagaatgaagaagaggtctttgcatggaataatgaagtaaaacagggactttcaagtagcatctttaccaaagatctgggcagaatctttcgctggcttggacctaaaggatcagactgtggcattgtaaatgtcaacattccaacaagtggggctgagattggaggtgcctttggaggacgtagagaaggtctattttactatcaactacagtaaagaccttcctctggcccaaggaatcaagtttcagtaaaggtgttttagatgaacatcccttaatttgaggtgttccagcagctgtttttggagaagacaaagaaaattaaagttttccctgaataaatgcattattatgactgtgacagtgactaatccccctatgaccccaaagccctgattaaatcaagagattccttttttaaaaatcaaaataaaattgttacaacatagccatagttactaaaagatgagttaggtggatttttattatgtcaactagttgtacatggctttttaaaagttaatgattattttgtaattagaaaaaaatagtacgtaccagggtaggaatttgggaaaatacagaaccgaggagaaaacagaagtctttgcagtagatacagggtgtctcctgaccaagtgaaggattcaggggcggggggtgaatattgcttgacattacccacctatggcatgtgttggatgtcgtgtgattgaaagggggatgcattcccctgtatgcttggaccacagttcagtattcatgtggaataacttgcagtgcttaaaatgacaacaggcattcatcacagttatggctcttgcttatgaaggctgtgtcaacttggaagagatttctggggtagacagattttgttcctgtgctggagtctgccacctgctggaggactctgaggccaaaattgcctgtgcagagttgtatagaaaatgcgtctggaggctgggcaaggtggcttatgcctataatcccagcactttgagaggccgaggcgggtggatcagtagaggctaggagtttgagaccagcctggccgatatcgtgaaaccccatctttaccaaaaaatacaaaaattagcccagtgtggtggcaggcacctgtaatcccagctattagggaggctgaggcaggagaattgtgtgaacccaggaggcagaggttgcagtgagcctagattgtgccactgcctgggcaacagtgagatcctgtctacaaaaaaaaaaaaaaaaaaaagtgcatctggatttttttatacaaccttagaccaccttctttagctttaggcgtctgcggttgcccttggatctgttctcaatcctcagtgtgtgtggcagcatgtggtcatagagagctgggcaaagttcactttctctttgctgacagtctcaccttttctcactgggaagctgcacaggagcctttgggctggttcagcccagaggcccctgttctcctgccttcctggcattctctgctccccttctgcatggcacccctctactcctgccaggttagaatggagcagaggcctttgaacaagatgacatttgtagacaacctgatccatcaggatgtggagagatctggacaaatggcaaataatttggggttgaattatggcccagagaagtaagcaaatgaaaaactaaacaattataaatgtatctgggaagcaaaggtattcataatatgtcccatggccagctgcgagcagtatttaactagacatgctgttgtcaatattgaacatgaatcaagccaaatactgatatagctattgagagaaggttggcaggaagaaatcatgggtgagggtatgtgggagtgataatcttagctatagattttaggtaaaactgattctgaaagctttctttgaaacaaatttataatttttcttctacatgtttctagcacaaggactcaatttttttggttataatgttcattaaaacatatgccttca

SEQ ID NO: 103842 - DNA, 2422 bp, Homo sapiens
tatcattaattagaaaactttaatttgtaatctaccaaaacagtgaaaacaaccaacccttcccccgccccccaatacaaaccctccgttgcctactccagggacaagaggcgtcaccatcgctgaggagctggttaggaatgtcggctctccgaccctagcccagacttactgaatcagaatgtgcatttaccacgacgaccaggtcattacacgcattttacagtttcagaacccctgctatagcctactgtacttcagcgccaatattttgctgaaaagaattcccagctggaactgtggctcccggagtctttcaccagatggcagcagcccactcctccctgtagcactcccattgttccaggcaggattcagccgcaggctcctccggaagaccaggggcagacggggcggtggcggggtcgtgcccagtgggaggggtcgggtctgcccaatgggttctcccgggcggggggcggggctctatttcagcagctctcagggccttgggctcatcccgagtcccgggctcagtatgtggcgccttcctcgcgcgctgtgtgtgcacgctgcaaagaccagcaagctctctggaccttggagcaggcctgccgccttcatgtccactctcctcatcaatcagccccagtatgcgtggctgaaagagctggggctccgcgaggaaaacgagggcgtgtataatggaagctggggaggccggggagaggttattacgacctattgccctgctaacaacgagccaatagcaagagtccgacaggccagtgtggcagactatgaagaaactgtaaagaaagcaagagaagcatggaaaatctgggcagatattcctgctccaaaacgaggagaaatagtaagacagattggcgatgccttgcgggagaagatccaagtactaggaagcttggtgtctttggagatggggaaaatcttagtggaaggtgtgggtgaagttcaggagtatgtggatatctgtgactatgctgttggtttatcaaggatgattggaggacctatcttgccttctgaaagatctggccatgcactgattgagcagtggaatcccgtaggcctggttggaatcatcacggcattcaatttccctgtggcagtgtatggttggaacaacgccatcgccatgatctgtggaaatgtctgcctctggaaaggagctccaaccacttccctcattagtgtggctgtcacaaagataatagccaaggttctggaggacaacaagctgcctggtgcaatttgttccttgacttgtggtggagcagatattggcacagcaatggccaaagatgaacgagtgaacctgctgtccttcactgggagcactcaggtgggaaaacaggtgggcctgatggtgcaggagaggtttgggagaagtctgttggaacttggaggaaacaatgccattattgcctttgaagatgcagacctcagcttagttgttccatcagctctcttcgctgctgtgggaacagctggccagaggtgtaccactgcgaggcgactgtttatacatgaaagcatccatgatgaggttgtaaacagacttaaaaaggcctatgcacagatccgagttgggaacccatgggaccctaatgttctctatgggccactccacaccaagcaggcagtgagcatgtttcttggagcagtggaagaagcaaagaaagaaggtggcacagtggtctatgggggcaaggttatggatcgccctggaaattatgtagaaccgacaattgtgacaggtcttggccacgatgcgtccattgcacacacagagacttttgctccgattctctatgtctttaaattcaagaatgaagaagaggtctttgcatggaataatgaagtaaaacagggactttcaagtagcatctttaccaaagatctgggcagaatctttcgctggcttggacctaaaggatcagactgtggcattgtaaatgtcaacattccaacaagtggggctgagattggaggtgcctttggaggagaaaagcacactggtggtggcagggagtctggcagtgatgcctggaaacagtacatgagaaggtctacttgtactatcaactacagtaaagaccttcctctggcccaaggaatcaagtttcagtaaaggtgttttagatgaacatcccttaatttgaggtgttccagcagctgtttttggagaagacaaagaaaattaaagttttccctgaataaatgcattattatgactgtgacagtgactaatccccctatgaccccaaagccctgattaaatcaagagattccttttttaaaaatcaaaataaaattgttacaacatagccatagttactaaataaaaaataaaataaaactgaggggggggccggtactcaatttgcctatagtg

SEQ ID NO: 103843 - DNA, 2413 bp, Homo sapiens
tatcattaattagaaaactttaatttgtaatctaccaaaacagtgaaaacaaccaacccttcccccgccccccaatacaaaccctccgttgcctactccagggacaagaggcgtcaccatcgctgaggagctggttaggaatgtcggctctccgaccctagcccagacttactgaatcagaatgtgcatttaccacgacgaccaggtcattacacgcattttacagtttcagaacccctgctatagcctactgtacttcagcgccaatattttgctgaaaagaattcccagctggaactgtggctcccggagtctttcaccagatggcagcagcccactcctccctgtagcactcccattgttccaggcaggattcagccgcaggctcctccggaagaccaggggcagacggggcggtggcggggtcgtgcccagtgggaggggtcgggtctgcccaatgggttctcccgggcggggggcggggctctatttcagcagctctcagggccttgggctcatcccgagtcccgggctcagtatgtggcgccttcctcgcgcgctgtgtgtgcacgctgcaaagaccagcaagctctctggaccttggagcaggcctgccgccttcatgtccactctcctcatcaatcagccccagtatgcgtggctgaaagagctggggctccgcgaggaaaacgagggcgtgtataatggaagctggggaggccggggagaggttattacgacctattgccctgctaacaacgagccaatagcaagagtccgacaggccagtgtggcagactatgaagaaactgtaaagaaagcaagagaagcatggaaaatctgggcagatattcctgctccaaaacgaggagaaatagtaagacagattggcgatgccttgcgggagaagatccaagtactaggaagcttggtgtctttggagatggggaaaatcttagtggaaggtgtgggtgaagttcaggagtatgtggatatctgtgactatgctgttggtttatcaaggatgattggaggacctatcttgccttctgaaagatctggccatgcactgattgagcagtggaatcccgtaggcctggttggaatcatcacggcattcaatttccctgtggcagtgtatggttggaacaacgccatcgccatgatctgtggaaatgtctgcctctggaaaggagctccaaccacttccctcattagtgtggctgtcacaaagataatagccaaggttctggaggacaacaagctgcctggtgcaatttgttccttgacttgtggtggagcagatattggcacagcaatggccaaagatgaacgagtgaacctgctgtccttcactgggagcactcaggtgggaaaacaggtgggcctgatggtgcaggagaggtttggatatacatgcacagaggaaagattggaagacactatcaaaattggagaagtctgttggaacttggaggaaacaatgccattattgcctttgaagatgcagacctcagcttagttgttccatcagctctcttcgctgctgtgggaacagctggccagaggtgtaccactgcgaggcgactgtttatacatgaaagcatccatgatgaggttgtaaacagacttaaaaaggcctatgcacagatccgagttgggaacccatgggaccctaatgttctctatgggccactccacaccaagcaggcagtgagcatgtttcttggagcagtggaagaagcaaagaaagaaggtggcacagtggtctatgggggcaaggttatggatcgccctggaaattatgtagaaccgacaattgtgacaggtcttggccacgatgcgtccattgcacacacagagacttttgctccgattctctatgtctttaaattcaagaatgaagaagaggtctttgcatggaataatgaagtaaaacagggactttcaagtagcatctttaccaaagatctgggcagaatctttcgctggcttggacctaaaggatcagactgtggcattgtaaatgtcaacattccaacaagtggggctgagattggaggtgcctttggaggagaaaagcacactggtggtggcagggagtctggcagtgatgcctggaaacagtacatgagaaggtctacttgtactatcaactacagtaaagaccttcctctggcccaaggaatcaagtttcagtaaaggtgttttagatgaacatcccttaatttgaggtgttccagcagctgtttttggagaagacaaagaaaattaaagttttccctgaataaatgcattattatgactgtgacagtgactaatccccctatgaccccaaagccctgattaaatcaagagattccttttttaaaaatcaaaataaaattgttacaacatagccatagttactaaa

SEQ ID NO: 103844 - DNA, 2313 bp, Homo sapiens
tatcattaattagaaaactttaatttgtaatctaccaaaacagtgaaaacaaccaacccttcccccgccccccaatacaaaccctccgttgcctactccagggacaagaggcgtcaccatcgctgaggagctggttaggaatgtcggctctccgaccctagcccagacttactgaatcagaatgtgcatttaccacgacgaccaggtcattacacgcattttacagtttcagaacccctgctatagcctactgtacttcagcgccaatattttgctgaaaagaattcccagctggaactgtggctcccggagtctttcaccagatggcagcagcccactcctccctgtagcactcccattgttccaggcaggattcagccgcaggctcctccggaagaccaggggcagacggggcggtggcggggtcgtgcccagtgggaggggtcgggtctgcccaatgggttctcccgggcggggggcggggctctatttcagcagctctcagggccttgggctcatcccgagtcccgggctcagtatgtggcgccttcctcgcgcgctgtgtgtgcacgctgcaaagaccagcaagctctctggaccttggagcaggcctgccgccttcatgtccactctcctcatcaatcagccccagtatgcgtggctgaaagagctggggctccgcgaggaaaacgagggcgtgtataatggaagctggggaggccggggagaggttattacgacctattgccctgctaacaacgagccaatagcaagagtccgacaggccagtgtggcagactatgaagaaactgtaaagaaagcaagagaagcatggaaaatctgggcagatattcctgctccaaaacgaggagaaatagtaagacagattggcgatgccttgcgggagaagatccaagtactaggaagcttggtgtctttggagatggggaaaatcttagtggaaggtgtgggtgaagttcaggagtatgtggatatctgtgactatgctgttggtttatcaaggatgattggaggacctatcttgccttctgaaagatctggccatgcactgattgagcagtggaatcccgtaggcctggttggaatcatcacggcattcaatttccctgtggcagtgtatggttggaacaacgccatcgccatgatctgtggaaatgtctgcctctggaaaggagctccaaccacttccctcattagtgtggctgtcacaaagataatagccaaggttctggaggacaacaagctgcctggtgcaatttgttccttgacttgtggtggagcagatattggcacagcaatggccaaagatgaacgagtgaacctgctgtccttcactgggagcactcaggtgggaaaacaggtgggcctgatggtgcaggagaggtttgggagaagtctgttggaacttggaggaaacaatgccattattgcctttgaagatgcagacctcagcttagttgttccatcagctctcttcgctgctgtgggaacagctggccagaggtgtaccactgcgaggcgactgtttatacatgaaagcatccatgatgaggttgtaaacagacttaaaaaggcctatgcacagatccgagttgggaacccatgggaccctaatgttctctatgggccactccacaccaagcaggcagtgagcatgtttcttggagcagtggaagaagcaaagaaagaaggtggcacagtggtctatgggggcaaggttatggatcgccctggaaattatgtagaaccgacaattgtgacaggtcttggccacgatgcgtccattgcacacacagagacttttgctccgattctctatgtctttaaattcaagaatgaagaagaggtctttgcatggaataatgaagtaaaacagggactttcaagtagcatctttaccaaagatctgggcagaatctttcgctggcttggacctaaaggatcagactgtggcattgtaaatgtcaacattccaacaagtggggctgagattggaggtgcctttggaggagaaaagcacactggtggtggcagggagtctggcagtgatgcctggaaacagtacatgagaaggtctacttgtactatcaactacagtaaagaccttcctctggcccaaggaatcaagtttcagtaaaggtgttttagatgaacatcccttaatttgaggtgttccagcagctgtttttggagaagacaaagaaaattaaagttttccctgaataaatgcattattatgactgtgacagtgactaatcccccgcttagcaaggacccacgctctgcaagacc

SEQ ID NO: 103845 - DNA, 2161 bp, Homo sapiens
  misc_feature (2108)..(2108): n is a, c, g, or t
  misc_feature (2111)..(2111): n is a, c, g, or t
tatcattaattagaaaactttaatttgtaatctaccaaaacagtgaaaacaaccaacccttcccccgccccccaatacaaaccctccgttgcctactccagggacaagaggcgtcaccatcgctgaggagctggttaggaatgtcggctctccgaccctagcccagacttactgaatcagaatgtgcatttaccacgacgaccaggtcattacacgcattttacagtttcagaacccctgctatagcctactgtacttcagcgccaatattttgctgaaaagaattcccagctggaactgtggctcccggagtctttcaccagatggcagcagcccactcctccctgtagcactcccattgttccaggcaggattcagccgcaggctcctccggaagaccaggggcagacggggcggtggcggggtcgtgcccagtgggaggggtcgggtctgcccaatgggttctcccgggcggggggcggggctctatttcagcagctctcagggccttgggctcatcccgagtcccgggctcagtatgtggcgccttcctcgcgcgctgtgtgtgcacgctgcaaagaccagcaagctctctggaccttggagcaggcctgccgccttcatgtccactctcctcatcaatcagccccagtatgcgtggctgaaagagctggggctccgcgaggaaaacgagggcgtgtataatggaagctggggaggccggggagaggttattacgacctattgccctgctaacaacgagccaatagcaagagtccgacaggccagtgtggcagactatgaagaaactgtaaagaaagcaagagaagcatggaaaatctgggcagatattcctgctccaaaacgaggagaaatagtaagacagattggcgatgccttgcgggagaagatccaagtactaggaagcttggtgtctttggagatggggaaaatcttagtggaaggtgtgggtgaagttcaggagtatgtggatatctgtgactatgctgttggtttatcaaggatgattggaggacctatcttgccttctgaaagatctggccatgcactgattgagcagtggaatcccgtaggcctggttggaatcatcacggcattcaatttccctgtggcagtgtatggttggaacaacgccatcgccatgatctgtggaaatgtctgcctctggaaaggagctccaaccacttccctcattagtgtggctgtcacaaagataatagccaaggttctggaggacaacaagctgcctggtgcaatttgttccttgacttgtggtggagcagatattggcacagcaatggccaaagatgaacgagtgaacctgctgtccttcactgggagcactcaggtgggaaaacaggtgggcctgatggtgcaggagaggtttgggagaagtctgttggaacttggaggaaacaatgccattattgcctttgaagatgcagacctcagcttagttgttccatcagctctcttcgctgctgtgggaacagctggccagaggtgtaccactgcgaggcgactgtttatacatgaaagcatccatgatgaggttgtaaacagacttaaaaaggcctatgcacagatccgagttgggaacccatgggaccctaatgttctctatgggccactccacaccaagcaggcagtgagcatgtttcttggagcagtggaagaagcaaagaaagaaggtggcacagtggtctatgggggcaaggttatggatcgccctggaaattatgtagaaccgacaattgtgacaggtcttggccacgatgcgtccattgcacacacagagacttttgctccgattctctatgtctttaaattcaagaatgaagaagaggtctttgcatggaataatgaagtaaaacagggactttcaagtagcatctttaccaaagatctgggcagaatctttcgctggcttggacctaaaggatcagactgtggcattgtaaatgtcaacattccaacaagtggggctgagattggaggtgcctttggaggagaaaagcacactggtggtggcagggagtctggcagtgatgcctggaaacagtacatgagaaggtctacttgtactntcnactacagtaaagaccttcctctggcccacactggccgtgatccccacatg

SEQ ID NO: 103846 - DNA, 2341 bp, Homo sapiens
tatcattaattagaaaactttaatttgtaatctaccaaaacagtgaaaacaaccaacccttcccccgccccccaatacaaaccctccgttgcctactccagggacaagaggcgtcaccatcgctgaggagctggttaggaatgtcggctctccgaccctagcccagacttactgaatcagaatgtgcatttaccacgacgaccaggtcattacacgcattttacagtttcagaacccctgctatagcctactgtacttcagcgccaatattttgctgaaaagaattcccagctggaactgtggctcccggagtctttcaccagatggcagcagcccactcctccctgtagcactcccattgttccaggcaggattcagccgcaggctcctccggaagaccaggggcagacggggcggtggcggggtcgtgcccagtgggaggggtcgggtctgcccaatgggttctcccgggcggggggcggggctctatttcagcagctctcagggccttgggctcatcccgagtcccgggctcagtatgtggcgccttcctcgcgcgctgtgtgtgcacgctgcaaagaccagcaagctctctggaccttggagcaggcctgccgccttcatgtccactctcctcatcaatcagccccagtatgcgtggctgaaagagctggggctccgcgaggaaaacgagggcgtgtataatggaagctggggaggccggggagaggttattacgacctattgccctgctaacaacgagccaatagcaagagtccgacaggccagtgtggcagactatgaagaaactgtaaagaaagcaagagaagcatggaaaatctgggcagatattcctgctccaaaacgaggagaaatagtaagacagattggcgatgccttgcgggagaagatccaagtactaggaagcttggtgtctttggagatggggaaaatcttagtggaaggtgtgggtgaagttcaggagtatgtggatatctgtgactatgctgttggtttatcaaggatgattggaggacctatcttgccttctgaaagatctggccatgcactgattgagcagtggaatcccgtaggcctggttggaatcatcacggcattcaatttccctgtggcagtgtatggttggaacaacgccatcgccatgatctgtggaaatgtctgcctctggaaaggagctccaaccacttccctcattagtgtggctgtcacaaagataatagccaaggttctggaggacaacaagctgcctggtgcaatttgttccttgacttgtggtggagcagatattggcacagcaatggccaaagatgaacgagtgaacctgctgtccttcactgggagcactcaggtgggaaaacagggagaagtctgttggaacttggaggaaacaatgccattattgcctttgaagatgcagacctcagcttagttgttccatcagctctcttcgctgctgtgggaacagctggccagaggtgtaccactgcgaggcgactgtttatacatgaaagcatccatgatgaggttgtaaacagacttaaaaaggcctatgcacagatccgagttgggaacccatgggaccctaatgttctctatgggccactccacaccaagcaggcagtgagcatgtttcttggagcagtggaagaagcaaagaaagaaggtggcacagtggtctatgggggcaaggttatggatcgccctggaaattatgtagaaccgacaattgtgacaggtcttggccacgatgcgtccattgcacacacagagacttttgctccgattctctatgtctttaaattcaagaatgaagaagaggtctttgcatggaataatgaagtaaaacagggactttcaagtagcatctttaccaaagatctgggcagaatctttcgctggcttggacctaaaggatcagactgtggcattgtaaatgtcaacattccaacaagtggggctgagattggaggtgcctttggaggagaaaagcacactggtggtggcagggagtctggcagtgatgcctggaaacagtacatgagaaggtctacttgtactatcaactacagtaaagaccttcctctggcccaaggaatcaagtttcagtaaaggtgttttagatgaacatcccttaatttgaggtgttccagcagctgtttttggagaagacaaagaaaattaaagttttccctgaataaatgcattattatgactgtgacagtgactaatccccctatgaccccaaagccctgattaaatcaagagattccttttttaaaaatcaaaataaaattgttacaacatagccatagttactaaa

SEQ ID NO: 103847 - DNA, 2046 bp, Homo sapiens
tatcattaattagaaaactttaatttgtaatctaccaaaacagtgaaaacaaccaacccttcccccgccccccaatacaaaccctccgttgcctactccagggacaagaggcgtcaccatcgctgaggagctggttaggaatgtcggctctccgaccctagcccagacttactgaatcagaatgtgcatttaccacgacgaccaggtcattacacgcattttacagtttcagaacccctgctatagcctactgtacttcagcgccaatattttgctgaaaagaattcccagctggaactgtggctcccggagtctttcaccagatggcagcagcccactcctccctgtagcactcccattgttccaggcaggattcagccgcaggctcctccggaagaccaggggcagacggggcggtggcggggtcgtgcccagtgggaggggtcgggtctgcccaatgggttctcccgggcggggggcggggctctatttcagcagctctcagggccttgggctcatcccgagtcccgggctcagtatgtggcgccttcctcgcgcgctgtgtgtgcacgctgcaaagaccagcaagctctctggaccttggagcaggcctgccgccttcatgtccactctcctcatcaatcagccccagtatgcgtggctgaaagagctggggctccgcgaggaaaacgagggcgtgtataatggaagctggggaggccggggagaggttattacgacctattgccctgctaacaacgagccaatagcaagagtccgacaggccagtgtggcagactatgaagaaactgtaaagaaagcaagagaagcatggaaaatctgggcagatattcctgctccaaaacgaggagaaatagtaagacagattggcgatgccttgcgggagaagatccaagtactaggaagcttggtgtctttggagatggggaaaatcttagtggaaggtgtgggtgaagttcaggagtatgtggatatctgtgactatgctgttggtttatcaaggatgattggaggacctatcttgccttctgaaagatctggccatgcactgattgagcagtggaatcccgtaggcctggttggaatcatcacggcattcaatttccctgtggcagtgtatggttggaacaacgccatcgccatgatctgtggaaatgtctgcctctggaaaggagctccaaccacttccctcattagtgtggctgtcacaaagataatagccaaggttctggaggacaacaagctgcctggtgcaatttgttccttgacttgtggtggagcagatattggcacagcaatggccaaagatgaacgagtgaacctgctgtccttcactgggagcactcaggtgggaaaacaggtgggcctgatggtgcaggagaggtttgggagaagtctgttggaacttggaggaaacaatgccattattgcctttgaagatgcagacctcagcttagttgttccatcagctctcttcgctgctgtgggaacagctggccagaggtgtaccactgcgaggcgactgtttatacatgaaagcatccatgatgaggttgtaaacagacttaaaaaggcctatgcacagatccgagttgggaacccatgggaccctaatgttctctatgggccactccacaccaagcaggcagtgagcatgtttcttggagcagtggaagaagcaaagaaagaaggtggcacagtggtctatgggggcaaggttatggatcgccctggaaattatgtagaaccgacaattgtgacaggtcttggccacgatgcgtccattgcacacacagagacttttgctccgattctctatgtctttaaattcaagaatgaagaagaggtctttgcatggaataatgaagtaaaacagggactttcaagtagcatctttaccaaagatctgggcagaatctttcgctggcttgggtacaactttgtctattttgaaaatttatataagtctgatttatgtgacctacaggatcagactgtggcatcgataaaacgggtaccgagctc

SEQ ID NO: 103848 - DNA, 1767 bp, Homo sapiens
tatcattaattagaaaactttaatttgtaatctaccaaaacagtgaaaacaaccaacccttcccccgccccccaatacaaaccctccgttgcctactccagggacaagaggcgtcaccatcgctgaggagctggttaggaatgtcggctctccgaccctagcccagacttactgaatcagaatgtgcatttaccacgacgaccaggtcattacacgcattttacagtttcagaacccctgctatagcctactgtacttcagcgccaatattttgctgaaaagaattcccagctggaactgtggctcccggagtctttcaccagatggcagcagcccactcctccctgtagcactcccattgttccaggcaggattcagccgcaggctcctccggaagaccaggggcagacggggcggtggcggggtcgtgcccagtgggaggggtcgggtctgcccaatgggttctcccgggcggggggcggggctctatttcagcagctctcagggccttgggctcatcccgagtcccgggctcagtatgtggcgccttcctcgcgcgctgtgtgtgcacgctgcaaagaccagcaagctctctggaccttggagcaggcctgccgccttcatgtccactctcctcatcaatcagccccagtatgcgtggctgaaagagctggggctccgcgaggaaaacgagggcgtgtataatggaagctggggaggccggggagaggttattacgacctattgccctgctaacaacgagccaatagcaagagtccgacaggccagtgtggcagactatgaagaaactgtaaagaaagcaagagaagcatggaaaatctgggcagatattcctgctccaaaacgaggagaaatagtaagacagattggcgatgccttgcgggagaagatccaagtactaggaagcttggtgtctttggagatggggaaaatcttagtggaaggtgtgggtgaagttcaggagtatgtggatatctgtgactatgctgttggtttatcaaggatgattggaggacctatcttgccttctgaaagatctggccatgcactgattgagcagtggaatcccgtaggcctggttggaatcatcacggcattcaatttccctgtggcagtgtatggttggaacaacgccatcgccatgatctgtggaaatgtctgcctctggaaaggagctccaaccacttccctcattagtgtggctgtcacaaagataatagccaaggttctggaggacaacaagctgcctggtgcaatttgttccttgacttgtggtggagcagatattggcacagcaatggccaaagatgaacgagtgaacctgctgtccttcactgggagcactcaggtgggaaaacaggtgggcctgatggtgcaggagaggtttgggagaagtctgttggaacttggaggaaacaatgccattattgcctttgaagatgcagacctcagcttagttgttccatcagctctcttcgctgctgtgggaacagctggccagaggtgtaccactgcgaggcgactgtttatacatgaaagcatccatgatgaggttgtaaacagacttaaaaaggcctatgcacagatccgagttgggaacccatgggaccctaatgttctctatgggccactccacaccaagcaggcagtgagcatgtttcttggagcagtggaagaagcaaagaaagaaggtggcacagtggtctatgggggcaaggtaagggatgctctgagatcaattgtgac

SEQ ID NO: 103849 - DNA, 1724 bp, Homo sapiens
agcatttctccattgcccagggcttaacaccgcgcctgatacccattactgctcaaaacaatgttttatagaatacaatggaaaggttattacgacctattgccctgctaacaacgagccaatagcaagagtccgacaggccagtgtggcagactatgaagaaactgtaaagaaagcaagagaagcatggaaaatctgggcagatattcctgctccaaaacgaggagaaatagtaagacagattggcgatgccttgcgggagaagatccaagtactaggaagcttggtgtctttggagatggggaaaatcttagtggaaggtgtgggtgaagttcaggagtatgtggatatctgtgactatgctgttggtttatcaaggatgattggaggacctatcttgccttctgaaagatctggccatgcactgattgagcagtggaatcccgtaggcctggttggaatcatcacggcattcaatttccctgtggcagtgtatggttggaacaacgccatcgccatgatctgtggaaatgtctgcctctggaaaggagctccaaccacttccctcattagtgtggctgtcacaaagataatagccaaggttctggaggacaacaagctgcctggtgcaatttgttccttgacttgtggtggagcagatattggcacagcaatggccaaagatgaacgagtgaacctgctgtccttcactgggagcactcaggtgggaaaacaggtgggcctgatggtgcaggagaggtttgggagaagtctgttggaacttggaggaaacaatgccattattgcctttgaagatgcagacctcagcttagttgttccatcagctctcttcgctgctgtgggaacagctggccagaggtgtaccactgcgaggcgactgtttatacatgaaagcatccatgatgaggttgtaaacagacttaaaaaggcctatgcacagatccgagttgggaacccatgggaccctaatgttctctatgggccactccacaccaagcaggcagtgagcatgtttcttggagcagtggaagaagcaaagaaagaaggtggcacagtggtctatgggggcaaggttatggatcgccctggaaattatgtagaaccgacaattgtgacaggtcttggccacgatgcgtccattgcacacacagagacttttgctccgattctctatgtctttaaattcaagaatgaagaagaggtctttgcatggaataatgaagtaaaacagggactttcaagtagcatctttaccaaagatctgggcagaatctttcgctggcttggacctaaaggatcagactgtggcattgtaaatgtcaacattccaacaagtggggctgagattggaggtgcctttggaggagaaaagcacactggtggtggcagggagtctggcagtgatgcctggaaacagtacatgagaaggtctacttgtactatcaactacagtaaagaccttcctctggcccaaggaatcaagtttcagtaaaggtgttttagatgaacatcccttaatttgaggtgttccagcagctgtttttggagaagacaaagaaaattaaagttttccctgaataaatgcattattatgactgtgacagtgactaatccccctatgaccccaaagccctgattaaatcaagagattccttttttaaaaatcaaaataaaattgttacaacatagccatagttactaaa

SEQ ID NO: 103850 - DNA, 1997 bp, Homo sapiens
tctatttcaacagttctcagggacttgggctcatcccgacgtcaccgggctcagttatgtgcgacagcctgtccctccgtacagctgatgtggtgcactgcatggccaatagacccagggaacgctcgtcttggaccattggtagcaagctcggtgacgaactgtcattgctctcacgtcatccttctagtcgaaatcgagaccctcagtatgtcgttggcgtgaaaagtagactgggggcatacacgtagcacgtgaacaagacggatgtgtggcgatgttactataaatgggtaaagacttagtggggaagtgcctggagggatgatggtttattgtagctgaaccatattttgctcgctgtattagactaagggagctcagataaggaagagtctcgatgaggtcatgagtggtggactatgaagaaactgtagagaaaggcaaaaaggaagcatggaacaatctggggcagagtattcctgctccaaaacgaggagaaatagtaagacagattggcgatgccttgcgggagaagatccaagtactaggaagcttggtgtctttggagatggggaaaatcttagtggaaggtgtgggtgaagttcaggagtatgtggatatctgtgactatgctgttggtttatcaaggatgattggaggacctatcttgccttctgaaagatctggccatgcactgattgagcagtggaatcccgtaggcctggttggaatcatcacggcattcaatttccctgtggcagtgtatggttggaacaacgccatcgccatgatctgtggaaatgtctgcctctggaaaggagctccaaccacttccctcattagtgtggctgtcacaaagataatagccaaggttctggaggacaacaagctgcctggtgcaatttgttccttgacttgtggtggagcagatattggcacagcaatggccaaagatgaacgagtgaacctgctgtccttcactgggagcactcaggtgggaaaacaggtgggcctgatggtgcaggagaggtttgggagaagtctgttggaacttggaggaaacaatgccattattgcctttgaagatgcagacctcagcttagttgttccatcagctctcttcgctgctgtgggaacagctggccagaggtgtaccactgcgaggcgactgtttatacatgaaagcatccatgatgaggttgtaaacagacttaaaaaggcctatgcacagatccgagttgggaacccatgggaccctaatgttctctatgggccactccacaccaagcaggcagtgagcatgtttcttggagcagtggaagaagcaaagaaagaaggtggcacagtggtctatgggggcaaggttatggatcgccctggaaattatgtagaaccgacaattgtgacaggtcttggccacgatgcgtccattgcacacacagagacttttgctccgattctctatgtctttaaattcaagaatgaagaagaggtctttgcatggaataatgaagtaaaacagggactttcaagtagcatctttaccaaagatctgggcagaatctttcgctggcttggacctaaaggatcagactgtggcattgtaaatgtcaacattccaacaagtggggctgagattggaggtgcctttggaggagaaaagcacactggtggtggcagggagtctggcagtgatgcctggaaacagtacatgagaaggtctacttgtactatcaactacagtaaagaccttcctctggcccaaggaatcaagtttcagtaaaggtgttttagatgaacatcccttaatttgaggtgttccagcagctgtttttggagaagacaaagaaaattaaagttttccctgaataaatgcattattatgactgtgacagtgactaatccccctatgaccccaaagccctgattaaatcaagagattccttttttaaaaatcaaaataaaattgttacaacatagccatagttactaaa

SEQ ID NO: 103851 - DNA, 2288 bp, Homo sapiens
tatcattaattagaaaactttaatttgtaatctaccaaaacagtgaaaacaaccaacccttcccccgccccccaatacaaaccctccgttgcctactccagggacaagaggcgtcaccatcgctgaggagctggttaggaatgtcggctctccgaccctagcccagacttactgaatcagaatgtgcatttaccacgacgaccaggtcattacacgcattttacagtttcagaacccctgctatagcctactgtacttcagcgccaatattttgctgaaaagaattcccagctggaactgtggctcccggagtctttcaccagatggcagcagcccactcctccctgtagcactcccattgttccaggcaggattcagccgcaggctcctccggaagaccaggggcagacggggcggtggcggggtcgtgcccagtgggaggggtcgggtctgcccaatgggttctcccgggcggggggcggggctctatttcagcagctctcagggccttgggctcatcccgagtcccgggctcagtatgtggcgccttcctcgcgcgctgtgtgtgcacgctgcaaagaccagcaagctctctggaccttggagcaggcctgccgccttcatgtccactctcctcatcaatcagccccagtatgcgtggctgaaagagctggggctccgcgaggaaaacgagggcgtgtataatggaagctggggaggccggggagaggttattacgacctattgccctgctaacaacgagccaatagcaagagtccgacaggccagtgtggcagactatgaagaaactgtaaagaaagcaagagaagcatggaaaatctgggcagatgtgtctttggagatggggaaaatcttagtggaaggtgtgggtgaagttcaggagtatgtggatatctgtgactatgctgttggtttatcaaggatgattggaggacctatcttgccttctgaaagatctggccatgcactgattgagcagtggaatcccgtaggcctggttggaatcatcacggcattcaatttccctgtggcagtgtatggttggaacaacgccatcgccatgatctgtggaaatgtctgcctctggaaaggagctccaaccacttccctcattagtgtggctgtcacaaagataatagccaaggttctggaggacaacaagctgcctggtgcaatttgttccttgacttgtggtggagcagatattggcacagcaatggccaaagatgaacgagtgaacctgctgtccttcactgggagcactcaggtgggaaaacaggtgggcctgatggtgcaggagaggtttgggagaagtctgttggaacttggaggaaacaatgccattattgcctttgaagatgcagacctcagcttagttgttccatcagctctcttcgctgctgtgggaacagctggccagaggtgtaccactgcgaggcgactgtttatacatgaaagcatccatgatgaggttgtaaacagacttaaaaaggcctatgcacagatccgagttgggaacccatgggaccctaatgttctctatgggccactccacaccaagcaggcagtgagcatgtttcttggagcagtggaagaagcaaagaaagaaggtggcacagtggtctatgggggcaaggttatggatcgccctggaaattatgtagaaccgacaattgtgacaggtcttggccacgatgcgtccattgcacacacagagacttttgctccgattctctatgtctttaaattcaagaatgaagaagaggtctttgcatggaataatgaagtaaaacagggactttcaagtagcatctttaccaaagatctgggcagaatctttcgctggcttggacctaaaggatcagactgtggcattgtaaatgtcaacattccaacaagtggggctgagattggaggtgcctttggaggagaaaagcacactggtggtggcagggagtctggcagtgatgcctggaaacagtacatgagaaggtctacttgtactatcaactacagtaaagaccttcctctggcccaaggaatcaagtttcagtaaaggtgttttagatgaacatcccttaatttgaggtgttccagcagctgtttttggagaagacaaagaaaattaaagttttccctgaataaatgcattattatgactgtgacagtgactaatccccctatgaccccaaagccctgattaaatcaagagattccttttttaaaaatcaaaataaaattgttacaacatagccatagttactaaa

SEQ ID NO: 103852 - DNA, 1628 bp, Homo sapiens
tatcattaattagaaaactttaatttgtaatctaccaaaacagtgaaaacaaccaacccttcccccgccccccaatacaaaccctccgttgcctactccagggacaagaggcgtcaccatcgctgaggagctggttaggaatgtcggctctccgaccctagcccagacttactgaatcagaatgtgcatttaccacgacgaccaggtcattacacgcattttacagtttcagaacccctgctatagcctactgtacttcagcgccaatattttgctgaaaagaattcccagctggaactgtggctcccggagtctttcaccagatggcagcagcccactcctccctgtagcactcccattgttccaggcaggattcagccgcaggctcctccggaagaccaggggcagacggggcggtggcggggtcgtgcccagtgggaggggtcgggtctgcccaatgggttctcccgggcggggggcggggctctatttcagcagctctcagggccttgggctcatcccgagtcccgggctcagtatgtggcgccttcctcgcgcgctgtgtgtgcacgctgcaaagaccagcaagctctctggaccttggagcaggcctgccgccttcatgtccactctcctcatcaatcagccccagtatgcgtggctgaaagagctggggctccgcgaggaaaacgagggcgtgtataatggaagctggggaggccggggagaggttattacgacctattgccctgctaacaacgagccaatagcaagagtccgacaggccagtgtggcagactatgaagaaactgtaaagaaagcaagagaagcatggaaaatctgggcagatattcctgctccaaaacgaggagaaatagtaagacagattggcgatgccttgcgggagaagatccaagtactaggaagcttggtgtctttggagatggggaaaatcttagtggaaggtgtgggtgaagttcaggagtatgtggatatctgtgactatgctgttggtttatcaaggatgattggaggacctatcttgccttctgaaagatctggccatgcactgattgagcagtggaatcccgtaggcctggttggaatcatcacggcattcaatttccctgtggcagtgtatggttggaacaacgccatcgccatgatctgtggaaatgtctgcctctggaaaggagctccaaccacttccctcattagtgtggctgtcacaaagataatagccaaggttctggaggacaacaagctgcctggtgcaatttgttccttgacttgtggtggagcagatattggcacagcaatggccaaagatgaacgagtgaacctgctgtccttcactgggagcactcaggtgggaaaacaggtgggcctgatggtgcaggagaggtttggagcaatggaaatgagaagatactctgctgttgtcacatatgctcctgatatcacaaatgaataaaagttattcacatggaagctgattttaaagtgcacttaaggaaatcgatgatcaaaagatcagtaataaatgtatgtctaaggctgggcacagtggctcacgtctgtaatcctagcactttgggaggctgaggtgggtgaattgcctgagctca

SEQ ID NO: 103853 - DNA, 2100 bp, Homo sapiens
tatcattaattagaaaactttaatttgtaatctaccaaaacagtgaaaacaaccaacccttcccccgccccccaatacaaaccctccgttgcctactccagggacaagaggcgtcaccatcgctgaggagctggttaggaatgtcggctctccgaccctagcccagacttactgaatcagaatgtgcatttaccacgacgaccaggtcattacacgcattttacagtttcagaacccctgctatagcctactgtacttcagcgccaatattttgctgaaaagaattcccagctggaactgtggctcccggagtctttcaccagatggcagcagcccactcctccctgtagcactcccattgttccaggcaggattcagccgcaggctcctccggaagaccaggggcagacggggcggtggcggggtcgtgcccagtgggaggggtcgggtctgcccaatgggttctcccgggcggggggcggggctctatttcagcagctctcagggccttgggctcatcccgagtcccgggctcagtatgtggcgccttcctcgcgcgctgtgtgtgcacgctgcaaagaccagcaagctctctggaccttggagcaggcctgccgccttcatgtccactctcctcatcaatcagccccagtatgcgtggctgaaagagctggggctccgcgaggaaaacgagggcgtgtataatggaagctggggaggccggggagaggttattacgacctattgccctgctaacaacgagccaatagcaagagtccgacaggccagtgtggcagactatgaagaaactgtaaagaaagcaagagaagcatggaaaatctgggcagatattcctgctccaaaacgaggagaaatagtaagacagattggcgatgccttgcgggagaagatccaagtactaggaagcttggtgtctttggagatggggaaaatcttagtggaaggtgtgggtgaagttcaggagtgacaacaagctgcctggtgcaatttgttccttgacttgtggtggagcagatattggcacagcaatggccaaagatgaacgagtgaacctgctgtccttcactgggagcactcaggtgggaaaacaggtgggcctgatggtgcaggagaggtttgggagaagtctgttggaacttggaggaaacaatgccattattgcctttgaagatgcagacctcagcttagttgttccatcagctctcttcgctgctgtgggaacagctggccagaggtgtaccactgcgaggcgactgtttatacatgaaagcatccatgatgaggttgtaaacagacttaaaaaggcctatgcacagatccgagttgggaacccatgggaccctaatgttctctatgggccactccacaccaagcaggcagtgagcatgtttcttggagcagtggaagaagcaaagaaagaaggtggcacagtggtctatgggggcaaggttatggatcgccctggaaattatgtagaaccgacaattgtgacaggtcttggccacgatgcgtccattgcacacacagagacttttgctccgattctctatgtctttaaattcaagaatgaagaagaggtctttgcatggaataatgaagtaaaacagggactttcaagtagcatctttaccaaagatctgggcagaatctttcgctggcttggacctaaaggatcagactgtggcattgtaaatgtcaacattccaacaagtggggctgagattggaggtgcctttggaggagaaaagcacactggtggtggcagggagtctggcagtgatgcctggaaacagtacatgagaaggtctacttgtactatcaactacagtaaagaccttcctctggcccaaggaatcaagtttcagtaaaggtgttttagatgaacatcccttaatttgaggtgttccagcagctgtttttggagaagacaaagaaaattaaagttttccctgaataaatgcattattatgactgtgacagtgactaatccccctatgaccccaaagccctgattaaatcaagagattccttttttaaaaatcaaaataaaattgttacaacatagccatagttactaaa

SEQ ID NO: 103854 - DNA, 1915 bp, Homo sapiens
  misc_feature (18)..(18): n is a, c, g, or t
  misc_feature (33)..(33): n is a, c, g, or t
cctattaaatttttcctnttgtcctttctcccnaaaaaacagtgcggaacacctcaaattaaggatgttcatctaaaacacctttactgaaacttgattccttgggccagaggaaggtctctacttgtactatcaactacagtaaagaccttcctctggcccaaggaatcaagtttcagtaaaggtgttttagatgaacatcccttaatttgaggtgttccagcagctgtttttggagaagacaaagaaaattaaagttttccctgaataaatgcattattatgactgtgacagtgactaatccccctatgaccccaaagccctgattaaatcaagagattccttttttaaaaatcaaaataaaattgttacaacatagccatagttactaaaagatgagttaggtggatttttattatgtcaactagttgtacatggctttttaaaagttaatgattattttgtaattagaaaaaaatagtacgtaccagggtaggaatttgggaaaatacagaaccgaggagaaaacagaagtctttgcagtagatacagggtgtctcctgaccaagtgaaggattcaggggcggggggtgaatattgcttgacattacccacctatggcatgtgttggatgtcgtgtgattgaaagggggatgcattcccctgtatgcttggaccacagttcagtattcatgtggaataacttgcagtgcttaaaatgacaacaggcattcatcacagttatggctcttgcttatgaaggctgtgtcaacttggaagagatttctggggtagacagattttgttcctgtgctggagtctgccacctgctggaggactctgaggccaaaattgcctgtgcagagttgtatagaaaatgcgtctggaggctgggcaaggtggcttatgcctataatcccagcactttgagaggccgaggcgggtggatcagtagaggctaggagtttgagaccagcctggccgatatcgtgaaaccccatctttaccaaaaaatacaaaaattagcccagtgtggtggcaggcacctgtaatcccagctattagggaggctgaggcaggagaattgtgtgaacccaggaggcagaggttgcagtgagcctagattgtgccactgcctgggcaacagtgagatcctgtctacaaaaaaaaaaaaaaaaaaaagtgcatctggatttttttatacaaccttagaccaccttctttagctttaggcgtctgcggttgcccttggatctgttctcaatcctcagtgtgtgtggcagcatgtggtcatagagagctgggcaaagttcactttctctttgctgacagtctcaccttttctcactgggaagctgcacaggagcctttgggctggttcagcccagaggcccctgttctcctgccttcctggcattctctgctccccttctgcatggcacccctctactcctgccaggttagaatggagcagaggcctttgaacaagatgacatttgtagacaacctgatccatcaggatgtggagagatctggacaaatggcaaataatttggggttgaattatggcccagagaagtaagcaaatgaaaaactaaacaattataaatgtatctgggaagcaaaggtattcataatatgtcccatggccagctgcgagcagtatttaactagacatgctgttgtcaatattgaacatgaatcaagccaaatactgatatagctattgagagaaggttggcaggaagaaatcatgggtgagggtatgtgggagtgataatcttagctatagattttaggtaaaactgattctgaaagctttctttgaaacaaatttataatttttcttctacatgtttctagcacaaggactcaatttttttggttataatgttcattaaaacatatgccttca

SEQ ID NO: 103855 - DNA, 1870 bp, Homo sapiens
gatctgctacattttaaaagtgggcatgaaaatcttctgttatgtatgtactgtcattaattctgttattttttcccactagtactatcaactacagtaaagaccttcctctggcccaaggaatcaagtttcagtaaaggtgttttagatgaacatcccttaatttgaggtgttccagcagctgtttttggagaagacaaagaaaattaaagttttccctgaataaatgcattattatgactgtgacagtgactaatccccctatgaccccaaagccctgattaaatcaagagattccttttttaaaaatcaaaataaaattgttacaacatagccatagttactaaaagatgagttaggtggatttttattatgtcaactagttgtacatggctttttaaaagttaatgattattttgtaattagaaaaaaatagtacgtaccagggtaggaatttgggaaaatacagaaccgaggagaaaacagaagtctttgcagtagatacagggtgtctcctgaccaagtgaaggattcaggggcggggggtgaatattgcttgacattacccacctatggcatgtgttggatgtcgtgtgattgaaagggggatgcattcccctgtatgcttggaccacagttcagtattcatgtggaataacttgcagtgcttaaaatgacaacaggcattcatcacagttatggctcttgcttatgaaggctgtgtcaacttggaagagatttctggggtagacagattttgttcctgtgctggagtctgccacctgctggaggactctgaggccaaaattgcctgtgcagagttgtatagaaaatgcgtctggaggctgggcaaggtggcttatgcctataatcccagcactttgagaggccgaggcgggtggatcagtagaggctaggagtttgagaccagcctggccgatatcgtgaaaccccatctttaccaaaaaatacaaaaattagcccagtgtggtggcaggcacctgtaatcccagctattagggaggctgaggcaggagaattgtgtgaacccaggaggcagaggttgcagtgagcctagattgtgccactgcctgggcaacagtgagatcctgtctacaaaaaaaaaaaaaaaaaaaagtgcatctggatttttttatacaaccttagaccaccttctttagctttaggcgtctgcggttgcccttggatctgttctcaatcctcagtgtgtgtggcagcatgtggtcatagagagctgggcaaagttcactttctctttgctgacagtctcaccttttctcactgggaagctgcacaggagcctttgggctggttcagcccagaggcccctgttctcctgccttcctggcattctctgctccccttctgcatggcacccctctactcctgccaggttagaatggagcagaggcctttgaacaagatgacatttgtagacaacctgatccatcaggatgtggagagatctggacaaatggcaaataatttggggttgaattatggcccagagaagtaagcaaatgaaaaactaaacaattataaatgtatctgggaagcaaaggtattcataatatgtcccatggccagctgcgagcagtatttaactagacatgctgttgtcaatattgaacatgaatcaagccaaatactgatatagctattgagagaaggttggcaggaagaaatcatgggtgagggtatgtgggagtgataatcttagctatagattttaggtaaaactgattctgaaagctttctttgaaacaaatttataatttttcttctacatgtttctagcacaaggactcaatttttttggttataatgttcattaaaacatatgccttca

SEQ ID NO: 103856 - DNA, 1163 bp, Homo sapiens
tatcattaattagaaaactttaatttgtaatctaccaaaacagtgaaaacaaccaacccttcccccgccccccaatacaaaccctccgttgcctactccagggacaagaggcgtcaccatcgctgaggagctggttaggaatgtcggctctccgaccctagcccagacttactgaatcagaatgtgcatttaccacgacgaccaggtcattacacgcattttacagtttcagaacccctgctatagcctactgtacttcagcgccaatattttgctgaaaagaattcccagctggaactgtggctcccggagtctttcaccagatggcagcagcccactcctccctgtagcactcccattgttccaggcaggattcagccgcaggctcctccggaagaccaggggcagacggggcggtggcggggtcgtgcccagtgggaggggtcgggtctgcccaatgggttctcccgggcggggggcggggctctatttcagcagctctcagggccttgggctcatcccgagtcccgggctcagtatgtggcgccttcctcgcgcgctgtgtgtgcacgctgcaaagaccagcaagctctctggaccttggagcaggcctgccgccttcatgtccactctcctcatcaatcagccccagtatgcgtggctgaaagagctggggctccgcgaggaaaacgagggcgtgtataatggaagctggggaggccggggagaggttattacgacctattgccctgctaacaacgagccaatagcaagagtccgacaggccagtgtggcagactatgaagaaactgtaaagaaagcaagagaagcatggaaaatctgggcagatattcctgctccaaaacgaggagaaatagtaagacagattggcgatgccttgcgggagaagatccaagtactaggaagcttggtgtctttggagatggggaaaatcttagtggaaggtgtgggtgaagttcaggagtatgtggatatctgtgactatgctgttggtttatcaaggatgattggaggacctatcttgccttctgaaatgtgaaataaaaagccttgcactgtttgatccaacggaatcccgaaagttctgggtggaaacatcacgggtcttaattttccctgatgcaaagatatgtttgtaccca

SEQ ID NO: 103857 - DNA, 1287 bp, Homo sapiens
tatcattaattagaaaactttaatttgtaatctaccaaaacagtgaaaacaaccaacccttcccccgccccccaatacaaaccctccgttgcctactccagggacaagaggcgtcaccatcgctgaggagctggttaggaatgtcggctctccgaccctagcccagacttactgaatcagaatgtgcatttaccacgacgaccaggtcattacacgcattttacagtttcagaacccctgctatagcctactgtacttcagcgccaatattttgctgaaaagaattcccagctggaactgtggctcccggagtctttcaccagatggcagcagcccactcctccctgtagcactcccattgttccaggcaggattcagccgcaggctcctccggaagaccaggggcagacggggcggtggcggggtcgtgcccagtgggaggggtcgggtctgcccaatgggttctcccgggcggggggcggggctctatttcagcagctctcagggccttgggctcatcccgagtcccgggctcagtatgtggcgccttcctcgcgcgctgtgtgtgcacgctgcaaagaccagcaagctctctggaccttggagcaggcctgccgccttcatgtccactctcctcatcaatcagccccagtatgcgtggctgaaagagctggggctccgcgaggaaaacgagggcgtgtataatggaagctggggaggccggggagaggtacgcgggcgctcaagaaatctctgcagccgccggggctcgctcgaggaggccgggcgggcactgacctaccgactccccgctggcgctggatgcggtagtagcatgggagattttgaagctccacagtaaaagttttctcgtgtagggtgcctttaaaacaaaaacttagattttaggtccttgtgtgctatgcagaatcgacgtcattttggagctgtaggggctaaacttcccgcgcatatttaaaacattatggtctaccgggcgcggtggctcacccctgtaatcccagcactttgggaggcctaggcgggcggatcacctgaggtagcgagttcaagaccagcctgaccgacatggagaaaccttgtctctactaaaaaaaatacaaaatagccgggcgtggtggcgcatgcctgtaatcccagctactagggaggctgaggcaggagaatcgcttgaacccgggaggtggaggtcgtagtgagccgagatcgtgccattgcactccagcctgagcaacaagagcgaaattccgtctcaaaaaaaaaaaa

SEQ ID NO: 103858 - DNA, 203 bp, Homo sapiens
gcttggtgtctttggagatggggaaaatcttagtggaaggtgtgggtgaagttcaggagtatgtggatatctgtgactatgctgttggtttatcaaggatgattggaggacctatcttgccttctgaaaagtaagcaatgaaattagttaagctgagttttgtactctgatatacagagctccaaaaaaaataaaatactctg

SEQ ID NO: 103859 - DNA, 671 bp, Homo sapiens
gtctgttcattgagaaagctgttctaataataaaacgatgccataaagggcaaaatgatgagccagccttccttttctctctccagctaatgttctctatgggccactccacaccaagcaggcagtgagcatgtttcttggagcagtggaagaagcaaagaaagaaggtggcacagtggtctatgggggcaaggtaagggatgctctgagatcaattgtgacagctttttaaccttcttttccctgagacacaagcagggctctgggcatattggaaaagccaccccatttgacatccttcttctcctgtctttatttatatatattattataaaacaaggaaacacatgtttttgtttgtttgtctgtttttgagacagagtcttactctgtgcccaggatggagtgcagtggcgcaatcttggctcacggcaacctccgcctcccaggttcaagtgattctcctgcttcagcctcccgagtagctgggattacaggtgcatgtcaccacacccagctaatttttatattttttggtagagatggggtttcccatgttagccaggctggtctctaactcctggcctcaagtgatccacccaccctggcctcctaaggtgttgggattacaggcatgaaccaccacacttggctctgtttgtttttgtgac

SEQ ID NO: 103860 - DNA, 2276 bp, Homo sapiens
tatcattaattagaaaactttaatttgtaatctaccaaaacagtgaaaacaaccaacccttcccccgccccccaatacaaaccctccgttgcctactccagggacaagaggcgtcaccatcgctgaggagctggttaggaatgtcggctctccgaccctagcccagacttactgaatcagaatgtgcatttaccacgacgaccaggtcattacacgcattttacagtttcagaacccctgctatagcctactgtacttcagcgccaatattttgctgaaaagaattcccagctggaactgtggctcccggagtctttcaccagatggcagcagcccactcctccctgtagcactcccattgttccaggcaggattcagccgcaggctcctccggaagaccaggggcagacggggcggtggcggggtcgtgcccagtgggaggggtcgggtctgcccaatgggttctcccgggcggggggcggggctctatttcagcagctctcagggccttgggctcatcccgagtcccgggctcagtatgtggcgccttcctcgcgcgctgtgtgtgcacgctgcaaagaccagcaagctctctggaccttggagcaggcctgccgccttcatgtccactctcctcatcaatcagccccagtatgcgtggctgaaagagctggggctccgcgaggaaaacgagggcgtgtataatggaagctggggaggccggggagaggttattacgacctattgccctgctaacaacgagccaatagcaagagtccgacaggccagtgtggcagactatgaagaaactgtaaagaaagcaagagaagcatggaaaatctgggcagatattcctgctccaaaacgaggagaaatagtaagacagattggcgatgccttgcgggagaagatccaagtactaggaagcttggtgtctttggagatggggaaaatcttagtggaaggtgtgggtgaagttcaggagtatgtggatatctgtgactatgctgttggtttatcaaggatgattggaggacctatcttgccttctgaaagatctggccatgcactgattgagcagtggaatcccgtaggcctggttggaatcatcacggcattcaatttccctgtggcagtgtatggttggaacaacgccatcgccatgatctgtggaaatgtctgcctctggaaaggagctccaaccacttccctcattagtgtggctgtcacaaagataatagccaaggttctggaggacaacaagctgcctggtgcaatttgttccttgacttgtggtggagcagatattggcacagcaatggccaaagatgaacgagtgaacctgctgtccttcactgggagcactcaggtgggaaaacaggtgggcctgatggtgcaggagaggtttgggagaagtctgttggaacttggaggaaacaatgccattattgcctttgaagatgcagacctcagcttagttgttccatcagctctcttcgctgctgtgggaacagctggccagaggtgtaccactgcgaggcgactgtttatacatgaaagcatccatgatgaggttgtaaacagacttaaaaaggcctatgcacagatccgagttgggaacccatgggaccctaatgttctctatgggccactccacaccaagcaggcagtgagcatgtttcttggagcagtggaagaagcaaagaaagaaggtggcacagtggtctatgggggcaaggttatggatcgccctggaaattatgtagaaccgacaattgtgacaggtcttggccacgatgcgtccattgcacacacagagacttttgctccgattctctatgtctttaaattcaagaatgaagaagaggtctttgcatggaataatgaagtaaaacagggactttcaagtagcatctttaccaaagatctgggcagaatctttcgctggcttgggtacaactttgtctattttgaaaatttatataagtctgatttatgtggtgagtggacttaaaaaaactgctgtagtctaaaatcagtttttcagtattgaaagcctttgagctttggtttagattttttatttatttttgtttgtttttaatttcctgttcattgctctcaccatgcctccctttttacacagacctaaaggatcagactgtggcattgtaaatgtcaacattccaacaagtggggctgagattggaggtgcctttggaggacgtagagaaggtctatttctccttttccatgttgggcagcaaagaaaaacc

SEQ ID NO: 103861 - DNA, 1955 bp, Homo sapiens
tatcattaattagaaaactttaatttgtaatctaccaaaacagtgaaaacaaccaacccttcccccgccccccaatacaaaccctccgttgcctactccagggacaagaggcgtcaccatcgctgaggagctggttaggaatgtcggctctccgaccctagcccagacttactgaatcagaatgtgcatttaccacgacgaccaggtcattacacgcattttacagtttcagaacccctgctatagcctactgtacttcagcgccaatattttgctgaaaagaattcccagctggaactgtggctcccggagtctttcaccagatggcagcagcccactcctccctgtagcactcccattgttccaggcaggattcagccgcaggctcctccggaagaccaggggcagacggggcggtggcggggtcgtgcccagtgggaggggtcgggtctgcccaatgggttctcccgggcggggggcggggctctatttcagcagctctcagggccttgggctcatcccgagtcccgggctcagtatgtggcgccttcctcgcgcgctgtgtgtgcacgctgcaaagaccagcaagctctctggaccttggagcaggcctgccgccttcatgtccactctcctcatcaatcagccccagtatgcgtggctgaaagagctggggctccgcgaggaaaacgagggcgtgtataatggaagctggggaggccggggagaggttattacgacctattgccctgctaacaacgagccaatagcaagagtccgacaggccagtgtggcagactatgaagaaactgtaaagaaagcaagagaagcatggaaaatctgggcagatattcctgctccaaaacgaggagaaatagtaagacagattggcgatgccttgcgggagaagatccaagtactaggaagcttggtgtctttggagatggggaaaatcttagtggaaggtgtgggtgaagttcaggagtatgtggatatctgtgactatgctgttggtttatcaaggatgattggaggacctatcttgccttctgaaagatctggccatgcactgattgagcagtggaatcccgtaggcctggttggaatcatcacggcattcaatttccctgtggcagtgtatggttggaacaacgccatcgccatgatctgtggaaatgtctgcctctggaaaggagctccaaccacttccctcattagtgtggctgtcacaaagataatagccaaggttctggaggacaacaagctgcctggtgcaatttgttccttgacttgtggtggagcagatattggcacagcaatggccaaagatgaacgagtgaacctgctgtccttcactgggagcactcaggtgggaaaacaggtgggcctgatggtgcaggagaggtttgggagaagtctgttggaacttggaggaaacaatgccattattgcctttgaagatgcagacctcagcttagttgttccatcagctctcttcgctgctgtgggaacagctggccagaggtgtaccactgcgaggcgactgtttatacatgaaagcatccatgatgaggttgtaaacagacttaaaaaggcctatgcacagatccgagttgggaacccatgggaccctaatgttctctatgggccactccacaccaagcaggcagtgagcatgtttcttggagcagtggaagaagcaaagaaagaaggtggcacagtggtctatgggggcaaggttatggatcgccctggaaattatgtagaaccgacaattgtgacaggtcttggccacgatgcgtccattgcacacacagagacttttgctccgattctctatgtctttaaattcaagaatgaagaagaggtctttgcatggaataatgaagtaaaacaggggcctagggagccgccccttgtcatgtaccatcaataaagtaccctgtgctcaacca

SEQ ID NO: 103862 - DNA, 1665 bp, Homo sapiens
taagctagtacgggcctgggtttgaatcggccgaggagactattgcctgctaacaacgagccaatagcaagagtcgacaggccagtgtggcagactatgaagaaactgtaaagaaagcaagagaagcatggaaaatctgggcagatattcctgctccaaaacgaggagaaatagtaagacagattggcgatgccttgcgggagaagatccaagtactaggaagcttggtgtctttggagatggggaaaatcttagtggaaggtgtgggtgaagttcaggagtatgtggatatctgtgactatgctgttggtttatcaaggatgattggaggacctatcttgccttctgaaagatctggccatgcactgattgagcagtggaatcccgtaggcctggttggaatcatcacggcattcaatttccctgtggcagtgtatggttggaacaacgccatcgccatgatctgtggaaatgtctgcctctggaaaggagctccaaccacttccctcattagtgtggctgtcacaaagataatagccaaggttctggaggacaacaagctgcctggtgcaatttgttccttgacttgtggtggagcagatattggcacagcaatggccaaagatgaacgagtgaacctgctgtccttcactgggagcactcaggtgggaaaacaggtgggcctgatggtgcaggagaggtttgggagaagtctgttggaacttggaggaaacaatgccattattgcctttgaagatgcagacctcagcttagttgttccatcagctctcttcgctgctgtgggaacagctggccagaggtgtaccactgcgaggcgactgtttatacatgaaagcatccatgatgaggttgtaaacagacttaaaaaggcctatgcacagatccgagttgggaacccatgggaccctaatgttctctatgggccactccacaccaagcaggcagtgagcatgtttcttggagcagtggaagaagcaaagaaagaaggtggcacagtggtctatgggggcaaggttatggatcgccctggaaattatgtagaaccgacaattgtgacaggtcttggccacgatgcgtccattgcacacacagagacttttgctccgattctctatgtctttaaattcaagaatgaagaagaggtctttgcatggaataatgaagtaaaacagggactttcaagtagcatctttaccaaagatctgggcagaatctttcgctggcttggacctaaaggatcagactgtggcattgtaaatgtcaacattccaacaagtggggctgagattggaggtgcctttggaggagaaaagcacactggtggtggcagggagtctggcagtgatgcctggaaacagtacatgagaaggtctacttgtactatcaactacagtaaagaccttcctctggcccaaggaatcaagtttcagtaaaggtgttttagatgaacatcccttaatttgaggtgttccagcagctgtttttggagaagacaaagaaaattaaagttttccctgaataaatgcattattatgactgtgacagtgactaatccccctatgaccccaaagccctgattaaatcaagagattccttttttaaaaatcaaaataaaattgttacaacatagccatagttactaaa

SEQ ID NO: 103863 - DNA, 2314 bp, Homo sapiens
tatcattaattagaaaactttaatttgtaatctaccaaaacagtgaaaacaaccaacccttcccccgccccccaatacaaaccctccgttgcctactccagggacaagaggcgtcaccatcgctgaggagctggttaggaatgtcggctctccgaccctagcccagacttactgaatcagaatgtgcatttaccacgacgaccaggtcattacacgcattttacagtttcagaacccctgctatagcctactgtacttcagcgccaatattttgctgaaaagaattcccagctggaactgtggctcccggagtctttcaccagatggcagcagcccactcctccctgtagcactcccattgttccaggcaggattcagccgcaggctcctccggaagaccaggggcagacggggcggtggcggggtcgtgcccagtgggaggggtcgggtctgcccaatgggttctcccgggcggggggcggggctctatttcagcagctctcagggccttgggctcatcccgagtcccgggctcagtatgtggcgccttcctcgcgcgctgtgtgtgcacgctgcaaagaccagcaagctctctggaccttggagcaggcctgccgccttcatgtccactctcctcatcaatcagccccagtatgcgtggctgaaagagctggggctccgcgaggaaaacgagggcgtgtataatggaagctggggaggccggggagaggttattacgacctattgccctgctaacaacgagccaatagcaagagtccgacaggccagtgtggcagactatgaagaaactgtaaagaaagcaagagaagcatggaaaatctgggcagatattcctgctccaaaacgaggagaaatagtaagacagattggcgatgccttgcgggagaagatccaagtactaggaagcttgatgtggatatctgtgactatgctgttggtttatcaaggatgattggaggacctatcttgccttctgaaagatctggccatgcactgattgagcagtggaatcccgtaggcctggttggaatcatcacggcattcaatttccctgtggcagtgtatggttggaacaacgccatcgccatgatctgtggaaatgtctgcctctggaaaggagctccaaccacttccctcattagtgtggctgtcacaaagataatagccaaggttctggaggacaacaagctgcctggtgcaatttgttccttgacttgtggtggagcagatattggcacagcaatggccaaagatgaacgagtgaacctgctgtccttcactgggagcactcaggtgggaaaacaggtgggcctgatggtgcaggagaggtttgggagaagtctgttggaacttggaggaaacaatgccattattgcctttgaagatgcagacctcagcttagttgttccatcagctctcttcgctgctgtgggaacagctggccagaggtgtaccactgcgaggcgactgtttatacatgaaagcatccatgatgaggttgtaaacagacttaaaaaggcctatgcacagatccgagttgggaacccatgggaccctaatgttctctatgggccactccacaccaagcaggcagtgagcatgtttcttggagcagtggaagaagcaaagaaagaaggtggcacagtggtctatgggggcaaggttatggatcgccctggaaattatgtagaaccgacaattgtgacaggtcttggccacgatgcgtccattgcacacacagagacttttgctccgattctctatgtctttaaattcaagaatgaagaagaggtctttgcatggaataatgaagtaaaacagggactttcaagtagcatctttaccaaagatctgggcagaatctttcgctggcttggacctaaaggatcagactgtggcattgtaaatgtcaacattccaacaagtggggctgagattggaggtgcctttggaggagaaaagcacactggtggtggcagggagtctggcagtgatgcctggaaacagtacatgagaaggtctacttgtactatcaactacagtaaagaccttcctctggcccaaggaatcaagtttcagtaaaggtgttttagatgaacatcccttaatttgaggtgttccagcagctgtttttggagaagacaaagaaaattaaagttttccctgaataaatgcattattatgactgtgacagtgactaatccccctatgaccccaaagccctgattaaatcaagagattccttttttaaaaatcaaaataaaattgttacaacatagccatagttactaaa

SEQ ID NO: 103864 - DNA, 2315 bp, Homo sapiens
tatcattaattagaaaactttaatttgtaatctaccaaaacagtgaaaacaaccaacccttcccccgccccccaatacaaaccctccgttgcctactccagggacaagaggcgtcaccatcgctgaggagctggttaggaatgtcggctctccgaccctagcccagacttactgaatcagaatgtgcatttaccacgacgaccaggtcattacacgcattttacagtttcagaacccctgctatagcctactgtacttcagcgccaatattttgctgaaaagaattcccagctggaactgtggctcccggagtctttcaccagatggcagcagcccactcctccctgtagcactcccattgttccaggcaggattcagccgcaggctcctccggaagaccaggggcagacggggcggtggcggggtcgtgcccagtgggaggggtcgggtctgcccaatgggttctcccgggcggggggcggggctctatttcagcagctctcagggccttgggctcatcccgagtcccgggctcagtatgtggcgccttcctcgcgcgctgtgtgtgcacgctgcaaagaccagcaagctctctggaccttggagcaggcctgccgccttcatgtccactctcctcatcaatcagccccagtatgcgtggctgaaagagctggggctccgcgaggaaaacgagggcgtgtataatggaagctggggaggccggggagaggttattacgacctattgccctgctaacaacgagccaatagcaagagtccgacaggccagtgtggcagactatgaagaaactgtaaagaaagcaagagaagcatggaaaatctgggcagatattctgcttgtcgttttatattgcttggtgtctttggagatggggaaaatcttagtggaaggtgtgggtgaagttcaggagtatgtggatatctgtgactatgctgttggtttatcaaggatgattggaggacctatcttgccttctgaaagatctggccatgcactgattgagcagtggaatcccgtaggcctggttggaatcatcacggcattcaatttccctgtggcagtgtatggttggaacaacgccatcgccatgatctgtggaaatgtctgcctctggaaaggagctccaaccacttccctcattagtgtggctgtcacaaagataatagccaaggttctggaggacaacaagctgcctggtgcaatttgttccttgacttgtggtggagcagatattggcacagcaatggccaaagatgaacgagtgaacctgctgtccttcactgggagcactcaggtgggaaaacaggtgggcctgatggtgcaggagaggtttgggagaagtctgttggaacttggaggaaacaatgccattattgcctttgaagatgcagacctcagcttagttgttccatcagctctcttcgctgctgtgggaacagctggccagaggtgtaccactgcgaggcgactgtttatacatgaaagcatccatgatgaggttgtaaacagacttaaaaaggcctatgcacagatccgagttgggaacccatgggaccctaatgttctctatgggccactccacaccaagcaggcagtgagcatgtttcttggagcagtggaagaagcaaagaaagaaggtggcacagtggtctatgggggcaaggttatggatcgccctggaaattatgtagaaccgacaattgtgacaggtcttggccacgatgcgtccattgcacacacagagacttttgctccgattctctatgtctttaaattcaagaatgaagaagaggtctttgcatggaataatgaagtaaaacagggactttcaagtagcatctttaccaaagatctgggcagaatctttcgctggcttggacctaaaggatcagactgtggcattgtaaatgtcaacattccaacaagtggggctgagattggaggtgcctttggaggagaaaagcacactggtggtggcagggagtctggcagtgatgcctggaaacagtacatgagaaggtctacttgtactatcaactacagtaaagaccttcctctggcccaaggaatcaagtttcagtaaaggtgttttagatgaacatcccttaatttgaggtgttccagcagctgtttttggagaagacaaagaaaattaaagttttccctgaataaatgcattattatgactgtgacagtgactaatccccctatgaccccaaagccctgattaaatcaagagattccttttttaaaaatcaaaataaaattgttacaacatagccatagttactaaa

SEQ ID NO: 103865 - DNA, 1447 bp, Homo sapiens
tatcattaattagaaaactttaatttgtaatctaccaaaacagtgaaaacaaccaacccttcccccgccccccaatacaaaccctccgttgcctactccagggacaagaggcgtcaccatcgctgaggagctggttaggaatgtcggctctccgaccctagcccagacttactgaatcagaatgtgcatttaccacgacgaccaggtcattacacgcattttacagtttcagaacccctgctatagcctactgtacttcagcgccaatattttgctgaaaagaattcccagctggaactgtggctcccggagtctttcaccagatggcagcagcccactcctccctgtagcactcccattgttccaggcaggattcagccgcaggctcctccggaagaccaggggcagacggggcggtggcggggtcgtgcccagtgggaggggtcgggtctgcccaatgggttctcccgggcggggggcggggctctatttcagcagctctcagggccttgggctcatcccgagtcccgggctcagtatgtggcgccttcctcgcgcgctgtgtgtgcacgctgcaaagaccagcaagctctctggaccttggagcaggcctgccgccttcatgtccactctcctcatcaatcagccccagtatgcgtggctgaaagagctggggctccgcgaggaaaacgagggcgtgtataatggaagctggggaggccggggagaggttattacgacctattgccctgctaacaacgagccaatagcaagagtccgacaggccagtgtggcagactatgaagaaactgtaaagaaagcaagagaagcatggaaaatctgggcagatattcctgctccaaaacgaggagaaatagtaagacagattggcgatgccttgcgggagaagatccaagtactaggaagcttggtgtctttggagatggggaaaatcttagtggaaggtgtgggtgaagttcaggagtatgtggatatctgtgactatgctgttggtttatcaaggatgattggaggacctatcttgccttctgaaagatctggccatgcactgattgagcagtggaatcccgtaggcctggttggaatcatcacggcattcaatttccctgtggcagtgtatggttggaacaacgccatcgccatgatctgtggaaatgtctgcctctggaaaggagctccaaccacttccctcattagtgtggctgtcacaaagataatagccaaggttctggaggacaacaagctgcctggtgcaatttgttccttgacttgtggtggagcagatattggcacagcaatggccaaagatgaacgagtgatcttctgcaaggtgatcttctgacgatgaggtgatcttctgcacgataaggtgatcttctgcacgatgaggtgatcttctgcacgataaggtgatcttctgcacgat

SEQ ID NO: 103866 - DNA, 1359 bp, Homo sapiens
tatcattaattagaaaactttaatttgtaatctaccaaaacagtgaaaacaaccaacccttcccccgccccccaatacaaaccctccgttgcctactccagggacaagaggcgtcaccatcgctgaggagctggttaggaatgtcggctctccgaccctagcccagacttactgaatcagaatgtgcatttaccacgacgaccaggtcattacacgcattttacagtttcagaacccctgctatagcctactgtacttcagcgccaatattttgctgaaaagaattcccagctggaactgtggctcccggagtctttcaccagatggcagcagcccactcctccctgtagcactcccattgttccaggcaggattcagccgcaggctcctccggaagaccaggggcagacggggcggtggcggggtcgtgcccagtgggaggggtcgggtctgcccaatgggttctcccgggcggggggcggggctctatttcagcagctctcagggccttgggctcatcccgagtcccgggctcagtatgtggcgccttcctcgcgcgctgtgtgtgcacgctgcaaagaccagcaagctctctggaccttggagcaggcctgccgccttcatgtccactctcctcatcaatcagccccagtatgcgtggctgaaagagctggggctccgcgaggaaaacgagggcgtgtataatggaagctggggaggccggggagaggttattacgacctattgccctgctaacaacgagccaatagcaagagtccgacaggccagtgtggcagactatgaagaaactgtaaagaaagcaagagaagcatggaaaatctgggcagatattcctgctccaaaacgaggagaaatagtaagacagattggcgatgccttgcgggagaagatccaagtactaggaagcttggtgtctttggagatggggaaaatcttagtggaaggtgtgggtgaagttcaggagtgacaacaagctgcctggtgcaatttgttccttgacttgtggtggagcagatattggcacagcaatggccaaagatgaacgagtgaacctgctgtccttcactgggagcactcaggtgggaaaacaggtgggcctgatggtgcaggagaggtttggagcaatggaaatgagaagatactctgctgttgtcacatatgctcctgatatcacaaatgaataaaagttattcacatggaagctgattttaaagtgcacttaaggaaatcgatgatcaaaagatcagtaataaatgtatgtctaaggctgggcacagtggctcacgtctgtaatcctagcactttgggaggctgaggtgggtgaattgcctgagctca

SEQ ID NO: 103867 - DNA, 562 bp, Homo sapiens
agaacatggtctacattctgccttccgaaatccatattaacatttggtggctgcttgttgaagctaggtgatagcattagagagtcctggtgtcatgaaagccagagcatcctagtgaactttcagggatggggtggaaggtggagaagaaatgggctatggagtagttcagaatgtctccaatggggctacttttgagagagaatgctctctttcaccatttgtcttccaggatatgaacagaatatagagttgctatcttccttagagtgtgaaagtctaggctgtctgcaagacagcatgttatggtttttattattttttattgattgattgattgtagagacggcatctcgctgtgttgcccaggctggtctcaaactcgtggccaacatagtgaaactccatctctactaaaaatacaaaaattagctgggtgcctataatcccagctaatcgggaggctgaggccggagaattgcttgaaccctgggggcggaggttgcagtgagctgagtgccactgcactccagcctgggcaacaaaacaaaactccatcaaa

SEQ ID NO: 103868 - DNA, 652 bp, Homo sapiens
acgaaagcacagaatatgaatgggagaagagtgaggaaagcttctaaaggtatatagaggccttaggtttagacgcaccagccagatatccaggtggatgaacttctgtggaagctgaaaatggtggcactatagtttgagagttggagctaatctttgtagaggtaatacttgaaaccatggcactgaataaaggttaaaataagagacagtgcagagagagaacggggtttgagtctttttgaagactatatgtgaagaggtggagaaagaaagtagtgagcagagataaagacatcagaccagtaggagcataatcagatcatgtgaagaggaaaggagtttcaaagtagaggaagtggattctgtagaaagatcaaggacaggacaggcgcagtggctcacacctgtaatcccagcactttgggaggccgaggcgggtggatcacctgacatcaggagttcaagaccaacctggccaacatagtgaaactccatctctactaaaaatacaaaaattagctgggtgcctataatcccagctaatcgggaggctgaggccggagaattgcttgaaccctgggggcggaggttgcagtgagctgagtgccactgcactccagcctgggcaacaaaacaaaactccatcaaa

SEQ ID NO: 103869 - DNA, 737 bp, Homo sapiens
catatcttgagtttattatgtatagagtaaggctattttctttttgaaggtaaaaatcacataatataaaattaataacaaccattttaaagcatacaatgcacttgcttttagtatattcacaatgttccagggcaatttcatcatgtcccttccaaaaacccattatgcataaagttgttacaccctattctgcttccctgagccctaacgaccactaatctaatttatatcccaattgatttgccaattcctgatgtttcatgtgaataaaatcaagtaatatttgtccttttgtgcacttaacataatgctttcaaatttcacccatattataacatatataagtacttcattctttgttatagctgaaaattgggtgtccatttatgagtcaacaagcgtatggattgtttccactttttgactgtatgaatattactgctgtaaatattcatgcacatgtttattttttgagcacctatgttttgtaagattaacagctgacttaagagaaacaatggaaggcaagaggcagtagaataatatattcaaaagatgcaaaggaaaaaaaactctcggccacgaattccttatccagcaattatttttcaaaaatgaagataacacaaagacttacccagataaacagaaatattaactgaagttgttgctggcagacctaccacattaaaaaaaacgctaaaataaattcctaaggctaaaagcaagtcaca

SEQ ID NO: 103870 - DNA, 477 bp, Homo sapiens
aaagagaatttattggctgatatacatgaaaattacagaagtttccttcagacaaatttgactgtaaatcctcattatgttatcaggactcagtctgtctcaccctctctccttcctctctcctggtgtctcccacagtctcctagctctgtccattcttggcttttttcttaggcaccatctctctttgtggtagcaaagatgaccccctcacagctgccagattacataatccttagccctctgatgatctgagagagggcttcatctgaaatagcaaaagtccaaaggctggcacatatccaccatgcccaagctcattaacatattctctatatctcattggcctcccgtgattctagaatttgatcacttcttctgcatgcttttcctattccaggtccttgctttgacattgatgtgctttttagcagaaactgtgtgtaaaactaagaattaagcttaacactaatctaa

SEQ ID NO: 103871 - DNA, 194 bp, Homo sapiens
tcaaaccagatttacaagccatgcaactaggacaacaccagaattaccccacagaactgcttcagtggaggtcttaactgctgcaggtgttaaacacaaggacacttggcagtgcatagtggacaccaccgctagaaaacgctgcctctgaaacctggcagccatgcttgtctacttcacatcacttgcttcct

SEQ ID NO: 103872 - DNA, 354 bp, Homo sapiens
accaaattcatttctggatcaggaatatcgaaagagatttaatattgtcgaagaagatactgtcttatattgctatgaatatgaaaaaggaagatcaagtagtcaaggaagacgagaaagcaccccaacttatggcaagctacgacctatatctatgccagtggaatataattgggtgggggactatgaagatccaaataagatgaagagagatagtagaagagaaaactctctacttcggtatatgagcaatgaaaagattgctcaagaagaatacatgtttcagagaaacagcaaaaaggacacagggaagaagtcaaaaaagaagggtgataagagtaatagcccaactca

SEQ ID NO: 103873 - DNA, 390 bp, Homo sapiens
cgctgaaaggtttacagaaagtgttcccaggacggtgctaaggcgctgaagcaagggcaggggctgagtgcaaagggaacttcaggccctctagctagacaagaggatggagctttgcatggagagaaagctagtgacaaggctgggggaaggggccctgcaggggcttcatcctggaggggtctgagccagacaggaatgtgggtagatgtacatttccggttctctgtgcggaagcagggtggtgggccaggaaggagggcagtgggcttgtgtggttggagggtggtactctttcttccggctcccctttccccccgagtgcctccttcccactgtggatggcacttaccatgtgcgcaatgggacaactctgcctgaccccagcac

SEQ ID NO: 103874 - DNA, 236 bp, Homo sapiens
ttccttcctctctcacgtcacactgataggagaacaataacgtaggaagataactggagtatattaacaacttttcatttatttctacaatatcaaacctactcttaaaactgaaattctacttctattagattgttagctagctggataaaaggccattttccctgattttcactctgtcacccaggctggagtgcagtggcgttatcatggctcacagaagcctcgacctccca

SEQ ID NO: 103875 - DNA, 503 bp, Homo sapiens
cacctgagcctcccagaggctagcatgatatagtttgaacttgtgtacagaatatgaccttaacctacttgaaaaactctgtgttgtgatggctgctgctttcctggcattatagaggggggttgactttatatatctacctaatggctgattgtatttatccatttgggcttccataacaaaataccatagactgggtggcttaaacaacagacatttttttcttacagttctggaggctgggaagtccaagatcaaagagcccagtgatttggttctgggtgaggaatctctttctggcttgcagatgccaccttcttgctatattctcatttggtggagagagagcactggtctctcttcctcttgtaaggggactaattccaacaccacagctcccccaccatgacctcattaaaacctaattatctcccaaggctccatttccaaatacagtcacattggggttagggcttcaacatatggattttagggggacatga

SEQ ID NO: 103876 - DNA, 254 bp, Homo sapiens
ctcggtacccatccttccctctctacgttcatgtgttctcattgttcaactcccacttaggagtgagaacacgtagtgtctggttttctttctagtgaagcagcaatttctcttctctacctagctgaacacagtgtggctgagcagctatctgaagtgaaatgaatgctgactcttgtatatctttattttttattttttgagacggagtttcgctcttgctgcccaggctggagtacaatagcgtaacacgg

SEQ ID NO: 103877 - DNA, 200 bp, Homo sapiens
taactgccccctctccccagcacacaaataattctttctagtgaagcagcaatttctcttctctacctagctgaacacagtgtggctgagcagctatctgaagtgaaatgaatgctgactcttgtatatctttattttttattttttgagacggagtttcgctcttgctgcccaggctggagtacaatagcgtaacacgg

SEQ ID NO: 103878 - DNA, 372 bp, Homo sapiens
gaccaatgtttagggaaagcagtgggtggtggcagctgatttcctgagaatgagcaatgaactcatagaccaggttccaagtggaaaagcctggggctttctctcttggctttcttggcagaatgggctgtgagtgtgtgtgtgtgtgagagagagagcttaacctggtctggctaatgataataacaacagcagacacatgcagagcagttactttgtgccaggcacttgtcttaactcatgtacaccccatggcaccgctcagtaggtgctgttatcatccccatctgctggatgtgtaaacagaggccggggatgggaggtaacttactcaggtcacactgttagcaagtgataggactcgttttttgt

SEQ ID NO: 103879 - DNA, 330 bp, Homo sapiens
aaactgacaaagaggctgtgtaaatctgatgctcacagacggaaacttgcacaagcttcagctctttttctagactggtgattcaaattattgtcattttttgacacagggtctcatttgtcacccaggctggagtgaaatggtgtgatcacggctcactgcagcctcaacctcctgggctcaaacaatcctcttagcctctggagtggctgggaccacagttgtatagactatgaccagctaatttttcaaattattaagtgagagacaattagccgggctcagtggctcacgcccattatcccagcactttgggaggccgaggcaggt

SEQ ID NO: 103880 - DNA, 424 bp, Homo sapiens
gctaacgtcattgaacactaaaaaattaaaatccagtactattaataatatcatgcacacagtagcaagacttcaggaattaatctatcaaatgagtgtgagagtctggtacactagaactcaaaaaggcacaaattgtttgtaccagaaacagaaatgaaagattctttaaaaagatttgtatttctacaagataatgtgaatttttataggctaaagtatagcacgaaataatttaaaaacaggcagagctacagagatctgataattttgtgatttccaaatttgtttaagctatgacactccttttttcccccgaagaaatttcatattgaagctcaatatataaaaaagattggcttggacagtggtccctgagtccctcttgaaaactggttgggtttagtattatttgaaagcccct

SEQ ID NO: 103881 - DNA, 883 bp, Homo sapiens
gagcttccatgtcctcaggacatatcaccttcccagcacattgctgcgcatcaccaactaggaatctcactcagacatcagtgtccaaagtttttgttggagtttcattaactattatgactgattgaattattggccacatgatgtgattgaacttaatctccaacctcctcctctcccaagagttcaaactgatatcacgtgtctcagagccctaattctctacatggttggtctttctggcatggccggtatcatcctgaaactatctcgggggcccaccatgagtcacctggttaaacagaaactcacgtgtgatcagcgagatctaccatgcaggacaaagacacttgcagaaactccaaagcttagaggctcccgggaactggtgacaaagaccaagtgaatccttcattatatgacagtggggaaactaaggagtagctagaaacttctatatgaagaggcatcgccatcatgcatactgaagtgatggatctgtggtcagttggcttctttcttgggtttccatatattctatatgtcaaatctgaatttaggtgaggagatacttctaaggcagagttttgctccctgtttaaccaggctggagtgcagtggcacaatttcagctcactgcagcctccgcctcccaggttcaagtgattttcctgcctcagtctccagagtagctaggattacaggcacccgccaccacgcccggctaatttttggtatagttagtagggacggggtttcaccatattgaccaggctggtcttgaactactgacctcgggcgatccacctgcctcagcctcccaaagtgccaggattacaggcgtgagccaccgcctggcatgtatgtatgtttgtttgtttgt

SEQ ID NO: 103882 - DNA, 651 bp, Homo sapiens
  misc_feature (501)..(501): n is a, c, g, or t
gagcttccatgtcctcaggacatatcaccttcccagcacattgctgcgcatcaccaactaggaatctcactcagacatcagtgtccaaagtttttgttggagtttcattaactattatgactgattgaattattggccacatgatgtgattgaacttaatctccaacctcctcctctcccaagagttcaaactgatatcacgtgtctcagagccctaattctctacatggttggtctttctggcatggccggtatcatcctgaaactatctcgggggcccaccatgagtcacctggttaaacagaaactcacgtgtgatcagcgagatctaccatgcaggacaaagacacttgcagaaactccagcctgggcaacaacagtgaaactctctctctcaaaaaaagaaagtcatccacttaaagcatagatatagtgtgtcagaatcaaaccatagatttaaccttaacaattgctgtatttaagaactatgttgaggctcantggtgtggtcccagcactcaagaggccccaagccaggggatcttttaaccccagaatatgagacaacctgctagcctgggcacattggcaaaatccatctccaccaaaaaacaaaaccgaccaaaaaccttgttgaggccaaaacagggc

SEQ ID NO: 103883 - DNA, 504 bp, Homo sapiens
aatcatgaaaggttattagatttttatcatatgctttttcatatgttgaattggtcttgcattcctgggataaatcacatgtagtcatggagtagaatccttttaatatgcctctgtatgctgatggttggaattttgtgtttgttttcagaagggatgttggtcttttcttgtgatatccttgccaggctttagtattaggatgtctcgaggagactattgtgattgatgtagggactgtactggcattcaaagtttcaggcttttatccaccacactctttattctatcttagatttgtctggtttcgtaggtctaattgttgggcgtcaagctattccttccacctgaaaccgttttcttactctcccagatgcatttgtcaaaagtctatcaagactcatatcgaaggccactagttctgggagaacagttctagctctttaactggaagcaatcacattagtcttgggctcccatagaacgttatacagagcttcctta

SEQ ID NO: 103884 - DNA, 732 bp, Homo sapiens
tctttatgtagtttggatattaacctgttattagatgtatgatttgcaaatattttctttcattgccttggttgtgttttcactctgttggttgtttgctttgatggatagatgtttttaagtttgatgtagtccagtttgtctgtttttgtttctgttgcctatgtttttgatgtcatatctcaaagtcattatttaagcatagattcccatatgtaaaattagtaagtctcaaagatatttgggggtggagatactagtaatagtagtaataagcccagatattttggagttgtttgataagtctggccagattgccttcagcacacagtcatcaattcaatctccagtctgaaatgtctggaattgcctatttcacatcaccagtgccagcactgggcactgacatttaagtttcttttctgctaaattgacaggttaaaagtaaagattggctgggcatggttgctcacgcctgtaatcccagcactttgggaggctgaggtgggcggatcacaaggtcaggagtttgagaccagcctggccaatatggcaaaaccccatctctactaaaaatacaaaaattagctcagtgtggtggtgggcgcctgtagtcccagctacttgggaggctgaggcaggagaatcacttgaacccgggaggcggaggttatagtgagctggattgcgccactgcacttcagcctgggccacagagcaagactctgattg

SEQ ID NO: 103885 - DNA, 1197 bp, Homo sapiens
  misc_feature (1029)..(1029): n is a, c, g, or t
caggaaggggagtaagaacctagggtacagtgtcccccatgggaaagcagtgcttaccctcttggatgtagcttgggaccacagtaacagaagtatttacagtttgatttttgtaacaggagaaatcatattttcctctaagttgagacacattcttccatcttcctaccttacaccctcccccattcctggcagctctgaaacacttgctcaagccttgcttaatatagcaaaagcagctaatctgttgatcatctgaggtcagaactaacattcagaaagttctcctaagggtttgggtcttcattccaagtcagtcatcctacccaggagaccacacctcacccaccttcatgcactccacactccaatcccacacaccttgctccccactccccccccacacaaaccctaaaccctaagcagaatgacattaagataataatttgtaattgcaatacacacagcaggcattcaaaaatggaagaagaaaggaaaagctgcagaaaaatctttaagtactccacaaactgcacaagccacagacgattgaataatcaagctgactttcctagggaaaatagcattgctattaaaacaagctgagtcatcaaatattaggcagttataaacaaacttctacatcatccagtctagtgggtctggcaaacataccctatggaccaagtccaacctggctggcctggtttttggtaaattaactgtcatcaggcataactcacacccatttgtttacctgctatctgtaaacagaagtttcagcgaatagttccctcttttaaaagcagagttgaatagttcctgcagagtagtctctgcaggaatgttttggccccacaaagccaaatacatttatgatgtggccctttacagagaaagtctgctgcacctatctaattcatcaaacccattcaaaggtaaggaaactaaggcccaaagtggtgaacctccaacaggaggcaaagtcagaataagaagctcaggtctctcagtaaacagccctttgtntcgttcggtgcccggctctacaaattatttattgcttgagtatgaagttaatctgaacttcagtttcttcatgtataaaatgagattacaatgctgatcctcttcccagcattaatgaccatttttggagaattcttagagttcggggaaagctcagttctttctgcc

SEQ ID NO: 103886 - DNA, 298 bp, Homo sapiens
tggggggggaaacactatgttgcagtttttgctgggaaatgagtgttaagcattttgtttggtactcggaaaatctgccttgacagtccttcataataaaaccaattatcaggggtgctattacatataaacttccggaccccaatttaaataaaagggggggatcattttttttgtaaaatagtctccataacacttaaaatcaaccatttgtgaaaacctacatgcttatcaaggggacaacatgggactgaaaatacttgttacctaaataaatacttctgaggctgggatgatt

SEQ ID NO: 103887 - DNA, 429 bp, Homo sapiens
aagttttgggggtggttatagtgaccaactcagtgggctcctttctgaggcaggctctgatttttactttcctggagggatttttttggtgccccacaccatgggacaggctgaactagaccatggtactttctgttctgtctccttagatgacttgcacacgtgctcttgaaaaattattcagaaaccaccaggagaaagcagatcctttgggtatttgggaaaactgcttggaattgtctctgaaatttcagcatgttcccttcgcctttcctccttccaccaccattggcaaaggctctctcatttcactaatgagaggagatgaatgctttggtgaaggccatagcaggcagagcaggcaaggaaggggcagagagccccttagaagtgacttcggcattgggtatagagcacaggatttcttcc

SEQ ID NO: 103888 - DNA, 412 bp, Homo sapiens
ttaagaataggttgaaaacacagggccttgttcattaggatagacaaaaactgacttaaaagtaatagcttatagtataatttgagagcaacgaattttttttttacttgtgcagttgatgagtaatttttcatcacttggatgaagaacaggtttacatttgtcatggtccaggttgcccttttggtaccctgcagaagaaacagagtgtgcacacacagaaagtaaccaccgaacattttgtgagagaaccctgagaatcttgtggtcagcctgaacctttcactttgtttagcctgcttggcccttgtgaactgacactgcctgcttctcccaggctcgtgtcttaatgctctcccctcactccacgctccagccagctgtcttccactctgttccttgcattccgccc

SEQ ID NO: 103889 - DNA, 632 bp, Homo sapiens
gccctaagcacctcgacttgccgccccgggccaggtcggcggggttcgtgcaggggctccgtggggccgcgtcgggcaggggccgcccgggcccgagcacggcacccacaaacaggctggcgtcccgcgacggagacccgggtccggcccggagccgcccgggaggcttgaggccaagggcctggcccagcgcgcggccggagcgggtcgggggcgcagagctgtgcggcggcgccttccgggccccgggcctgtgcagggccggcttccccttgcggggcgaggctgcgggccgggctgcggtgcggggttccaacaaaggaccgaggccccagaagcggcccccacgcgtcctttgtttctgcgtggaacaaactttacacacgtgtgtgttttccgagggtttcccgtgtgctgagcgcttgcaaagcggagtcgcgcccggggagacgcgaagccggtgcccgcggctcacccagggaccccagccagacagcggcacccgcggggcgcgtgcgggacccccaggcgaccgggggaagcaccggtaaccgccccccacccgtgctttttctctcacggagaatgttcccgcgcgttcgttgtgcaactaaaaattaatgtgaaacatc

SEQ ID NO: 103890 - DNA, 359 bp, Homo sapiens
atgcaataggaagggagagatgattatggaactgtagtcactggagaatagtgtgcagtagaggtggggatgggttactctgtgcagacagaatgggatttgaacaggcagaataggacagatgacagatgagaagaaattaggaaaggtacagaacttcctttttcctctatcactcattcattcaacaacttttacggaaagtctacagtaagctaggcactaggcttaggctgagcgggaactacaaagaaaaaaggacacaaatcatgtcctcaaggagattatagtctggcaatgaagaaaaacgtgttataaataaccgtaatacaatgcagatgtaatatgggtcaaaagag

SEQ ID NO: 103891 - DNA, 336 bp, Homo sapiens
gcttattgtagacccaggatactcctataattatgaaaaatgtttctttaatttgacttaatccagagttttctatggaatatctattaacatcttaagaactagtgttctgtaaatcaaggtttgtgacatgttgggttaaatattattgtttctgtgactaatttctttggacattcctaacatcatagctttgcattaagagaagaggagatatgtataaaccaatgcacaccttgaataatcaatttattcttcaaattttccaggaaattcaaccacaatcacgttatttcacagatcatgtcaagaatatagtcaactctcatttctcat

SEQ ID NO: 103892 - DNA, 207 bp, Homo sapiens
gggggtgctgggggctcaggaaggggatgggagtttgtgtttcatggggacagagtgtcagttctgtaagaggaaaaggttctggagatggatggttgggacagctgtacagcagtgtgaacatatgtaataaaacagaactggacactgacagttaaaatcatatatattgatgtataattttgatgctacatgttttacataatt

SEQ ID NO: 103893 - DNA, 506 bp, Homo sapiens
ttttgactcccatgtgtatgctccacctgcatggctccagccctgcccactccgctgaacttcagcccattgaacatccctcaaacggctccaataccccagaaatctgcagtggaagtcatcggcccctcgcctccaagtccttttacttcctatttcccatctcaggcagtggccaaggacagatgcctactcattcattctccctcctcttttctgcactccccagctcacactggctctgtgttttgtctctttacccggttcttattcctccttaaagatttggctccaaggtggttttgcagaaccccaggtggaagagagctcacctagtggcctgcacagaactctaccttactacctcttacgagatgacattgaagcacctgtctatgactgtccttcaaactacaccccccaaccccagggcccaccggactctaagtgcttcaacgacacgggctttttgttgggtttttgtacccactaagcctagcacactg

SEQ ID NO: 103894 - DNA, 710 bp, Homo sapiens
aatcattggcctaaatatagtataactatagggaaaaaaagcccctttatctttgctattatttacttatttatttatttattgtagaatatttggagttttttttatcttattggatgtggctctcatccttgctaacctaattttcactgatagcaaagtttatattcctttggattatcattctattttttctagctattgccttattttttctcatgaatggtcttcttcgagtatttgtagaagggtaagtttgattattttcataatgcataaagctattttgtacttttataagaagcactttgtgagactgaggcaggaggatcaggaggtcaggagttcaagaccactgcacccagcctaaatcattgtcttataaagatacatgcatgcatgcatagacatggaatcaatctaaatgccatcaatgatagattggataatgaaaatgtggtacatagagagaatgggacatctggcttccgagcagaaacctttgtagtgccagcgatgaaagagataattaaatacgggtgatgttgagaaaggcaagaagatttttgttcagaagtgtgcccagtgccacaccgtggaaagggaggcaagcacaagactgggcctaatctccatggtctcttcaggcaggagacaggtcaggccattggattctcttacacagatgccaataagaacaaaggcatcac

SEQ ID NO: 103895 - DNA, 489 bp, Homo sapiens
ccagccatcatccaatatatattttaggcagctaactctgatagcattggttaaggtgacctaaagtgacaagtgtactgatgcagaagtaccagttagaaagcagtgggcatagtacaggtgaggatatctgagggttgcattgtaagtattgattgtctgagggcttgatgttttctaagtgtggagcctgtttgtgaatgttttaggggaacgagcttcctgaaagcacagccatcttacttttcttgtctaaaaaaaaaatgctaagtccttttttactcttactggatccagttttgaactaaatttataaattagcaatcactgcttcttagaacagcagtgactggcattgagatcacttgtcaatgcctgctggccccacagcctgacagctattgtctacggaatagtcctgggttctagtcttggctgaggctgtgatttattatctgatcttgagccggcccctttcccatcctaggc

SEQ ID NO: 103896 - DNA, 787 bp, Homo sapiens
tgtgatgtatgtggcaaagactttaatcagaagcgataccttgcacaccatcgtagatgtcacactggtgagaaaccttacatgtgtaataaatgtggcaaggtttttaataaaaaagcataccttgcacgtcattatagacgtcatactggagaaaaaccttacaagtgtaatgagtgtggcaagacgttcagtgacaagtcagccctcttagttcacaagacaattcatactggagagaaaccttacaagtgtaatgaatgtggcaaggtttttaatcaacaatcaaaccttgcacgtcatcatagagttcatactggagagaaaccttaccaatgtaaagaatgtgacaaagttttcagtcgcaaatcataccttgaaagacataggagaattcacactggtgagaaaccatacaaatgtaaggtttgtgacaaggctttcagacatgattcacacctggcacagcatattgtaattcacactagagagaaaccttacaagtgtaatgagtgtggcaaaacgtttggtgaaaattcagccctcttagttcacaagacaattcatactggagagaaaccttacaagtgtaatgaatgtggcaaggttttcaatcaacaatcaaaccttgcacgtcatcatagacttcatactggagagaaaccttacaaatgtaaagaatgtgacaaagttttcagtcgcaaatcacaccttgaaagacataggagaattcacactggtgagaaaccatacaaatgtaaggtttgtgacaaggctttcagacgtg

SEQ ID NO: 103897 - DNA, 379 bp, Homo sapiens
agcgccactcttggaaagaagagttgcctgcatagcgctttgggaggcttaggtgggaggataacttaggagtttgagaccagtctggggaacatagtgagactctacctctatttttaatgtttaaaaatttaaaaaagtaactccagatcacggctcaaccattttactgcagtaacttgctagccccaacccagtttgttatattaaaacatcctggctttctccctcattcactgactcacccctttctttacattgtaatgagtcctccagcagaggtctgtctttcataccaaagaagggaataccaaaggtacactaaaggcttttacccattgattctaagccaggcaccatactatgtagtttacatgta

SEQ ID NO: 103898 - DNA, 300 bp, Homo sapiens
gtaggtgatggaggtggaggtggggctggcattgtgggtggcatgagggactcctgtagtcctggctggccaggaggcacaagactggagccagcccacttaagtataggcctaacctttcataaacggtatctcaaaggatgagtccttaatcactttggattcagttttctcccctgttactgagaataatgatcaattctaccctactacgtaggactgtcctagcaattgaataggagaatgtgtgttttcaggattcccttgtggagaaaccccagccctctctataattctgcc

SEQ ID NO: 103899 - DNA, 162 bp, Homo sapiens
tgttgaaagaactatcaggggaaaggaagaagagaagacagaccagcatggatgcaaaatcagggacttcaagggatttccagatccatctgagatgagagtttcataataatcctgccacacttcctagcaaagctccctttctgccactctcagaagcag

SEQ ID NO: 103900 - DNA, 218 bp, Homo sapiens
tatgtaaaggacttaacccaattaaaattgaacacaggatttgaatagttactttggcaaagaagatatgcggatcacaaacttgcgagaagatgattagtcattaggggaatgcaacttaaaaccataaggagataccactacatatgcactagaatggctaaaagtgttgactgggggccaggcgcggtggcttattcctgtaattccagcacttc

SEQ ID NO: 103901 - DNA, 488 bp, Homo sapiens
taacggtgataggaggattgacaggagggagggagtattggctgagcgcaagagagtgttgactgtgcgagaagaggcctggctggccccagggatgaggcttcacaaacaagcgcatcattaggagagtcgcagctgcagaggctgcagaggtcccagcagatccccgtgcccgtctccctgctgctccctgtacgtgggtgcggcacccaccacgagcaatgagccagtgtctacacagcgcagctactgaagtccacgcttgattccggcttccttggttcccctcatgccttttcctgcccagccctctgggttgggacagtttcccgtttttgacgccctgggcagtcctgagtggggcgcccctcgagtggtctgcctggggtgggggttgtaagaggccgggtgcctgctcagacctttccggcaccgcgaggaggccctggcgttttgttccaagtgcttggttatctgggccctcccac

SEQ ID NO: 103902 - DNA, 152 bp, Homo sapiens
ggccaacctgcctggaacccctggagcagagcgcagaagaccagacactgcgccaaaaacgcgcccgcatcttatctttaagctggctccatcttctcaactgcaccagcagctagtgccccagccacctatccacctaagacgagcccaag

SEQ ID NO: 103903 - DNA, 348 bp, Homo sapiens
atttgcttagttttttttttttttttttggacagagtctcgcactgtcacccagctggagtgcaatggcacgacctccgcctcccaggttcatgcgattctcctgcctcagcctcccgagtagctggggttacaggattacaggtgcacatcaccatacctggctaatttattgtatttttagtagatatgaggtttcactatgttggccagactggtctcgaactcctgaactcgtgatccgcccacctcggcaacccaaagtgcatttgcttaattttttaacagctccacagtgaagttacctcaaatcagtaaaagccctatcaattctaatccatttattttc

SEQ ID NO: 103904 - DNA, 381 bp, Homo sapiens
tggaccaggggcaattctctttgtataatgtggattattgtttatgttcctatcttgtttccctgttagactgtgagctggagagtttgcacttttatgtgtcgttctaacactctcagtccttacagttcactgaacccagcagccagtcaaaaatctttgccactgttgaattgtaatgctgtacgttcaggggaatacattgctatttattaaatgaaggagaactttcaaatttaagaagagattgttttgcatgctgaagacagtaggtattataaaatacttaaatgggagcctttcccaccccagaacaacctacttagcattagataaatttactatttaaagtagccaaagaccacttctagaaatagaacc

SEQ ID NO: 103905 - DNA, 276 bp, Homo sapiens
gaacccttgacctcaggtgatccacccaccttggcctcccaaagtgctgggattacaggcatgagccacctcacctggtctaaaactaaaattttttcaataacaaatagattgatgggttgagtcacgtatctatttaccatagatttccctaggtttgggggactgaaatatgaattagaagttgtccttaccctcagtgagcttagttagtctattaaaggagattgataggaggacagattttttagcaatttagtatgataatattttatc

SEQ ID NO: 103906 - DNA, 476 bp, Homo sapiens
ctgcttctttcccccagccctaacctattccatgtctctgtggatttgtctgtcctgaagttgcagttgtactttgtgtgaatggaatcacgcgatatgtggtcctttgtggctggcttctttcactcggcctaatgttttcaagattcatctatgttgtagcatgcatcgatacttcattcctttttgttttcaaataatattccattatataaatggaacgcatttgatttgtgggttcagctgttgacgggtacttgggttgcctctgcttcttggctatgatgcataacactgctatgaccattcctgccatggttttgtgtgtaagagggggtctatatgatggaaattcagtccatggccaccctgaccaaatccctggttatccaggaggatggagccctcactccgaagtcaggaaggtctccgagtttagttccggggcctggatggcttcattgtcattttcacca

SEQ ID NO: 103907 - DNA, 305 bp, Homo sapiens
atattggctttgggaccagaaaaggccatgctcattcccacgtaacagctcttttaaaatgaaggcagctcttttgtccatctgaattgcttctcttccaggccacgcttctcttgtccctcagctgttctttattagagaggctttgaggacttttattactctgagagcctcatcagaatgtttctctctgctgctatttctcattggagtctatgacaaaccactcgactgcctcatgactacattgacaccatagcaatccatcatacatctcaaacaataatcacaggtaacagaggtcc

SEQ ID NO: 103908 - DNA, 411 bp, Homo sapiens
tcctatctctggtatcctcactttgcaacctttctgctgtagagtagtatacaaggccaggtttttcatctaggctcttcctacagattgcttacatttggagaatgacttctttccctattggctaggtgagttggcaagttgatttaaggacttgcgcctgtaagatgagtaaaataacagcaacttctcacagatatttttgaagattaagtgaactagtatataggaaactcttagtaagaattaaatgttagccatctaatctctaaattcaggttttatcatatcttacacttgctgaaaaacataccgacgactattgtgtattgtatcatcaattaagtatttttctgcctgatgttctaagcttgcttcctaactctaaccccatgttaacttctaatcttt

SEQ ID NO: 103909 - DNA, 386 bp, Homo sapiens
tgctggtgctttgcacggtgttggtgccgaaggcagaggctgcggaggagggcaggtgctggaggactggccatcccattgcttgaggagtgctgtgggcgccacattttgaggatctctagatagatcccaaagcctgtcctttccttaaggagtccttccttgttcaactggtgacatctgcagagactatctccaaagcgtctcatccacgggaactttgccattggccctggcattggtggctgcttagaatagcagaccctgtcctgttcccgccagggcagtggtgggcggggccgcctgaacacacctggaggcggaatgcatggggcactgctggtgcactgcgtgttagtccattcttgtgtttctgtaaaggaata

SEQ ID NO: 103910 - DNA, 218 bp, Homo sapiens
aagaggtgggagaaattgtgagaaggtgaaaggagttctgaggaggcgggaggagttctgaggaggtgggaggagctctgaagaggaatcctgaggagccaggaggaattctgaggaagtgaaaggattctgaggatggaggaggagttctgaggaaggaggaggagttctgaggagggaggaggaattctgaggaggtgggaagagttctgaggagg

SEQ ID NO: 103911 - DNA, 418 bp, Homo sapiens
cctttaacaagatagctgtggggatgtatacagtgacatttgaaatgctttgggggtacttttaataaaagcacaagtggactttgatgtatgtagtccatgtgcttctgaaaagttgaggtgacacaaaaccacattgtgaacaaaacagtagagccacccattgaaagaaactcaaatgttgatccctttggaaacatgaataaccgtctttttgtgttgcaaattccgttctcataatgtatgttatttatgtaaagtaggatagatttatgctaaaaaaaaatcaaggattttttttgggtgtacgatttaaaatctgacttgagagaatttaccaaacagaactggaaagccatttcttattcagaagatatttaagtttgaaatagtaggagtacacccttctcctaaaaaa

SEQ ID NO: 103912 - DNA, 104 bp, Homo sapiens
ttggctggaaacttgattttggacctttgtgttgaggaatgggggcttgcctgggatctggtggcctcgttatggggcatctgagctggtttgcttgttcccag

SEQ ID NO: 103913 - DNA, 2109 bp, Homo sapiens
tggaatcaccaagaatttgagcaggaggcatcataaaatgaagctgttcttcaggaagattagaatggtcatggtatgtgggatagacaggcccagtctttctgggacttactacctaacgagggactgaacttactggaccctttgcctacatatgagaaactggaatagctccatggggaaggggcaaagtacacatacttacagtgtcagggttgaaaggctttcttagtgcacacctgggctcccccaccccgctccatcttataaatgaagaagctgaggcccagagaggtcacttgcccaaagtcacacagtagttgagccaggttcacagcaaggccccttcatttccaatccataactctccttattcctgcaagtagctgcctttcaggctctgtagaaactatgccctttccacaggaaatacaggactttcctgctcaatccagtcacatacacacctacactcccatccccagtgcatcagcagcagaggaaacacatctctctagggctactggattagttcacactcgaagccactggtatctggcatggctagaagggaaagctgctagatgaaatctatttatcagagaaaggaaggctagaacatttttcaacagctcaggtcctgttctctacaagcgatactggcacataagccagggaggggagacgaggttggggcagtaaaagctcggaactgggttgttagaaaactggaatcttctgattcttgttctgttaacttcctaggtgtccttgggcaaatgagttttcctctctggatctcattttcttcatatataaaatgagatggttaaatttgatcagttcctcaaactttgtaccataaagaatatctctttattatatttcctcccaaactctgctatcaaactgtagtttaagtgatcatctgttgtggtccttttgtaggtatagatatgattttgttatttttgaaatgctggaaaacactggaattcctaggtccctccctttagtgacaaacaattggtgactctagagctctagggcctcctccaggactgaaaggatgattcatgggaccctcaagcccctaagataccattggtcaaaagggactttatagagtctctaggccagccctctgatttgacaaattgagattgaggctggagagcaaaggaaagtgcaggctcccggatcacatcctggagtcagggctgcactgcaagagcactcaggtctcttctccttgctgggtgcattcaccattgtaccctgctgtcctcaccgactttggtccttcaatttgctttaactgtcaagaacgaaccctcagacctttcctgccttctctgattctccacacctgctcatctgacctttacgtcctgcctgcccatctgggcctggctggacttctgctctgcctctggacacctgcctgtgctcctaaggctctccagcatccctagggagttaatgccagctctgccaaacgacctctgtcctgctgcagcccacgctctggcatggcaccaagacatgtggggccctacctttccagcatgtgggggagttacacagacaccacacagatgccaggacagcctgtggcagactcccagagccctgggacagccaacacaataatggcagccagttcccaggctctcgttgggtctcagggagctcaccccaccctcctctccagcagtccctgtctgctcaaggtagtgagcttggcatctaacccatagctccctggaaacttagattaaatcacagccacacagtcaccaattaaacaaatgtaacatctgataagggctgttacctctacacatagacaaaagaatgaatttgggagctgggggtgctgttggcaattaataggaagatatgtccattatagccactcatccaatgaatcaagaaagatttcttggaaaaaaatgggattccagatccatttgagtaatgtgtccctatgcctatcactcctggaaattaaatgatttaatttaactctggtgcacttatctccaaaaacccagaaagactcacggaatttcagatagactggcagcaataaacggtggtgccatt

SEQ ID NO: 103914 - DNA, 252 bp, Homo sapiens
tgcaaatatcaaacctgcattcataagttaaagtgttgtgatatttaatacatcagttgatgtttttaataaataaggctctctgcagcttttctgttatgaatcacagtcttcaacattcatccgaacgatggatattcggcatgccttaagttcaagttttttgttctcttatagccaagtggctacaaaataatagtatcaatctacttcaaaggcagtctgatagagtgtaaaagggcttcacttggg

SEQ ID NO: 103915 - DNA, 244 bp, Homo sapiens
agatgcagtttctgtgaaatcaaatctatcgtttatttttaaaagtgtgaagggagttgagggtaaaagggcaaaacccagcagtcctgggaacagacacacttctcatgggttcttccaagttggattcctaaacagcataatctttggtatacactttgactaagaaaaatattctagtacaacaacgctggtaactcaactgtaggattcatcagtgatttggtgggcagcaaaatcccct

SEQ ID NO: 103916 - DNA, 196 bp, Homo sapiens
gctatcctcagaccatcatcacctttctcttgggcagttggacagcacctcggtggtttcctgacttcatcctcacctggccctgatactcctccccttagcagccagatgaatctttccagaaggctatcctcagaccatcatcacctttctcttgggcagttggacagcacctcggtggtttcctgacttcatc

SEQ ID NO: 103917 - DNA, 710 bp, Homo sapiens
agtgtttcacattggagacatctgctaatataaatgggaggttttactgtcaagtccaattagcaaaacgtggtaataatttttttgtcagtattttcagattacatgataaaattttacatttgagcttctagcattgattaatataggatattgaccacgtttatgtttaaatttcattttgttcagcagacaaaatgtacttcccttaactttcattaatagtgtttacatcttttgtcagcacagcaaacttttagaaagtaatagttttacttatttttatcttctgttttctctttgtactgctttgtcttgcattgtgttccaacacatgagacttactgctcactgaattttggagtcttttagaggtaaattgtggactcaggattttttgaaacttggtgtgtaactctaaatcttgtatatgcatctttgttgcttattacatatttacacacacaaccacaaattttaaacttatgatgaaaatttacaataacctgaaagatccagagatgtatgagagcattttgtaacttgttattcagttactaaatttgaggtgaataattaaaaagaaaaggacattaggagagtgaaaatcttctcttcaaataatctttgatagataaaaatggaaggtaagatgtttctagatagaatgttttcatacaatttcagcttcatatcataaatttttctgg

SEQ ID NO: 103918 - DNA, 283 bp, Homo sapiens
tgtttgttttggagagacagggtttcaccgtaggatggccacactggcctcagactcctgacctcaagtgatccacctgccttggtctcccaaagtactgggattataggcatgggccactgcgcctggcctcaagtaatcttttgttaagaaaagatgtaatacattctgctgtcagaattgtagcttttctttaataaattcagtactagaaaaaataagtagttcttaaaattattatacaatggagtcactgctgtgagatttatttaaataatattag

SEQ ID NO: 103919 - DNA, 739 bp, Homo sapiens
gtcactgtgcccagccacacgtaaaattttaaaacacgtgcatggctgtggacactcctgccagagctgtggtctagctcctgggaagtaacatccaaccttccacccctcaccccttccattggtgtccttaaagtcctgcacagtttgtagccagggtactggcattgattgcttaccttggactcatcctaggttgtcttttctgacttgttcctatcttggctggatttaggataagaggaggggagaagaagtgttgggaggcagcaggatagggcctgggcattgcttaaactgggagtaagggacattcctttcttctacttgtacattttgtgtaattggaagatttggagatcttttgtctccaaatgaatcactcccacatctggtgggcccatgagaaaaagaaatgttggatctagcttcattcccattgtggggaaggaagtggaatcacagaaaggcaggaggattatacatgctcctgcttgtggaccaaccatatgaatagagaaggtgaggaatcctttggtgttcacaatgggcaggagtcaaggaggcagaggatatacataataggatatatagaaagagaatctcatactgtgcctccccagtggtcggccaaccacttacctttagttctctctggccaagtgtcttgtccactgtggacctatcattcttgtgatagtccgacccctggccttcaccccactcagaggtcctgggc

SEQ ID NO: 103920 - DNA, 282 bp, Homo sapiens
agaaacagcagtttccaaaaactcgatttttagaaggaccaaggcagaatgcattttgtgaaaatcaccttctcaatttacattgttgaggtctcattatagaaggaaaagagcaccagggagctggcttttcagaaaaataaaatggaatcttcagaggaaaggatagggccaggcacggtggctgaggcctgtaatctcagcactttgggaggccaaggcaggcggatcacttaaggtcaggagttcaagtccagcctggccaacatggtgaaaccttgt

SEQ ID NO: 103921 - DNA, 459 bp, Homo sapiens
gaaaatgagctcatctccttggtagttatgaatatcaaatgctgcaacttataacagtggctgtaagactttagtcagcataaaaatcatctggaaagcttgtgaaaaaatgcaggattctaggtcccacccccagggagtctgatctaatagctctagagcagggcccaggaatctgcattttgaaaaaaacatctgaggtgaatctcataccgttggatcatgctttgagaaacacagatacagaaactgcaaagataagttactacttttaagtgcagtggacgtaatagttcaatagcctatttgtggtactaactagatgctggctgcatgaataaatgccagtggcttcctggaggtgattcatccaagatcagcttcagaacagatgaatcatatacagcccggcattgccattacgtgacttccctctccaatgccagctccgtaacctct

SEQ ID NO: 103922 - DNA, 252 bp, Homo sapiens
aaatgaactcccatgacttccatctttctgtatttcagaactccgcctggctaagcatgaggaggcagccaaaagggcagaaaacactgcgtgtaaactgctgtgtgtaattagctcctaagtaatcagggtgtacttccagaggaagtggcccactggaaggtgtttggcagtgtacaaagggcctgggttctagctctcactgggtgtgagctatgtgaccacctgcagcacaccttaagtccctaagct

SEQ ID NO: 103923 - DNA, 316 bp, Homo sapiens
gtagttttaatggttttaatttggtcaaaattattgaacagttttaatacgaaattatgttctcgtaggaaattggtaaaaccagaattaaaatagtgttttatagtagaaaaggtattggctggaagccgagagacctgatgtgatcctggctctcccaatacctttctgacgtcactgtgggccttttagtttcttcatctataaaataagattctttttaaatccaagattctacatcttggcaattatattcaccctctgcataatgatgtttcagtcaatgatcgagtgcatatgactatggtccaataat

SEQ ID NO: 103924 - DNA, 282 bp, Homo sapiens
gtgccctgacagccctgagtctgtttccaggcggtgagcaaggtgggattgagaacttgccccaggatacccgtctcccagctgcaaaataaaagggcttggtttttcccctgcctgtggagtctgcacaccagatttgtgccttcccccaagttctggccagagggcttcttgccctgttcaagagcattttctctttgtcacagtttgctctgtccaagtgtggacagatcaagatttgtagccctgtgaccaaggcagaaagggcctggtaacactggt

SEQ ID NO: 103925 - DNA, 260 bp, Homo sapiens
ggaggaggagagagaccgggagggcgcccgggaggcagggcgcgcgcacactccgagggacgcagcgagcgcagagccgccgccgggcgcccccctgccgccccatgctgtgctccatggcgaactcgggctgcctcctgctgtccaactccggcagcatgctcccgcactccgtgccctgcccgcccgccttcctctacctccaacagagcgatcaggacgccacggctccgcctgaagcgatggcccagccctacccc

SEQ ID NO: 103926 - DNA, 159 bp, Homo sapiens
gtagtacttgaaacttcaaaaataacattatacgataaaacacatgttatttctttgttatcttaaaatagcaacaaattctatatacgtagaaagacctatgtagaaaaaaaatgaacattctagcctggacaacatagcaagaccccatcttaaaaa

SEQ ID NO: 103927 - DNA, 462 bp, Homo sapiens
ccatgttggccaggctggtcttgaactcctgacctcaagtgatccggctgccttggcctcccaaaatgctgggattacagatgtgagccaccatgtctggccctcatgttgagcttcgaccataacttgggtgtgccctgggaatggcaaagacataggaagtgggtgctggtcgctgctttgaaagggtctaaagccgagttcctcctcaccttcgaggacttgttggattctatggtgcttgctcctaagctccgagcaggctgcagcacaggggacctgcacgtagaatgtttttgtttgtaggttagatactcctactaccttctttctatacttattttattacttgctgagtttaacttcacaaatagttcccttgtgcctgcttatctgatttcttgcagagatcagaggcagcaagtatgggcataaactcagcgagttctaacctcctagctc

SEQ ID NO: 103928 - DNA, 429 bp, Homo sapiens
  misc_feature (312)..(312): n is a, c, g, or t
  misc_feature (325)..(325): n is a, c, g, or t
tggctctggaacttctctacactgtctacaagttaaaaataagctgatgttccaggagagtacggttggatcctgagagtaagacctggtagaataaacagtatcgtcagtgttctcagattccttgaaagcaggaactaggtgatattcttttttttttttctgagacagtttcactttgttgcccaggctgaagtgcagtggcatgatcttagctcactgcctgccgggttcaagcaattcttgtgcctcagctacccgggaggctgaggcgggagaatcgtctgaacccggaaggcggaggttgcagtnagccgagattgtntcactgcactccagcctgagtgacagcatgacactctgtctcaaaaaaccaacaacaacagcaccaaaaaattgggtttggctttgtatttctgtcactttact

SEQ ID NO: 103929 - DNA, 544 bp, Homo sapiens
agatgtctcattttccctactgaaggcatttgctgtggctttcatggcaaaatgcttgcacctagaagactctagagataattgtgggccagtattaaatcttaagactttggttttacaacataaatatctactttggagaaggagataatataattgaaaggagctagaggaatgtataatgtttacccattaacactatccctttatttaacagccccatgggggaaattccctttataccccaggagcccatgtcttaccaggtaagaagcccagattgaactggagggacattcttccagtcctcttagtaacataaactcctgggatgtggtccaagtttgacctgtcattaaaaattccatactccagtgggttagaagctagattccaatgaaggcggttggttttgtttttctatttacaaccattcttagtcacattcttctctgggcttttgttgtatactttaaaaaaactgtttgatgtgcaatttgttacctgtaactttctaaatgaataaaagaagattgaaaaaata

SEQ ID NO: 103930 - DNA, 303 bp, Homo sapiens
agaaccgcctggaaagggggatcagttggcaggtgggtgagtggatgaatgaggagtccacacgactttttccatggtttttgcatgtgtccagaggttgccctagaaacctcatacttgagagtgttgaggcctggaaggataaacaggagtctaccaagtagatgagaggaggggagaagaaggatcttctcagcaaaggacagaaagagcaaaagcacagaaaaatgcaagtgtgttatttgttcaagaaaaggcaagcagttcagtgtagctggggcctagggtacaagctgagagggc

SEQ ID NO: 103931 - DNA, 322 bp, Homo sapiens
ggtataattaatgctatcttttcataaggacactgagattcagagaggttgagcaaatttcttaaagtcttttagcaagtgagaggcaggatagatatttggaccccactctccctggttcttatacctactctcttaatcagtttgctgtcttcatcctcctggttgctaaagccaagctgtagcccttgtcatgggtacattgtctgcatttaggaggactaggctccctcaggacttgggtagctttcttggtctatcatagtccacatagccagtttcattagctaaagagggcatttgctctgtaataaatgtgccc

SEQ ID NO: 103932 - DNA, 660 bp, Homo sapiens
tttactggctactgttctttcagagaaagaaagtttgagaaggaaaatatttcagttctctcaagttatcttagtgatcacttaaatttgaataagacaatgaaaatcattgaccagcaacaaataagtatcaataaacatttaggaatcaaaaaaagggcttgccagtcaggatttgcaccattagataaagagccacaacttaaaaatccatgtataatatattgattgattaaattctcttaggcccatatagaacacactaaaattttggaagaaagaaacaaataaataaaataaatgcctttgctgtcttaatacatttaacaaatatgtgtggaatagctattaagtgctggcaatatggcaggcactggagataacaatgatgaacagaaattgacttgtcctcatggagagtacatcctagcagaagaatcaggtattattcaaatgataactcaagcaaatgtgaaatttcaaatgggatacatgttgtaaggaaggcagctagtaggaatatttgacctagagaagggcaaggaaagctctccctgaggaggtcaacaatgagctgaaatctaacatgaatggaagtgaactaagcaaagagcaggaagaaaaagctaacagcttgtacacagcttgcttggtaagaac

SEQ ID NO: 103933 - DNA, 413 bp, Homo sapiens
cctccttagcctcccaaagtgctgggattacaggtgtgagccacctcgcctggccggaatggggaaatttgaccccccagaaagaaaagagaacagagtaagtaggagggtcccagactgcagtgcagctctcagatgattttggccaaactgacccaagtccccattagaatctggcaggaagtgaccttattatcccatagtcgctgtctgggcgtagccctcaggaagcacggtcttattgtaaatgtggtggtggtagattcagaggacagcagttgaggttctcagtcaattacacctgcagcaggagatccgagtggggtctttccacagttgtcatcatcccactggtttcaaaacagctccattcattcactgaggggctgaccacccgggatgtttctgtggca

SEQ ID NO: 103934 - DNA, 606 bp, Homo sapiens
taattttttttagtacagacagggttttgccacattggccaggctggtctcaaactcctgacctcagacgatacacttgcctcggcctcccaaaatgctaggattacaggcacgagccaccttgacccagcctaatatagtaatttttattatgcataaaaagttataaagtaaatatgcctcatgggacatcgttgtttcatttttatatgaaataaaataactttctatttttacatggaaatcagaattcatatgtctcacgtgtttttggtgttgttatccacaggagaccaatcattttgcaatggcaatccctaatgatctattccctaatcaactggaaatacttccaaatcagttaataaacttctttcaatgtttaaagtttgaaatatccaagttggggttaaagggaaagctcatgtttagttgtcagtgtatctcagcagcacatcatgggaatatttatttgtattgttgggaacatgttttctttcctgttatgtgctggaggagttggctcatgggttgcaggaccaaaacctgaaaatatctctgactgtgtgtcaccagaccacacaatgaatacatcacttaggttag

SEQ ID NO: 103935 - DNA, 89 bp, Homo sapiens
cagaaagccaaaaagactagatgaggaaataccatcattgtgtggaatattctggattgggagtggagtgctcagctaccctgcaccag

SEQ ID NO: 103936 - DNA, 345 bp, Homo sapiens
aaggtagaggagagagataataactttgtgtaactttgtcagtcagtctgaataatgccagcatttcatgtcctcatacagtgatgatggcgacatacagggtagtaactccctcttctatttttttaaagaaggaatgcctttggggtattaatggagaatatgccttgataagtacagtaagatgtgttattaggtattaggatataccagccttccagtgagaagacttagtaataaatgagtagcattttaatgataacatttaatgtttctacttaaataatatatgcagacaatgtaacgagtcaaacagaaaagatcacgaagaaaagcaagagccat

SEQ ID NO: 103937 - DNA, 318 bp, Homo sapiens
aagaaacaccagcactgttattagtgtgtggaggtagcagagaacagaatggactgctcggagaaggaaagagaagccacaatgaggggaaaccatagactggtcttctttgtaattttcattgagaagcactttttgcaccacagttagtctgtattcagagtacttagcttactaaggcaagctggcaggtaccagttttgagaatgagttcacacaaatgttattacgttaaatgggacaaaggagaacttaaaagtaatacctagccaggcacagtggctcacacctgtaatctcagtgctttgagaggctaag

SEQ ID NO: 103938 - DNA, 298 bp, Homo sapiens
agcattacatcttacagctggagaataatctcctttgactccatgtcctgcatcatgggcacacgggtgcagggttgggcctccaaggcctcaagtggttccaccccgtggctttactatgctcagtccatatgtcagcccttgtaggttacagttgggtgcctgtggctttcgcaggttggacctgcatgctggtggtatagttctgggatctcagcagcattcctgctcccacagctccattaggcattactttagtggggactctgctgcggccttgcttctggctgcactaggc

SEQ ID NO: 103939 - DNA, 974 bp, Homo sapiens
tttttttttttttttttggcttatagtccattttgaaaatgtggtagacattttaaaacatagtgcacatcagcatgtaacctcaaaatctggcatgcaaattcagaggttcacaaaatctctgcagcccacccactgtagccttcccagagttaagagcacctggcctgtgctacatggattggtgaaatattagaaaagatgagagaaaatcagtatgagcataaattttatcttctttttggtgagtactttgaaagaaaattaggacctaatcccctagtttaagtgaaagaggtaatttggttgctacatgatagagattcattgaaggagaaagaagtagacagtagacaaagttgttgttcaaagtataatcaagagtcaggcatccaattgaggtctgaacaatagcttttattcatgttctctcaccagtctgtgttacatgaagctttaatgatatttgatgattgaattcattttttaaaatagctgcattgcagaaaagtggtttgctattaaaatattacgtaccttaggagactgaggtggaaggattacttgagcccaggagtttaagacaagcctgggcaacatagcaagaccctgtctctaaaaataataataataataactgagcatggtggcttccgcctgtggtccctgctacgtgggaggctgaggcagaaggatcacttgatgccatgaggtggaggctgccgtgaggcgtggtggtgccatggccctccagcctgggtaacaaagcaaaacctgcctcttaaaaaagaaaaaattacgtacttgagtttggatcatacagattaatgaaagaactacaaaagatttttactgcttaattctgtatttggggtctcttcatttttaaaaataataaagcaatttgctttatcttacattggggttttatattcccaattatttcaccttaattttacaatttttactatatg

SEQ ID NO: 103940 - DNA, 475 bp, Homo sapiens
tttttttttttttttttggcttatagtccattttgaaaatgtggtagacattttaaaacatagtgcacatcagcatgtaacctcaaaatctggcatgcaaattcagaggttcacaaaatctctgcagcccacccactgtagccttcccagagttaagagcacctggcctgtgctacatggattggtgaaatattagaaaagatgagagaaaatcagtatgagcataaattttatcttctttttggtgagtactttgaaagaaaattaggacctaatcccctagtttaagtgaaagaggtaatttggttgctacatgatagagattcattgaaggagaaagaagtagacagtagacaaagttgttgttcaaagtataatcaagagtcaggcatccaattgaggtctgaacaatagcttttattcatgttctctcaccagtctgtgttacatattacgtggggtcctctaggtcgac

SEQ ID NO: 103941 - DNA, 648 bp, Homo sapiens
tttttttttaacaaagaagtacacactaaatcttttttaaatttttaaaaatattttaatatttttaaaatttttaaaaaattttttttcttgctatgttgcccaggctgaactcgaacacctggcatcaagcaatcctcctacctcaacagtagctgaggcaggagaatggcttgcacctgggaggtggaggttgcagtgagcagagattgcaccactgtactacaacctggaagacagagtgagactctgtctcaaaataaataaataaataaatatataaataaaaattaaaattaaaaaatggctttacaaatggtttatatccttacataattaccacttaaaatactgaaccaatgcacaaaaatagatgagagctaaaatttattgagtgcttactatgtattaatcactatgctaagcattttacatgtattatttaatactcacaagaactctattaaataggtaccattaccatccttattttatagtgaggagtcagatttaccaagaggttaaataattggctcaagggcatacagctggagccaaaatttgaacttaagatgcctaaatcaagagcctgttggagtaagcactttactataattgtctccaaagcttggttttggtatagaaagc

SEQ ID NO: 103942 - DNA, 279 bp, Homo sapiens
aaagcaagttacagaagaatacctgctctatatttttatggacataaaatttaatatagcaaaattagatggtttattgcttagggatacatatatatgtgacgaggagagtataaagaaaagcaaaggaggccgggcacagtggctcatacctataatcctagcactttgagaggccgaggtgggtggatcacttgaggtcgagaccagcctaggcaacatggtgaaaccctgtctctataaaaaataccaaaattagccaggtgtggtggcgcatgc

SEQ ID NO: 103943 - DNA, 174 bp, Homo sapiens
caaggtcatacagccaaaaaacaaagaacgctgcagccaggatcaaaaccccagtctgactccaattgctattctacctataacactgacaactgattgtcaagcactgtaaaaccagcctcttgatataactttagacacatccagggatccattccactttagagtgctata

SEQ ID NO: 103944 - DNA, 431 bp, Homo sapiens
ttgtcttgaactgactgactcatgccagccctacagaagtgccttttacatattggagcaacagtgtgttggcttggctgttgacatggatgaaattgaaaagtaccaagaagtggaagaagaccaagacccatcatgccccaggctcagcagggagctgctggctgagaaagagcctgaagtcttgcaggacccactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggtaactgagcaattgtgaacagctacttctgtgttgacatctggagacttctggttcaggga

SEQ ID NO: 103945 - DNA, 309 bp, Homo sapiens
gagctcagaattagacctagataaatgtagtcaactaatctttgacaaaggagcaaaggcaatacaataaacaatagatagactttgaacaaatggcactggagcaactggacattcacatacaaaaacatgaatcttaagacatagaccttacactcttcataaaagtaaacccaatataaattatagacctaaatgtaaaatgtaaaaatataaaacttctagaatataacacaggagaaaacctaggttaacatgaatatggtgatgactttttagatacaacaccaaaggcatgacctatgaggg

SEQ ID NO: 103946 - DNA, 494 bp, Homo sapiens
attaaaagtcgttcgacaacattaataactgttcaaatcatcatacaatcctattgtttaattgtctttataaacttgagatattgccttctttagggcatctttttagaattctgtcccagtttctgacttgttcagcagtttcactaatataacaaattgaccatgtagcttaccttacacaaattaaaatacaaatttttgaggttggttgtggtggctcacgcctgtaatcccagcactttgggaggccaaggcggtcagatcatgaggtcaggagatcaagaccatcctggccaacatggtaaaaccctgtctctactaaaaatacaaaaattagtcagatgtggtggtgcgtgcctgtaatcccagctacttgggaggctgaggcagtagaatatcttgaaccagggagttggaggttgcagtgagtggagatcgtgctctgccctccagcctgggtaacagtgagactctgtctcaaagaaagaaaa

SEQ ID NO: 103947 - DNA, 263 bp, Homo sapiens
tgtaggttgggcctggtgggaggtgatttaatcacaaacgggaggttggtaggggtggaagggaaaacaaatgggtaggatgaggaggagtaggctggcagtagggtagtgagaggttcgtgggcagtagtaagggggagtagcctgctgcagaggcaaagcctcaaggaaaacctccaccagggcagtgcacctatggctttgcagggtgtagcccccatggctgccctcataggctgggctgttgttgagtgcctgtagct

SEQ ID NO: 103948 - DNA, 291 bp, Homo sapiens
ctgtgagcttataattgctttgaaatttttgtctgctgtatctagtatcttcaatactcagaggcaatttctattgactgcatttttttcttgagtacgagtcacactcctgtttctttgtaggtcttataatttttttgttaagaactgggcattttagataatatagcagctgtggattctgatcctcccaaattgctgttgttacttttttgtctgttcattgctctttgtttagtaacatgtttgtcaaacctgtgaaatctttttcctgtggtttgtggccattaa

SEQ ID NO: 103949 - DNA, 429 bp, Homo sapiens
ctaaaatgcatgtgaccaggctcacactgattattgtctatattaagcacctgctgcatacaaagttctgtgcaatgcagggttaagcagcagaaacctttgttagagggctgcagaagacagtggtcattaaagatatgaagggattggcattagaggtcccctgggagcagtggaaagcctctggtgcaggggttggtgagcctgggaaagatttctggacagtgggactcagataagaccaggtttgacactctgccactataaagatccagacagagggtttttctctatacagtgagtgcaccagtcctaaaggaaactactccagggaagtcacagggggtgagtgggcagttctcatcccatagcaagcagtagtttctgggcagaggcataacatgataggagcagtattttaaaaaagat

SEQ ID NO: 103950 - DNA, 200 bp, Homo sapiens
ggctacttttgctcccacccccagccagccctcctgggacaggtgtgaaggctccagtgccctgacagcatgtcttgaggtgatgtgaggcagccctgaggcagcctctcacagctgagcagaggagtgggtccacccttcaaccctccccagcaccaggctgactgtactgtgggagctggcccacatgaggctgacag

SEQ ID NO: 103951 - DNA, 325 bp, Homo sapiens
agtggaacccttcctttacccaaagaaagttttcatgaaatgattttgtgtgtgtgacagcttcccaggtgcatagtccttcctcagtactgtagtgctgttctgggaggcactgcttctagaattccactgccggcatctcaccacccacttgctatgctggacctggaaggagaaatgaggttttcaggccatgccaggcagctagctgtttccaggggagagttaaaaatatttgagctcacttactgctctttgtttattagtggactcagccctttttctgagtaaatacagaccccgtcttagtcctaagacacctcag

SEQ ID NO: 103952 - DNA, 525 bp, Homo sapiens
gcctgaagaaagctgctgatggggctgctgagccaggcgttgtggggcagatgatcgaggcagctgaagagcgcccgtggactgtaagtaggctgaccgttgatcattgttggctggataaggaacttgatggttttttaaaatgcgcgtgatacaatagttctctctttaaaacccaagcacagctcatacataaattgagagtgttctctagaagacattaaaaatagtgcattttaggccgggagcggtggctcacgcctgtaatcccagcactttgggaggtgagcagattgcctgactttaggattttgagatcagcctgggcaacatggtgaaaccctgtctctattttttaaaaaagcaaaaaatttagccaggcgtggtggcgggaatctgtaaccccagctacttgggaggccgaggcaccagaatcacttgaacccaggaggcagaggttgcagtgagcccacattgtgccactgtgctccagcctgggcgacagagtgagactctgtctccaaa

SEQ ID NO: 103953 - DNA, 1409 bp, Homo sapiens
tagaagacatcaaagtgctgttttacagcaagggttggcagactgtttctgtgaagggccagacagtgaaggttttagagtctgcagggcaggcagtcgctgtcgcagctcctcagcaccaccactgcagctataaatgtatgggcatggctgggttcctataaaactttatttacaaaaacaggcctctggtgggatttggtcggtgggtggaggggtgtagcttgccccagttctggagggatgtggccaaagtgttctgtgaggacgctgtagtgaccctaaggagaggcacccaactccatcagggctcagggaaggcttcctggagggggtggcgcctgaatgagcatgagctggccgagacgaagagcagcctggctgaacgggtcgggtctcacaacacggtgctcatgaggaacgctcttaatgtgcacactgtcctgtgtctctgcagagcctgctcgctcagcacaaagactttggagcagcttttgagcccctgcagaggaagctcttggacctccaggtcagggtccaagccgagaaggggcttcagcgggaccttcctggaaaacaggcccagctctcaaggttgcaggtgaggggtctgtgaggcctgaatcactcctgcccaggtgctcagctgcacctggaagcagcgtctccctctagcagtaaccagcaaagcaacagctgccgtgagccagaaatttagacccttagttgagatctgacctttcacctcaacagaacctctgcttatttatctgatggttcctgacctcaaacaactgagtcttgagctcagcaaaatgacaaactgtctttctgtttactcctcagttccaaagtctaacattggtatttgtttttagaattgctttgctaagtattcttaatgagtccagaggtgttcagttaaaccaactttgggattaagaataaatgttctgaaacgtggactgtaagtaggctgaccgttgatcattgttggctggataaggaacttgatggttttttaaaatgcgcgtgatacaatagttctctctttaaaacccaagcacagctcatacataaattgagagtgttctctagaagacattaaaaatagtgcattttaggccgggagcggtggctcacgcctgtaatcccagcactttgggaggtgagcagattgcctgactttaggattttgagatcagcctgggcaacatggtgaaaccctgtctctattttttaaaaaagcaaaaaatttagccaggcgtggtggcgggaatctgtaaccccagctacttgggaggccgaggcaccagaatcacttgaacccaggaggcagaggttgcagtgagcccacattgtgccactgtgctccagcctgggcgacagagtgagactctgtctccaaa

SEQ ID NO: 103954 - DNA, 228 bp, Homo sapiens
aaaatgcgcgtgatacaatagttctctctttaaaacccaagcacagctcatacataaattgagagtgttctctagaagacattaaaaatagtgcattttaggccgggagcggtggctcacgcctgtaatcccagcactttgggaggtgagcagattgcctgactttaggattttgagatcagcctgggcaacatggtgaaaccctgtctctacttaaaataaaaaatt

SEQ ID NO: 103955 - DNA, 714 bp, Homo sapiens
gatggagggttgaatgccaaaacttcgtaatcgtagaaaattctggaaagccgccggcggggcaaggccacgaggatcctcctcgcagcaccgcgccgcgcggggcccaggggccgcgctcacgcccgccgctcggcgcagacacgagtgcccccgacttgagccgaacctctagccgatgccggcgccgccgccgccggggatgcgtaagccgactgggaagcgagggggggaggcggcctgcgcggcaccgcccgacctggccgcggcgggctgagccccaggttccggaggaatgctcgctccccgctggagtcctaccagcccaacacggacctgagccgcgaccacgcgggctgcagcctgcagcacatcagctacccggagaacgcggacgcggaagcaccgctgctcagcacccccgaagaaacacggaatccagagaggcacaggcaccgccccggcgcgcacagctgcactcagcggcttccttcctactacatacatacataggagtgggagccgaggaccacttgttgcttgcggacttcctctagcataaaagatggaaagaaaacacacaccgaagcaagggaccaaaggaacagaaaagaaacgcagagatcataggaaaactgcaaagaaatacttgataatatcttccaaacgattagagaagacataacattcattaagaatacacatatagatgta

SEQ ID NO: 103956 - DNA, 390 bp, Homo sapiens
tgtggcggccgcagtaacgcaaacctgagggctcctccgctgcggagcggcgggcgggcgcggaggccgagggcgagcggggcagccgcccgctcgtcgccgctgaccccgagcccggccgcggtttccgccccctgccgtggcgggcgggcctcccctgcgctaccccctcgcccgcgcccgccagcgcccgaggccggggagaaaggggagcagcgggagccggggactaccggagatgggagcacgcctcctgctgctgtcgtccagccccaggttccggaggaatgctcgctccccgctggagtcctaccagcccaacacggacctgagccgcgaccacgcgggctgcagcctgcagcacatcagctacccggagaacgcggacgc

SEQ ID NO: 103957 - DNA, 467 bp, Homo sapiens
gacatactcatcccacttagttgagagaagagatttctagtttgggttacagttgcccaaccttccctttaaagagaatccagtcatgttttcaatggtaaaaagccttaaaaagctgcccttcgaagatctcctatgactgcatgtcaaggtattttgtacctacaatcccagaacttggttccttccccatgaggactaacaaatgttcacaacaatcatgatcaagtgtgcactggaagaaaaaatccacaatctgggcttctcacttcgtgcttcataaatgacaatcactgcttgatgcagatgttgcactgtatccactcagggatgtttccttaaaaaaaaaaaatacatcaagaaggaggaaaaaattaaaaacaggaaaatgacaacaaaatgtgaatggtataaattaaatatgttgctgagagcacctctctgacaaggctttcagaccaacaagc

SEQ ID NO: 103958 - DNA, 923 bp, Homo sapiens
  misc_feature (359)..(359): n is a, c, g, or t
  misc_feature (458)..(458): n is a, c, g, or t
  misc_feature (464)..(464): n is a, c, g, or t
  misc_feature (481)..(481): n is a, c, g, or t
  misc_feature (484)..(484): n is a, c, g, or t
  misc_feature (568)..(568): n is a, c, g, or t
  misc_feature (781)..(781): n is a, c, g, or t
  misc_feature (784)..(784): n is a, c, g, or t
  misc_feature (787)..(788): n is a, c, g, or t
  misc_feature (805)..(805): n is a, c, g, or t
  misc_feature (811)..(812): n is a, c, g, or t
  misc_feature (819)..(819): n is a, c, g, or t
gtggaaccactgttcaaagctagatatttgtatgtttgcgggggagggtaatggccccctgcatttttcacccacatttaaaatcaaaagctatattatgaggagttggactgttctgtcaaaggcaaaacaaaaataatatagaaggcctaggttttgcatagtcttcttttttttaagagttggggtcttgccgtgttgcccaggctggtctgaaactcctgggctcaactgatcctcccgcctcagcctcccaggtgctgggattactggagtgagccatcgggcctggccagattttgcatagtaaaacagtgaaacagatagagttgtatttaaggtcagtattctaggcctcncttcaactgcagtcataccatcatagaagatagttctatgtcatcctgttatctggacattataataaacaacaagccctctatacacaggttccaaancccgtnatctagacattatcaanaanaagccctctctctatacagagtttccaaattctgaagctgatagcgcacttggtctcactgagcctccctccccgccctcctgntgctcctcagacatctgggctgcagacacattgcagttacagcacatacacttctagctcggaaaagcctagtttcttgtatttctttcaggtaactgccagtttctgtggctgaatttaagcacttacagcatcttcctagctgggtgttggtggctcacaactgtaatctcagcactttgggagggtgaggcgggcagatcacctgaagtnggnagnntgagaccagcctgaacnacatgnngaaaccngtctctacctaaaattccaaaattaggttgggcgtgggtggtgcattgctctggtatccaggtactccgggagagtgaagggggagaattgcttggaacccagg

SEQ ID NO: 103959 - DNA, 328 bp, Homo sapiens
tgtagagacaggggtttcaccatgttgattaggctggtcttgaactcctggcctgaagtgatccacccctctaggccacccaaagtgctgggattacaggcatgagccactgcgccccgccagtttctgtattttgatagtagccatcataatgggtgtgaagcagcatctcattgtggttttgatttgcatttccctaaccatgagtgaattgtgtgtttattggtgaattatgactattttaaatcaatctggatcattcttattttctccttgaatgttgtttctctgattctctgtattttctctcttctcttcctatatcaaa

SEQ ID NO: 103960 - DNA, 304 bp, Homo sapiens
gcacgttgtaggatacttgaaccaggagtcaagagcagcctggaacattagagacactatctctacaaaaagcaaaagtgagccaccgcgcccgaccttattgtctcttaaagcctttcatttaaagttctaaatattgtcttgtaacataaacagcagtatttttgctgccaaatttccttacaagtctcctgtttgggggatgtgttcttactggctttttattagttaatcctgtccctgtatggattattttgaatagttcatagcccaattgctttttatcatttccataaattctatc

SEQ ID NO: 103961 - DNA, 1491 bp, Homo sapiens
ccgatgcgagtatacattcgaatgactgactattggagggaggtggtgtgttcacgtgagcctacatccgagggtgctcttcgtaaggggtagttgttgttttatagctccaaatggtttttttattctcagtgtagcaactgtttgatttttttttggatacagctgtatgaacacttttctattttatactgaaatcacacaggtttgtgatctaagtgccagaaccatggaggagactctggccttatctgtagggacctaaattttttaagtgctatgaacactgatcaagtagttgtggagagatgagaagaatatatgcagcaaaggtgctgtgagcccagttccaacggctgtgttctggtaatcgtgcagaacagcatgtgggctctgggccttggcaggtgcacagacgggcgggcgtcacgtgtgttcagagcttgtctccacctcacggctctgtgctcttctgtgtgctgcgttgtggccgtgaagtgggagctctcctttccaaaggcagagcttactgtcatggctcagatgttcactcgcatcttcaccccaaacttccctgaattgcagtgatttctgttataaggcacatagcaagcctgtaccactctacagtaaaatctctacactaacagtttaaagcccgaaagctgaagcattcagcctctgcaagtgtagactactggactgtagtagaggcatttggaatacttacaaagtcaagtgctgtggcttcagttcccccggctccccacccctgacatccatacttatgttgtctggaagagccatggacacatcattattttcagcaaccagctgcagtgaaactccatttacagcaaccccatagtataaaaccacaatgcctcattgtaatgggatattgaagttcattgaagaattactaggttgccatgtggctcacttatttaaaaaaaaaaaaaaaaactcacccgttttcctgggatttgttgtaaggagttttcactggcctcactcagaccaatttctgcttcaaaaagcactgaatgtgacctgttgcattcagttgtagcatcaaatccacacctagtcattgcttgaggggccaaattgtgttctgtcccatgcacgctctatttggtgttaaaatggaaccttacggttgtgttttaagtattcattgaaaccagcttcagaaaacaagatgccatagtaaattgagaataacattttttccttcttcagggtggctgtaattccaggtggccgtgatttctttcttccccactgcccactccttcgccaaacccacgtattcagtgttctgatcttgtttgtgcagagtgaactctgatgcagtatcagtcttgtcctgggagccgggtcctgctgctcacaagcccagagctgccagggagctcctggcagtagcacgttgtttagaaagttgggtggcttcattcagcatggaacaagctaatggcacaggag

SEQ ID NO: 103962 - DNA, 434 bp, Homo sapiens
gtaagctaaacaggaaaataacgtatttataagtgtatagacaatgatgctgaagttgattattcacagccttgcttgtggaaagtttaatatcaaatgtataacaatgcagaatgatgcttttgtttttgtttttaataggagcatcttgtttaaaacgtcatttcagaacatcttttctgagtcttgggtgggcacatggggcagggaggctataggagaaggactgtatttgctggataattttcattagtatgaggtaatcttagaaatttcttaagattgttttgaatgtattaatgctgtgcattcaaatttgcccaaatatgtggattttccctttacctataaagcagcaattctaacggaagtcagtatactttatgctactgagcatgagcatgatctctgggcaaaaaatactaattcattat

SEQ ID NO: 103963 - DNA, 918 bp, Homo sapiens
ggattggacaagcttggtctgggggagtgaagaccattcaacatcagctgcaggagagcatgtttaaagctatgagaagagatgcagcaatagtggtggcatttattggagtcaaggaagtcttcccaggaaggggactgaagcctgaaggatgagcaggaatcaatgtagtgaagtgggtgggaggaaccaagtgtggccccagtcagaacttcaggaacaaaggccagaggcaagcggccacatggtggactgcaggagctgaggagttcagcctggctggagtggagagtgcaagtgggtgggtcagaaagatgatgctagaggtggcccaccctggaagagtttgtttcagatacgtcaccctgactccactccagaccgttaatgagacgggggagaaatcagtgaccagatagaaggctctttcagcaaacgggcaagagatcaagtgcctgacctagaggaatggtagtgggaacggcaagaaattgctagctttgcacaatgattaggactagagtggagagattttttggaagaggtaatgattgactgaatgctttagaacatggctcagttcttcctcagctttgctggtctttctgtacaacttggaaagaatgtggtcattgttctggttatatataaatgcttttgtgtaggtgtaagtaggtatatttgttagttttaggagataaggtcttgctctgttgcccaggctggagtgcagtggcaccatatcggttcactgctgcctcgaactccggggtcaagtgatcctccaactcagtgtctgaagagtagggactacacaggtgcatgccaccacacctagataatgtctgtcttatctttttttgcgacaggatctcactttgttgcccaggctggtcacaaactcctggcttcaagcaa

SEQ ID NO: 103964 - DNA, 619 bp, Homo sapiens
gcaaaaaatgtttccaaattctgtatgggctcagtgttggtatatagttaaggtaaaatggtaataatgagattaattctttactcctaactatgtgctttccttagatagtgagcacagtgattttatgtagcaactgttaagtggagtgtctccaacagagttctaattaatatccaaaataaagatgacattattatttatatgcactggatcttattggataatttcttaagtatggtcttcttttccttgtttaataagttgatctagatatttttttcatagtccctattttgctaagtcatcacttctgagagtaatatctgttctgtattatgggcaagcagctgacgaaaccaaataaaagctaagagaattactcttctggtatgtcacaaaaatgaggtccaagttcaggttagttacattcaaggccactgaggattcttatggttattatcatggtatcactgttattaaactttgaagcatcacaaagaattggtgaagagccaaaagactgaagactggcacaattgtttaccatcaccttcaataagggatggaaattggattctggaagccacaaaccagaaagtctggtgtcacatcttaa

SEQ ID NO: 103965 - DNA, 321 bp, Homo sapiens
agacataaatggacagtattgttttatgaatacatcagtaagaaaatactttaacaggaacgggaaattctccaggttcagtgtgagatttccacctataattttcatttggctggcgagactgacttgcgttacttgagttatgctattttaaaagtatttgtcaccagtatgtatcccttctttgatatttttcctcccttctacagtgacttttaaaatccaaatctaatcaagctgccactgaggacatattgttatattaaacatacaaatgtttaagccttattaaatacagactgggtttcagtaaatcagaaa

SEQ ID NO: 103966 - DNA, 418 bp, Homo sapiens
tctttgtttggcttggcagtaaaaagactgaaaagtgtaatggaaagaagccttcgcaataaaatcctccagctaatatttctaatgtagcttcaaagaagaaacacacattcttcataccactcttttagcacggaaggggtagtgttctattaaaccaagtaataggaccacttattaactttaactcataactgataaagagtgaatttgtaatactattgctcaataatcaacacaccagccctagggcaggtggatgagagtacaagtaggaactctgtgcacaggcttctatttcaattactacttctggtaaaatttgaagactaccctagacctcctgtgtctcagctttttctcattcttgcttctcaaaaagcaggacagaaagaggaccagcacatgccaagtcccg

SEQ ID NO: 103967 - DNA, 297 bp, Homo sapiens
caggcattcatttccgtaagcctctctctttcctcctatatggtatgtgatgagtttgggggaaagcatctgcatttaagctctgttctggtggagagagggaagaggtctcagtgtttatcgtctcccatgagttgagtgtgcaggatctgtagccaacaactcttgagttttgagagttccatgtgagcctcactacatgctaagtcagaaccacagggtgagtgaatgctctttctctgctccatctggcttctgtcttcttaacagcatatctgctgtttcacatagctgcat

SEQ ID NO: 103968 - DNA, 562 bp, Homo sapiens
tcgaacatctcatcagacactttctctaaaagaaaacaatactgtctattctgagaaaagacaacatcacagcaccttcaatcccagtgcctttcacaggttcttccaccttccaaatccaataaaatcatcaatcttaaattctgctttttaaatgtccttccaatgcaacccttctccatttcctataccttatgttcctgttttcttcttaatcagtatccttgtccccaacctctactcaacaactcaccccataaaactgtaatctttcttaaaaaaattaatcgccaactctaaaagatcctgaatacatttctacctactccacatcctctcctagctgaactctgttgtgcctctactcctctgcaattatctatttttgcttgtctcccccactcaggttgagttaggaacagtcttgtacctctctgcatcttcaatgattagtaactgcctggttccataagtgtttgccaaatggactgtatgaatgaacttatatgatttgctatgaaagaagggttaagaatctcaaagcatctgaagctatgagaag

SEQ ID NO: 103969 - DNA, 342 bp, Homo sapiens
aaccttcagcttggctcataccttgcccccagagctggtcatccctgagtgctagttcttgagtgctcttcccctactgtcctacctttaggtctcaaacgggtcccatctgtgtactcatcatccatctattcattcatccatttatccatttacctatccaccttccacccatctgctatccaccatccatccatccatccatccatcatctgtccattcatctatcatccatccttctatcgtctgtccatcaatccattcattcaaccaatagccctgggcgtacgcctaaacgctaacattactgcaggccacctactcatgcacctcattggaagc

SEQ ID NO: 103970 - DNA, 233 bp, Homo sapiens
tctgcagcttgttgggtaaataactcttatctgtaatcatgccttggggatttgaagtaaaagttgaagggttagggaagggcagtgtgaatagtaaacacttggtccaggaagagaacatgtaataactttagacagttagataaaagctctctttgcccttcccgctgcaggaagcctgtttgtaggtacacttgccaaaactcacaaaagagaagaattgttttaaagaa

SEQ ID NO: 103971 - DNA, 576 bp, Homo sapiens
taaataaattaaaatataaaaaattatccaggcgtggtggcaggcgtctgtagtcccagcttcttgggaggctgaggcaggacaatggcgtgaacccgggaggcggagcttgcagtgagcggagatcgcgccactgcactccagcccgggcgacagtgtgagattctgtctcaaaaggaaaaaaaaaatttctctaagttataaaaggcaataaatctaaaataatttaagagtagtcttgatgctaatacagcattggaattggaatctgaataaaattgtagtagttgtaaaagttgcacaaaaagaagcaaacctggctcataatacccaattactttaacaatgagaccatcttaaagcccttttagttatttgcatgagtatcagaagtagctattcagaagttttccccaaaatgaactgatttgaaataccacagatgattaaaatttctgtagttgctaatcaccttgttgttttaaataaacatcatctagatgcatgttatccttcagacaaatccctgagggaaacctatgtgctgactataaacgtgttaccatttctgacgta

SEQ ID NO: 103972 - DNA, 413 bp, Homo sapiens
ccaaaactgaccttccccaataaaatgcctaatgaagatagggaagaaggaaagaggcagatttcccagcccaaaaaggccctaagggacccacatcccagactgaactagagatggttccctaaggtaacccaatctcttggggctggggcttgactagaagataaaactatataggaatgaaggcactgaactcttctttataatcctcacactgagatttcttttctatctatataattaatgttgtgtgtatacgtcaaaatactgcaatctctcacattttaatcacacattttaattattctctagctctggatggaacacatctagcactttaaaagtatgtattaaatactgatactgttatagtgtgatttttataaaatatatctaaatacataaatatattg

SEQ ID NO: 103973 - DNA, 144 bp, Homo sapiens
aaacgtagtcctaaatcctggcttcaccttctctgcccatgtgaccttgagcaaccttggaggaggctttcctgtgtcacctcatctgtaacatggagtcagacctacctctcaacaaaaagcccgtaccagatggctttgctg

SEQ ID NO: 103974 - DNA, 185 bp, Homo sapiens
atcattagtggtatggcaggaagaaggtcttgccaaaccctgaattcaaagaagaggaggggtagggtagaggatgtaagaaattgagaaggagccgtgaggtaatggggcaggaggaggaagaaggtgggttctctttccaggacagagccttctgaggatgccagagctgggtgcaggctgtt

SEQ ID NO: 103975 - DNA, 248 bp, Homo sapiens
acagttctagggtccacactgatttgcctgtagaggcctgccagtggcttcagatagtatccctatctgccactgacacttcaagcaccattggatctcctgaaacataaagcccaagtgggagagcagcttgcacagcagcctggacctgttgcagagcctgcttttatcctgggcttaaaactagcagctttttgggtcacttggcaaataggtcagagagtaacacactcaattgaggaatatgt

SEQ ID NO: 103976 - DNA, 472 bp, Homo sapiens
gtgggggtggagacgccctccaggactgacatggctccctgtaaatgtaaacccccaaaccagagactcagttataggatacatatattagggagtttggtatggtgagtgagcacttagggttggggttcaagtcttgtttcggttactctgtgactttggacaagtttcttaacctctctgagcatttaaaaaatctcatctgcaaaatgggaaggtatgatctaatttattaataatttattctttatgaggtctcaagctcctgggattcttctgaggcttcaatgggacaatgaatctaaagcacttagcaaggtgtttggcagagtcagccctccccaaatggctgtttttgttgttgttgcaactagtaaaacagagaaattcacctgagagttcctagggagcttagtctattttctgttgcttataatggaatacctgaacctggaagcccaaggtcaagggg

SEQ ID NO: 103977 - DNA, 2913 bp, Homo sapiens
actctatgtctcctctcgttggattgtgacaccgggaggtcagggaactccaggaccttgttctctgctggattcgcagcaaccagcacagcacgtagggcgtagttggtgctggatggatgtttgttgaatgaatgaatgatgaatggctggcaccttgtctgctcatccctaactcctgttccttcatctgtgcagccctaatctttgtttcctcatctgtccatccctttatttgtgcatcctcattcttagccccttcactgcccttctccatctcttcctccttgttcatttgtccctgttctctgtcctctactccactcatgcccatctctgtccccttgacttacccagtccctgctactatctccatccctaatttctgccctcttgtctgtctactcctaattccttttccttgtccatccctaatacctgtcaccttgtccttcttcctcgaatctccatccctaatccatctgcccctaatctctgtcccctttgcccatccttccttttctcggtgtctctttccacccttatctccacacctgcccaccctgcactcccattctgtttcccatctgcacccttgccccatccctcccacacacaggaccagacggccaccatgtcaggagactacgaggatgacctctgccggcgggcactcatcctggtctcggacctctgtgcgcgggtccgagatgctgacaccaacgacaggtgccaggagttcaatgaccgaatccgaggctatccccggggtccagatgcagacatctccgtgagcctgctgtcggtcatcgtgacattctgtggcattgtccttctgggtgtctctctcttcgtgtcctggaagttgtgctgggtgccctggcgggacaagggaggctcggcagtgggcggtggccccctgcgcaaagacctaggccctggtgtcgggctggcaggcctggtaggcggaggcgggcaccacctggcggctggcctgggtggccatcctctgctgggcggcccacaccaccatgcccatgccgcccaccatccaccctttgctgagctgctggagccaggcagcctggggggttctgacacccctgagccctcctacttggacatggactcgtatccagaggctgcagcagcagcagtggccgctggggtcaaaccgagccaaacatcccctgagctgccctctgaggggggagcaggctctgggttgctcctgctgccccccagtggtgggggcttgcccagtgcccagtcacatcagcaggtcacaagcctggcacccactaccaggtacccagccctgccccgacccctcacccagcagactctgacctcccagccggaccccagcagtgaggagcgcccacctgccctgcccttacccctgcctggaggcgaggaaaaagccaaactcattgggcagattaagccagagctgtaccaggggactggccctggtggccggcggagcggtgggggcccaggctctggagaggcaggcacaggggcaccctgtggccgtatcagcttcgccctgcggtacctctatggctcggaccagctggtggtgaggatcctgcaggccctggacctccctgccaaggactccaacggcttctcagacccctacgtcaagatctacctgctgcctgaccgcaagaaaaagtttcagaccaaggtgcacaggaagaccctgaaccccgtcttcaatgagacgtttcaattctcggtgcccctggccgagctggcccaacgcaaactgcacttcagcgtctatgactttgaccgcttctcgcggcacgacctcatcggccaggtggtgctggacaacctcctggagctggccgagcagccccctgaccgcccgctctggagggacatcgtggagggcggctcggaaaaagcagatcttggggagctcaacttctcactctgctacctccccacggccgggcgcctcaccgtgaccatcatcaaagcctctaacctcaaagcgatggacctcactggcttctcagacccctacgtgaaggcctccctgatcagcgaggggcggcgtctgaagaagcggaaaacctccatcaagaagaacacgctgaaccccacctataatgaggcgctggtgttcgacgtggcccccgagagcgtggagaacgtggggctcagcatcgccgtggtggactacgactgcatcgggcacaacgaggtgatcggcgtgtgccgtgtgggccccgacgctgccgacccgcacggccgcgagcactgggcagagatgctggccaatccccgcaagcccgtggagcactggcatcagctagtggaggaaaagactgtgaccagcttcacaaaaggcagcaaaggactatcagagaaagagaactccgagtgaggggtctggcctaggcccgggatcggaccaggctccctcaggaccccatcctttcctgcccggaccgtgaattcatctccttgaagccataacgtccgagctgctggtgcggggcagccctggccctaggcttcctaaccctggaagcgagaggatgagaggaggccggcccagctccttctttcagggtgggggtcattcagcctccactgtgtctgtcttttcttccctggggctccccctcgaggcgaggggccatgcatgtctgggggacccctgccccccaaaaccctctgtctgtctctgtctctttgctgtttgtccaagactcagtgtcccgacccttgttctcgccgtgaatgtcaatgggccaatcctctctgtcctttcagacacacacacacctgtgtccaccccttctgttcgccacaccctgcgtctggccggtccccccactgctgctgctatcaacgccagaataaacacactctgtgggtctcactcca

SEQ ID NO: 103978 - DNA, 631 bp, Homo sapiens
actctatgtctcctctcgttggattgtgacaccgggaggtcagggaactccaggaccttgttctctgctggattcgcagcaaccagcacagcacgtagggcgtagttggtgctggatggatgtttgttgaatgaatgaatgatgaatggctggcaccttgtctgctcatccctaactcctgttccttcatctgtgcagccctaatctttgtttcctcatctgtccatccctttatttgtgcatcctcattcttagccccttcactgcccttctccatctcttcctccttgttcatttgtccctgttctctgtcctctactccactcatgcccatctctgtccccttgacttacccagtccctgctactatctccatccctaatttctgccctcttgtctgtctactcctaattccttttccttgtccatccctaatacctgtcaccttgtccttcttcctcgaatctccatccctaatccatctgcccctaatctctgtcccctttgcccatccttccttttctcggtgtctctttccacccttatgttcgccacaccctgcgtctggccggtccccccactgctgctgctatcaacgccagaataaacacactctgtgggtctcactcca

SEQ ID NO: 103979 - DNA, 2479 bp, Homo sapiens
ggcgcgcggggctgcggcggcggcggcggcggcagcggcggctccggcccctagatcagacattctctctcattacccggcgcgtgggaacgggtccacagccccttgtccgccctagaacccccatgggctgccgcccgccgccgcctcggctgccacccaggacacggcagagataagcgcaggaccagacggccaccatgtcaggagactacgaggatgacctctgccggcgggcactcatcctggtctcggacctctgtgcgcgggtccgagatgctgacaccaacgacaggtgccaggagttcaatgaccgaatccgaggctatccccggggtccagatgcagacatctccgtgagcctgctgtcggtcatcgtgacattctgtggcattgtccttctgggtgtctctctcttcgtgtcctggaagttgtgctgggtgccctggcgggacaagggaggctcggcagtgggcggtggccccctgcgcaaagacctaggccctggtgtcgggctggcaggcctggtaggcggaggcgggcaccacctggcggctggcctgggtggccatcctctgctgggcggcccacaccaccatgcccatgccgcccaccatccaccctttgctgagctgctggagccaggcagcctggggggttctgacacccctgagccctcctacttggacatggactcgtatccagaggctgcagcagcagcagtggccgctggggtcaaaccgagccaaacatcccctgagctgccctctgaggggggagcaggctctgggttgctcctgctgccccccagtggtgggggcttgcccagtgcccagtcacatcagcaggtcacaagcctggcacccactaccaggtacccagccctgccccgacccctcacccagcagactctgacctcccagccggaccccagcagtgaggagcgcccacctgccctgcccttacccctgcctggaggcgaggaaaaagccaaactcattgggcagattaagccagagctgtaccaggggactggccctggtggccggcggagcggtgggggcccaggctctggagaggcaggcacaggggcaccctgtggccgtatcagcttcgccctgcggtacctctatggctcggaccagctggtggtgaggatcctgcaggccctggacctccctgccaaggactccaacggcttctcagacccctacgtcaagatctacctgctgcctgaccgcaagaaaaagtttcagaccaaggtgcacaggaagaccctgaaccccgtcttcaatgagacgtttcaattctcggtgcccctggccgagctggcccaacgcaaactgcacttcagcgtctatgactttgaccgcttctcgcggcacgacctcatcggccaggtggtgctggacaacctcctggagctggccgagcagccccctgaccgcccgctctggagggacatcgtggagggcggctcggaaaaagcagatcttggggagctcaacttctcactctgctacctccccacggccgggcgcctcaccgtgaccatcatcaaagcctctaacctcaaagcgatggacctcactggcttctcagacccctacgtgaaggcctccctgatcagcgaggggcggcgtctgaagaagcggaaaacctccatcaagaagaacacgctgaaccccacctataatgaggcgctggtgttcgacgtggcccccgagagcgtggagaacgtggggctcagcatcgccgtggtggactacgactgcatcgggcacaacgaggtgatcggcgtgtgccgtgtgggccccgacgctgccgacccgcacggccgcgagcactgggcagagatgctggccaatccccgcaagcccgtggagcactggcatcagctagtggaggaaaagactgtgaccagcttcacaaaaggcagcaaaggactatcagagaaagagaactccgagtgaggggtctggcctaggcccgggatcggaccaggctccctcaggaccccatcctttcctgcccggaccgtgaattcatctccttgaagccataacgtccgagctgctggtgcggggcagccctggccctaggcttcctaaccctggaagcgagaggatgagaggaggccggcccagctccttctttcagggtgggggtcattcagcctccactgtgtctgtcttttcttccctggggctccccctcgaggcgaggggccatgcatgtctgggggacccctgccccccaaaaccctctgtctgtctctgtctctttgctgtttgtccaagactcagtgtcccgacccttgttctcgccgtgaatgtcaatgggccaatcctctctgtcctttcagacacacacacacctgtgtccaccccttctgttcgccacaccctgcgtctggccggtccccccactgctgctgctatcaacgccagaataaacacactctgtgggtctcactcca

SEQ ID NO: 103980 - DNA, 2843 bp, Homo sapiens
ggcgcgcggggctgcggcggcggcggcggcggcagcggcggctccggcccctagatcagacattctctctcattacccggcgcgtgggaacgggtccacagccccttgtccgccctagaacccccatgggctgccgcccgccgccgcctcggctgccacccaggacacggcagagataagcgcagccccttcactgcccttctccatctcttcctccttgttcatttgtccctgttctctgtcctctactccactcatgcccatctctgtccccttgacttacccagtccctgctactatctccatccctaatttctgccctcttgtctgtctactcctaattccttttccttgtccatccctaatacctgtcaccttgtccttcttcctcgaatctccatccctaatccatctgcccctaatctctgtcccctttgcccatccttccttttctcggtgtctctttccacccttatctccacacctgcccaccctgcactcccattctgtttcccatctgcacccttgccccatccctcccacacacaggaccagacggccaccatgtcaggagactacgaggatgacctctgccggcgggcactcatcctggtctcggacctctgtgcgcgggtccgagatgctgacaccaacgacaggtgccaggagttcaatgaccgaatccgaggctatccccggggtccagatgcagacatctccgtgagcctgctgtcggtcatcgtgacattctgtggcattgtccttctgggtgtctctctcttcgtgtcctggaagttgtgctgggtgccctggcgggacaagggaggctcggcagtgggcggtggccccctgcgcaaagacctaggccctggtgtcgggctggcaggcctggtaggcggaggcgggcaccacctggcggctggcctgggtggccatcctctgctgggcggcccacaccaccatgcccatgccgcccaccatccaccctttgctgagctgctggagccaggcagcctggggggttctgacacccctgagccctcctacttggacatggactcgtatccagaggctgcagcagcagcagtggccgctggggtcaaaccgagccaaacatcccctgagctgccctctgaggggggagcaggctctgggttgctcctgctgccccccagtggtgggggcttgcccagtgcccagtcacatcagcaggtcacaagcctggcacccactaccaggtacccagccctgccccgacccctcacccagcagactctgacctcccagccggaccccagcagtgaggagcgcccacctgccctgcccttacccctgcctggaggcgaggaaaaagccaaactcattgggcagattaagccagagctgtaccaggggactggccctggtggccggcggagcggtgggggcccaggctctggagaggcaggcacaggggcaccctgtggccgtatcagcttcgccctgcggtacctctatggctcggaccagctggtggtgaggatcctgcaggccctggacctccctgccaaggactccaacggcttctcagacccctacgtcaagatctacctgctgcctgaccgcaagaaaaagtttcagaccaaggtgcacaggaagaccctgaaccccgtcttcaatgagacgtttcaattctcggtgcccctggccgagctggcccaacgcaaactgcacttcagcgtctatgactttgaccgcttctcgcggcacgacctcatcggccaggtggtgctggacaacctcctggagctggccgagcagccccctgaccgcccgctctggagggacatcgtggagggcggctcggaaaaagcagatcttggggagctcaacttctcactctgctacctccccacggccgggcgcctcaccgtgaccatcatcaaagcctctaacctcaaagcgatggacctcactggcttctcagacccctacgtgaaggcctccctgatcagcgaggggcggcgtctgaagaagcggaaaacctccatcaagaagaacacgctgaaccccacctataatgaggcgctggtgttcgacgtggcccccgagagcgtggagaacgtggggctcagcatcgccgtggtggactacgactgcatcgggcacaacgaggtgatcggcgtgtgccgtgtgggccccgacgctgccgacccgcacggccgcgagcactgggcagagatgctggccaatccccgcaagcccgtggagcactggcatcagctagtggaggaaaagactgtgaccagcttcacaaaaggcagcaaaggactatcagagaaagagaactccgagtgaggggtctggcctaggcccgggatcggaccaggctccctcaggaccccatcctttcctgcccggaccgtgaattcatctccttgaagccataacgtccgagctgctggtgcggggcagccctggccctaggcttcctaaccctggaagcgagaggatgagaggaggccggcccagctccttctttcagggtgggggtcattcagcctccactgtgtctgtcttttcttccctggggctccccctcgaggcgaggggccatgcatgtctgggggacccctgccccccaaaaccctctgtctgtctctgtctctttgctgtttgtccaagactcagtgtcccgacccttgttctcgccgtgaatgtcaatgggccaatcctctctgtcctttcagacacacacacacctgtgtccaccccttctgttcgccacaccctgcgtctggccggtccccccactgctgctgctatcaacgccagaataaacacactctgtgggtctcactcca

SEQ ID NO: 103981 - DNA, 2345 bp, Homo sapiens
ggcgcgcggggctgcggcggcggcggcggcggcagcggcggctccggcccctagatcagacattctctctcattacccggcgcgtgggaacgggtccacagccccttgtccgccctagaacccccatgggctgccgcccgccgccgcctcggctgccacccaggacacggcagagataagcgcaggaccagacggccaccatgtcaggagactacgaggatgacctctgccggcgggcactcatcctggtctcggacctctgtgcgcgggtccgagatgctgacaccaacgacaggtgccaggagttcaatgaccgaatccgaggctatccccggggtccagatgcagacatctccgtgagcctgctgtcggtcatcgtgacattctgtggcattgtccttctgggtgtctctctcttcgtgtcctggaagttgtgctgggtgccctggcgggacaagggaggctcggcagtgggcggtggccccctgcgcaaagacctaggccctggtgtcgggctggcaggcctggtaggcggaggcgggcaccacctggcggctggcctgggtggccatcctctgctgggcggcccacaccaccatgcccatgccgcccaccatccaccctttgctgagctgctggagccaggcagcctggggggttctgacacccctgagccctcctacttggacatggactcgtatccagaggctgcagcagcagcagtggccgctggggtcaaaccgagccaaacatcccctgagctgccctctgaggggggagcaggctctgggttgctcctgctgccccccagtggtgggggcttgcccagtgcccagtcacatcagcaggtcacaagcctggcacccactaccaggtacccagccctgccccgacccctcacccagcagactctgacctcccagccggaccccagcagtgaggagcgcccacctgccctgcccttacccctgcctggaggcgaggaaaaagccaaactcattgggcagattaagccagagctgtaccaggggactggccctggtggccggcggagcggtgggggcccaggctctggagaggcaggcacaggggcaccctgtggccgtatcagcttcgccctgcggtacctctatggctcggaccagctggtggtgaggatcctgcaggccctggacctccctgccaaggactccaacggcttctcagacccctacgtcaagatctacctgctgcctgaccgcaagaaaaagtttcagaccaaggtgcacaggaagaccctgaaccccgtcttcaatgagacgtttcaattctcggtgcccctggccgagctggcccaacgcaaactgcacttcagcgtctatgactttgaccgcttctcgcggcacgacctcatcggccaggtggtgctggacaacctcctggagctggccgagcagccccctgaccgcccgctctggagggacatcgtggagggcggctcggaaaaagcagatcttggggagctcaacttctcactctgctacctccccacggccgggcgcctcaccgtgaccatcatcaaagcctctaacctcaaagcgatggacctcactggcttctcagacccctacgtgaaggcctccctgatcagcgaggggcggcgtctgaagaagcggaaaacctccatcaagaagaacacgctgaaccccacctataatgaggcgctggtgttcgacgtggcccccgagagcgtggagaacgtggggctcagcatcgccgtggtggactacgactgcatcgggcacaacgaggtgatcggcgtgtgccgtgtgggccccgacgctgccgacccgcacggccgcgagcactgggcagagatgctggccaatccccgcaagcccgtggagcactggcatcagctagtggaggtgagtaggggtcccacaccgacccctgacaagcacccgtgcaccctcggccccttcatccatgcaacgaacgccctgcatgttcgtgagtcgcagagccaggcgtcctaggtttcaatccctgctgtgccaactttagctgtgcggcttagagccagttacccaagcgctctgtgcctcaatttacccactaggaaatgggactgttgatagcatcttctgttaggatagaggtgagatgtgctgagttaaacgttctgtaggtggtcgctgctgttgttacccatgaggctaagttgaaaatagagggggctgggcgtgagccaccgcgcctggctattggcttctctctcgggtaggtgtttgcagtggcaatgagatggtcacttggagctccaggtgtataatgctgtatctgttatgataccttcggctgaa

SEQ ID NO: 103982 - DNA, 1652 bp, Homo sapiens
ggcgcgcggggctgcggcggcggcggcggcggcagcggcggctccgggtacccagccctgccccgacccctcacccagcagactctgacctcccagccggaccccagcagtgaggagcgcccacctgccctgcccttacccctgcctggaggcgaggaaaaagccaaactcattgggcagattaagccagagctgtaccaggggactggccctggtggccggcggagcggtgggggcccaggctctggagaggcaggcacaggggcaccctgtggccgtatcagcttcgccctgcggtacctctatggctcggaccagctggtggtgaggatcctgcaggccctggacctccctgccaaggactccaacggcttctcagacccctacgtcaagatctacctgctgcctgaccgcaagaaaaagtttcagaccaaggtgcacaggaagaccctgaaccccgtcttcaatgagacgtttcaattctcggtgcccctggccgagctggcccaacgcaaactgcacttcagcgtctatgactttgaccgcttctcgcggcacgacctcatcggccaggtggtgctggacaacctcctggagctggccgagcagccccctgaccgcccgctctggagggacatcgtggagggcggctcggaaaaagcagatcttggggagctcaacttctcactctgctacctccccacggccgggcgcctcaccgtgaccatcatcaaagcctctaacctcaaagcgatggacctcactggcttctcagacccctacgtgaaggcctccctgatcagcgaggggcggcgtctgaagaagcggaaaacctccatcaagaagaacacgctgaaccccacctataatgaggcgctggtgttcgacgtggcccccgagagcgtggagaacgtggggctcagcatcgccgtggtggactacgactgcatcgggcacaacgaggtgatcggcgtgtgccgtgtgggccccgacgctgccgacccgcacggccgcgagcactgggcagagatgctggccaatccccgcaagcccgtggagcactggcatcagctagtggaggaaaagactgtgaccagcttcacaaaaggcagcaaaggactatcagagaaagagaactccgagtgaggggtctggcctaggcccgggatcggaccaggctccctcaggaccccatcctttcctgcccggaccgtgaattcatctccttgaagccataacgtccgagctgctggtgcggggcagccctggccctaggcttcctaaccctggaagcgagaggatgagaggaggccggcccagctccttctttcagggtgggggtcattcagcctccactgtgtctgtcttttcttccctggggctccccctcgaggcgaggggccatgcatgtctgggggacccctgccccccaaaaccctctgtctgtctctgtctctttgctgtttgtccaagactcagtgtcccgacccttgttctcgccgtgaatgtcaatgggccaatcctctctgtcctttcagacacacacacacctgtgtccaccccttctgttcgccacaccctgcgtctggccggtccccccactgctgctgctatcaacgccagaataaacacactctgtgggtctcactcca

SEQ ID NO: 103983 - DNA, 1115 bp, Homo sapiens
ggaagcctgagccctggatgtcagggtgtaaagcaggaggctccgaccggagagaaaatcagggagagttgaagaggggctgaggcaagatatcgctgaccttttccccaactgcaggaaaaagcagatcttggggagctcaacttctcactctgctacctccccacggccgggcgcctcaccgtgaccatcatcaaagcctctaacctcaaagcgatggacctcactggcttctcagacccctacgtgaaggcctccctgatcagcgaggggcggcgtctgaagaagcggaaaacctccatcaagaagaacacgctgaaccccacctataatgaggcgctggtgttcgacgtggcccccgagagcgtggagaacgtggggctcagcatcgccgtggtggactacgactgcatcgggcacaacgaggtgatcggcgtgtgccgtgtgggccccgacgctgccgacccgcacggccgcgagcactgggcagagatgctggccaatccccgcaagcccgtggagcactggcatcagctagtggaggaaaagactgtgaccagcttcacaaaaggcagcaaaggactatcagagaaagagaactccgagtgaggggtctggcctaggcccgggatcggaccaggctccctcaggaccccatcctttcctgcccggaccgtgaattcatctccttgaagccataacgtccgagctgctggtgcggggcagccctggccctaggcttcctaaccctggaagcgagaggatgagaggaggccggcccagctccttctttcagggtgggggtcattcagcctccactgtgtctgtcttttcttccctggggctccccctcgaggcgaggggccatgcatgtctgggggacccctgccccccaaaaccctctgtctgtctctgtctctttgctgtttgtccaagactcagtgtcccgacccttgttctcgccgtgaatgtcaatgggccaatcctctctgtcctttcagacacacacacacctgtgtccaccccttctgttcgccacaccctgcgtctggccggtccccccactgctgctgctatcaacgccagaataaacacactctgtgggtctcactcca

SEQ ID NO: 103984 - DNA, 562 bp, Homo sapiens
cttctagttccttgtatatattcatgttcctttttctgtatggagttcccctcctccttaccctcctatccatttgaaatcctaccccttgtataatatccaggtcagatgccacattcctcaagttcccacaccatgaattctcatttttcatcagcattgtgtttttatctttaactgtcttatgttagtgtttatgtacatggtttatttcttcttggttttaagcttgttgaaggcaaggactgtgtctcttaccttctttggcatctcttttggtacatgtgatagttgcttagtgtttgttgaatttgtgaatgaattgtggttctacgtgaccatacttatgaattgtttgacctagagtgaattgcctgttaaattaactgtctttaaattataatcttcctagttgctgaagtttttagattgctaaattacaccttttcaaccttaacacagtaatgccacattttctttctggctattattgctagtttgtttatgagcattagttagagttctctgatgaagtgtactcattctgtttaatatcaaaata

SEQ ID NO: 103985 - DNA, 397 bp, Homo sapiens
ggtggttatccagcctcgtgtgctcagaacagtgtgaggtggatgaggcactggtggatgtttgcgtggcaaggatggtgggaccccaggcccatgttcttcccgttacctttctctggtgttaactgttagcatcatttctgctgtttttatacaacaggtgctttttgtatggattcaagtgaaataaaaactagcacggctgtaacttataaacgtgcccccttttgtatctgtagttagaaaggtgcagatagtattaaaagggtagcttacttcagacactctgtctctggatctgaccaccgctcgggaggccagcacacgcagagctggcgtctcatccccagccattggtgatcatcggcgaaggcggagttcaggtccatcgttcctg

SEQ ID NO: 103986 - DNA, 778 bp, Homo sapiens
cttcatgttgattttcctttttcctgtagtctagttcagtaattcagaaaccttactctaccaggctgtgtattacaaaacacatatgcttgatataatggttttaagagattttcaagggacattttgcctatacccaatgtagaacctattctctgatttaagagtcagctccacatattacacatatgtaagcaaactgtacaaacaggtaattttcataaagcacctgtatttacatagctgatattaaaagttacatagttgatcatatagataggtcagtgattcactatgtagtatgtatgctacttttgctacatgattataccttttaatcttttttactctagtaactaggtatttattttaatgcctattggaaaatacactgaataaatcaaagctatattttttggatattattgcttaagacaaggtccaaaaaagctaccatatttgattggctctaatacacgttgatcttgctgatgttggactgtgtcttaaaactggtgtcagatcatagcttactgggtagcatttttttctcagtggtacataaaatggtgtgtcttacaatttatagcatctcatactcagaaataaagtatataatcttaaatttttaattcaatgcaaagaaaaccaactcatatttcatgtatatgtgtgaatatggcaaatatcttgaaggtgttatacaaataactgacatttggcaagcactgaaaatagtctatttttaaacaaaatgctgatcatgctttgtatatag

SEQ ID NO: 103987 - DNA, 904 bp, Homo sapiens
tgcatcaccagataatgagcttcaccacttgtctgcctcctgtgtccttccgcggggagtaaatgtcacttcagcttgccgcatctctaaataggcaaattttcagtgctcagaaaaggacctgatctttgcacaaagtgctttgatggttgcctgcttgagtcactcccaatcccttcctgaagccctttctttataattcttctgttgaaatagccatcatattcacagtactaatcacagcatctcacatttactaaaaacttaccccataccaggaacccagagttgggggggctgtgtcagaattatgtaatttacgtgtcccaataatcctagatgcttcttgaccatctagttttgtcaaatgagaaaactgaggttccaaagaagtcaataaacttgtccaaagtctgaaaaaaaaaaaaaaaaaaaaaaaaaaaaaaaaaaaacacaacaaaaaaaaaaaaaaaaaaaataaaacaaaaaaaaaaaaaaaaaacaaccgaagaagaaccaaggaaaacaaacaagcataacaacaatagaccaaagaggcgcgcgggacggccgaacaaagctctccaaagagcggagacaggccagaacagcatacaaggctggggccccggcagatattgcaacaaaagagagcaagtggcctcgacagtaagatggaccggatacctaactccagaagagcaccgaccggagatgaggagcagaaagtggacgaacagagagaccaagaaattgtgcgagaagtagaactaagactagaggagaaacagcaacaaacggagggtagtctacgcgaaacaaagcagcagaaacaacacgcaacgcagaccggacgagaaactgcagagagagacaaaaagcaaaggagagggggagaagacaa

SEQ ID NO: 103988 - DNA, 634 bp, Homo sapiens
tgcatcaccagataatgagcttcaccacttgtctgcctcctgtgtccttccgcggggagtaaatgtcacttcagcttgccgcatctctaaataggcaaattttcagtgctcagaaaaggacctgatctttgcacaaagtgctttgatggttgcctgcttgagtcactcccaatcccttcctgaagccctttctttataattcttctgttgaaatagccatcatattcacagtactaatcacagcatctcacatttactaaaaacttaccccataccaggaacccagagttgggggggctgtgtcagaattatgtaatttacgtgtcccaataatcctagatgcttcttgaccatctagttttgtcaaatgagaaaactgaggttccaaagaagtcaataaacttgtccaaagtctgaccgactctgcttgccatgtgacgagtctgtcttagaactgggtcattgccctgcttgcaatgctgtgccctctgcaagcccccccacccccctggtctcctgagctcggtaaggtgctccagctgcctctaccatagcacttcctacatggactgtaacatttctttactgctccaacttctcattaaattgggggctcctcaaagccagggttggt

SEQ ID NO: 103989 - DNA, 518 bp, Homo sapiens
  misc_feature (7)..(7): n is a, c, g, or t
  misc_feature (10)..(10): n is a, c, g, or t
ggtagtngtntcacaagtgcagctgctggcataaagagctaaatattcactcccaatcccttcctgaagccctttctttataattcttctgttgaaatagccatcatattcacagtactaatcacagcatctcacatttactaaaaacttaccccataccaggaacccagagttgggggggctgtgtcagaattatgtaatttacgtgtcccaataatcctagatgcttcttgaccatctagttttgtcaaatgagaaaactgaggttccaaagaagtcaataaacttgtccaaagtctgaccgactctgcttgccatgtgacgagtctgtcttagaactgggtcattgccctgcttgcaatgctgtgccctctgcaagcccccccacccccctggtctcctgagctcggtaaggtgctccagctgcctctaccatagcacttcctacatggactgtaacatttctttactgctccaacttctcattaaattgggggctcctcaaagccagggttggt

SEQ ID NO: 103990 - DNA, 835 bp, Homo sapiens
cctgtttacaagatggtgcctgggctgacaggtacccctcgggttctgggtctcaaccctcccctgccagatcctgcacggggaagggcagcagggcctgtgggaggcggtgtgcatccgacaaatcagtgcacacctgctttgtgcctggccccgagctggctgcagagaccctggtccctaccctggggacctcttactgatattaactcagaggatatcctgcctgcaccagcacccagagaagacaggtgcccaggcagcagcgcccatgtcatcatccagaaggggtagagacagggtcacctgaaccttgcaaccactaggcagttacactgtgcgtgggtggagaggagcccccagcagctgctggaatttggagcccggacacctcctggggccttgcttttctcatgcacacaatgggcatgtggaggatagtaatttgggccagcgtgtttccattctagcggggcgcagccatcgcagaccttctttcagaaggctggtgtttaaccccacatgagcccctgcctgccagtggtctccaaaactccaaagcccagatggcgtcctccttccctcccatctggccacgggtggtggggggtctcgaggtcaaagtgcggaggtgcccttctgagaccacccaggaagcgtgcgtcttttccctcttcctcccagctgggccctcctgtgagtcaccatgcggagcagccgcagctggggctctgctccaggccagcgtgccctcgcggggagaagcctataaactcccaggcacctgcagctcatcaggaggaggccgagcggggagcctggtctcatctccctg

SEQ ID NO: 103991 - DNA, 379 bp, Homo sapiens
caaagaatctcaattttacctattttacagatcgtgaaaaagaaatcttaccaactggacatcatggatagtgctgtgatgaataacaaaagattttttaaaaaagggaaaaacaggccaggcgcagtagctcgtgcctgtaatctctgcattttgggaggccgaggcaggtggatcacttgaggtcaggagttcaagaccagcctggccaacatggtgaaaccccatctctactaaaaatacaaaaattaacctggcgtggtggtgcatgcctgtaatcccagctactcgggaggctgacacagaagaatcgcttgaacccaggaggcagaggttgtggtgagctgagattgcgccattgcactccagcctgggcaac

SEQ ID NO: 103992 - DNA, 844 bp, Homo sapiens
aaaggtttaaaggctttatagttcacttaacaaataagaaagctaacctagtaacagattattttctagagtttctagtttctagagttttattttctggtagtttccagactttctgcttttggtgagaatggatagatattactcccaaaatttggaagaattgagtccactgaaatttaaccccttgtttgagaaggctaatgaaaaggttatagacagcaaagaaactattataaatagaataaaaatgtgactcaatactttcatttgattcttttcttcatcttatataattttttaatctttaaagatatttttatctacaactttgtaaccattacacaactttgaagtttcagttatgttaaattgaattatatcattacataaactcatgtaatcatcatgtaaaaagtataaaaacatttgtatacatacaataagtagtccaccaaaatatctacaaatagaaaaatgctctccacattaactatggttgggttgtcagatctactcttcgacttcctttttgctcctaagtgcagctacactacaaagagttgctgtcccatagccatcatcaggtaatcagccatcaaaaggaataattggaatttgtgcactttgtgtctgttctaacttgaagaaaggttcctgtgcttctatgttcctgagcttctttgttctgtcgaagattacaaaaggctaatgtttcaagatcataataaaatccatatataggccgggcgcggtggactcacacctgtaatcccagcactttgggaggctgaggcgagcagatcacaaggtcaggagattgagaccatcctggctaacacgg

SEQ ID NO: 103993 - DNA, 325 bp, Homo sapiens
agagggcgagggcagagcatccttgggcggagatgcctttaaaaaatcatccaccgcagcggtagaaacagttttgtttggctttatttatacggaatggtttttcagtgaaatgctgtcttgcttaaaagaagagatgcctccccaggagctcacccggcgactggccacagtgatcactcatgtcgatgaaattatgcagcaggaagtcagacccctgatggcggtggagataatagaacaacttcacagacaatttgccattctttcaggaggccgaggggaggatggcgcccccatcatcacggtcccagagttttcgggg

SEQ ID NO: 103994 - DNA, 680 bp, Homo sapiens
tcatgtataaacatgaagattttggtgccattgaccaaagtgtggaaagcatgaggaaaagaaactaggtgtgcagacgaggtcgggcatctagagagggagttagcgtgttcaattggaaatatgaactttgaggtgtgcaggctgtaaggcagctagaaagttgggtgtggcgttttgaagttaggtcagctagagaaacaactgagctttgagatcctgctgatcagagaggtgagcgctaaagatagctaagtgtaataccccaggagcatcaacttttaaggtggcattaatttgatttattagcccacagaaaactttttaatgataatgcatcaacagaatgcatacaagagctcatcatttataatatgtgctgggaggaatgtagaaaacaatatatgatttttctggtaaattaattgctgcaatatgtgaaaaaatggtcttcatatgcatgtttttattttgtaacaaaaccaaaaattaccaaaataataatttagaggaatcttttttttgacaagaaaatgtgtcagattttgaaaaaatgcaacatctatcggatgattttaataatactatcactccgtgtgcattattttgcttttttgcttaagtcacatcctcatatttcattagaaaccatattgttgcactggacctctatattgagt

SEQ ID NO: 103995 - DNA, 323 bp, Homo sapiens
ctttctcctctcagctattgattacagtaaatcaagcaagcaaaaaaatacttccttctatatgatccctccccttcccctgctgctttttctttcaatcttagtattagctttaaactctcaatctctcttaaaacattcaggggaagataatcaggaaccagaagccagtggcatagttttactagtgtatgcaaaagacaaatttgacctgcatttcaatgaaagacctaagctttatgtgttattggggacttcatcaagggaatttgaataaggaagggacaaagaaatgaatgaagagatggatatgtcaaaaaaac

SEQ ID NO: 103996 - DNA, 781 bp, Homo sapiens
cattcaaattcagagtgctgacagggtcaaggtctctctgaaggctcaagggaaggatccctccttgcctctctctagcttctggtggttgccagccaccccttggcactccttggctggtagatgcatccctccaatcttggcctccatcctcacatctctttctctctgaatgcatttgtgtctaagtttccctcatcttataatgacaccagtcactgaattagggctcaccataattcagtacgatgacctcatcttaacttgattacatctgcaaagaccttatttccaaatgcggtcacattcacaggtactaggggttaggacttaaacagatattttggggaacacaattcaacctgaacagcctaaaatgatacatttttaaggaaaatattctgataattctcaaaattatatggcaaatactgtaatactgtgctgttttcaaaatgaagcacaaaataaaaacattaagagtatattttaataaaaatgagcatagaaccagcaatttgaattgtattcttctgtttcatttgttattcccattgtagacggcataaactctaatatatgtagagattttgtattagatttttcctcactctcgaactgccccagcacttaatttcaaaagaaattcctggcattttcccactacatatacttttcagctcctttctgaacatcgctgcttagcatcaaaattactttcagccaatttgtaatctcccaggtctcagatggctgaagcagagttccttgggaagtccca

SEQ ID NO: 103997 - DNA, 294 bp, Homo sapiens
  misc_feature (172)..(172): n is a, c, g, or t
gtttgcccaaatacatggttaggctcatcttggacttgtttttgttttatatcttctgttacttctatgcacatattaatagatacctaattaatatttggttggaaatcttaaaagttaggattttttttttctttttttttgagacgccatctcagagagaaaaaaaagnaattacgcgtggtggcccatgcctgtcatcccagctactgaggaggctgaggcaggagaatcgcttgaacatgggaggtggaggttgcagtgagccgagatggcgccactgcactccagctt

SEQ ID NO: 103998 - DNA, 428 bp, Homo sapiens
  misc_feature (378)..(378): n is a, c, g, or t
taaacatggagaaagtgtggatcccagtggagatgggatttgaacccaggtctgtccaagcccagggtctgtgttttgattgtatcagaccaccttctgactatatgccagcccccttgctggaatttgtttctcccaggcaagcaaattctcctttctaccgtctattaatattaaaagagtgcactccccatactgacttttttcagttctctaggcttgtcctgacttccccatttctactactagtagtaacagtgataacagtatcgtatcttcaattttttaaagatagttgttcttgggctgcttttggagaccagcaggctactgaatctcatcatcgaaaggaagcctggcagtacataggacagatgnaaatattgatactccgggaaccccccccgcaactagaccccgcccgcact

SEQ ID NO: 103999 - DNA, 423 bp, Homo sapiens
gggccctgctgatcacaaaattttcctctgcaaggttcccaacatctatccaaagagaaatcttcagtaatgctctgattagaaaaggtgaatgtcattatctgggtactgtccttatctatcatcaacacctagatatctttctcagtttaaaaaaaattaatttaagagctaatcagaattctttgagatagcgatgtataacggaaagaaaactatactgggattctgagctccaattctggttctgccctttgttaactgcataatattgggaagatagttaaaccactatcaatggtggtttgtcatcactaaaatggaaaagtctatatttaactcatataattgatattggactttttagggtcaaaaagtaccatcctaaagtatgatgctttggcatgctgagtactttgaact

SEQ ID NO: 104000 - DNA, 533 bp, Homo sapiens
aacaagcgatcccgggtgactgaagttttaactcagagtccaaatgctgcatagaagagcagctgctggcttcatttatcgtgacgagtaaaataaaacataggaaaacagtcgcagttttaatttaagcataatctaaacttcaacttgatccttgcaatgtagcatcataccttatggagaaacatgaagacaaaggttgtaataaaatttggatgataaaaaaagttggatgacaaagaagatgtggaaagcagaaagaggattggtatgcaaaacccatttaggttctgctgctcacagttctaacctcagagggtggagagatacacagcccatacttcacatagtcagatgctgaaaacaagcatctaggccagtgccatccaacagagctttctgtaatgatggaaacactctgcgtctgcaccgtctaatacaaaagccactgatacgcatgtgccacaaagtccttggcatgtgtgtagtgcaaacaaggaattatttcatttaattttaaacaaatttaaata

SEQ ID NO: 104001 - DNA, 520 bp, Homo sapiens
  misc_feature (21)..(21): n is a, c, g, or t
  misc_feature (25)..(25): n is a, c, g, or t
  misc_feature (59)..(59): n is a, c, g, or t
ttagaggatcccgcgggagcnttancctggcacactgtgctgagcatttcccttgcagnctgtgccacactgtgctgagcgtcttcccctgcagcgtgtgccacactgctgagcgtgtaaccctgcagctgtgtccctgctctgggagagttgagagtggggagcagccaccttggagggccaggtggatggggctgggtgaggctgaactgttccccttacacaggacacagtgacaggcagagggcccagggccatggtaggttgggggtggggtgggagccacagcactgccattggaggtcaccagggtgtccatcccactggcaggcagtttggcggtgaatgcagccccagagagttgtccacaagaccatggggtgagaggctcccatggggttggccaccccacggtgattatgttggcgcgggagccgtgggaaggaacgagagtcttggttcagatgacctcggcctgtgtcctcagctgcacagagctgtgggaacaaacaagaccatc

SEQ ID NO: 104002 - DNA, 1474 bp, Homo sapiens
cctataaaacttctttaagtattgtaattccagtctgccccaactttaaaaaaaattcttattaatatgtcagtcattaattgctagtttgggctctcattatttcctgttttttaacaattttgtgataattttattattggcaaattaatacatcaacacttaaatcattgactataataataccttctggctacctctgtatcaaccaaattctgtaggtgcaaacatataccagggaattcttactggcaaaatgatcaatctggagtgtgcatccactgtgaatggagcaaattgccctatacccattgataacctagctttcttagtttgtagatgtaggaaacaaaatagtgacagagagagaagggggtccacagggcatggtatatttatcagcagtggaaaaaaagtgcatagatcatttagtccaagaacttaaaactaaatagagccataatttactttggagagtcattttaatttgtctttggtaccaaggagaagacggaaccaaaaacaaactctccaagtatattcacacattcaacaaaatttttgcatgccttctatgtcgtaggcatttttagttcctggggatttggacatggctaagtcagagaaggccattgctcaccatgaacactgtataccagaaggagagtggggaggagacaaaaaacaaataagaccacttcagacaatcaaagtatcagttaagagaatgaaaacaggcctgactcagtggctcacgcctgtaatcccagtactttgggaggcggaggttgggggatcacctgaggtcaggagatcgagaccagcctggacaacatggtgaaaacccgtctctactaaaaatacaaaaattaactgggcatggtggcaggcacctgtaatcccagctactggggaagctgaggcaggagaatcgcttgaacctgggaggcggaggttgcagtgagccaagattctgccactgcacttcagcctgggtgacagtgcgagactccatctcaacatcaaaaaaaaaaaaaaaaaagaataaaaacagggtaacataatgcaaagtaactgtgtggaattaaaaattgattattttagaaaatgtgactggcttaggacggggataatatgtgaacagaaatctatctcatgagaaagtgctactgttgtcaaaattaccttatctgagtgaatggtattttttttatcttttccacacatgcgtgggaaaggtatgatttctgcatgtaattgcagtttaacccttatttctaggttgatcataggtcccagtttacccaggaaaattccagtttatacctgttgtacctgtgtaattattggtagcactccctttcactcttacaatgtcttggtttggatgatatatggtgaagtttttgttgaaactaaattatgaagtctgatatatttggataaaaataaagaattgcttttcttctccttt

SEQ ID NO: 104003 - DNA, 463 bp, Homo sapiens
gaggaggcagcaggaggccggcagacccagcgaggaagggacagcgagaaatggaagggaggatggggacaggaggaggagggaactgtgaggagggaggacattcagtaagggggacctccctgggcctggcaggttagtcacatccaaggtcccgcccagcctccctgccacctcagcatggcacagcagaggaggaaacccacttgtccaggccatgcccaggcctcaggggaaggaggctgaggaactgggtctgctgcaggagcctggagtgcagcccagcctggcaccctgggctgggctcacagtggcacttcaggcgggagtgggtggtgaaacacatcgccacctgccccatctccacggcctgccctctcccggactcccagcatctaggtccgccgtgatgggggccatcctccttgcagcctccagaagaaagcaaagcacagctctcatg

SEQ ID NO: 104004 - DNA, 92 bp, Homo sapiens
aaagaagagcatagagcatagagtatttggttcattttggtgtccctggacaaaagacttggactcagattggcaacgacaggattctgaag

SEQ ID NO: 104005 - DNA, 384 bp, Homo sapiens
gtttcacgaaaagcagcccctgagacaaagatttggtgcaagtagttaattgagaggtgatgccagaatatggtgagggagcgaggaagtgatcagggaagtgaagaaagctaatgaggtggggggtgttcctgtaggagtcatcacagtgggcaactgggctcactcctgctggggatgttcaagacacagtgtcacacaaagctctggactgccccatgaagggacactcccacctgtgaagggtcgcttgctcctgggacagtgacccccagtaccctcagccttctcccctgtatgggctaagctgctctaacaggtagaggacaccctacctgagagagcgggtgccccggatgggaagtcatcagtgttctggaactt

SEQ ID NO: 104006 - DNA, 373 bp, Homo sapiens
tggaaaagctgtcaatgactggtgcttgtattttgttatcttacctaatggaaactttcagaaaatttcatttaaaataccttataaaatagaaaatactaggattaatctcagtggtatgttatgaagataaaatgatactttaaagtgcttagagccaagctaggcccatcgaaagcattcaataaatgccagctatttcgataattatcaggattgccactactcatcaattgattattaactttcgggttgcttattcctacagtttggttctctttagcttttccttcctttgatctctctctgagctggtgtcaacccaatatttctcaatttcagtgggaatctttttacttgcctggtcaaacac

SEQ ID NO: 104007 - DNA, 375 bp, Homo sapiens
tttttttttaaattagagacagcatttcatcatgttgcccaggctgaccttgaactcatgggttcaagggatctgcccacctcagcctctcaaagtgctgggattccgggtgtgagccagtgctctcacaggggaaaaccatgtacctgtacaaggttcttcatcacagtctacatcaactccaaggaaaacaatttctagagcaatgtggtcagcgatgggaaggggacactttccacaaggccaacaccacctctgggtctggctttatgtatttctgaagtgcctgctattctgagtcatgaaatgagtgacacacatgctcccttggcttcaaggtgactaaattcccagaactgtgggctgggaagggac

SEQ ID NO: 104008 - DNA, 475 bp, Homo sapiens
gtgcctgtgttaacgtatctatttatgattgcattggagacaaatggcaggcttgaacttctaatgcagtgttacccaaatgttacccaaattctgtgggtgtacgagtgctcaagtgtgagaaacactgaagtatgtgtgcagactcaaccctaacaggggaagcccacatgtcacatcacatgtggggcctttgcacccccaccccacctgccgcctcttcccagcttccccatctcagtcatcagctcacagccagcccctcaaagcccagccttgcggtcgtcctcagatccttcactcctgacgctgccccctccctctagccccccagcgagtcctgacagttctgcccatgatggctctctcaccccctccacttctctccacgcccaccactgccatagtaatctgcgtccccatggcctctctcctgcatggtggaacctcctctggcctgcccgtggccactgta

SEQ ID NO: 104009 - DNA, 197 bp, Homo sapiens
tgggctcaagcaatctgcccacctcagcctcccagggtgctgggattacaggcatgagccaccgcccctggcctatttgtagttttaaatcagtattaacagaagccaaatgtgtaagtaaagtcagccatgaatagaaaagttcattaaaaatccatttcatagcttcttggcgttcagtgtaaatacaaaaagga

SEQ ID NO: 104010 - DNA, 406 bp, Homo sapiens
aaataaatttttttaaataattaattaattaattaattaattaaaaaagaacatagaatcatcagggtgtatgttaccaagagacagtatagggaaagagggagagagcccacacatgaaggccgagggacagtgagtgtcttctgtggcctcccaaggagtttgggctttatctgtgtatggtagacagctgttgcaggattttaggacggttgacttttgcattcctgtagtacctggaatcaggtgcagggtctggagtcacctgtaggagtggtagagccctctagtggcagtctgtagaatgcagtgggagaaagacccggaaaaggggagtaattgacgaatgccaccgttggctggcgaggtggctcacacctgtaatcccagcactttgggaggctga

SEQ ID NO: 104011 - DNA, 744 bp, Homo sapiens
ccaagatacagaaaacctgagagaaaggaaatgaatttaaatggatgaaaatagggcgggagagttagagtttctctgtctgccagtgggggaaagtaggcagaagactctgcttccaagggagagacttatactttaaccttggagcataagaagaggaaactgaggctgagagggaggaagtatcttgcccaaggtcccccaggcaacaagcaatggaaccaggatttgaaaccaggacttttcatcttaatcttcctcctgtggatatataagatcattataacatgaggaatttggaagagccaacgtactaaggtattgaactgatccttaccaggatgaaagctcctttctagtgaatgtcactagcctgtgatagacagagagcaaaggcagagatccttgtctcttttcttcactgtggtgctcccagcactgagaacaatgcttggcaaatgggtggaatattttcccagatggggagagagacttatgcaagccattaaggaggctgctctgcctgcgtgtcgaaggaggacatcttcagtgactgaagttttcactgagcagttggcagtcgacgcacatggaggacacacatgaggcctaggaaggcagccgtcaacagaactgtcttattgtctgtcctcatggaattgactttccagtggagaaggcaaagccctgtcctaactatgggagtcacagagatgcataaaataaattccctcatctccggaa

SEQ ID NO: 104012 - DNA, 444 bp, Homo sapiens
ccaagatacagaaaacctgagagaaaggaaatgaatttaaatggatgaaaatagggcgggagagttagagtttctctgtctgccagtgggggaaaggtacagtgccttcttgctttttatcctgtttccattccaggctgtaagattgatgctgtccatgatcataggaaaatgccaaaggctgggcatgctctgactcggcactcagatggagcaccatgcctggccaggctgttctctgacaagctctctggctcctggcattgtagtccccctgcccttttaaaaaacaaaaaacaaacaaacaaaaaatgagcacggcttgtttctctaagaaatatgaaatactttctaaaatttgagcaccacaccaagctttcctgtgagggaggttcaaatcaccataggaataaaataaagcctcttttcaatgcttagctgttc

SEQ ID NO: 104013 - DNA, 529 bp, Homo sapiens
gctgctggcagcatgtaccctcatcctgcctcactccttagcagctagtgtgaacgtgaagaattgagaaatatagtgatcacatcagtgtgtattcattctggtcagcaaactaggcatatcttaagttttttaggaaatcactgttggcctccttttgtgtatcatagtgcaaaacagttttaattagttgaattattatagatacacaagaatttagaaaatgcgtctgggcgtggtagctcacacctgtagtcccggcactttgggagtccaaggcgaatggatctgcttaagtccaggagtttgagaccagcctgggcaacatggtgaaaccctgtgtctacaaaaactaccgtgtctacaaaaaaattagccaatcatggtgttgcatgtctatggttccaactactttgagaggctgtggttggaaagatcacttgagcccaggagttagaggttgcagtgagccgagatcacaccactgcactccagcatgggcaaaaaaaaatgagactcttgtttaaag

SEQ ID NO: 104014 - DNA, 521 bp, Homo sapiens
gctgctggcagcatgtaccctcatcctgcctcactccttagcagctagtgtgaacgtgaagaattgagaaatatagtgatcacatcagtgtgtattcattctggtcagcaaactaggcatatcttaagttttttaggaaatcactgttggcctccttttgtgtatcatagtgcaaaacagttttaattagttgaattattatagatacacaagaatttagaaaatgcgtctgggcgtggtagctcacacctgtagtcccggcactttgggagtccaaggctgaggtgggtggatcatgaggtcaggagatcgagaccatcctggctaatacggtcaaaccccgcctctactaaaaatacaaaaaatcagctgggcgtggtggcaggtgcctgtagtcccaactactcgtgaggctgaggcgggagaatggtgtgaacccgggaggcagagcttgcagtgagccgagattgcgtcactgcactccagcctgggcgacagagcgagactccatctcaaaaaaa

SEQ ID NO: 104015 - DNA, 2229 bp, Homo sapiens
aatgaaccaaattcacaatcaaaatttccaatttttcggtttccttcatcattctcttctcccgttggaatggtatttcatccccgaagccactttttgtatgcttatggcaatcaggaatgggaagatacagtgcagtcggaagtgttactgagagaattttcacattatactatgatcacttgggattcctacataagctgactctgggtcgctttgaagctagtggaccacccacagcctttggaaattctagaaatctttttggacagcctccagatatgggctttgagactgcgcttgccccacagcacacctccttagatgaaattatcttttttgcatatgtacctgagaacgaaccccaggaaacgatctacagcaagaagttcggcaatatacactatggaaaagtgatacactctgggaaaactggaagagcttacataagaaaggtattgcaacatacgactcctaaaggatttttgtcctcagttattgcagaaatgaaagagccctttggattagaagaagtgaatgagagctcttgtttgtctagttcccttttgattaataaagctggaaatgtctataaactcactcttgattcacaagttgttcaggccttgtttgaagatacagatatagagaagactgtagtgcttcccgggtacagcagcttcctcatcacaagcattttagataataagaatgcattagccattgctaccatgcctgaaagtgcacccaacaatatgacctttctaaagagcacatggttcttatacaactttgggcaaaggaatggacgaacatggaaaatatattcaaaaccatgtaattattggtttcaacatgatgattcaccatccctcaacattgtgaaatacattgatctgggaaactcttatgttttaaaagctaaggtcatacggaatgcaaaaggttttcgaatgcttgaaataccactactgactgtgtttgttggaaaccctaatttgttggaagttacagctgaagtcacttttgatgatactgacagttatgtaataacaatttctgcagctagcaaagttttacatcagggttcaacttcactggcatttattatgtggtcagcctctactgagtgctttgttacgacaatggtgccaacactgaaaagcagctgtagttatctcagatctatgcatcacattcctagcaaatttatcccatttgaagactggattagtggagttcataaagacagtcagggttttaacctcatcaaaactttgccgataaactacaggcctccatctaatatgggaattgctattccactcacagataatttttatcatgcagatcctagcaaacccataccaagaaacatgtttcacatgtcaaagaaaaccggtaaattcaaacagtgtgctaatgtttccactcgggaggagtgtaactgcacaaaggatcagaagttttcacatgctgttgctttctcggattgcagggaaaaagttcctcgctttaagtttccaattacacaatatccagtttctttggaaattatcaacgaggatggacgtgtcccattgcaatctccatatctggttactgtgactgaagtgaacatgaggcacaactggaaactgaaacacactgtgccagaaaatattaaaagaatgaaacaattagtagaaccaattcttggtgctgcagtgtataatccttcaggtctcaacttaagcataaagggctctgaacttttccactttagagtgaccgtcatttcaggagtaactttttgtaacttaattgaagaatttcagatttatgttgatgaggcaccattgccattcccaggacacacgcttattgccgtggcaacagcggtagtgctagggggattaatttttatagcatttatgtttcaactgcaaggcatccatccgtggaggacattccaaagatggattagaagaaaccaagagaagttttcaagtatctctctcagtgagctgattcatagatcaaagtctgaagagtgaacacatggtgatcataatttctctttattttctagttttatcagccaattcctagaacaatatatttaaatgttaaatatgcaagctacataaaatcctaaagaattgtcattataattcaaactgctacttgtcaatatattcaccatttccttttcttattttgaatacatagaaaatgtcttatgccagg

SEQ ID NO: 104016 - DNA, 699 bp, Homo sapiens
ccgaataggaacagctccggtctacagctcccagcgtgagcgacacagaagacgggtgatttctgcatttccatctgaggaatgggaagatacagtgcagtcggaagtgttactgagagaattttcacattatactatgatcacttgggattcctacataagctgactctgggtcgctttgaagctagtggaccacccacagcctttggaaattctagaaatctttttggacagcctccagatatgggctttgagactgcgcttgccccacagcacacctccttagatgaaattatcttttttgcatatgtacctgagaacgaaccccaggaaacgatctacagcaagaagttcggcaatatacactatggaaaagtgatacactctgggtagtgatatgcatttatttagatggcatattggtttctagaatctactttttaaattttttgagatagggtcttgctctgtcatccaggctggagtgcagtagtgcgatgacagctcactgcagcctcaatctcccaggctcaagcaatgctctggccccagcctccagaatagctgggactgcaggcacacaccaccaagcccggctaagttttgtattttttgtagagatggggtttcaccatgttgcccaggctggtctcaaacccctgagctcaagggattcacccacctcagcttcccaaactg

SEQ ID NO: 104017 - DNA, 416 bp, Homo sapiens
aggggcaggagccggagctattcctggggtcagcaaaggccagggtggggggcagattttggtgctgtggcttcccgaggatgctaatgggaacctggaggcctcggatttggactcaaccatcccctggctggggacttcaacggacttgtggaaattcccaggaggcccccagccattctggtaccatcatcacctgacatacgaccgaccagcctcccccactgtgtgctgccctctcttcctccacaagagactctggtctttgtttcccacatggtgctcagaggcacccagtataaacagcagcacataagcagagtgatgggctttgtgcccactgctaagtctcggcagaaattctagggaagattctcaacatggtttgtgcagattgagccgaacgctgtgatcag

SEQ ID NO: 104018 - DNA, 306 bp, Homo sapiens
gaccatcagaacagctagagcacacctgaggcacggcctcatcctctccaagtcacttcctgccacagatgctcgggaagtgctgcttctctgtgcagcatctcctgccctcctccatctggtgttggaggcatcttagatgttctctgggacctgaggtctgtaggaaaccccggctgtggacttcacacaagggtcgctctttcccacactccaggtttccctttaagctgctaatttgtaacaggcattcatagaaacagaataagatagagaaattctattaaaggaacttatgtgcttttg

SEQ ID NO: 104019 - DNA, 371 bp, Homo sapiens
ctgccaccctgtttcgctcatctcttctcaagcccagaccaatcaatagctatcaaatgatctgattacaatattttgtggcgtgaatttaccttctgtattgctgtatgagggatctttctaaaactttcctttgttccacatttataaagcattgtcaagaatgaattaatccttataaatactaaaaagaaacagtatttccaaataattaagccattgtctctgaatgtttttatttttgtattttgtcagttgttttgtggaaatctttctaatgtatatgcgaagatttctgctctgagaaaaatatataacaaagttatatccttccatgtacttctctttttgttttttttttttttaagaca

SEQ ID NO: 104020 - DNA, 441 bp, Homo sapiens
ccccgtcttctctttgctcagttccctgaactagtcatgtgaaacttcattttcaaaatattttaccgtgatcctggctcttcagagaacttcaaaatgcttcaaaatgctccaagtctttctttaatgattgtgaatgaagccctcatcctctagtaagaagctacccaagagccaagtggaatagcaacatacacatatctcatttgagacaagagatgttttttcctcgaagctgcttgtgttttgatttttttaaacttgaattttaactgcacgtatgggtttgccattagaattccagttaaaatttggattcttcatttctgtgaacataaggctttaatgggtgactctgtgcacaccatgcatccattgttttcttaaaatgagacacacctgtagtacagacttggatatttacagaatgcacattaagaa

SEQ ID NO: 104021 - DNA, 331 bp, Homo sapiens
tacggtcatagctgactcttgaggatccccatatttttcttgggaagctgcaaatcgtatacttctgtgatacttattttactaactgttgactttgttagtgtgagttttaattgcaaactgtagaaaatcacagtaaatgataattcacagaagatgtttggtctctaaaagatttggatacccagcactgaagtagggaatcttccttttttgtaagctgacgtttttgttatcattcagaatttataaaagaacagatttaagtttatcatattcacaaagacatctttccattataaattttgttgtttatgccctaggtctgtga

SEQ ID NO: 104022 - DNA, 466 bp, Homo sapiens
aggaaaaatatctttatgtactcctcattttgctcattttgagttctttaaacatcaaaaaagttaatccattaactatttcaaataagtcatatatgatttctgtataatatgttgccatggaattttgttaatcacagagtaagttaaactatgctataagagcaaaaagcttgctttgaatgcttctgcaaagccctaggcaacaggaaaagcaatatttcctcccttaattattacagggaggtcactgatcgttacataattgccccgattctcatcctgaggatacaagaaagaatgctctggaagagggctgctttgcaaggacatgatcaggctgtgtcctgggaggactacaatagagctttagaaggtatagggtttgcccacagtttaaactagcttctcaacaatagaactctatgctttttccaactaggacatatgtgaactgtgcaggtta

SEQ ID NO: 104023 - DNA, 422 bp, Homo sapiens
tcaaaaattaacaggtcagtatggataaaagtaagtcaagaaaataaagtgttacaggttgagagaattttaacttcataaagaaacaaccagttgccacaatatacctaaacatgacaactaagacaaaggtatttccttttttaattataagagaatgattgaaaaaactgaagtatgtaatttatgtttaacaaatgcaagaggaggaggatgaaaaggtttgacagtcttatttcctattagtgcaagattttcccataaagcacttgagtggacttttataaaataaatgttattcaatccatcattgtgcatgatagttttacaactaatcacttatggcttttacaaccaagtgttaatgattatgattagaaaaggaacagatttttctgtgtttctggtagtggcttttacta

SEQ ID NO: 104024 - DNA, 207 bp, Homo sapiens
gcagaatgctttaggatgacttattgcttacctcttctaccctgcctggccttccaccggtgggtgagaacatcaaatgccaggagtgtggcccggctccagaacctgggcctgcctgccggggtggttggcacagctgggatgccccatgtcctgttgctggtcccagggtcagcaagtgtgaggctgtgccaactgggacaacag

SEQ ID NO: 104025 - DNA, 264 bp, Homo sapiens
ttgattcctgactactttgttgtgaattgcacaactcacacagtaatgtagcttcacatacagcttgggaagcacataggcatcgaagatgcccgcttcagaaatgtccctgactgctgcggcctccactatgtttcgaatgacgaatttcttaatggccttgtccttgggcacgcattgggcacagttagtgcagcaaataggctgcacgtggccatggccctttttggcacgaccgttgttccttcttttgtcatcttggag

SEQ ID NO: 104026 - DNA, 402 bp, Homo sapiens
gtcgaggaggacttcaacagataggaagaagaagttcatcaggatggaagagatatttaagtcagggagaaacatactagaaggaaatagactaagaaaaatggcagaggtgggatgaagggtagtattttcaggggaaggctggccccacaagatgaatatcactcattctttatggtctacatggatgccagctatcaacactgagctttgacatagtggaatttggcttggacagtattcctttaagaaagaaaaattaaaaacaaaccaaatgcattctgaaaaagacaaaacaaaacataatcaaacaaacaatgttcttctttggatatctgcctcacacacaaagctttgccctctaatatgtctctgctaaggacagaaaatcatattgccaaa

SEQ ID NO: 104027 - DNA, 355 bp, Homo sapiens
agcacgcgggcctctgggcacagctatatgttctgaaaatgaacaccttcatttgttttctctgggcttccaagaattcgggtccacctgaaaagttcgccactccgtgtggcttcatcccttaggaggcttcctgagagcaagaactgcccctcagagcactcctggaggaaaaagggattttgcagataacttggttatcacagagagttatcacagagacctccaaattgttaccccatcttcagactccagaggattctggggtacccccagtcagggcatttggaaggcactgctgagcctagcctcagtgtcctggactgggctccactgtatggtctcatgtgttcta

SEQ ID NO: 104028 - DNA, 473 bp, Homo sapiens
ttcttacatttgaatctcagatccattttgaaacttggtttaagataggagtaatgaaatctaattttgttattttccagatggctttccaattatgtcaacctcacttttcaagaaattcatcatggtgctgaggcaactgtatgtccacatagaaaagaataaaattgtacccccgtctcagacctaaatttatttatttatttattttttctttaacttttattttaagctcaggggtacatgtgcagaacgtgcaggtttgtttacataggtaaatgtgtgccatggtgttttgctgcacagatcataccatcacctgggtattaagccagcatccattagctattcttcctgatgctttccctcccccacacccccgacaggccccagtgtgtgttgttcccccttccttgtgtccgtgtgtttgcatcattcagctcccagttgtaagtgagaacatgtttggtttt

SEQ ID NO: 104029 - DNA, 788 bp, Homo sapiens
cccacccatccccattcagaatccagatctcaccggaaacattcttgttgccacagcctacctctcccttgcacctttcgcttgagtagctccctgggacagtgctaaaagcttcaggctgcctagacaagtctccccaccaagccactccctgtacagaatctgttcttgagctttgtgctctgatattctcgattctaaacatgggtaggctatattccttttaatcaagttcttcaagctgaacctggtgaatggctttgcaagtgccatttttcagggactaaacatatcgtgctacaaaatcaatagatgttatattcaaagttaattatcatttctaggtaaatttaaattaactgagaatttccttgaacgtttttgtttgttgtcatccttatgttttcctccttaagaggcagaccatgtgtcaatcttacaaatccagctatgccctctctttgcaacctcctgagatgctctgcaggactttatgtggtgactacctgtcctccttcagggactgcaggcctgtgattatgaaatagaaataaagcaaaattccccagctcataaaagacttcactcacaccacgtggctgccaaccaataggagtaagatgggctagtgaaaattgcaagtacttgtggagaagattagatgattgattcaaataatgtcactactataaagaaaattttaatctggatttatcaagcccctttggtccaggtctctgaactaatatttagaggcaaagaggacagaaaaaaaaaaaaaaaaaaag

SEQ ID NO: 104030 - DNA, 1310 bp, Homo sapiens
tcagttgtgagatcgtctgatacataagtaccatcaattcgcctctactctatatgcatgtgctgcaattaagtatgactcgggtctgcttactaggtgccgcacgatttcataatacttaaataagaaggacctccatatacgatactgtacaggggccaataacgctcacacccgctatcatttgccaaggaacctaacttccgtgggaggctgtacttggggagagaacttaaagtaaataagaagctgtcaccgtgttaagtataagcataggctctctagactgcttgtgtgagagaaaggtgacgattatggctttgactcgtgtggcattcatgataaagctatagtagtatggatgataaattgaaacattgtaatcaaaacacacatttaaaatgttggctatcatctgtttacccaaaacctagctgagagaaatgattctgaggaaagatggtataagtcaatgatttttctgccttctttttttaaagcacagaagaaagcatatgtagacccctagaatggcagaactgttgtgattcagtggagtgtgttagtccatttggcactgctataaaggaatacctgaggctgggtaatttataaagaaaagaggtttatttggctcacagttctgcaggctgtacaagcatggcaccgatatctgctcagcttctggtgaggcctcaggaagcttttactcgtgggggaaggtggagaggaagcaggcgtgacacatagtgagaaagggagcaagagagaagagggggaaggggccagaccctttttaataaccagaccttgcaataactaatagaatgagaactcactcattactgcaagaatggcaccaagcccttcgtgagggatccgcccccatgacccaaaaactcccaccagggcccaactccactattggaggtcacatttcaacatgagatttggaggcaacaaacatctgaaccatatcatggagtaaggaaagtaaatggcctcaagccctgccccctgtaattcctcttacccttttgggggtccctggagcacctctgggaatcctgaggttatagaacacagcatgaaaaccacagatcaagggggtggttgtctgtgtgttcttctaggtttgaaaagtttgattcttagattcagtttagcaactaagcccttcagtgctccctgcgttcagccatgagatgctgctcttatgattctttgtgtgctgtgaaactgtggctagggtcgtattccttatcctgttcagtcccttccagagcagtagttccaagacacacgatgtg

SEQ ID NO: 104031 - DNA, 429 bp, Homo sapiens
ggagtgcagtggcgtgatcttggctcactgcaacctttgcctcccgggttcaagcgattcttgccagggttcaagcaaatctcgtgccttagcctcctgagtagctggaattacagacatgcaccaccatccccggctgatttttttgtatttttagtagagacagggtttcaccatattggccaggctggtcttgaacttctgacctcaagtgatctgcccccctaggccccccaaagtgctgggattacaggcataagccaccgtgcccagcccccattcctttctaccaacttaaatcctatatttcttcaagtcttggcttaggactctacatgcagtcttccttggttccctcactgcaaatatttactttaaacacgctgaaagattgttaattatataaagggtatactgtaagtagttatt

SEQ ID NO: 104032 - DNA, 251 bp, Homo sapiens
actgtgtgctgtatgctctaccaggggctgtgagggcactgtagggataagcaaggcattggatcttcccacggcactcagcacaagagtgtgcccagagtagatgcttaggaaatgttaaaattgaattggtttgacttgaacttgcacttgcaattctgaaggctatctaatgttagatgtctacaggaatctttaggcttggtcaagaatgtctgaacacatggcctatggttatgggttgtaagcaa

SEQ ID NO: 104033 - DNA, 588 bp, Homo sapiens
  misc_feature (15)..(15): n is a, c, g, or t
ggttgattctagagnatcacagttcgacggagactctcagccacatgcaccaactactcaggaagctgtggctggagatcttattagctctggagttggagcttacagtgagctaggatgggaccactgcaatccagtctggagaagagtgtgagaccctgcctggaaaaaaaaaagttaaaaatgtaaacattaaagggagcggtcaagagtgataggtgccataaacatgtcaaataagctctgaaagatgctgtttgagttggcaattgattattgatcatattattgaacactttataattgatcagtgaacttggcaattgatcattcactggtgactggtgagaatgaagttagtggaaagataggaaatcaatggaaagattgactacagtggattgaaggaggagtggtagattgaatatagaattttctcaagaagcttaagtaaagtgatagcaagagaaaggactgtagctgtaaaactgagattttatgaagttgaaatatggttttttttcttaaaaatgataagaacctttagcatgctgtggcaaagagccaagagagagtctccgtcgaagt

SEQ ID NO: 104034 - DNA, 406 bp, Homo sapiens
gaaaacggtctggaattatataatgatgacggttgtacctctttatgaatatacaccactgaattgtataatttaaaattatgaatattatggtatgtgaattatatttcaatacaaaaatgtttaaaatggatcagatgtggtggctcatgcctgtaatcccaacactttgggaggcagaagtgggaggattgcttgaggccaggagttcaagaccaacctgggcaacatagctagactccatctctaaaaaaatttttaaaacagctggttgtggtggcacatgcaccaactactcaggaagctgtggctggagatcttattagctctggagttggagcttacagtgagctaggatgggaccactgcaatccagtctggagaagagtgtgagaccctgcctgga

SEQ ID NO: 104035 - DNA, 1136 bp, Homo sapiens
caatatatcagaagtataaatcttttgggtgttcaaacacatcacctactttcaattttatcttttcctccgtcctctcccaacctgaattaattaccccgaaataaatgtaaagtaatacaacatatggctgtgctataaataatacttacagtcataataatgtggatgttcaacagtgcttgagactagaagatatcatctagagtaaggatggggtcactgagatgagacttctagcgactcgtgttaaatcccaagctatttcggaaagggctcgaatgcgatggagaaggatttccaatgaggggcatgcaagtcctgataactcagccactgatgcaagcagtaggtgaagaacatgcccacgcgtagtacccctagaatcgtgctaatcagataaagaagaacacttatatgcgggtggtaggtgtatgctgaaaactgtttagactgcagacctattgctcgtacccgggagagctgggttatgggaggatcctgtgtggtggacgacccacgtgatatacccacagctgattaggaggctgatggatagagtaagcagctttgtagatcgcagtcgcttgtggatgcacccaggagactaatgcacacctgtggctgggaaacataaatgtatggggtgtaacggtggggcttcacagccaagtgaatgcccagacactttgaggatgaatcgaggacggaatgtgatcagccataaagggtgcatgcgaagttcaaaggatcagccgtgaccaaaatggatgaagagcgggttgtctactactaaagtgcccaggatgagccgggcatggtggggcatgcctgtgaatccctagattaactcaagtgaaggctgagagcaggagcacttcggcttggaacccgggaaggaacggaaatggcagtgagccccagatcaacccaggcgcataaaggctgggccacaaagaggcagaataccgtctccaaagaaaaatacaaagccatatggcccgcgcccgggtacacacgagaaaactcaactggaaagacaaagggacaccagggccaaaacgagacccgcactgggacccgggccaccacaaaaacaagggcactgaatacggagcccgtcacacaatggggct

SEQ ID NO: 104036 - DNA, 479 bp, Homo sapiens
gagacttcgtctcaaaacaaataaacaaacaaacaaaaattcccaaccatgagcccagacaccctcaattggttgctattgttagagaatccccaaaccaaattcctaaggaaggccatgccttgctttttgtttttgttcttttgagacgaactctaccctgtcacccaggctggattgcagtggtatgatgaaagctcgctgaagccttgacctcctgggctcaagcaatcttcccacctcagcctctcaagtagctgggactataggtgcatgccgccatgcccggctaatttttgtattttttgtagggatggggttttgccatgttgcctaggctggtctcaaactcttgagctcaagctgtctgcctgcctcagcctcccaaagtgttaggattacaggtttgagccaccgtgccccactggccatgccttttaatatatattagtcagaaccttctttgggaaattttttgt

SEQ ID NO: 104037 - DNA, 688 bp, Homo sapiens
agcaagtttattaggaaagtaaaggaataaagaatgtctaccccatagacagagcagcccagaatggttttaggtggatgggtcaagagggtcttttacctcaatggttggctttccttgcttctttccccaaaacacacaggatggctgcagggtcccatcaatttcgttaagtactataaaggtgagatttttgctagtgcaattgactcgaaaggaaacaagctctaattgttgtcaagcttatcttgagatcgatttgggtgacttcattttggaaggtgattaacttgtgagaattttttaaatatgtttttaattctcctcccagagggctagtggaagttacccatgacgactctaaaagcagtttaggaagtctgtcagatgatttcagcccagggaatcagccttaaaagaccgaacatgaaacctgctgtcagtagttcaagtgactgggaaatccactgggattgaactcccagtagctgggttttctcacctgcaaaaccaagactaccgtgtctggccttcgtgcatctctcagggtaaagaaaaatagcaacttataaaattttccacagggagcttagtgaagggaccatgccaagtctgaggtctgtgtgcttgggccctgctggtgactgacagccagaaaggggagagatgaggccactcctccctccca

SEQ ID NO: 104038 - DNA, 470 bp, Homo sapiens
gcaatggcagaattgctccaatatgtgagaacggtcactgtggcggttgccgattatggaagccatgagccattattgttaccatgaaaatacgcatgatttatacattacttctactgttgccatgcgtgaccaaataaggatcttttgctttacattgtttctgctggaacaaagtaaagaagttcaacagtccaagagttttcttttctagtccagttattatgttactttttcagaaagcttaggatcttgataatagttcattcctgaggctgaaggggtttcattattaacaagtcagataattttcatttcagttttgataaaagatttttttttaattttgagcaaaggttgaagcacttaatgcttattgtaataattagttttatattttctattttgattgattcattggttgattttgattttaaggatttaaatagctgaaagtatggaccatattt

SEQ ID NO: 104039 - DNA, 332 bp, Homo sapiens
gtctgaaatttaaaagctgttctaaaataattcttggacgagttttcaattgtagatgaaaacaaattatggaagtaatattttggatgtgtatgataaacatgttggagcatacattagtataatttcccaatgggggttacttaagttttgaagttattctactttgcttattttattaagttatattttagttcttaatatttttcttaaagttcttattaccacataacaatttacatttagaatgtaaatgtatggagacaaacagtttcaaaggccattatcattgcatttctgcattatcaataaggttcagttatttataagat

SEQ ID NO: 104040 - DNA, 518 bp, Homo sapiens
tggctggacaacagactctccaaaaaaatgcatgtgtatacattatgcttattataaaatttactaataaaatgacatggaagacaattaaaattataataaaatatacaatgctcaacatttaaattctatatggccaattgattcttacagaatgcctttttgatttttgtccaactcttgcatctgtagtcaacctgtggtcgcaattgacagaagagtttaattctttctttgtgctcttactcctgggtccctcattgtacagtgatcatcaaatgcaacatccttcatgaaaatgaatagcttcactttttggcatttccttcctttttatgtgtcatagaatacactacattattcttgattttacagttaatttgtaaattgtttctaacccccactagtttataaactccttaagaatgagaagcttgcattaatcacttctatatatatagtgttttgaatatccttggcattcattaaatgtttagtgaattgaatgcgatgtttct

SEQ ID NO: 104041 - DNA, 406 bp, Homo sapiens
ttttaatcgtgactaaaatgcttttgagaaaataaaacttcttgactgttaactgttcacaggttctttttctgcctcagtggctccaaattttaatccctacccttgcccaccacaacttccaacttcctttacatatccttctttttttttttttcgagatgcagtcttgttctgtcgcccaggctgctggagtgcagtggcgcgatctcggctcatcgcgacctccgtctcctgggttcaagcaattcttatgcctcagcctcctgatgtagctgggattataggcatgtgccaccacgcccggctaatttttgtaattttaatagagacagggtttcaccatgttggccaggctgatctcgaactcttggcctcaggcaatccaccctcctcagcctcccaa

SEQ ID NO: 104042 - DNA, 350 bp, Homo sapiens
ggaagagtagtcagagaggtagtaataaaaggataagagagcttcaagaaggaagtagcggtgaagaaaagagcatactgtaaagagatcaaggagaaaacggaggagattaagcacagtcagatggtaagacagtgactgttgggtacagaacagactggtggagcccataccacagtaaggaagtctatccaggagatcattgccagaaacatgattcaaggtgttgagggactaatgtgagagacaacaaccttatttatgacctacacgctgcagaagggcgaatatagcgaagaaaaagagatcttatgaaaataagatctgttattccagagccagagactgtg

SEQ ID NO: 104043 - DNA, 787 bp, Homo sapiens
gagatctcactgtggtcttagtttgcatttgcttggttactgatgagcaccttgtcaaatatttatataccatttgtgtttatttttttaaataaaatgcttgctcatgcttttttgcccatttgcaaaaaaacttggggccgggtgcagtggctcatgcctgtagtcccagctctttgggaggccaaggtgggcagatcgcttgagcccaggagttcgagaccagccttggcaacatggcgaaaccctgtctttacaaaaaatacaaaaattagccgggtgtggtggtgtgcacctgaagtcccagctactcagtaggttcgctttgagcctgggaggcagaggttgcagtgagctgggaccgcatcactacacttcagcctgggcaacagagaaaaaccttttctcagaaacaaacaaacccaaatgtggttgtttgtcctgattcctaaaaggtctttatgtattctagataataatctttggtcagttatatgtgttaaaaaatatcttctttgtggccaggcacggtagctcacacctgtaatcccagcactttgcggggctgaggtgggtggatcatctgaggtcaagagttcaagatcagcctggccaacacagtgaaaccccatctctactaaacatgtacaaaacttagctgggtatggtggcgggtgcctgtaaccccagctgctccagaggctgtggcagaagaatcgcttgaacccaggaggcagaggttgcagcgagccaagattgtgccattgcactccagactgggtgacaa

SEQ ID NO: 104044 - DNA, 375 bp, Homo sapiens
accagaaaatggctgtatttctcctagcagagacacaggtgcaatgctgatctttgaaaattaggagtattgtcttgtcccaaaggacaggtggtaccattggctgggaactgaaatggaaaaggcatcttttgctgtctccatcactgctgcagacacaatcatgacgttttctgctgggggtttgtgtggatgcacttggaaacaggcttttcagtacacttagggcagctgcaccccagttgaaagtgtccccaccaacctggacttgctcaaagggtgggacttatctcttcctccccatacaaagcagcagcatttctgcaccatagaatgaaccagctacagagtatagaccagctacagctgtctatt

SEQ ID NO: 104045 - DNA, 471 bp, Homo sapiens
tcatagcaagaaactggtgatcttcaattaataggtaaaaagcgaaaaagatgtatgaaggcttttcagatgctacatgacaattttaacattaaaaatcatcacgttaaaacatttttgaataaagtctaattgcctcaataacatcttagcatagatcatcagaatatgacttacgttcagttaagactgaaaagaaagctgataagctctgattacaaacatgattctttgccagaatttaattttttccttgaattcaatcaaactagttctactgggtaaatgcagatagtgtctagaatttgtttttctctacatgccacagcatttataaagaatttaccaggtcatcaaagatatccctttggtgcacatgaatagtaatcagagtctcgtatttcactcgttccgtggaactcagatccctcgtggtgacgtctatcaatgtattgagtagctccaggaaag

SEQ ID NO: 104046 - DNA, 401 bp, Homo sapiens
agatcattgttaattaaatattttattcgtgagttcatgcattgttccattttccaagtatttttgcacactgaatgtatgacatgccactcccttatataaagccttacttagtgctcacatgaactaaatgagatagtatttttatctccattttacagataaggaaattaggatttagattaactgcccaaagtcagtaacaccaaacacaaaatggtagagctgaggcctgaacacaggtctttttagttgaaaactctgagctctgcttaatcattgtgctagtaagttcgtatcccaagtttaaagtccttcttcactttggaggatttccatgaaatagcctaccaatcctacttcccatttctgctgcacttggattttctatttcatatttc

SEQ ID NO: 104047 - DNA, 233 bp, Homo sapiens
atacatctcatttctttttttgactttttttaagttttgcctttgaaacctcaacactcttctttgggtaaattaagtagttcaatgagtaggtccctcattattactttaaataatcaagagttccaacctgatttctacaatcatttttattttgtctctagttaaatactacttgaatgaatgagagtggtctctttttccataacaatgcaattttaaatgtttcaata

SEQ ID NO: 104048 - DNA, 738 bp, Homo sapiens
atgagagcaggactggagttggtgagaaccactcggtcacccctgcctcattcatttttttccccaggccccaccactggaagaactttgaggggtgaggtggagactccagaatgggacactcccgtgtgactttaaacttacaggacagacggaggccttcctctgggttgctgagtcacaaggggccaccgttcaaggcagaagagcctcccagaagtaaagagggtgcgtttggtgggagcatctcttgtttaagccaaattctagcaccaccccagggctgctcccaggggtgtgtgcaggaagccaaggatccccgaccgtcagcccagctccttcctacaagaaccacatgccttatacacgaggagttacccaccaccaacaaacaataaaaaaaaaaactaacaagagcacaaaagcaaacccacggtgagtagccagaggaagcacagagaagtagcacaagaaggtaaaagaaaacggagagaggagatgagtggggagaaagagcaccagaacaaccgatggagtgaacaagaacctaaatgacccgaacgaacgaccagaacacgaaagaaaaattctacagacagaaaaaccgaacaccgaccaacggaaccccaggacaaagcacccccgagacacagagaacgcaagaccgaagtcagaagtcgagacgaacaacgaaagaggaacgaagaggaagatcccagaaccccagagagaagacca

SEQ ID NO: 104049 - DNA, 861 bp, Homo sapiens
gctctggctcctgcccagctgctccttgagctgggagccaaaccccagactcccttgtctcaggaactggtccagaatggccttagtagtcagctaagaagagctctatatgaaggcctgggagggctggctgcccagactctggctgcctgggtgggctgccaggacccctcctctgtatagacctgccccagctcagcaaaggaaggacatgtaaggaaaaggcaaggctaccagtggaactgcagtgctgttgggggtgggtgtgagtctttgcaccagctgacctctcctttttctggggctggaaggaatttgatgtcaccagtatcttagagccacatgcctcattcttcaggaacaacctcttgggatcctggaggcatacaaggtctcctgaggccttggacttgtgtctgcatgccagcagatgaggctggaactgtgacagagtgtgagcacgtgcaggtgacctcttcaaatgcttctcccttgttcctttccttgggagtcacactgcctgatttgtccagtggtggacactcttgagcctttgaggtttagtattaggattgccagcataggttggtcaatttttaatttgatttctatgttgatatggtttgaatgtgtgtcccctctaaatcttaagttgaaatgtaatccctggtgttggaggcggggcctggtgtaacgtgtttgggtcaatgggaatggatcctccatgaatgtcttggtgctgtcctcccagtaatgagtgagttcttgctctgaattcatgtgagatctggttgttgaaaagacaggttgttaaaagagagcatctcctctcttgctcctttgctccctctcttgccatgt

SEQ ID NO: 104050 - DNA, 306 bp, Homo sapiens
gtgacagggattgatctgagaaaggagaggtgagggaaggaacagtggccttaggtggagggtggactcaagcccagaaccacgctggcccacccaggtgctgtaggaccacctactccttgagagcaagactcccacccgcattggggttttcgcctagaaacagttcagcttgtccagaatctcccagccttgaagaccccttagagtcctaccttctttgggtcctgcttccttccaaatagatagtatcttaagcactgtcctagacaagtttgtttctccctctgctcaaactctcctttt

SEQ ID NO: 104051 - DNA, 211 bp, Homo sapiens
agacaagctacagggtgaaagaaaatatttacaaaccctatatgcaacaaattactaagatgtagactatataaaggattcataaaacttaatagtaagcaaaaatccaattatggaatgaacaaaaaacacaaagaagtaacttctcaaaaagaatatatagatgacaaataagcttataaaaacatgtttaacatcgttagccattagg

SEQ ID NO: 104052 - DNA, 986 bp, Homo sapiens
cttgattttcccaaggctacgggaaggtaggggccattatcccccactttacacgaggagaagttcaggctcaagaagatgaaatggcttattcaaagcgggtgcttattaagtgacagagttgagatttgaaccaagatctgcccaacttcaaaactaaagtcaccagatgacctcctccaaaatatgaaacctttaggaacaagaagggagccagtgagaaatatacagtcatccctcagtatcccttgggcgatttctgccaggacctctgtgaacaccaggatctgtggctgctcaattccctgatataaaatggagtagtgtttgcatgtaacctatgcacaccttcctatgtacttcgaatcatctctggattacttctaatacctaatacaatgtaaatgctacataaatagttgttatactgtaatgtttagggaataaggacaagaaaaaatgtctatacatgtttagtacagatagaattttattttgcatctcttgaattcacagatggagaacccatgaatatggagggccaactgcatagactgcatatatttccaccctttttccatctcaccatctcagacaaaagtcataatagtatacataactcaaattattaatttaattaaattaattggataaaattcaaaaaaaaaaaaaaaaaaaaaaaaaaaaaattgtgggggggccggggccccggaaaaggtttttgaaacccactccgttgggggggccggggcccccagagaggataaaggagcaccgggggcagacagggcgtgatcccaaggaagaaaacccggggcaaggaacaaaggcgctgggggtatccaccaccgagtataaaaagagccggaggggaacaccagcaagggtatcggtgaacacaaactccagaagagggaggtcaccgagggcaaacaaagggggctaccacaacagaggggcccgagcgacgccggatataaagtagg

SEQ ID NO: 104053 - DNA, 1135 bp, Homo sapiens
cttgattttcccaaggctacgggaaggtaggggccattatcccccactttacacgaggagaagttcaggctcaagaagatgaaatggcttattcaaagcgggtgcttattaagtgacagagttgagatttgaaccaagatctgcccaacttcaaaactaaagtcaccagatgacctcctccaaaatatgaaacctttaggaacaagaagggagccagtgagaaatatacagtcatccctcagtatcccttgggcgatttctgccaggacctctgtgaacaccaggatctgtggctgctcaattccctgatataaaatggagtagtgtttgcatgtaacctatgcacaccttcctatgtacttcgaatcatctctggattacttctaatacctaatacaatgtaaatgctacataaatagttgttatactgtaatgtttagggaataaggacaagaaaaaatgtctatacatgtttagtacagatagaattttattttgcatctcttgaattcacagatggagaacccatgaatatggagggccaactgcatagactgcatatatttccaccctttttccatctcaccatctcagacaaaagtcataatagtatacataactcaaattattaatttaattaaattaattggataaaattcactcaagctttttctctattaattccactggttaatcacattaatgctatgaggtagttttaacattatacaggcattataagtaaggaaatggaggcacagagatgttacgttcccagtaagggattctagccctggaagtctctggctcttaagccctcaggcttaactactaatttatgctacatctccatcattaaggttatctaataaagtgtgtactctcaagagctgaacagcctagcagcaaacagataatgagaaggggaaacaatgcaggaagctaaagaaatcttcacataacaaaaggatcccagggtctttttaagaaacactgtctgaagtgtttgtttacagatcattaaatacttaacagaggaagaaactaaaaaccactgactttctctaagccaatactgattaagtaccaaagagatgttaacataaagcaaataagaaattataataattattaa

SEQ ID NO: 104054 - DNA, 1042 bp, Homo sapiens
ttgaacctggtggtggggagggagggcggaggttgcagtgagctgagattgtgccacttcactccagcctgggcgaaagagcgaaactcatctcaataataataatgaaaaataaaaataaaacaaaacaaaataaaataaaatgaattgagcttatattttgggattccctttctgccaaagctgagtagttcttcatgctctggagcagtggttcttaactgaaggtgattttgctccccagggcacacttgccaaggtctggagttggttgtgagattgtcgggggagcggtctactgcatccagtaggtagaggccattgatgctgctcagtgtcctacaatacacaggacagctcccacacagcaaagaattacccggccgcaaataccaatagggctgagattgagaaaccacggtctagaatccagcaaaatctttcgatcttcaccactgtcgactggggagggctcagcacaactcatgaagccatgggtttcagcacagccagggaaggtccccgagtgaaggtcagatggggagaggcctgcatggctggcaccgaggagacacagccagaccagtagctgcatgctcttgggcaagctcttcccgtctgagtttagtttcctttaaatgccaagtgaagaaagccagccagggtatcacgaaaaccctttctagaactcatattccaagattctggccctgaccctctattctcataacctgggcatgattcaagaaatgtgtgagccaggcacagtggctcatgcatgtaatcccacccctttgggaggccaaggcaggtggatcacttgaggtccagggattgagaccagcctgcccaacatggtgaaaccctgtctctactaaaaatacaaaaattagctggacgtggtggtgtgtgcctgtaatcccaggtactcgggaggctaaggcaggagaatcacttgaacctgggaggcagaggttgcagtgagctgaggttgcaccactcactccagcttgggctgcagagcgtgagactctgtctcaaa

SEQ ID NO: 104055 - DNA, 429 bp, Homo sapiens
cctggctgcccccataatgcagttttatctgcccttttatagcatctaagtctttaaagataaaaatgcaccccccaaaaggaagtttcattattgtttgtagcctgcatttgatgagctagatattttacagatgtccagaacggggcaacttctctcttcaatatgcctttcccaccaaaaaacttaaaaaaactgagggcatgatcaagggtgataataaatcaaggatgaatgctttaatagaggccaaggagaaaaccttggggaaaactaaggcaaagaagatactttgaacattttgccagttgcatttgaaataactttttcctgcagcacgagtcttcttgcatattctagaggcaacacaggtgcaaactgctccctgggacttcctagtcatatttagcacttagaataacttctctg

SEQ ID NO: 104056 - DNA, 90 bp, Homo sapiens
cagaagtcatgagttggggggaaatgctaactggaatccagaaaagaaaaaataatggaagaaatttcatgacgctattgaggactgaaa

SEQ ID NO: 104057 - DNA, 824 bp, Homo sapiens
gtaaatcatgaagggcctagtatgtaaggacttaattttgtgaggcactagtaggaagttgcagagcaacttgatgcagagttgtggtagtttgtcctttcagatgagacagatgttggggatgaggagggagggcttcagcatgattggtgaattggtgcttttcacagtgacagggtgttcctgaatgggcttaggagtgaattttggacatgatgagtgtgaggtgtcagaaggacatggaggtaggtggtgatgtctagcttaccgttagaaataaatagaggtcaggtgcggtggctcacactggtaatcccagtgtttccggaggccagggcaggagaattgcttgaggccaggagtttgagaccagcctgggcagcaaagtgagaccccgtctctaaaaaaaaaataagaaaaattagctgggtatggtgaagcgtacttgtagtcctagctactcaggaggctgacgcggaaggatcacttgagcctaggagattgaggctgcagtgagctgtgatcaatgcgttgcactccagcgtgggtgacagtgtaagatctatctataaacaaaacaaaacaaaaagccaaatgaattgagtcactgcagattgaaactggtctccagtcctaaatcacagtggaaaagttcatacatttctatcatttaaaaattaaaattatggggatcctcttttctctccaccctcttccccaaacctaagaggtagaagaaaaggaaaatgttacaaccaacttttagagggaaaatcatgtttacttttctctttaaaaatttggagcaattgaaataaactagg

SEQ ID NO: 104058 - DNA, 533 bp, Homo sapiens
agcagtgctggaattacaggcatggagccactgtgcctggcccttgtttcacttttggatccttgtggttacaaattgggcccacccgagcactgcgaggtcatctccctctctgctgattagtaacctcagttcccttttccacgtaacctaaggcattcacaggttccaggggtgagcaagctggaggtttttccagtaatgttcccttgctgtcctcagatgccatccgggatcccacattgcatttagttgtcatgtctccttaatctcgtctgcaaccatttctcagcgtttccctgtttttcatgaccttggcagttttgatgagggcagtcatctttttttatgtctttgtgactgaccgttcacacattggcatgtttgtaaagcacggtgtggctgacgtgtggctcacctgactgcttttccaaatggggtgcagtgtgctctacagtgggagaacagctttgtgtcttcttttagctggaaggagctacatgttttatagaagggacttctgaaactagaca

SEQ ID NO: 104059 - DNA, 417 bp, Homo sapiens
atgctttcctctccattatttagtggggtcaccttggcctgtataaatcccacttccagatcccttcccccatcatagtgcatgttataggctcttgtgtcatttctgtcttaataccttttagtgtaggttaccttcccctaagtataattaaacaaatctataattactatgtctgttcctgctttatttcctttatagtggagatttgttgactatagatagcttgaatgtctcggtttactttatagggatttttagaggaaaaagtaaatatttctttgaaatttctatgtacttatcaagggatatagataatttgttttctgtctttcagaattttgatggggatttggtttaaactttatctgctctttgagttttatagtataaatctttttaagaaattgtgtttat

SEQ ID NO: 104060 - DNA, 378 bp, Homo sapiens
cgtgccagggccctcggtagcccagacctgccgtactctaccagccgagcacagcccgaaggccagggaacaaacacagacggaggccgagtgggcccggagcagggtcttgccgcgaagggcctgggctcaacgttagagcgtggcgcgaccctattctggctgcaacgagaggggtgaatgaagtgggcgccggggacctcccagaatcggagctccagacgcgggcgggccaggggccgccggaaaactgcgcgcgccccgccctaccccgtccggccccgcgtcgcgttctcctcccccactgcgcagccctcggctgccccctgccgccgccgggcggaccctgcaagccccgctgtccccgccttcgcaccg

SEQ ID NO: 104061 - DNA, 382 bp, Homo sapiens
gataggaggctactagtctaatgtcttctttgcccctagctaattacatggcctcaggaaaatcactaagctctctgagtttaaatttcttaatctaaaagtgaggcagtatattgttatttcctaaagtttggttcatgatccatctatttcaaaaacacctgggctgctttactgggatctaccccatatcatctaaatcagtgtctctgtggttaggcctgggaatttgcatgttaacaaattcctcaagcttttaatgtgttttaaaggttgtaagcactggactgtataaggggtttcttttagcttttacatgttgtgattcttccctgtcagtcttgcatgatggagttggtgctaagaaagagtaaaattgtaa

SEQ ID NO: 104062 - DNA, 302 bp, Homo sapiens
gcatcctttgtcactgagaatgatgacagaggtggtgctggctcctactgctgctctgaaaggctgggttaagaggaaagcggaggtgggagcagcagttctgcttttcatgacaaccagggaataggggaggtgggagccaacaagggacctacatgaacacccagtctgtgtcttcgtctatattactcactgtttactcccaggctctcacaccttatcagaggggaaaagtaaacctcccacaaaacaccatttggttcaactacagatgtattttggatatcttcaatcaacgcttg

SEQ ID NO: 104063 - DNA, 231 bp, Homo sapiens
ggaagcctcctaacacccctgctcttcgttaggctgcagctgctttcctgtccatgatttaagcatccttagatcccagctgtccaggaagctctccccacgcacctcagcctaagtccagcctcccactgagctcccatggcatgactgtccaggccccagcgcccttgtgccctaaccggggctgttccatgttgatatgtggtctcctcaggcatggtgtacactact

SEQ ID NO: 104064 - DNA, 437 bp, Homo sapiens
ttgcttaaaccaaaacggattcctcttcctctcatgatccaaactcctgagtcccttcaccttttgcctacactatcacagtgacctccttgctgctttcacactggagagcgtgggctccctgtgatctactctccacatggcagccagtgtcatctggtaaacctttgctgaaaccctgccatgcccttcagttgccctggaaacctgaactcatcctcagcctgctcgcagagccctcatgccgctgggacgtcacgttatgtccctctcctgctggcccgctgcacccagccgcaccacatgccggccgcacctcacacacgctgcctcttggcccttcctcgaacacacggcgcttgtccttgttgtcccctcatctttgcatggccgatttctttttctcattcagctctaagtttaaactttcaacagtt

SEQ ID NO: 104065 - DNA, 333 bp, Homo sapiens
cacgggatctcatagatttatagaatcatctggtctagtgggtctcaaacttttttaaaaagcagtggaatccttttgtccaacagaaccccaagttctggctgaagtttcgccgcgcagtcttcgccaccatgccgccctgaaccgtggtctatttcccagttcgaggccgctgcgcggacctgagcatgctgctggcagatcagggccagagctggaaggaggaggtggtgaccgtggagatgtggcaggagggctcactcaaagcctcctgcctatacgggcagctccccaatgttccagtgacggagacctcacccttgtaccaagtcc

SEQ ID NO: 104066 - DNA, 142 bp, Homo sapiens
gaagctgcaagcagataaatgtgtccttagtcacatcttaaataatctcagaaaagaattttaccaaagatcaatacagaaaaggctttgtctaggtccagaagacacactatgctaaagaattataatagcggcataaaac

SEQ ID NO: 104067 - DNA, 403 bp, Homo sapiens
tgttctggcttccccttgtttcccacggccagtcattcaacaatgacctgattccattctagaatccctctcctccttgagttcatctcttcctcagcaagcctctgctctgattaacctccatcacctattttctccagtacccagcttttaaactgttaagcagtagcagagaaaagtaataaaatctgaacaggtctactaaaaaaagttatgctacttactctcagctatgtcctcattcactgttacttagcaatccttttattcattctaattggttcaatcaacaaattctaaaaagctgttgtgtgccaggaattttctcacctccaacaaacttacaaggctagtctacagagcccctctagcactcatcatccaacatttttctaacccctct

SEQ ID NO: 104068 - DNA, 334 bp, Homo sapiens
agacactgaaggattttagtcaggacagaaaatacatctcatttatatttcaaaacttatattgaaggccagggcaatcccaggaatctctcaagggagataggaaaatccaaatctatgctccaaagcccaggcaccactggaagacttttaattaataaaatgaaacaagtggagttccttcacagaagtgttggctgtggttcaatttacattatagtatgtggaaaattttccctttctgtctgctagagcaggaaaatttccttccaactatatccttccactccccaactctggggcatggatggaactaggatcatagaattctttt

SEQ ID NO: 104069 - DNA, 727 bp, Homo sapiens
actcatgtgcttacttagtcctgaatggagacaccgtcatcatccacatagcccactgtcgtaatccatacaggctgctacaaggaaatgcattagaccaggtagcttataaacaatagaactttgtttctcacagtcctggaggctgagaagtgcaagatcaaggtgccggcagtcttggtgtctggtgaaggcctgctttctcatagaggcttccttcttgctgtgtcttcacatggggagaggaacaaacaagctcccttgtgcctttaataaggtgctaatcccagtcatgagggcagagtctcatgtaaggcttaacctcctaatacatcaccttgagggttaggattttaacacatgaacattgacggaacacaacgttcattccatagcaccagggtagtctcctcatgtgaaggtctttacctgagtcacatgcatgatgtaccattttcatgtaaggttctaggaatctgtggacatctttggggggggccgttattttgctgatcacatattacatatattttaatattctagactagtatgaaaacaatgccacttccattgctttatatatgtatatatatatatacacattgtctaatgctataattaaaaaaaagttgtagacacaaatatacccatttaaaaaaaaacccattttttgctattttactttatactgccaactcctttttcctgaaactgcttcaactctgga

SEQ ID NO: 104070 - DNA, 421 bp, Homo sapiens
cttcctttgtaaaacagtgcttttacttactttacctatctcacacagttgttataaagaataaaattcagtctttgaaagtatttgtaaatgctatacacatatgagttagcattattttcattcattgaggttacctttaaaatattatttataaatctctttcaaaatgattttgagtgactctcaaaggttttctgtaaagaaagccaatacctctatttacaaactgctttctaaaagtaagtgtagtgttcacttcagtagcacatatactaaaaggtaagtgtgtattttctagtctttatgcatagatgctgtgatttcagggcagttgcaagatcctactagaccaccaatctttcttctttttagtgctgatcttctctcctacctcacctgaaatttatcaattagcgtt

SEQ ID NO: 104071 - DNA, 457 bp, Homo sapiens
gcagacgttcaagccatgtagggccattccctcatcaggccccttagcagatgggccctggcttctcttcagtggaaacagttcagtgtgcacctccggggtgccagggaagaaataaggccctttagggggttgggtttacgtccattgtcacaagagtggcacgaaaatgttctgcctcttaggacccctggctgatggggaacatcacagccaacttagttcagagtaaaatagagcaaaattcagtaagaacaaaacaataatgacaatccacttattcatatttgtctaccagcctgtcaaaacaataaaggtatttaaaagtgtatctggaatgagaaatgagaaagaattacaagaaaaattttcaaaaaggagggtaatgagttgagtattttcttatgaattcttacaatatgacaatatgcaagccatatgtggagacgggggtcca

SEQ ID NO: 104072 - DNA, 409 bp, Homo sapiens
ttcttcaataccctgcgtctccctgaaactttctaatgggtatgggtagtatataagaaagctattgacatttatctgctttgtcctatagctgactatattattcccttattaaacttttaaattatggaaccactatgcttttactagagaaattttaaacacacacataaaaattcagatcatttgcagtcctaccatcaaagacaactacttttaacagctgctatataatttttctgcacggcatatcataaattaaaatatattttataaaaataggatcatattgtgcatgttgttttactgtcacctagtaaagatttagtgaatgtaggttaatactaatgttataatcaacattattatcaactgtcaacataaatcttcctgcgtaaagatcaggatt

SEQ ID NO: 104073 - DNA, 245 bp, Homo sapiens
gaacccaaataatctgaatctaccctcttctaccacttccaagctgcttgaccttggggaaaaggaaggtccttatgtcatagtctcctcttcagtaagcaaaggataacaacagtaaccgcaacaacaataatacctacttaataggactgttacaagaattaaagaaggtaatttttataaaatatttagtgtctggcacataatgagtcttctattaataacatctattagttcatccattc

SEQ ID NO: 104074 - DNA, 352 bp, Homo sapiens
cccacccacagtctcttctctcctatttgaaacacaggactctgtctcctcctagatacacaccaaggttgaacaagcactcctaggggaataaagccactagttgagccatgccaatcaaatcctctcttttggaaacttgaacaaagacatagagattacaatgagaatttgaaggacgctgtataagatactagactgacagccgtgcatggtcatgagcagcccagggatgaccactgggagaagagaaggcggagagcagcagagatcacagaaatcatgaggccctgaaaagtgaagatcccgccctcactttctcactttcctgatgcagtcatgtgaaatttgt

SEQ ID NO: 104075 - DNA, 191 bp, Homo sapiens
aagaagaaaatgaaaaacatttaaaattttataaaattccaatggctcagcaacatcacactccctagtgataccttgacacatagtaggtttacaacaaatgccgatattttttccttcatgtagaaggcgaatggggaattacaggggcctttttattttctctctcatccatatctgggctttctgcc

SEQ ID NO: 104076 - DNA, 428 bp, Homo sapiens
gtgaccagggcaggctttgcttaggtgtcctaagatgatctgaagacggggaggcctgggatggttgacggcacctctggctgtggaacagcataagcttgctatgggagtgagtgtgtctgggacagctttaaggagcgtggtttgcctgaagccaagggccgggtttgggggaagaaagccttggtgtcggatggggaaagatagggcgggtcactgggggtctgaatgggagaaggctggactggacctttcaggccaccgaaggattcaggccgaggagctgcatagtgaccgagggtgatgaagctggttttggcttggggatggctggccagaggtgggagaacaggtgtctagggaggcttcttggacaaggggctctgggactgagtcttgagggtgggcatggtttggagagcaggggc

SEQ ID NO: 104077 - DNA, 422 bp, Homo sapiens
agacagagattaaatatatatgtcttttcttttttttttgagacaggatcaggctcttttgtccaagctggagtgcagtggcacaatctcagcttactgtaacctaagcctccccagtccccagctcaaggtatcctctcatctcagcttccctagtagttggaactctaggtgcacaacaccacgccagttattattattattttttaattttttatagagacaggttttcaccatgttgcccaggctggtctcaaactcctgagtttaagcgatcctcccaccttggcctcccaaagtgctgagattacaggcatgagccactgcatccagcatgcacgtctctttcattgactgtttctgagatgtatccttcacaatgaaccagtaataggaaatgaactggccagatgtggtggctc

SEQ ID NO: 104078 - DNA, 393 bp, Homo sapiens
tccatttctggctttaaaaagcactaccaagaaccaggtaagatggccagctagatgcagccaggagatgcctcttccaccaagtggaaccaaaatatagagtaaacaatcacactttgaacaggtcttttgagagaaaacattgaaagttgatagaaaggagacacagacaccatagatgaagagggcggaagctgggtagcctactctgagtccctgggcaccaggactgtccccagtcctgagctggacctaaagaaggggttaaggaattccagggtactacattctcaccatagacctctgggatcctagctacaggagctcccatgacccccatagatctttgaaatggcagaagccgcctcccagagatcagggagaagcacagct

SEQ ID NO: 104079 - DNA, 224 bp, Homo sapiens
catgtactactgctacactcatccctcactcccacccacctttcggaggtaggccgcccatcactagatttagcagagcatccgctgactgaaatgagacacagctgggaggcacccaccaccacccgcctttgtagaacagctacccaaaaagacaaggatagcaagtcccctgaagcttttccaatctattcctttttgtgattgttttccttttgaaatag

SEQ ID NO: 104080 - DNA, 331 bp, Homo sapiens
attttttcatcttcccgtttccttcctcttctccaggacttccatcttggaggagcaggaatatggtttatcatttgagagtgatataagtcagcaaatacagaatatctgttcttctggtgctgtattccgggagaaagccatagacccttcctcttagggagctgagataggatagtagggaggcaggaaggtagaaatacacatgtattctgagtgccagggtggacgcctgcatgtgagattgttgatacaacaagagagggagtgggagttctcctgggcgggtcttgagctgagatttgaaagaggagtgggtgttttgttgtat

SEQ ID NO: 104081 - DNA, 658 bp, Homo sapiens
ggctctcacctggggcctgagttcttcttgagttccttttcttgctcatgcgaggcttgactcaggacctcactgctctgagtgagaatctggtgggagggaaacggggtcctaggcagctgtgactgctgtgggcattgtccctctagcctcagttctgtaccctcaccccctccccgtggagatgctgcaggccccctgagctacacaccacactgcctgggagtgtagggccctcacaggcagcaaggagtgtggggcctgggtgggcttgaggtggcttggcgaggtgtgggggccacatgatggagctttcttgcagaatctccctaagcgacgctctgccagccctacccgatggctccctgtagctggggctgctactgatcccccactcttgctgccaagcacaaaagcagcccttctggaaatgcaaatggctcggctcagccgtcatctctcctaattttggatttggtaactgagctctcagaaaccaaattgcaggaatctcttttgtgttaggaagatgaagttagtttagcatttttgtcagtaagtgcatatcagcagcaattccccatcgtttgcctccccagcgccttcatgccctaattttcccaatgtgaaataaaagaatagatgtctgtgatttaaa

SEQ ID NO: 104082 - DNA, 662 bp, Homo sapiens
ctctcttttaaaaaaatcaatcttttgaaaattaccccctaaaatgcctttctgacttttttctgataacctctatgaaattttaataaaacagatatactatctattgtttacattgttacatatactatctattgtttacttatactgtaagtatagctgttccttgtatataagaagtaagatttttggctggttacagtgactcacgcctgtaatcccagcacttagggaggccgaggtgggcggatcacttgagtccaagagtttgagaccagtctgggcaacatggtgaaaccccatctctacaaaaactacaaaaattagccaggcgtggtggcacgtgcctgtagtaccagctactagggaggctgatgtgggaggattgctgagtctgggaggtggcagttacagtgagctgagattgtgccacagcactcaaccccgggcaatagagtgagaccttgtcccaaaaaaaaaaaaaaaaaaaaagtaagtttttttgccccctccaagaggtgattttcacccccttagccccactgagagtgatgctataaacagaaaagaatttgaggtgagtgatgtccgtgaatgtagtaacatctgacatttgggataaagccaatctgaaagagtgaacaatcaagtggtagaatgac

SEQ ID NO: 104083 - DNA, 384 bp, Homo sapiens
tggttcttgaaggtcacagtagttccttgactgctaagactacaatatctgcaatagaatgtgtgttttctataattgctttaaacaggtaaacaccagtgctctaatcaaaatgaccattcaatctaaacagaaaactacttttttttttccaggagaacatgtagtatttaacaaatgacatcctaaggttgtaaaggaatggataatttaaagtagctaatgggaatgacaatgttagttgtactgccccaaatctaactgccaataagaatgcctctgtagttttaccacctgaaatacttccagtataggcagctaatctaacctgcaacacagccaattcaatcattgctgacactttcaccatcaacactgatcact

SEQ ID NO: 104084 - DNA, 469 bp, Homo sapiens
tgatatgctagctaactttatttttttcatacataaaacaatgtgtttaaccccaagtgtattaacaatgctttgcaatttcctgcaatgctcaggaaatatctaagactactataccaaaaagcagattgaatttgaattctatttttacatagtaaatataaaattgtattttatagtcctaaaattatatttaataaatatagtgtgaacagggtattattttagtagtttctgtcatgaaatacttatgcctcacaaaaccaatagtgtaaaaaaaatttcaagaacacatcaaataagttacagtttaataaacaatgatttgtccatgaagagtgattatgccttaaattaatattgttgcaaggtcaaaaagttgacattggtaacacaccactcttgaggatacagacattttggcaaaaaaataacccattacgggatcaaattagaaggaaagttagta

SEQ ID NO: 104085 - DNA, 910 bp, Homo sapiens
agagtctgaaaattaatcctgtgtgcttatctcagaagcccttgtgatctctaagcatccctcataatgctttcagaaacaaccaattagaaaccctactggaaaattatgatctagtctctccctctccccaagtgggtcacattttaagtcaagtgtcgacaatagtacttactcaatgacttgattttttattgaacttagcaaaattttaatttttttaaaccattaacttaaagatgacttcagagacttcatcatgaggaattttatcttttttacttttgaacattatctatttttccctcaaagtttctgttgtactctgaacctgttttaatgggaagcacagacatttccatcatctcaggttcagaaaaattaaaaaaaaattttattatggaaaaataaacatatacaaaagtagagcaaataggataatgaagccccatgtatgcatcactcatcttcacccattttcaacacatggccagtttttcatttatttcaggggtcaataaactttttctgtgaagagctgcatagtatatatattttcagccttgctggacacatttgatctttatcacttattttatttttaaatcttttgaaaatgtaaacatcagccgggtgcagtggcttacacctgtaatcccagtaattggagaggctgaggctgccagatcacttgagctcatgagttcgacaccagcccaggcaacatggcaaaaccctgtctcaacaaaaaatagaaaaattagccaagcgtggtggtgagcacctgtagtcccagctacttgggaggctaaggtgggaggatcacttgagtccaggaggcagaggctgaagtgagccagtcacaccactgcactctagcctgggtgacacagccagatcttgtctaaaa

SEQ ID NO: 104086 - DNA, 376 bp, Homo sapiens
tatttatttaaaaaatatgagcatgattacattaaactatatattatacaatctatccaaagtttaactaacttaaataataaaacctggttgagcagggtggctcacacctgtaatcccagcactttgggaggccgaggcaggcggatcagttgagcccaggtgttcgagaccagcctggccaacatggcgaaatcctgtttctacaaaaaatacaaaatacaaaaaatttgccgggcatagtgttgtgtgcctaggaggcacaactacttgggaggctgaggtgagaggatcacttgaacccaggttgaggctgcagtgagctgtgatgtcgtcactgcactccaccttgggtgacagagtgagaccttgtctc

SEQ ID NO: 104087 - DNA, 358 bp, Homo sapiens
tggatattaactaagtttgggcctaacaagtataccttagtgcccaactgcctcattcaactcattgggcagttgttgcaccgggtggggaggtctctgctgggatcactgaaccaaaggaaggcagaatcagcaagacctgttgctcatggccttttacccactcacagagtctgactcaggctcctgttctcattcagggtcagtcatcctttcagtctcatcccctggatctcaactcctccaccttcctggacatcttataataatttatctcgtgcctccttcctccttccagaatgacaaaattagcatcatattagtcagtgggcttatgtgccagatagctcagttgttt

SEQ ID NO: 104088 - DNA, 384 bp, Homo sapiens
gggatagtggcagcacctgtctcactaggtggtcagggtgcctagaacagtgccctacaggttgtgaatccctgaatagtgattggtgcttcttcctccttctttgcttcctcctccttctccccttctccttcctgtcattttcggaattctctcagcaacttcagcaaagagtgagcgctctccaaggctaactcttcagccacggccccagatagagactcgctggcccatctagggttgtgcacttgtcctggagacaaaggttgggtggggtcaaccctacgtaaagcacatggttaggaagggatattttccaaaaggaaaatcaggatactggtgccagaaaaagggggaaaggcaaaaaacagcagctgtcccctt

SEQ ID NO: 104089 - DNA, 161 bp, Homo sapiens
aatttcacagcctcggggaaagacattgtttcccctaaagatcaggtcttgaagttggaagttgtcatttggtctataacttacactaatgaaaagcctcttagagtgcttactgtgtgccagacacattaatcatagtagtaacagctgacatttgagcg

SEQ ID NO: 104090 - DNA, 120 bp, Homo sapiens
acgcatcgtgcctcagtcatcgagagtgaatcagaaatcctgcaccatgagaagcagtacgagccattctactcatcttttgttgcactttccacacactatattacaacagtttgcagt

SEQ ID NO: 104091 - DNA, 282 bp, Homo sapiens
agtgagctgatgatcgctccatggcactccagcctgggcaacagagcaagactaagaaaaaaaaagaaagaaaaagaaaaagaaaacaaagtaatgtaaaaggtgttattcaggctggggacccccaaagtgctgggattacaggcatgagccccagggcaggcctaggatttgcattacaaggctctgcattgttcctgagaactggagagagtgctcaatctacctttcgctattgagcaacattcagaagtcagttttaaatctcttatcttctgcata

SEQ ID NO: 104092 - DNA, 331 bp, Homo sapiens
agctgttaagatgccgttcaaccccaaggttccacgagtgagtgatcgcaattgctgctgcagccccgcctccactggggattattatcagagattgattttccactccaggctctcccgtttctagtgccactgctgaagtcctaagtcactgcctcctaactggtcctcctaccctaactcctcccagacaggcttcctgccctaactcctctctgaccagccctcctgccctgacttctccctgaccggtcctcctgccctaactcctccctgaccagtcctcctgccctaagtcttctccctgacctgttctcctgccctaagtctc

SEQ ID NO: 104093 - DNA, 228 bp, Homo sapiens
tagagcccgtgaggctgggtctcgggcaagagagctgggcatgcgacatctctcagggaggcctctggtccagggaccctgacagcatctctgcaacatctgcagctggactttctgggttcaaatcccacaaggtaactgtccatgagtcacaaaatgtccctggactctggatccccaaaaacaaagcaagcacagtgatgatggtcacttcaaggagctgctcag

SEQ ID NO: 104094 - DNA, 390 bp, Homo sapiens
aaagactttatgtctcaggttccatgtttgtgaaatgagaaataattatagctgctgcacaggcttgtcaaagaggattatataaagagccttggtgtgacccctagccatgtccttttcagagtacgtggctggaactcttagctccttcagtctgacattggagatgactagagaccttgaaccaagtgcccaggaggcagaaactctccaaccactacatctctgtgctggcctccaagaaggattgcccacattgtgggaaagatcatttttattctcagaaaggagcccctggtcagataacttgcttggaagcatctgggtttccccagtgggctatcagctgcctccaatgctgagaaaacaaagtgtcacatcgctctgcag

SEQ ID NO: 104095 - DNA, 206 bp, Homo sapiens
aaaaaaatgacgataaccaacgcaccctcacacttctttgagccctctgctgttctaggtttacaaagctgggctttcaattcccttcccatgtcacctcgctgtcttcctgagttcaattaaagaaaacagtaacagcaagaggctgacgttattggaaccctttttgggccgcaggtcttgcttctacgaggcccttttgaagt

SEQ ID NO: 104096 - DNA, 370 bp, Homo sapiens
gtaggaatggagaagaaataatgatttaaaaacatttaagggatccttctaacaaaacccagtgattagtggtacatctggaatgagggattattccaaggtttattatttagataataggtgactcatgcagagactaaacacaggaaaaacaattttcaggaaaaattagaaaagttgctatttatacatgttaaatttgagttgtctataacagatctgtctactgatatcaatttggctatcgaaatcaggagtaaaattttgtctaaagataaaagatgaaaattagaagtgcctaaaactgacaacgggtctagtatctagatcatccaaggaacttctgcaaattcatcagactaaaaagaag

SEQ ID NO: 104097 - DNA, 315 bp, Homo sapiens
tctgcctttaccttggagtgtccagaaaagacagcaggggccaaatgacaagccaaagttagtgtgacatttccacggagtaggggttgcaaaattgccgttggaaagaggagaaataaaggccatggaaagaaactctagggaaatgacaggccttattcacagactatgtccagaataaaggagccccagggtcaagggtcaacagtaggcctgttggaaactagggtcccattggagtcaggaaataaaaaattcaagtgattcataaaagtcttgaaaggcatgacaatttctaacagttgctagaaatgg

SEQ ID NO: 104098 - DNA, 142 bp, Homo sapiens
gctttctgtgtaaggacctacagaactggacacccatgctgccagcactataccacaggccaggcggagggcaggcctcacccagggatagctgtggccatgacaagcctctctcccttccaggccttggcttcctcatctg

SEQ ID NO: 104099 - DNA, 119 bp, Homo sapiens
gcttttagcctcccaatacctggaaacctgctcctgtcaagaaaggacccattatctctttctttcccacgagacgtggagatgaggaggggtgtgtgcctgccgagatgatatcaaag

SEQ ID NO: 104100 - DNA, 142 bp, Homo sapiens
aaaaaaaaaaaaaaaaaaaaaaagcttttacgtaggcctctatgtaagaaaaacttcaggaggaggcgttccccctgctttctgaggacgccctactgcgtaactggtagctttcaataaactctctcgcctcactacactc

SEQ ID NO: 104101 - DNA, 338 bp, Homo sapiens
gcagatttcagcaaatatttgccaattgatctcttagtttagagagttggtaaagtattttaaaattgccacatctcattttccaggattgaaattcctatcttttttgaaattcacataaagtcccatgaatatgattttgttggtttcagatagaatttcccttcaggacaatagcattctctacttaagaatgtgccagctgattggaggtccagccctttcctatctgcattagttacatttaccacatgctttctgagctgtctctcagctgtggctaccggatcgaatctgctggctcccaagtatgcgggggctctttcacatgcaccccc

SEQ ID NO: 104102 - DNA, 793 bp, Homo sapiens
cggcgcgttggagcccgggcggcgccgggaacagctgccgcggcgtcctctagcagcgcgcggctctcccgggacctgcgccggccgggggcggggagaggcggggaggggaggccggcgggcgggaaggggcggggagcgcgctcctgcggcggcgacggcggcggccgtcctcatcccggcgcttgagaggacgcggggctgcgcaaatggcttgtcccgctctcggtctggaagctcttcagcccctgcagcccgagccgccccccgagcccgccttctccgaggcgcagaagtggattgaggttgctgaatgctataaagccaggacttgtaaaaaagatcaatagattgcctacccccatggcaggactggacaatattatcttattcttgagcaggttgtacagagctcggccttaaagaatctcaacttttggacccgagtgacctccaggatacatccaacagagtaacagtcaagagccttgattatagtaggaagctgaaaaatgtattagttaccatttactggctgggaaaagcaggaaacagttgcacatcctacagcggaacggaactaaacctgaaggagtctgaaggatcgtggctcagatgcgacaggacactgatgacattgacagtcttaacgcagtatcgagaaagtggtacatcgactggtgggattccgaagcgcagagaatccctctctcctcctcgcacggcaagcatgatcctcgacagctggatcctttgggtccgcctcggaagaggctcaccagatgagaccagg

SEQ ID NO: 104103 - DNA, 166 bp, Homo sapiens
tatctggggagagggtagaggtcaggatgacatttaagtcactccaggttaaagtgaaggactgagttagatattggaattcctgtatatatttattggggtctgatgagaaagagccaaaatgctgactgatttgggaaaggtctgatagagaaaaaggcacatg

SEQ ID NO: 104104 - DNA, 438 bp, Homo sapiens
gtcccctattcagaaagatgacagactccaggtaactgacggaacagatcttgatcttgcttcttgcttaaatgaaggtttagaacatcttcagatgcaggcacatttattattgttcatctgaataattttggtgaaaatttttttgcctcttatgtaccattttgtccctggtgttttggttctgttttccttgatgtaggcttttttttttttttgtcttcctgagatggagtcttgctctgtctcccaggctggagtgcagtggtgtaatctcgactcactgcagcccctgcctcccggttacagggaaaaattctcctgcctcagcctcctgagtagctgggattacaggcgtccagctaatttttgtatttttagtagagacgagattccaccatgttggccggcctgttcttggactcctgactcaggtga

SEQ ID NO: 104105 - DNA, 247 bp, Homo sapiens
agcaacaaaagtcaagtgctcgggaatctaacatttacaaaattggttttgctttaacacaaacaaagatttctttttcatttgtaattatggtaaaatacacataacatagaatttatcatcttaaccatttttaagtgtacagttcagtaatggtaagtacattcacactgttgtatattctgtctctggaactcttctcatcttgcaaaatgaaaactttaaacccattaaatgacaagtcttc

SEQ ID NO: 104106 - DNA, 333 bp, Homo sapiens
tgagagctgatcatggtgggactgggggaagatgaccctagcttcttcctgttggcaaggggcacagttgaggtaagagtcaggattagaggaacgaaactgccttggagtaacctgtaagtatttacaagtgctcagttggggatctcaggggtgcagtacaaacaccttagtgctccaatccactgtcttagcacagcatttaattgcacaccagactataagataataatttatcttttagtctctgataatatttcatgaaacacagggccagaatctgaaactattcaatctcactgggacaatctgttttccattgccaacgcactg

SEQ ID NO: 104107 - DNA, 374 bp, Homo sapiens
tacctctctcatggtcctctccctcgaattcagcctgtcctacttgaaattttcctctcccttgaattcagcctgtcctacttgaacttttcctctccctctgaaagggctactcccctttgcccacccacagtgagtgccaacaccacccaacaacaaaagcccaacccacaggccagctttttaaaatgatcctccattactagtggaaatatcttcaaaatctctcttgcccactgctcactcaagtctagcttcctaaatggccatgctttctttggtatcaccacctacagtccctcagtccctttttttgagacagagtcttgccctgctgcccaggctggagtgcaatggcttgatctcggcttact

SEQ ID NO: 104108 - DNA, 467 bp, Homo sapiens
ttttttttttgagatggagtctcattctgtcacccaggctggaatgcagtggcgcgatctcagctcaccgcaagctccacctcccgggttcacgccattctcctgcctcagcctcctgagtagctgggactacaggcgcccgccaccatgcccggctaattttttgtatttttagtaaagatggggtttcaccgggttagccaggatggtctcgatctcttgacctcgtgatccacccgcctcggcctcccaaagtgctgggattacaggcgtgagccaccatgcccggccatcagatggtatttcttaaaatccaaaaaaaaggatttttgaaaagtagatgaggatagttattatcattactatgtatttgtttatatgctatcttaaccaaggaattaaagttgctcaatttaaaggttttctaaataatctacacttacattacaaagttcagacacatatat

SEQ ID NO: 104109 - DNA, 324 bp, Homo sapiens
cttgctaggtagagatcacaaatatttaaagaaaatgtctcttgtaaaagtaggagaacaaataaatgaaaaaatttaaaagattattagaggaaacagagacaattcaaaaattcaagaagagttaaaaaaaagaaaaattcatcttctccctgaagtcagtaactacagagagctgtgagaagatacacaatctataaaactagaatagaatactattgaaaaagtgactatattggaacaacaaaaattcttgaatttaagcaatcaaaataactgttggtagagaaacagcactgaggaaacctcaacgaaaaaagaaca

SEQ ID NO: 104110 - DNA, 324 bp, Homo sapiens
tacatttaaaattttattttatatttagaatcacattaccctttaagttctaaataccaaaataaagagaaaggacatcaaagtcagccttaggagtaagaatttcagtcaatctagcacatctgtagagctcctcaaggctgaaaggaggggctctgaaactcccaaaatgtgtacaagttgttgtatttataaggaaactggcatctttcttgggagatgctttacaactttctctaaattctcaaaagggaaagcaatatattttttaaaagtttaaaaccaccatagtaagtaagattctctttccatcgtttatctaat

SEQ ID NO: 104111 - DNA, 700 bp, Homo sapiens
cgtggtggtgggcacctgtaatcccagctactcgggaagctgggataggataatcacttgaacccaggaggtggagcttgcgttgcagtgagccaagactgtgccactgtactccagcctgggcgacagagtgagactgtctcaagagaaaaaaaaatcttttcagtgctgcatcacaaatggatgggggaaaggagcgggtgcagaccaacaatgaatgcaagctgacccattatggtagcacagatgaaagatcttggctacccagattggatgtgaatgctacagacacaatagaaatatcataaaaatcattagtgccaaggatttggcagctgaatgaggggggctgaaggacagggacgaatcaagacttggcaatttttggcttgaacacccaaaaggatgatgtgccatgtattgttttcattaaatgtttaagggaaaacatgatgtgaaattactatgtggaatagtgttgtttttaatacttaagaaaaattacattgttaactacaaagtaatttcaaacttaatgtgtatttcttgatcaactatagtcttcccacaatttctcaatgtctgagcttacttaaaaattgccaacatcaattttagattcttcttagacaattttctactgtccttagaataacggattctaaacatggcctaccaagactgttcccaccctgtcctt

SEQ ID NO: 104112 - DNA, 118 bp, Homo sapiens
acctggaaagaggaggtgattctaactcctcacttaggtgaatggagacatggcattgccactaaaaggaatagagaatactggaaaagaaacaaacatctgaaggggaagtagctct

SEQ ID NO: 104113 - DNA, 177 bp, Homo sapiens
tcctcacttccatctacttccacttagaaagtctacaaatccaggagtctacttcatttatctggacaatagcccagtgcagagaagcagagactataccaactaaaaagcagaggaactggagaaaattttccctgaatcactctggagggcttcaaaagaatggagacagatgag

SEQ ID NO: 104114 - DNA, 282 bp, Homo sapiens
gaggatatctgccgttttgggacttgcatgtggtgatattgatggaagctgaagtcgagatggtgaaactacttatagggaatgttggtatgggttgataaaatgagtttaatttgggccatgttgaatttgaggtgatatggaacatacaagtagaagtgatcatagatgctgaacatgcatggtgcaggtgatagtggttgatattattttgagggttattagctaagttgaggccttgaaaataaatgagttctcctagggactttgggtagagattgt

SEQ ID NO: 104115 - DNA, 499 bp, Homo sapiens
ttcttttctttctttctttctttcttggttttttaaaatagcattttggcggtcgaaattggtactccccagcgaagtccccattgatgagctaagcctctgtctacatgtctagtatattttagttttaaccaaaggaattgtaatttaatagaaaaaacataaccaaatttcctcattccttgagcattctagtttaatcagtgttttatcactattgagaggagcatttaaaactttcaattagtcatttacagggaaagtatggattggcagaaggatcctttccccaatcttcttacaaagacacctaaaatgtgaggtaaccaagctggcccatttgtaatagtctagtaaacactagagaattttttgactaacacccagaaggtgagagttaggagagttagagctcacatggatcagaaccagttttcctagtcctccagcctgggtgacagagtgagactctctctcaaaaaaaaataataataataat

SEQ ID NO: 104116 - DNA, 1114 bp, Homo sapiens
ggcctccccagccatgtggaacaggtcaaaatgggagattttctggagcttcgtgaaatggaaggaagttgcctgcatttccaatgtttgttatggccagcagagccacccagctgtacaactccatgatgcattctttcaacttgttcagtgcacaatcccataaactatgaagcaagtatgctttgacatgaatgcatgtgtttcctctgggccaagaaaatgccatggaacataactggaatgaactgtcttgatatggtcccaaactggaaagctagcttcctgagctacctctatctggagggatatttccagaaggcagaagataaaagtgggttataagaggctaccacttataaacttcagcggtgaatcggggaattccagtgtgtacacacctatgggagagattctgaagactccattgacagaggccttggaaaagaaagtatttggatgcttgtcacactcagagatattgacaaggaaggcaggtctgcaaaaaaccctacttagatataaagaattttgccctgtttctaagtattcttttactctcaattaaggaggatctggaatatcaacaaaagagaagaagtagacaataaaacaaaatcacaatgtgagagaagcaaaacccggggttttaaccagttctctgaaatgggttccatagctatgacctcaactgaaagggagagaagacgcgttacattaaatataagcttgaggttttgggttaaactggtaatttcaacccctgaagagtaatggtaattatcaaaaatgaacttatatttgtaactgtgactcaaaagccagggacttttctgagtttttgctatgcagggacagataaaagaggtttgacacaacacataggagttaatgaaaggaggaaaaataaactaagttttgatagcatttaaatcagttcagaaatttcaaaacctgggaaaattttaactccaaatattttttagagactttaaacatgctaacatgttaatctgtttattttgaataaacaatatcagacttaatttatatatgaataataaaacatgcatttaattttctatagtcagaatgaaagttaaaacaacaaata

SEQ ID NO: 104117 - DNA, 347 bp, Homo sapiens
tcagctgggagtgagaaggccccaagatggctcagtcagacattgctcttccccacacctcgccaagactcggtttgctcttctagaaaacaaaacagaagcccagatcaggagacaaatcttagagagagaagtgaggtgttaggcaggtgtctggggccatcatcaccttcccctgctcctccgctgaaggaggctgtaggaggaacgagcatgttattatgccatttgctagtttcgtgatcttggacaggtggctttgcctctctcgacctcagtttcctcatctgtagagtgaaggtaataattgcgcttatcttggaagcatggtgagggttccgtgggtc

SEQ ID NO: 104118 - DNA, 348 bp, Homo sapiens
cctgagctcctttgcctggtctatgtttctctttgtcctaacattttttaactgctagcacaccggatcattgatctttcatggtttattgtatatcgtcttattcccctgctggaatgtcagcttcttgagggcagtgatcttttatctgcatccccaggatccagtacagtgcccagcacatagtaagtgcttgatatctgctgaattatgtacacccagcagtcagctctgggcaggcacagagagggtatttctgagtgaaggctgaatgaatgaattaatgaattgttgctgctgggaggaggcaaggctgcacatctgccagcctgctccccccaggcccac

SEQ ID NO: 104119 - DNA, 177 bp, Homo sapiens
ggtttttgtcctgtctcctggcaagaagctcctgcaacccttggaatagcctctgaagtgatcaaagtgtcttttatatgctaatgagatgactgttagctggctgcccctaggtagcttctggatggaagctggtcaccagaaaaccagacaggattagaaggttgggaatttcat

SEQ ID NO: 104120 - DNA, 139 bp, Homo sapiens
gcttctttcatctggaaccgccttccctttccctctctccgttctgttctgtctttctgtcttttatgacgttttggaagggtctgggcctcttgtcttgtagaatatcctcccatcgggatctgtctgtctcctcacg

SEQ ID NO: 104121 - DNA, 154 bp, Homo sapiens
tgcctggcaaggaagttgttgtttgctgacgatggttggatggggcctggactctggagcagaagtggcgcttgagcacagttgctgtttgctgacggtggctggatgtggctcggactctttggagcagaagtggcgcttgcgcacatctcga

SEQ ID NO: 104122 - DNA, 278 bp, Homo sapiens
tgaaggtgaacacatgctgagagaggacactttttatgctctccattgcctcggccaccacccctatctgttagctcttattcttaagtgccatctgctaaactatagcctgaaatataccaccaaacaaaaatacatcactgcaataagaaacatctgagaaagccactgcatgaatctatctgcagccaaggaacctgtatggagcctcagcaccttgaaagcactcaaaaataaagccaattgattatatgcaacatatatcacggtcatgccat

SEQ ID NO: 104123 - DNA, 197 bp, Homo sapiens
tacaaaatggttatcataagggttcaaaactttgtaatcagtgatatcacttaatgtttgccattatatagtctgcttcttgttcttgctaaagaaagatttttgagttgatttgtgtgcttcacagagctggaattcaatttcaaagcagaatgctgaattaataaatatgagcattatttttagggcttttgaag

SEQ ID NO: 104124 - DNA, 171 bp, Homo sapiens
cgaaggcgactctaaggatccccactgcatcggtgctcaaaaaacaaacaaaacactaccaccaaaaacctaactagccatagtcaagtagaagtatacaaatattccagaagaactaaactataaggtgtttgtaaatatttagatgtgaatgagtataaacaacgcatc

SEQ ID NO: 104125 - DNA, 144 bp, Homo sapiens
ctgctccagccatgttcctgctctcttgttcacttttcaccacgattgtaagtttcctgagacctcgccagaatcagaagccactgtgtttcctgtacagcttgcagaactgtgagccaattaaacctcattcctttataaatt

SEQ ID NO: 104126 - DNA, 372 bp, Homo sapiens
ttcctttacctgccatttctcttgcctcttgtgtttgcttcctaggattgattggctatatcttactttgtatctctactgttctttgattatcggtgtgaatgttttaatgaagttctcaaattaacttccattataatgaaaggcagtgatctttttaactttaaattatggcaacttacatagttgtaaaattatgttccggtcttaggatgggttggcaattcaaacatctaggtccacttttcaaacaggtactttagagtcataggtactagggtgtgtcccactcttgcaaatcagtagctgattcacgtgttacaaaagatgtgtcattaaccatttgtttactctgaaacttcatatagtata

SEQ ID NO: 104127 - DNA, 542 bp, Homo sapiens
agcaaggaaggcaactcctactgtcctcacttagaaccagaggaacagtcctgcccagggtgaactcaccctcgagccagccaaactggtgaatgcccttccccaagcgggagaagccctcatatctccaagcagccaacatgcttctgggttgaaggagcagctatgtgcccacacccaggtcctgagaaacagccgcacagtgccccacccactacagacaagccccagtcccgcccaacagctttgtatccacaattagagcctgcgaaacagacctgtgtgctgcccctgacagacatgctccttggctatctgaacagctctgcgctcacatgccaggactgagaaatagtctgcaggccacccctggtgggaaagccctcgagtcagccaattatccctgtgcccatatcccaggctgagaagcagccctccaagcagtatcttgtgggcagatacttccaaaaggaagcaaaagacctctacaatgaaaactacaaaacacttatgaaagaaattgaggaggatacaaacaagtg

SEQ ID NO: 104128 - DNA, 478 bp, Homo sapiens
tgagtatgggcaataacagtttgtgctgtgctaatacattctgatttcatcctataggccatggtggtcccctggagaattttaggcaggtgagcgacaaaatggaatttgtgttttagatttcaaggtccttgacagccgggcgggggcgggggtcttgttcatccttgtgtcatcagtaagtcacccatcttttgactcatagtaagaaatcaatgagcatttgtgaaatgagtgaaagacaacgccggagactatggaggccagaggggcatcagggagacaacccagggcctgttgcactagcctaggtgggagcaatgagagtgtggacagaggcagcaggaggtgctgggggaaggtcacactcccctccaacttgggaaggagggtcacagtatttggtgactgatgggggagatggatgaagttaaagcaaagatgactttatatttttagctagggtgatggcaaaact

SEQ ID NO: 104129 - DNA, 428 bp, Homo sapiens
  misc_feature (114)..(114): n is a, c, g, or t
aaaacccaaccaaaaaaccctcatttcctgctgtttaatttcaactttttaccaaccctcaattttggaaggccccaatccccaagcaaaaaagccccttgggacttgggcaangggcccagctggggctgggccctgggttttgagaaactcgctggcaccacagtgggcccctggacccggccgcgcagctggtggactgtaggggctcctgactgggcacaggagctcccagcttttgtccacggccagcaggatgggctgtcgtgtatatagctggggcgagggggcaggccccccttgtgcagagccaggggtctgagggcacctggctgtgttcccagctgagggagggctggggcgggggccgggcttggaacgatgtacgataccctcatagtgaccattaaacctgatcctccaccgcg

SEQ ID NO: 104130 - DNA, 2958 bp, Homo sapiens
atccttaattaaattaatccccctcccccctcgggtccgggcagcgctctcccgggagcggcggcacgcgcggagcgccgggtgcggccatgcggggaccgggcccgaccccgagcccgaccccgagcccaagcccgagccggagcccgagcgagaccccgagcccgagcccgagcgcgacccccggtgcggcgcggctaccccggcggaggcggcgggcgcggggcgcgctctgaggcccgggggatgcgccgccgcctcgaccatgggcgccgccgcctccaggaggagggcgctgaggagcgaggccatgtcctcggtggcggccaaagtgcgagcagcccgagcgtttggagagtacctgtcccagagtcaccctgagaaccgcaacggcgcagatcacctgctggctgatgcctactctggccacgacgggtcccccgagatgcagccggccccccagaacaagcgccgcctgtccctcgtctccaacggctgctacgagggcagcctctcagaggagcccagcattaggaagcccgcaggcgagggccctcagcctcgagtgtacaccatctctggggagcctgccctgctgcccagccctgaggcggaggccattgagctggcggtggtgaaggggcggcggcagcggcaccctcaccatcacagccagcccctgcgcgccagccctggtggcagccgggaggacgtcagcaggccctgccagagctgggcgggcagccgccagggctccaaggagtgccccggatgtgcccagctggctcctggccccacccctcgggcctttgggctggaccagccacctctgcctgagacctccggtcgccgcaagaagctggagaggatgtacagcgttgaccgtgtgtctgacgacatccctattcgtacctggttccccaaggaaaatcttttcagcttccagacagcaaccacaactatgcaagccatctcgaacttccgcaaacacctgcgcatggtcggcagccggagggtgaaggcccagacgttcgctgagcggcgcgagcggagcttcagccggtcctggagcgaccccacccccatgaaagccgacacttcccacgactcccgagacagcagtgacctgcagagctcccactgcacgctggacgaggccttcgaggacctggactgggacactgagaagggcctggaggctgtggcctgcgacaccgaaggcttcgtgccaccaaaggtcatgctcatttcctccaaggtgcccaaggctgagtacatccccactatcatccgccgggatgacccctccatcatccccatcctctacgaccatgagcacgcaaccttcgaggacatccttgaggagatagagaggaagctgaacgtctaccacaagggagccaagatctggaaaatgctgattttctgccagggaggtcctggacacctctatctcctcaagaacaaggtggccacctttgccaaagtggagaaggaagaggacatgattcacttctggaagcggctgagccgcctgatgagcaaagtgaacccagagccgaacgtcatccacatcatgggctgctacattctggggaaccccaatggagagaagctgttccagaacctcaggaccctcatgactccttatagggtcaccttcgagtcacccctggagctctcagcccaagggaagcagatgatcgagacgtactttgacttccggttgtatcgcctgtggaagagccgccagcactcgaagctgctggactttgacgacgtcctgtgaggggcagaggcctccgcccagtcaccatcaggccactccctctgcaccgggacctggggctgggccgcctcgtgctccccgggactgtgtggctccggtctcgcctggagccacttcagggcacctcagacgttgctcaggttccccctgtgggttccggtcctcgctgcacccgtggccgcagaggctgcagtccctgggggccgggaggatcccgccctgtggcccgtggatgctcagcggccaggcactgacctgccatgcctcgcctggaggctcagctgtgggcatccctccatggggttcatagaaataagtgcaatttctacacccccgaaacaattcaaagggaagcagcatttcttgttaactagttaagcactatgctgctagttacagtgtaggcaccccggcccagcagcccagcagcccacatgtgttcaggaccctccctgcccaccccctccctgccgtatcgatcaccagcaccagggtggcccgtgtgcgtggggccagcgtcgccgggctgcccagcctggctctgtctacactggccgagtctctgggtctgtctacactggccgagtctccgactgtctgtgctttcacttacactcctcttgccaccccccatccctgcttacttagacctcagccggcgccggacccggtaggggcagtctgggcagcaggaaggaagggcgcagcgtcccctccttcagaggaggctctgggtggggcctgctccccatccccccaagcccacccagcactctcattgctgctgttgagttcagcttttaccagcctcagtgtggaggctccatcccagcacacaggcctggggcttggcaggggcccagctggggctgggccctgggttttgagaaactcgctggcaccacagtgggcccctggacccggccgcgcagctggtggactgtaggggctcctgactgggcacaggagctcccagcttttgtccacggccagcaggatgggctgtcgtgtatatagctggggcgagggggcaggccccccttgtgcagagccaggggtctgagggcacctggctgtgttcccagctgagggagggctggggcgggggccgggcttggaacgatgtacgataccctcatagtgaccattaaacctgatcctccaccgcg

SEQ ID NO: 104131 - DNA, 2373 bp, Homo sapiens
cgaccactggcctggccctgctctggggacgtggcaggcaggagaggccatgtggcccgggctgcaggaaagcatctcaccctcagtcctgcactccgagggcacgtgtctctgtctgggctggggccagcagcaaggcccccctcccccactccaatcacacagatgtgtctgggaagcttttttgcccgttttggatgttgggccttggcagggtccaaagtttggtggaggagaggacctgcccctgaggtggctcaaggacacagagcaggagagggggctcctgcaggcccccagcccgccatggggtggtgcagacaggagccccgctctgctgcagcgcaggcaggctggatcctctgccacatgggcgtggaggctcagggcgaacttccgcaaacacctgcgcatggtcggcagccggagggtgaaggcccagacgttcgctgagcggcgcgagcggagcttcagccggtcctggagcgaccccacccccatgaaagccgacacttcccacgactcccgagacagcagtgacctgcagagctcccactgcacgctggacgaggccttcgaggacctggactgggacactgagaagggcctggaggctgtggcctgcgacaccgaaggcttcgtgccaccaaaggtcatgctcatttcctccaaggtgcccaaggctgagtacatccccactatcatccgccgggatgacccctccatcatccccatcctctacgaccatgagcacgcaaccttcgaggacatccttgaggagatagagaggaagctgaacgtctaccacaagggagccaagatctggaaaatgctgattttctgccagggaggtcctggacacctctatctcctcaagaacaaggtggccacctttgccaaagtggagaaggaagaggacatgattcacttctggaagcggctgagccgcctgatgagcaaagtgaacccagagccgaacgtcatccacatcatgggctgctacattctggggaaccccaatggagagaagctgttccagaacctcaggaccctcatgactccttatagggtcaccttcgagtcacccctggagctctcagcccaagggaagcagatgatcgagacgtactttgacttccggttgtatcgcctgtggaagagccgccagcactcgaagctgctggactttgacgacgtcctgtgaggggcagaggcctccgcccagtcaccatcaggccactccctctgcaccgggacctggggctgggccgcctcgtgctccccgggactgtgtggctccggtctcgcctggagccacttcagggcacctcagacgttgctcaggttccccctgtgggttccggtcctcgctgcacccgtggccgcagaggctgcagtccctgggggccgggaggatcccgccctgtggcccgtggatgctcagcggccaggcactgacctgccatgcctcgcctggaggctcagctgtgggcatccctccatggggttcatagaaataagtgcaatttctacacccccgaaacaattcaaagggaagcagcatttcttgttaactagttaagcactatgctgctagttacagtgtaggcaccccggcccagcagcccagcagcccacatgtgttcaggaccctccctgcccaccccctccctgccgtatcgatcaccagcaccagggtggcccgtgtgcgtggggccagcgtcgccgggctgcccagcctggctctgtctacactggccgagtctctgggtctgtctacactggccgagtctccgactgtctgtgctttcacttacactcctcttgccaccccccatccctgcttacttagacctcagccggcgccggacccggtaggggcagtctgggcagcaggaaggaagggcgcagcgtcccctccttcagaggaggctctgggtggggcctgctccccatccccccaagcccacccagcactctcattgctgctgttgagttcagcttttaccagcctcagtgtggaggctccatcccagcacacaggcctggggcttggcaggggcccagctggggctgggccctgggttttgagaaactcgctggcaccacagtgggcccctggacccggccgcgcagctggtggactgtaggggctcctgactgggcacaggagctcccagcttttgtccacggccagcaggatgggctgtcgtgtatatagctggggcgagggggcaggccccccttgtgcagagccaggggtctgagggcacctggctgtgttcccagctgagggagggctggggcgggggccgggcttggaacgatgtacgataccctcatagtgaccattaaacctgatcctccaccgcg

SEQ ID NO: 104132 - DNA, 2581 bp, Homo sapiens
cgaccactggcctggccctgctctggggacgtggcaggcaggagaggccatgtggcccgggctgcaggaaagcatctcaccctcagtcctgcactccgagggcacgtgtctctgtctgggctggggccagcagcaaggcccccctcccccactccaatcacacagatgtgtctgggaagcttttttgcccgttttggatgttgggccttggcagggtccaaagtttggtggaggagaggacctgcccctgaggtggctcaaggacacagagcaggagagggggctcctgcaggcccccagcccgccatggggtggtgcagacaggagccccgctctgctgcagcgcaggcaggctggatcctctgccacatgggcgtggaggctcagggcgtaagtcccgggcgaggacggaaggtcagagcctgggaatgcagctcgggaggagacttgatccagagcgccaggcactgcacctttgttctggagttgaaggggagccctggaaggctgtcgcgggaagagcactgggtgggatttgcctttgggtgggaggtggtgccaggagccagggagagcactggcttcccacaccgaaggggaacttccgcaaacacctgcgcatggtcggcagccggagggtgaaggcccagacgttcgctgagcggcgcgagcggagcttcagccggtcctggagcgaccccacccccatgaaagccgacacttcccacgactcccgagacagcagtgacctgcagagctcccactgcacgctggacgaggccttcgaggacctggactgggacactgagaagggcctggaggctgtggcctgcgacaccgaaggcttcgtgccaccaaaggtcatgctcatttcctccaaggtgcccaaggctgagtacatccccactatcatccgccgggatgacccctccatcatccccatcctctacgaccatgagcacgcaaccttcgaggacatccttgaggagatagagaggaagctgaacgtctaccacaagggagccaagatctggaaaatgctgattttctgccagggaggtcctggacacctctatctcctcaagaacaaggtggccacctttgccaaagtggagaaggaagaggacatgattcacttctggaagcggctgagccgcctgatgagcaaagtgaacccagagccgaacgtcatccacatcatgggctgctacattctggggaaccccaatggagagaagctgttccagaacctcaggaccctcatgactccttatagggtcaccttcgagtcacccctggagctctcagcccaagggaagcagatgatcgagacgtactttgacttccggttgtatcgcctgtggaagagccgccagcactcgaagctgctggactttgacgacgtcctgtgaggggcagaggcctccgcccagtcaccatcaggccactccctctgcaccgggacctggggctgggccgcctcgtgctccccgggactgtgtggctccggtctcgcctggagccacttcagggcacctcagacgttgctcaggttccccctgtgggttccggtcctcgctgcacccgtggccgcagaggctgcagtccctgggggccgggaggatcccgccctgtggcccgtggatgctcagcggccaggcactgacctgccatgcctcgcctggaggctcagctgtgggcatccctccatggggttcatagaaataagtgcaatttctacacccccgaaacaattcaaagggaagcagcatttcttgttaactagttaagcactatgctgctagttacagtgtaggcaccccggcccagcagcccagcagcccacatgtgttcaggaccctccctgcccaccccctccctgccgtatcgatcaccagcaccagggtggcccgtgtgcgtggggccagcgtcgccgggctgcccagcctggctctgtctacactggccgagtctctgggtctgtctacactggccgagtctccgactgtctgtgctttcacttacactcctcttgccaccccccatccctgcttacttagacctcagccggcgccggacccggtaggggcagtctgggcagcaggaaggaagggcgcagcgtcccctccttcagaggaggctctgggtggggcctgctccccatccccccaagcccacccagcactctcattgctgctgttgagttcagcttttaccagcctcagtgtggaggctccatcccagcacacaggcctggggcttggcaggggcccagctggggctgggccctgggttttgagaaactcgctggcaccacagtgggcccctggacccggccgcgcagctggtggactgtaggggctcctgactgggcacaggagctcccagcttttgtccacggccagcaggatgggctgtcgtgtatatagctggggcgagggggcaggccccccttgtgcagagccaggggtctgagggcacctggctgtgttcccagctgagggagggctggggcgggggccgggcttggaacgatgtacgataccctcatagtgaccattaaacctgatcctccaccgcg

SEQ ID NO: 104133 - DNA, 3216 bp, Homo sapiens
  misc_feature (3048)..(3048): n is a, c, g, or t
atccttaattaaattaatccccctcccccctcgggtccgggcagcgctctcccgggagcggcggcacgcgcggagcgccgggtgcggccatgcggggaccgggcccgaccccgagcccgaccccgagcccaagcccgagccggagcccgagcgagaccccgagcccgagcccgagcgcgacccccggtgcggcgcggctaccccggcggaggcggcgggcgcggggcgcgctctgaggcccgggggatgcgccgccgcctcgaccatgggcgccgccgcctccaggaggagggcgctgaggagcgaggccatgtcctcggtggcggccaaagtgcgagcagcccgagcgtttggagagtacctgtcccagagtcaccctgagaaccgcaacggcgcagatcacctgctggctgatgcctactctggccacgacgggtcccccgagatgcagccggccccccagaacaagcgccgcctgtccctcgtctccaacggctgctacgagggcagcctctcagaggagcccagcattaggaagcccgcaggcgagggccctcagcctcgagtgtacaccatctctggggagcctgccctgctgcccagccctgaggcggaggccattgagctggcggtggtgaaggggcggcggcagcggcaccctcaccatcacagccagcccctgcgcgccagccctggtggcagccgggaggacgtcagcaggccctgccagagctgggcgggcagccgccagggctccaaggagtgccccggatgtgcccagctggctcctggccccacccctcgggcctttgggctggaccagccacctctgcctgagacctccggtcgccgcaagaagctggagaggatgtacagcgttgaccgtgtgtctgacgacatccctattcgtacctggttccccaaggaaaatcttttcagcttccagacagcaaccacaactatgcaagccatctcggtgttcaggggctacgcggagaggaagcgccggaaacgggagaatgattccgcgtctgtaatccagaggaacttccgcaaacacctgcgcatggtcggcagccggagggtgaaggcccagacgttcgctgagcggcgcgagcggagcttcagccggtcctggagcgaccccacccccatgaaagccgacacttcccacgactcccgagacagcagtgacctgcagagctcccactgcacgctggacgaggccttcgaggacctggactgggacactgagaagggcctggaggctgtggcctgcgacaccgaaggcttcgtgccaccaaaggtcatgctcatttcctccaaggtgcccaaggctgagtacatccccactatcatccgccgggatgacccctccatcatccccatcctctacgaccatgagcacgcaaccttcgaggacatccttgaggagatagagaggaagctgaacgtctaccacaagggagccaagatctggaaaatgctgattttctgccagggaggtcctggacacctctatctcctcaagaacaaggtggccacctttgccaaagtggagaaggaagaggacatgattcacttctggaagcggctgagccgcctgatgagcaaagtgaacccagagccgaacgtcatccacatcatgggctgctacattctggggaaccccaatggagagaagctgttccagaacctcaggaccctcatgactccttatagggtcaccttcgagtcacccctggagctctcagcccaagggaagcagatgatcgagacgtactttgacttccggttgtatcgcctgtggaagagccgccagcactcgaagctgctggactttgacgacgtcctgtgaggggcagaggcctccgcccagtcaccatcaggccactccctctgcaccgggacctggggctgggccgcctcgtgctccccgggactgtgtggctccggtctcgcctggagccacttcagggcacctcagacgttgctcaggttccccctgtgggttccggtcctcgctgcacccgtggccgcagaggctgcagtccctgggggccgggaggatcccgccctgtggcccgtggatgctcagcggccaggcactgacctgccatgcctcgcctggaggctcagctgtgggcatccctccatggggttcatagaaataagtgcaatttctacacccccgaaacaattcaaagggaagcagcatttcttgttaactagttaagcactatgctgctagttacagtgtaggcaccccggcccagcagcccagcagcccacatgtgttcaggaccctccctgcccaccccctccctgccgtatcgatcaccagcaccagggtggcccgtgtgcgtggggccagcgtcgccgggctgcccagcctggctctgtctacactggccgagtctctgggtctgtctacactggccgagtctccgactgtctgtgctttcacttacactcctcttgccaccccccatccctgcttacttagacctcagccggcgccggacccggtaggggcagtctgggcagcaggaaggaagggcgcagcgtcccctccttcagaggaggctctgggtggggcctgctccccatccccccaagcccacccagcactctcattgctgctgttgagttcagcttttaccagcctcagtgtggaggctccatcccagcacacaggcctggggcttggcaggggcccagctggggctgggccctgggttttgagaaactcgctggcaccacagtgggcccctggacccggccgcgcagctggtggactgtaggggctcctgactgggcacaggagctcccagcttttgtccacggccagcaggatgggctgtcgtgtatatagctggggcgagggggcaggccccccttgtgcagagccaggggtctgagggcacctggctgtgttcccagctgagggagggctggggcgggggccgggcttggaacgatgtacgataccctcatagtgaccattaaacctgatcctccaccgcgaaaaaaaaaaaaaaaaaaaanaaaaaaaaagaagagaaagaaagaaagaaaaaaaaaaaaaaaaaaaaaaaaaaaaaagaaaacaacatatgacaccaaaacacaataaaaaaccacacgcagggagcacgaacgaaacataggcgaagctacacacagacaagagaaaaaataaaaaataacaaagag

SEQ ID NO: 104134 - DNA, 3556 bp, Homo sapiens
  misc_feature (3388)..(3388): n is a, c, g, or t
cgaccactggcctggccctgctctggggacgtggcaggcaggagaggccatgtggcccgggctgcaggaaagcatctcaccctcagtcctgcactccgagggcacgtgtctctgtctgggctggggccagcagcaaggcccccctcccccactccaatcacacagatgtgtctgggaagcttttttgcccgttttggatgttgggccttggcagggtccaaagtttggtggaggagaggacctgcccctgaggtggctcaaggacacagagcaggagagggggctcctgcaggcccccagcccgccatggggtggtgcagacaggagccccgctctgctgcagcgcaggcaggctggatcctctgccacatgggcgtggaggctcagggcgtaagtcccgggcgaggacggaaggtcagagcctgggaatgcagctcgggaggagacttgatccagagcgccaggcactgcacctttgttctggagttgaaggggagccctggaaggctgtcgcgggaagagcactgggtgggatttgcctttgggtgggaggtggtgccaggagccagggagagcactggcttcccacaccgaaggggaacttccgcaaacacctgcgcatggtcggcagccggagggtgaaggcccagacgttcgctgagcggcgcgagcggagcttcagccggtcctggagcgaccccacccccatgaaagccgacacttcccacgactcccgagacagtaggtgccccgcacaggcccgcccaccttccccagagcctcccctagaccccagacccctgctgggggtcccctgccagggccgctgggctgcgcttttgcactcctgaatcttggtttacctgtttgtgagatggggacgccctcagcatctccgatcgcaaaggcggggctaacaacggccgcggcagtgctggccgggggcgcctgtagggccgtgcccaccgccactcgcaagaggccctcaggggcagggggctgcggtgcccgcccccactccctcccaggcgcccggcggacttggctggagctgatgcctgcacgcgccttccaccggcctcgcaccagggtctcccttcccacatcaggccgctgcccagtggtgtccacaggcctgtcctgccgggctggcggcgacctctgtatggtcctcccacttgcttggaggaccctccgggatggggctttcgggccctgtgggccttggggccatggccaggataggaggtgctgccgggcctgctgtcctggtgaccctcttgcttcccaggcagtgacctgcagagctcccactgcacgctggacgaggccttcgaggacctggactgggacactgagaagggcctggaggctgtggcctgcgacaccgaaggcttcgtgccaccaaaggtcatggtgaggcccagcccgggcagtgctcctctacaccccgagcaggactccgccccaacccgagtccagccagctctgcctgggaccacgcagccttctccagctgcctgggggagggtgtctcacagggctatacccttgggctgcctggcagccagaaggtagcctcatgggggctcccacagccccttggcttttggatgggcctggggcccctgagcagctctttgtctccgcagctcatttcctccaaggtgcccaaggctgagtacatccccactatcatccgccgggatgacccctccatcatccccatcctctacgaccatgagcacgcaaccttcgaggacatccttgaggagatagagaggaagctgaacgtctaccacaagggagccaagatctggaaaatgctgattttctgccagggaggtcctggacacctctatctcctcaagaacaaggtggccacctttgccaaagtggagaaggaagaggacatgattcacttctggaagcggctgagccgcctgatgagcaaagtgaacccagagccgaacgtcatccacatcatgggctgctacattctggggaaccccaatggagagaagctgttccagaacctcaggaccctcatgactccttatagggtcaccttcgagtcacccctggagctctcagcccaagggaagcagatgatcgagacgtactttgacttccggttgtatcgcctgtggaagagccgccagcactcgaagctgctggactttgacgacgtcctgtgaggggcagaggcctccgcccagtcaccatcaggccactccctctgcaccgggacctggggctgggccgcctcgtgctccccgggactgtgtggctccggtctcgcctggagccacttcagggcacctcagacgttgctcaggttccccctgtgggttccggtcctcgctgcacccgtggccgcagaggctgcagtccctgggggccgggaggatcccgccctgtggcccgtggatgctcagcggccaggcactgacctgccatgcctcgcctggaggctcagctgtgggcatccctccatggggttcatagaaataagtgcaatttctacacccccgaaacaattcaaagggaagcagcatttcttgttaactagttaagcactatgctgctagttacagtgtaggcaccccggcccagcagcccagcagcccacatgtgttcaggaccctccctgcccaccccctccctgccgtatcgatcaccagcaccagggtggcccgtgtgcgtggggccagcgtcgccgggctgcccagcctggctctgtctacactggccgagtctctgggtctgtctacactggccgagtctccgactgtctgtgctttcacttacactcctcttgccaccccccatccctgcttacttagacctcagccggcgccggacccggtaggggcagtctgggcagcaggaaggaagggcgcagcgtcccctccttcagaggaggctctgggtggggcctgctccccatccccccaagcccacccagcactctcattgctgctgttgagttcagcttttaccagcctcagtgtggaggctccatcccagcacacaggcctggggcttggcaggggcccagctggggctgggccctgggttttgagaaactcgctggcaccacagtgggcccctggacccggccgcgcagctggtggactgtaggggctcctgactgggcacaggagctcccagcttttgtccacggccagcaggatgggctgtcgtgtatatagctggggcgagggggcaggccccccttgtgcagagccaggggtctgagggcacctggctgtgttcccagctgagggagggctggggcgggggccgggcttggaacgatgtacgataccctcatagtgaccattaaacctgatcctccaccgcgaaaaaaaaaaaaaaaaaaaanaaaaaaaaagaagagaaagaaagaaagaaaaaaaaaaaaaaaaaaaaaaaaaaaaaagaaaacaacatatgacaccaaaacacaataaaaaaccacacgcagggagcacgaacgaaacataggcgaagctacacacagacaagagaaaaaataaaaaataacaaagag

SEQ ID NO: 104135 - DNA, 3685 bp, Homo sapiens
atccttaattaaattaatccccctcccccctcgggtccgggcagcgctctcccgggagcggcggcacgcgcggagcgccgggtgcggccatgcggggaccgggcccgaccccgagcccgaccccgagcccaagcccgagccggagcccgagcgagaccccgagcccgagcccgagcgcgacccccggtgcggcgcggctaccccggcggaggcggcgggcgcggggcgcgctctgaggcccgggggatgcgccgccgcctcgaccatgggcgccgccgcctccaggaggagggcgctgaggagcgaggccatgtcctcggtggcggccaaagtgcgagcagcccgagcgtttggagagtacctgtcccagagtcaccctgagaaccgcaacggcgcagatcacctgctggctgatgcctactctggccacgacgggtcccccgagatgcagccggccccccagaacaagcgccgcctgtccctcgtctccaacggctgctacgagggcagcctctcagaggagcccagcattaggaagcccgcaggcgagggccctcagcctcgagtgtacaccatctctggggagcctgccctgctgcccagccctgaggcggaggccattgagctggcggtggtgaaggggcggcggcagcggcaccctcaccatcacagccagcccctgcgcgccagccctggtggcagccgggaggacgtcagcaggccctgccagagctgggcgggcagccgccagggctccaaggagtgccccggatgtgcccagctggctcctggccccacccctcgggcctttgggctggaccagccacctctgcctgagacctccggtcgccgcaagaagctggagaggatgtacagcgttgaccgtgtgtctgacgacatccctattcgtacctggttccccaaggaaaatcttttcagcttccagacagcaaccacaactatgcaagccatctcggtgttcaggggctacgcggagaggaagcgccggaaacgggagaatgattccgcgtctgtaatccagaggaacttccgcaaacacctgcgcatggtcggcagccggagggtgaaggcccagacgttcgctgagcggcgcgagcggagcttcagccggtcctggagcgaccccacccccatgaaagccgacacttcccacgactcccgagacagcagtgacctgcagagctcccactgcacgctggacgaggccttcgaggacctggactgggacactgagaagggcctggaggctgtggcctgcgacaccgaaggcttcgtgccaccaaaggtcatgctcatttcctccaaggtgcccaaggctgagtacatccccactatcatccgccgggatgacccctccatcatccccatcctctacgaccatgagcacgcaaccttcgaggacatccttgaggagatagagaggaagctgaacgtctaccacaagggagccaagatctggaaaatgctgattttctgccagggaggtcctggacacctctatctcctcaagaacaaggtggccacctttgccaaagtggagaaggaagaggacatgattcacttctggaagcggctgagccgcctgatgagcaaagtgaacccagagccgaacgtcatccacatcatgggctgctacattctggggaaccccaatggagagaagctgttccagaacctcaggaccctcatgactccttatagggtcaccttcgagtcacccctggagctctcagcccaagggaagcagatgatcgagacgtactttgacttccggttgtatcgcctgtggaagagccgccagcactcgaagctgctggactttgacgacgtcctgtgaggggcagaggcctccgcccagtcaccatcaggccactccctctgcaccgggacctggggctgggccgcctcgtgctccccgggactgtgtggctccggtctcgcctggagccacttcagggcacctcagacgttgctcaggttccccctgtgggttccggtcctcgctgcacccgtggccgcagaggctgcagtccctgggggccgggaggatcccgccctgtggcccgtggatgctcagcggccaggcactgacctgccatgcctcgcctggaggctcagctgtgggcatccctccatggggttcatagaaataagtgcaatttctacacccccgaaacaattcaaagggaagcagcatttcttgttaactagttaagcactatgctgctagttacagtgtaggcaccccggcccagcagcccagcagcccacatgtgttcaggaccctccctgcccaccccctccctgccgtatcgatcaccagcaccagggtggcccgtgtgcgtggggccagcgtcgccgggctgcccagcctggctctgtctacactggccgagtctctgggtctgtctacactggccgagtctccgactgtctgtgctttcacttacactcctcttgccaccccccatccctgcttacttagacctcagccggcgccggacccggtaggggcagtctgggcagcaggaaggaagggcgcagcgtcccctccttcagaggaggctctgggtggggcctgctccccatccccccaagcccacccagcactctcattgctgctgttgagttcagcttttaccagcctcagtgtggaggctccatcccagcacacaggcctggggcttggcaggggcccagctggggctgggccctgggttttgagaaactcgctggcaccacagtgggcccctggacccggccgcgcagctggtggactgtaggggctcctgactgggcacaggagctcccagcttttgtccacggccagcaggatgggctgtcgtgtatatagctggggcgagggggcaggccccccttgtgcagagccaggggtctgagggcacctggctgtgttcccagctgagggagggctggggcgggggccgggcttggaacgatgtacgataccctcatagtgaccattaaacctgatcctccaccgcggccgccgcgtgggtctgtcctctcagtgctttccaggggccttcctgtgcccagcttctgggcccactcctgtgaggtcactgctgcagggccttcctgcctggacagagttggagctaggccactagaccaccccacagggcatagccagggggaccagcacaggaggggacggagaggagctgcaggagggctggggggaggctgcagtctcggaggggggcctcgccgggtctggaggggacagcagagacagcccgttccccctgccgcctgagggcaccagggagagggctgtatgtccctcacgccacactgtgtgtgcagtcagcagtgtggccacagatgggggccactctctcaacctcaggtgtcctcagggcccagaccgctgctgggcacagccaggctggctgccagctggttccctgccccgtggctgggggacagagcagcacgtatcagctgggctagggtcagggggccactggtgcgcagcctggcacagcctggcaggcttgaggcccagtgtgctgggggtggtcacacagccgtcagccacctccagctcttccagggcattctagatggggtcccgggagggggcaggttttggtgccaatttgagtgtataaagttttaggtaaataccaaatgc

SEQ ID NO: 104136 - DNA, 3107 bp, Homo sapiens
atccttaattaaattaatccccctcccccctcgggtccgggcagcgctctcccgggagcggcggcacgcgcggagcgccgggtgcggccatgcggggaccgggcccgaccccgagcccgaccccgagcccaagcccgagccggagcccgagcgagaccccgagcccgagcccgagcgcgacccccggtgcggcgcggctaccccggcggaggcggcgggcgcggggcgcgctctgaggcccgggggatgcgccgccgcctcgaccatgggcgccgccgcctccaggaggagggcgctgaggagcgaggccatgtcctcggtggcggccaaagtgcgagcagcccgagcgtttggagagtacctgtcccagagtcaccctgagaaccgcaacggcgcagatcacctgctggctgatgcctactctggccacgacgggtcccccgagatgcagccggccccccagaacaagcgccgcctgtccctcgtctccaacggctgctacgagggcagcctctcagaggagcccagcattaggaagcccgcaggcgagggccctcagcctcgagtgtacaccatctctggggagcctgccctgctgcccagccctgaggcggaggccattgagctggcggtggtgaaggggcggcggcagcggcaccctcaccatcacagccagcccctgcgcgccagccctggtggcagccgggaggacgtcagcaggccctgccagagctgggcgggcagccgccagggctccaaggagtgccccggatgtgcccagctggctcctggccccacccctcgggcctttgggctggaccagccacctctgcctgagacctccggtcgccgcaagaagctggagaggatgtacagcgttgaccgtgtgtctgacgacatccctattcgtacctggttccccaaggaaaatcttttcagcttccagacagcaaccacaactatgcaagccatctcgaacttccgcaaacacctgcgcatggtcggcagccggagggtgaaggcccagacgttcgctgagcggcgcgagcggagcttcagccggtcctggagcgaccccacccccatgaaagccgacacttcccacgactcccgagacagcagtgacctgcagagctcccactgcacgctggacgaggccttcgaggacctggactgggacactgagaagggcctggaggctgtggcctgcgacaccgaaggcttcgtgccaccaaaggtcatgctcatttcctccaaggtgcccaaggctgagtacatccccactatcatccgccgggatgacccctccatcatccccatcctctacgtgagtcccgccccgggcctgcccccaacagatgccctcttgcggccccaccctgggccagcgccggcaccccaggtccccagggtgctgtggcgctgctggctctgacgcagccttgatgtggccttgtggcctgtgtctgtccccaggaccatgagcacgcaaccttcgaggacatccttgaggagatagagaggaagctgaacgtctaccacaagggagccaagatctggaaaatgctgattttctgccagggaggtcctggacacctctatctcctcaagaacaaggtggccacctttgccaaagtggagaaggaagaggacatgattcacttctggaagcggctgagccgcctgatgagcaaagtgaacccagagccgaacgtcatccacatcatgggctgctacattctggggaaccccaatggagagaagctgttccagaacctcaggaccctcatgactccttatagggtcaccttcgagtcacccctggagctctcagcccaagggaagcagatgatcgagacgtactttgacttccggttgtatcgcctgtggaagagccgccagcactcgaagctgctggactttgacgacgtcctgtgaggggcagaggcctccgcccagtcaccatcaggccactccctctgcaccgggacctggggctgggccgcctcgtgctccccgggactgtgtggctccggtctcgcctggagccacttcagggcacctcagacgttgctcaggttccccctgtgggttccggtcctcgctgcacccgtggccgcagaggctgcagtccctgggggccgggaggatcccgccctgtggcccgtggatgctcagcggccaggcactgacctgccatgcctcgcctggaggctcagctgtgggcatccctccatggggttcatagaaataagtgcaatttctacacccccgaaacaattcaaagggaagcagcatttcttgttaactagttaagcactatgctgctagttacagtgtaggcaccccggcccagcagcccagcagcccacatgtgttcaggaccctccctgcccaccccctccctgccgtatcgatcaccagcaccagggtggcccgtgtgcgtggggccagcgtcgccgggctgcccagcctggctctgtctacactggccgagtctctgggtctgtctacactggccgagtctccgactgtctgtgctttcacttacactcctcttgccaccccccatccctgcttacttagacctcagccggcgccggacccggtaggggcagtctgggcagcaggaaggaagggcgcagcgtcccctccttcagaggaggctctgggtggggcctgctccccatccccccaagcccacccagcactctcattgctgctgttgagttcagcttttaccagcctcagtgtggaggctccatcccagcacacaggcctggggcttggcaggggcccagctggggctgggccctgggttttgagaaactcgctggcaccacagtgggcccctggacccggccgcgcagctggtggactgtaggggctcctgactgggcacaggagctcccagcttttgtccacggccagcaggatgggctgtcgtgtatatagctggggcgagggggcaggccccccttgtgcagagccaggggtctgagggcacctggctgtgttcccagctgagggagggctggggcgggggccgggcttggaacgatgtacgataccctcatagtgaccattaaacctgatcctccaccgcg

SEQ ID NO: 104137 - DNA, 2978 bp, Homo sapiens
atccttaattaaattaatccccctcccccctcgggtccgggcagcgctctcccgggagcggcggcacgcgcggagcgccgggtgcggccatgcggggaccgggcccgaccccgagcccgaccccgagcccaagcccgagccggagcccgagcgagaccccgagcccgagcccgagcgcgacccccggtgcggcgcggctaccccggcggaggcggcgggcgcggggcgcgctctgaggcccgggggatgcgccgccgcctcgaccatgggcgccgccgcctccaggaggagggcgctgaggagcgaggccatgtcctcggtggcggccaaagtgcgagcagcccgagcgtttggagagtacctgtcccagagtcaccctgagaaccgcaacggcgcagatcacctgctggctgatgcctactctggccacgacgggtcccccgagatgcagccggccccccagaacaagcgccgcctgtccctcgtctccaacggctgctacgagggcagcctctcagaggagcccagcattaggaagcccgcaggcgagggccctcagcctcgagtgtacaccatctctggggagcctgccctgctgcccagccctgaggcggaggccattgagctggcggtggtgaaggggcggcggcagcggcaccctcaccatcacagccagcccctgcgcgccagccctggtggcagccgggaggacgtcagcaggccctgccagagctgggcgggcagccgccagggctccaaggagtgccccggatgtgcccagctggctcctggccccacccctcgggcctttgggctggaccagccacctctgcctgagacctccggtcgccgcaagaagctggagaggatgtacagcgttgaccgtgtgtctgacgacatccctattcgtacctggttccccaaggaaaatcttttcagcttccagacagcaaccacaactatgcaagccatctcggtgttcaggggctacgcggagaggaagcgccggaaacgggagaatgattccgcgtctgtaatccagaggaacttccgcaaacacctgcgcatggtcggcagccggagggtgaaggcccagacgttcgctgagcggcgcgagcggagcttcagccggtcctggagcgaccccacccccatgaaagccgacacttcccacgactcccgagacagcagtgacctgcagagctcccactgcacgctggacgaggccttcgaggacctggactgggacactgagaagggcctggaggctgtggcctgcgacaccgaaggcttcgtgccaccaaaggtcatgctcatttcctccaaggtgcccaaggctgagtacatccccactatcatccgccgggatgacccctccatcatccccatcctctacgaccatgagcacgcaaccttcgaggacatccttgaggagatagagaggaagctgaacgtctaccacaagggagccaagatctggaaaatgctgattttctgccagggaggtcctggacacctctatctcctcaagaacaaggtggccacctttgccaaagtggagaaggaagaggacatgattcacttctggaagcggctgagccgcctgatgagcaaagtgaacccagagccgaacgtcatccacatcatgggctgctacattctggggaaccccaatggagagaagctgttccagaacctcaggaccctcatgactccttatagggtcaccttcgagtcacccctggagctctcagcccaagggaagcagatgatcgagacgtactttgacttccggttgtatcgcctgtggaagagccgccagcactcgaagctgctggactttgacgacgtcctgtgaggggcagaggcctccgcccagtcaccatcaggccactccctctgcaccgggacctggggctgggccgcctcgtgctccccgggactgtgtggctccggtctcgcctggagccacttcagggcacctcagacgttgctcaggttccccctgtgggttccggtcctcgctgcacccgtggccgcagaggctgcagtccctgggggccgggaggatcccgccctgtggcccgtggatgctcagcggccaggcactgacctgccatgcctcgcctggaggctcagctgtgggcatccctccatggggttcatagaaataagtgcaatttctacacccccgaaacaattcaaagggaagcagcatttcttgttaactagttaagcactatgctgctagttacagtgtaggcaccccggcccagcagcccagcagcccacatgtgttcaggaccctccctgcccaccccctccctgccgtatcgatcaccacctggctctgtctacactggccgagtctctgggtctgtctacactggccgagtctccgactgtctgtgctttcacttacactcctcttgccaccccccatccctgcttacttagacctcagccggcgccggacccggtaggggcagtctgggcagcaggaaggaagggcgcagcgtcccctccttcagaggaggctctgggtggggcctgctccccatccccccaagcccacccagcactctcattgctgctgttgagttcagcttttaccagcctcagtgtggaggctccatcccagcacacaggcctggggcttggcaggggcccagctggggctgggccctgggttttgagaaactcgctggcaccacagtgggcccctggacccggccgcgcagctggtggactgtaggggctcctgactgggcacaggagctcccagcttttgtccacggccagcaggatgggctgtcgtgtatatagctggggcgagggggcaggccccccttgtgcagagccaggggtctgagggcacctggctgtgttcccagctgagggagggctggggcgggggccgggcttggaacgatgtacgataccctcatagtgaccattaaacctgatcctccaccgcg

SEQ ID NO: 104138 - DNA, 1659 bp, Homo sapiens
ggccgcaaaatctacgggcgaacggaatggaagcctgcccgcaaccttcgaggacatcctggaggagatagagaggaagctgaacgtctaccacaagggagccaagatctggaaaatgctgattttctgccagggaggtcctggacacctctatctcctcaagaacaaggtggccacctttgccaaagtggagaaggaagaggacatgattcacttctggaagcggctgagccgcctgatgagcaaagtgaacccagagccgaacgtcatccacatcatgggctgctacattctggggaaccccaatggagagaagctgttccagaacctcaggaccctcatgactccttatagggtcaccttcgagtcacccctggagctctcagcccaagggaagcagatgatcgagacgtactttgacttccggttgtatcgcctgtggaagagccgccagcactcgaagctgctggactttgacgacgtcctgtgaggggcagaggcctccgcccagtcaccatcaggccactccctctgcaccgggacctggggctgggccgcctcgtgctccccgggactgtgtggctccggtctcgcctggagccacttcagggcacctcagacgttgctcaggttccccctgtgggttccggtcctcgctgcacccgtggccgcagaggctgcagtccctgggggccgggaggatcccgccctgtggcccgtggatgctcagcggccaggcactgacctgccatgcctcgcctggaggctcagctgtgggcatccctccatggggttcatagaaataagtgcaatttctacacccccgaaacaattcaaagggaagcagcatttcttgttaactagttaagcactatgctgctagttacagtgtaggcaccccggcccagcagcccagcagcccacatgtgttcaggaccctccctgcccaccccctccctgccgtatcgatcaccagcaccagggtggcccgtgtgcgtggggccagcgtcgccgggctgcccagcctggctctgtctacactggccgagtctctgggtctgtctacactggccgagtctccgactgtctgtgctttcacttacactcctcttgccaccccccatccctgcttacttagacctcagccggcgccggacccggtaggggcagtctgggcagcaggaaggaagggcgcagcgtcccctccttcagaggaggctctgggtggggcctgctccccatccccccaagcccacccagcactctcattgctgctgttgagttcagcttttaccagcctcagtgtggaggctccatcccagcacacaggcctggggcttggcaggggcccagctggggctgggccctgggttttgagaaactcgctggcaccacagtgggcccctggacccggccgcgcagctggtggactgtaggggctcctgactgggcacaggagctcccagcttttgtccacggccagcaggatgggctgtcgtgtatatagctggggcgagggggcaggccccccttgtgcagagccaggggtctgagggcacctggctgtgttcccagctgagggagggctggggcgggggccgggcttggaacgatgtacgataccctcatagtgaccattaaacctgatcctccaccgcg

SEQ ID NO: 104139 - DNA, 1587 bp, Homo sapiens
  misc_feature (28)..(28): n is a, c, g, or t
  misc_feature (33)..(33): n is a, c, g, or t
aacataggcttaggtacgaggctgggtngtgcnagatctggaaaatgctgattttctgccaggaggtcctggacacctctatctcctcaagaacaaggtggccacctttgccaaagtggagaaggaagaggacatgattcacttctggaagcggctgagccgcctgatgagcaaagtgaacccagagccgaacgtcatccacatcatgggctgctacattctggggaaccccaatggagagaagctgttccagaacctcaggaccctcatgactccttatagggtcaccttcgagtcacccctggagctctcagcccaagggaagcagatgatcgagacgtactttgacttccggttgtatcgcctgtggaagagccgccagcactcgaagctgctggactttgacgacgtcctgtgaggggcagaggcctccgcccagtcaccatcaggccactccctctgcaccgggacctggggctgggccgcctcgtgctccccgggactgtgtggctccggtctcgcctggagccacttcagggcacctcagacgttgctcaggttccccctgtgggttccggtcctcgctgcacccgtggccgcagaggctgcagtccctgggggccgggaggatcccgccctgtggcccgtggatgctcagcggccaggcactgacctgccatgcctcgcctggaggctcagctgtgggcatccctccatggggttcatagaaataagtgcaatttctacacccccgaaacaattcaaagggaagcagcatttcttgttaactagttaagcactatgctgctagttacagtgtaggcaccccggcccagcagcccagcagcccacatgtgttcaggaccctccctgcccaccccctccctgccgtatcgatcaccagcaccagggtggcccgtgtgcgtggggccagcgtcgccgggctgcccagcctggctctgtctacactggccgagtctctgggtctgtctacactggccgagtctccgactgtctgtgctttcacttacactcctcttgccaccccccatccctgcttacttagacctcagccggcgccggacccggtaggggcagtctgggcagcaggaaggaagggcgcagcgtcccctccttcagaggaggctctgggtggggcctgctccccatccccccaagcccacccagcactctcattgctgctgttgagttcagcttttaccagcctcagtgtggaggctccatcccagcacacaggcctggggcttggcaggggcccagctggggctgggccctgggttttgagaaactcgctggcaccacagtgggcccctggacccggccgcgcagctggtggactgtaggggctcctgactgggcacaggagctcccagcttttgtccacggccagcaggatgggctgtcgtgtatatagctggggcgagggggcaggccccccttgtgcagagccaggggtctgagggcacctggctgtgttcccagctgagggagggctggggcgggggccgggcttggaacgatgtacgataccctcatagtgaccattaaacctgatcctccaccgcg

SEQ ID NO: 104140 - DNA, 1936 bp, Homo sapiens
aggctggtacaggtctgggatgcagtgacctgcagagctcccactgcacgctggacgaggccttcgaggacctggactgggacactgagaagggcctggaggctgtggcctgcgacaccgaaggcttcgtgccaccaaaggtcatgctcatttcctccaaggtgcccaaggctgagtacatccccactatcatccgccgggatgacccctccatcatccccatcctctacgaccatgagcacgcaaccttcgaggacatccttgaggagatagagaggaagctgaacgtctaccacaagggagccaagatctggaaaatgctgattttctgccagggaggtcctggacacctctatctcctcaagaacaaggtggccacctttgccaaagtggagaaggaagaggacatgattcacccctcctccacggtccgctctgtggagtggggtgcctgtcccctgccactgggtgacccacccctctccaccagcttctggaagcggctgagccgcctgatgagcaaagtgaacccagagccgaacgtcatccacatcatgggctgctacattctggggaaccccaatggagagaagctgttccagaacctcaggaccctcatgactccttatagggtcaccttcgagtcacccctggagctctcagcccaagggaagcagatgatcgagacgtactttgacttccggttgtatcgcctgtggaagagccgccagcactcgaagctgctggactttgacgacgtcctgtgaggggcagaggcctccgcccagtcaccatcaggccactccctctgcaccgggacctggggctgggccgcctcgtgctccccgggactgtgtggctccggtctcgcctggagccacttcagggcacctcagacgttgctcaggttccccctgtgggttccggtcctcgctgcacccgtggccgcagaggctgcagtccctgggggccgggaggatcccgccctgtggcccgtggatgctcagcggccaggcactgacctgccatgcctcgcctggaggctcagctgtgggcatccctccatggggttcatagaaataagtgcaatttctacacccccgaaacaattcaaagggaagcagcatttcttgttaactagttaagcactatgctgctagttacagtgtaggcaccccggcccagcagcccagcagcccacatgtgttcaggaccctccctgcccaccccctccctgccgtatcgatcaccagcaccagggtggcccgtgtgcgtggggccagcgtcgccgggctgcccagcctggctctgtctacactggccgagtctctgggtctgtctacactggccgagtctccgactgtctgtgctttcacttacactcctcttgccaccccccatccctgcttacttagacctcagccggcgccggacccggtaggggcagtctgggcagcaggaaggaagggcgcagcgtcccctccttcagaggaggctctgggtggggcctgctccccatccccccaagcccacccagcactctcattgctgctgttgagttcagcttttaccagcctcagtgtggaggctccatcccagcacacaggcctggggcttggcaggggcccagctggggctgggccctgggttttgagaaactcgctggcaccacagtgggcccctggacccggccgcgcagctggtggactgtaggggctcctgactgggcacaggagctcccagcttttgtccacggccagcaggatgggctgtcgtgtatatagctggggcgagggggcaggccccccttgtgcagagccaggggtctgagggcacctggctgtgttcccagctgagggagggctggggcgggggccgggcttggaacgatgtacgataccctcatagtgaccattaaacctgatcctccaccgcg

SEQ ID NO: 104141 - DNA, 2395 bp, Homo sapiens
atccttaattaaattaatccccctcccccctcgggtccgggcagcgctctcccgggagcggcggcacgcgcggagcgccgggtgcggccatgcggggaccgggcccgaccccgagcccgaccccgagcccaagcccgagccggagcccgagcgagaccccgagcccgagcccgagcgcgacccccggtgcggcgcggctaccccggcggaggcggcgggcgcggggcgcgctctgaggcccgggggatgcgccgccgcctcgaccatgggcgccgccgcctccaggaggagggcgctgaggagcgaggccatgtcctcggtggcggccaaagtgcgagcagcccgagcgtttggagagtacctgtcccagagtcaccctgagaaccgcaacggcgcagatcacctgctggctgatgcctactctggccacgacgggtcccccgagatgcagccggccccccagaacaagcgccgcctgtccctcgtctccaacggctgctacgagggcagcctctcagaggagcccagcattaggaagcccgcaggcgagggccctcagcctcgagtgtacaccatctctggggagcctgccctgctgcccagccctgaggcggaggccattgagctggcggtggtgaaggggcggcggcagcggcaccctcaccatcacagccagcccctgcgcgccagccctggtggcagccgggaggacgtcagcaggccctgccagagctgggcgggcagccgccagggctccaaggagtgccccggatgtgcccagctggctcctggccccacccctcgggcctttgggctggaccagccacctctgcctgagacctccggtcgccgcaagaagctggagaggatgtacagcgttgaccgtgtgtctgacgacatccctattcgtacctggttccccaaggaaaatcttttcagcttccagacagcaaccacaactatgcaagccatctcggtgttcaggggctacgcggagaggaagcgccggaaacgggagaatgattccgcgtctgtaatccagaggaacttccgcaaacacctgcgcatggtcggcagccggagggtgaaggcccagacgttcgctgagcggcgcgagcggagcttcagccggtcctggagcgaccccacccccatgaaagccgacacttcccacgactcccgagacagcagtgacctgcagagctcccactgcacgctggacgaggccttcgaggacctggactgggacactgagaagggcctggaggctgtggcctgcgacaccgaaggcttcgtgccaccaaaggtcatgctcatttcctccaaggtgcccaaggctgagtacatccccactatcatccgccgggatgacccctccatcatccccatcctctacgaccatgagcacgcaaccttcgaggacatccttgaggagatagagaggaagctgaacgtctaccacaagggagccaagatctggaaaatgctgattttctgccagggaggtcctggacacctctatctcctcaagaacaaggtggccacctttgccaaagtggagaaggaagaggacatgattcacttctggaagcggctgagccgcctgatgagcaaagtgaacccagagccgaacgtcatccacatcatgggctgctacattctggggaaccccaatggagagaagctgttccagaacctcaggaccctcatgactccttatagggtcaccttcgagtcacccctggagctctcagcccaagggaagcagatgatcgagacgtactttgacttccggttgtatcgcctgtggaagagccgccagcactcgaagctgctggactttgacgacgtcctgtgaggggcagaggcctccgcccagtcaccatcaggccactccctctgcaccgggacctggggctgggccgcctcgtgctccccgggactgtgtggctccggtctcgcctggagccacttcagggcacctcagacgttgctcaggttccccctgtgggttccggtcctcgctgcacccgtggccgcagaggctgcagtccctgggggccgggaggatcccgccctgtggcccgtggatgctcagcggccaggcactgacctgccatgcctcgcctggaggctcagctgtgggcatccctccatggggttcatagaaataagtgcaatttctacacccccgaaacaattcaaagggaagcagcatttcttgttaactagttaagcactatgctgctagttacagtgtaggcaccccggcccagcagcccagcagcccacatgtgtgctgtgttcccagctgagggagggctggggcgggggccgggcttggaacgatgtacgataccctcatagtgaccattaaacctgatcctccaccgcg

SEQ ID NO: 104142 - DNA, 2523 bp, Homo sapiens
atccttaattaaattaatccccctcccccctcgggtccgggcagcgctctcccgggagcggcggcacgcgcggagcgccgggtgcggccatgcggggaccgggcccgaccccgagcccgaccccgagcccaagcccgagccggagcccgagcgagaccccgagcccgagcccgagcgcgacccccggtgcggcgcggctaccccggcggaggcggcgggcgcggggcgcgctctgaggcccgggggatgcgccgccgcctcgaccatgggcgccgccgcctccaggaggagggcgctgaggagcgaggccatgtcctcggtggcggccaaagtgcgagcagcccgagcgtttggagagtacctgtcccagagtcaccctgagaaccgcaacggcgcagatcacctgctggctgatgcctactctggccacgacgggtcccccgagatgcagccggccccccagaacaagcgccgcctgtccctcgtctccaacggctgctacgagggcagcctctcagaggagcccagcattaggaagcccgcaggcgagggccctcagcctcgagtgtacaccatctctggggagcctgccctgctgcccagccctgaggcggaggccattgagctggcggtggtgaaggggcggcggcagcggcaccctcaccatcacagccagcccctgcgcgccagccctggtggcagccgggaggacgtcagcaggccctgccagagctgggcgggcagccgccagggctccaaggagtgccccggatgtgcccagctggctcctggccccacccctcgggcctttgggctggaccagccacctctgcctgagacctccggtcgccgcaagaagctggagaggatgtacagcgttgaccgtgtgtctgacgacatccctattcgtacctggttccccaaggaaaatcttttcagcttccagacagcaaccacaactatgcaagccatctcggtgttcaggggctacgcggagaggaagcgccggaaacgggagaatgattccgcgtctgtaatccagaggaacttccgcaaacacctgcgcatggtcggcagccggagggtgaaggcccagacgttcgctgagcggcgcgagcggagcttcagccggtcctggagcgaccccacccccatgaaagccgacacttcccacgactcccgagacagcagtgacctgcagagctcccactgcacgctggacgaggccttcgaggacctggactgggacactgagaagggcctggaggctgtggcctgcgacaccgaaggcttcgtgccaccaaaggtcatgctcatttcctccaaggtgcccaaggctgagtacatccccactatcatccgccgggatgacccctccatcatccccatcctctacgaccatgagcacgcaaccttcgaggacatccttgaggagatagagaggaagctgaacgtctaccacaagggagccaagatctggaaaatgctgattttctgccagggaggtcctggacacctctatctcctcaagaacaaggtggccacctttgccaaagtggagaaggaagaggacatgattcacttctggaagcggctgagccgcctgatgagcaaagtgaacccagagccgaacgtcatccacatcatgggctgctacattctggggaaccccaatggagagaagctgttccagaacctcaggaccctcatgactccttatagggtcaccttcgagtcacccctggagctctcagcccaagggaagcagatgatcgagacgtactttgacttccggttgtatcgcctgtggaagagccgccagcactcgaagctgctggactttgacgacgtcctgtgaggggcagaggcctccgcccagtcaccatcaggccactccctctgcaccgggacctggggctgggccgcctcgtgctccccgggactgtgtggctccggtctcgcctggagccacttcagggcacctcagacgttgctcaggttccccctgtgggttccggtcctcgctgcacccgtggccgcagaggctgcagtccctgggggccgggaggatcccgccctgtggcccgtggatgctcagcggccaggcactgacctgccatgcctcgcctggaggctcagctgtgggcatccctccatggggttcatagaaataagtgcaatttctacacccccgaaacaattcaaagggaagcagcatttcttgttaactagttaagcactatgctgctagttacagtgtaggcacccctggacccggccgcgcagctggtggactgtaggggctcctgactgggcacaggagctcccagcttttgtccacggccagcaggatgggctgtcgtgtatatagctggggcgagggggcaggccccccttgtgcagagccaggggtctgagggcacctggctgtgttcccagctgagggagggctggggcgggggccgggcttggaacgatgtacgataccctcatagtgaccattaaacctgatcctccaccgcg

SEQ ID NO: 104143 - DNA, 881 bp, Homo sapiens
tgcccatgcagagctcagtgcactggaccggcgatttacacagccccgaaacaattcaaagggaagcagcatttcttgttaactagttaagcactatgctgctagttacagtgtaggcaccccggcccagcagcccagcagcccacatgtgttcaggaccctccctgcccaccccctccctgccgtatcgatcaccagcaccagggtggcccgtgtgcgtggggccagcgtcgccgggctgcccagcctggctctgtctacactggccgagtctctgggtctgtctacactggccgagtctccgactgtctgtgctttcacttacactcctcttgccaccccccatccctgcttacttagacctcagccggcgccggacccggtaggggcagtctgggcagcaggaaggaagggcgcagcgtcccctccttcagaggaggctctgggtggggcctgctccccatccccccaagcccacccagcactctcattgctgctgttgagttcagcttttaccagcctcagtgtggaggctccatcccagcacacaggcctggggcttggcaggggcccagctggggctgggccctgggttttgagaaactcgctggcaccacagtgggcccctggacccggccgcgcagctggtggactgtaggggctcctgactgggcacaggagctcccagcttttgtccacggccagcaggatgggctgtcgtgtatatagctggggcgagggggcaggccccccttgtgcagagccaggggtctgagggcacctggctgtgttcccagctgagggagggctggggcgggggccgggcttggaacgatgtacgataccctcatagtgaccattaaacctgatcctccaccgcg

SEQ ID NO: 104144 - DNA, 1816 bp, Homo sapiens
atccttaattaaattaatccccctcccccctcgggtccgggcagcgctctcccgggagcggcggcacgcgcggagcgccgggtgcggccatgcggggaccgggcccgaccccgagcccgaccccgagcccaagcccgagccggagcccgagcgagaccccgagcccgagcccgagcgcgacccccggtgcggcgcggctaccccggcggaggcggcgggcgcggggcgcgctctgaggcccgggggatgcgccgccgcctcgaccatgggcgccgccgcctccaggaggagggcgctgaggagcgaggccatgtcctcggtggcggccaaagtgcgagcagcccgagcgtttggagagtacctgtcccagagtcaccctgagaaccgcaacggcgcagatcacctgctggctgatgcctactctggccacgacgggtcccccgagatgcagccggccccccagaacaagcgccgcctgtccctcgtctccaacggctgctacgagggcagcctctcagaggagcccagcattaggaagcccgcaggcgagggccctcagcctcgagtgtacaccatctctggggagcctgccctgctgcccagccctgaggcggaggccattgagctggcggtggtgaaggggcggcggcagcggcaccctcaccatcacagccagcccctgcgcgccagccctggtggcagccgggaggacgtcagcaggccctgccagagctgggcgggcagccgccagggctccaaggagtgccccggatgtgcccagctggctcctggccccacccctcgggcctttgggctggaccagccacctctgcctgagacctccggtcgccgcaagaagctggagaggatgtacagcgttgaccgtgtgtctgacgacatccctattcgtacctggttccccaaggaaaatcttttcagcttccagacagcaaccacaactatgcaagccatctcggtgttcaggggctacgcggagaggaagcgccggaaacgggagaatgattccgcgtctgtaatccagaggaacttccgcaaacacctgcgcatggtcggcagccggagggtgaaggcccagacgttcgctgagcggcgcgagcggagcttcagccggtcctggagcgaccccacccccatgaaagccgacacttcccacgactcccgagacagcagtgacctgcagagctcccactgcacgctggacgaggccttcgaggacctggactgggacactgagaagggcctggaggctgtggcctgcgacaccgaaggcttcgtgccaccaaaggtcatgctcatttcctccaaggtgcccaaggctgagtacatccccactatcatccgccgggatgacccctccatcatccccatcctctacgaccatgagcacgcaaccttcgaggacatccttgaggagatagagaggaagctgaacgtctaccacaagggagccaagatctggaaaatgctgattttctgccagggaggtcctggacacctctatctcctcaagaacaaggtggccacctttgccaaagtggagaaggaagaggacatgattcacttctggaagcggctgagccgcctgatgagcaaagtgaacccagagccgaacgtcatccacatcatgggctgctacattctggggaaccccaatggagagaagccccttgtgcagagccaggggtctgagggcacctggctgtgttcccagctgagggagggctggggcgggggccgggcttggaacgatgtacgataccctcatagtgaccattaaacctgatcctccaccgcg

SEQ ID NO: 104145 - DNA, 632 bp, Homo sapiens
gggcagtgctgactcgcggtggtttcccagggtgttcaggggctacgcggagaggaagcgccggaaacgggagaatgattccgcgtctgtaatccagaggtagggcctgccagccactcgccaccagggtccatctctggtctgtgctggcctggcctgggccccctcggccctggcagacctgatgggggaagggtggtggcgaccactggcctggccctgctctggggacgtggcaggcaggagaggccatgtggcccgggctgcaggaaagcatctcaccctcagtcctgcactccgagggcacgtgtctctgtctgggctggggccagcagcaaggcccccctcccccactccaatcacacagatgtgtctgggaagcttttttgcccgttttggatgttgggccttggcagggtccaaagtttggtggaggagaggacctgcccctgaggtggctcaaggacacagagcaggagagggggctcctgcaggcccccagcccgccatggggtggtgcagacaggagccccgctctgctgcagcgcaggcaggctggatcctctgccacatgggcgtggaggctcagggcgtaagtcccgggcgaggacggaaggtcagagcctgggaat

SEQ ID NO: 104146 - DNA, 3027 bp, Homo sapiens
atccttaattaaattaatccccctcccccctcgggtccgggcagcgctctcccgggagcggcggcacgcgcggagcgccgggtgcggccatgcggggaccgggcccgaccccgagcccgaccccgagcccaagcccgagccggagcccgagcgagaccccgagcccgagcccgagcgcgacccccggtgcggcgcggctaccccggcggaggcggcgggcgcggggcgcgctctgaggcccgggggatgcgccgccgcctcgaccatgggcgccgccgcctccaggaggagggcgctgaggagcgaggccatgtcctcggtggcggccaaagtgcgagcagcccgagcgtttggagagtacctgtcccagagtcaccctgagaaccgcaacggcgcagatcacctgctggctgatgcctactctggccacgacgggtcccccgagatgcagccggccccccagaacaagcgccgcctgtccctcgtctccaacggctgctacgagggcagcctctcagaggagcccagcattaggaagcccgcaggcgagggccctcagcctcgagtgtacaccatctctggggagcctgccctgctgcccagccctgaggcggaggccattgagctggcggtggtgaaggggcggcggcagcggcaccctcaccatcacagccagcccctgcgcgccagccctggtggcagccgggaggacgtcagcaggccctgccagagctgggcgggcagccgccagggctccaaggagtgccccggatgtgcccagctggctcctggccccacccctcgggcctttgggctggaccagccacctctgcctgagacctccggtcgccgcaagaagctggagaggatgtacagcgttgaccgtgtgtctgacgacatccctattcgtacctggttccccaaggaaaatcttttcagcttccagacagcaaccacaactatgcaagccatctcggtgttcaggggctacgcggagaggaagcgccggaaacgggagaatgattccgcgtctgtaatccagaggaacttccgcaaacacctgcgcatggtcggcagccggagggtgaaggcccagacgttcgctgagcggcgcgagcggagcttcagccggtcctggagcgaccccacccccatgaaagccgacacttcccacgactcccgagacagcagtgacctgcagagctcccactgcacgctggacgaggccttcgaggacctggactgggacactgagaagggcctggaggctgtggcctgcgacaccgaaggcttcgtgccaccaaaggtcatgctcatttcctccaaggtgcccaaggctgagtacatccccactatcatccgccgggatgacccctccatcatccccatcctctacgaccatgagcacgcaaccttcgaggacatccttgaggagatagagaggaagctgaacgtctaccacaagggagccaagatctggaaaatgctgattttctgccagggaggtcctggacacctctatctcctcaagaacaaggtggccacctttgccaaagtggagaaggaagaggacatgattcacttctggaagcggctgagccgcctgatgagcaaagtgaacccagagccgaacgtcatccacatcatgggctgctacattctggggaaccccaatggagagaagctgttccagaacctcaggaccctcatgactccttatagggtcaccttcgagtcacccctggagctctcagcccaagggaagcagatgatcgagacgtactttgacttccggttgtatcgcctgtggaagagccgccagcactcgaagctgctggactttgacgacgtcctgtgaggggcagaggcctccgcccagtcaccatcaggccactccctctgcaccgggacctggggctgggccgcctcgtgctccccgggactgtgtggctccggtctcgcctggagccacttcagggcacctcagacgttgctcaggttccccctgtgggttccggtcctcgctgcacccgtggccgcagaggctgcagtccctgggggccgggaggatcccgccctgtggcccgtggatgctcagcggccaggcactgacctgccatgcctcgcctggaggctcagctgtgggcatccctccatggggttcatagaaataagtgcaatttctacacccccgaaacaattcaaagggaagcagcatttcttgttaactagttaagcactatgctgctagttacagtgtaggcaccccggcccagcagcccagcagcccacatgtgttcaggaccctccctgcccaccccctccctgccgtatcgatcaccagcaccagggtggcccgtgtgcgtggggccagcgtcgccgggctgcccagcctggctctgtctacactggccgagtctctgggtctgtctacactggccgagtctccgactgtctgtgctttcacttacactcctcttgccaccccccatccctgcttacttagacctcagccggcgccggacccggtaggggcagtctgggcagcaggaaggaagggcgcagcgtcccctccttcagaggaggctctgggtggggcctgctccccatccccccaagcccacccagcactctcattgctgctgttgagttcagcttttaccagcctcagtgtggaggctccatcccagcacacaggcctggggcttggcaggggcccagctggggctgggccctgggttttgagaaactcgctggcaccacagtgggcccctggacccggccgcgcagctggtggactgtaggggctcctgactgggcacaggagctcccagcttttgtccacggccagcaggatgggctgtcgtgtatatagctggggcgagggggcaggccccccttgtgcagagccaggggtctgagggcacctggctgtgttcccagctgagggagggctggggcgggggccgggcttggaacgatgtacgataccctcatagtgaccattaaacctgatcctccaccgcg

SEQ ID NO: 104147 - DNA, 3194 bp, Homo sapiens
atccttaattaaattaatccccctcccccctcgggtccgggcagcgctctcccgggagcggcggcacgcgcggagcgccgggtgcggccatgcggggaccgggcccgaccccgagcccgaccccgagcccaagcccgagccggagcccgagcgagaccccgagcccgagcccgagcgcgacccccggtgcggcgcggctaccccggcggaggcggcgggcgcggggcgcgctctgaggcccgggggatgcgccgccgcctcgaccatgggcgccgccgcctccaggaggagggcgctgaggagcgaggccatgtcctcggtggcggccaaagtgcgagcagcccgagcgtttggagagtacctgtcccagagtcaccctgagaaccgcaacggcgcagatcacctgctggctgatgcctactctggccacgacgggtcccccgagatgcagccggccccccagaacaagcgccgcctgtccctcgtctccaacggctgctacgagggcagcctctcagaggagcccagcattaggaagcccgcaggcgagggccctcagcctcgagtgtacaccatctctggggagcctgccctgctgcccagccctgaggcggaggccattgagctggcggtggtgaaggggcggcggcagcggcaccctcaccatcacagccagcccctgcgcgccagccctggtggcagccgggaggacgtcagcaggccctgccagagctgggcgggcagccgccagggctccaaggagtgccccggatgtgcccagctggctcctggccccacccctcgggcctttgggctggaccagccacctctgcctgagacctccggtcgccgcaagaagctggagaggatgtacagcgttgaccgtgtgtctgacgacatccctattcgtacctggttccccaaggaaaatcttttcagcttccagacagcaaccacaactatgcaagccatctcgaacttccgcaaacacctgcgcatggtcggcagccggagggtgaaggcccagacgttcgctgagcggcgcgagcggagcttcagccggtcctggagcgaccccacccccatgaaagccgacacttcccacgactcccgagacagcagtgacctgcagagctcccactgcacgctggacgaggccttcgaggacctggactgggacactgagaagggcctggaggctgtggcctgcgacaccgaaggcttcgtgccaccaaaggtcatggtgaggcccagcccgggcagtgctcctctacaccccgagcaggactccgccccaacccgagtccagccagctctgcctgggaccacgcagccttctccagctgcctgggggagggtgtctcacagggctatacccttgggctgcctggcagccagaaggtagcctcatgggggctcccacagccccttggcttttggatgggcctggggcccctgagcagctctttgtctccgcagctcatttcctccaaggtgcccaaggctgagtacatccccactatcatccgccgggatgacccctccatcatccccatcctctacgaccatgagcacgcaaccttcgaggacatccttgaggagatagagaggaagctgaacgtctaccacaagggagccaagatctggaaaatgctgattttctgccagggaggtcctggacacctctatctcctcaagaacaaggtggccacctttgccaaagtggagaaggaagaggacatgattcacttctggaagcggctgagccgcctgatgagcaaagtgaacccagagccgaacgtcatccacatcatgggctgctacattctggggaaccccaatggagagaagctgttccagaacctcaggaccctcatgactccttatagggtcaccttcgagtcacccctggagctctcagcccaagggaagcagatgatcgagacgtactttgacttccggttgtatcgcctgtggaagagccgccagcactcgaagctgctggactttgacgacgtcctgtgaggggcagaggcctccgcccagtcaccatcaggccactccctctgcaccgggacctggggctgggccgcctcgtgctccccgggactgtgtggctccggtctcgcctggagccacttcagggcacctcagacgttgctcaggttccccctgtgggttccggtcctcgctgcacccgtggccgcagaggctgcagtccctgggggccgggaggatcccgccctgtggcccgtggatgctcagcggccaggcactgacctgccatgcctcgcctggaggctcagctgtgggcatccctccatggggttcatagaaataagtgcaatttctacacccccgaaacaattcaaagggaagcagcatttcttgttaactagttaagcactatgctgctagttacagtgtaggcaccccggcccagcagcccagcagcccacatgtgttcaggaccctccctgcccaccccctccctgccgtatcgatcaccagcaccagggtggcccgtgtgcgtggggccagcgtcgccgggctgcccagcctggctctgtctacactggccgagtctctgggtctgtctacactggccgagtctccgactgtctgtgctttcacttacactcctcttgccaccccccatccctgcttacttagacctcagccggcgccggacccggtaggggcagtctgggcagcaggaaggaagggcgcagcgtcccctccttcagaggaggctctgggtggggcctgctccccatccccccaagcccacccagcactctcattgctgctgttgagttcagcttttaccagcctcagtgtggaggctccatcccagcacacaggcctggggcttggcaggggcccagctggggctgggccctgggttttgagaaactcgctggcaccacagtgggcccctggacccggccgcgcagctggtggactgtaggggctcctgactgggcacaggagctcccagcttttgtccacggccagcaggatgggctgtcgtgtatatagctggggcgagggggcaggccccccttgtgcagagccaggggtctgagggcacctggctgtgttcccagctgagggagggctggggcgggggccgggcttggaacgatgtacgataccctcatagtgaccattaaacctgatcctccaccgcg

SEQ ID NO: 104148 - DNA, 2119 bp, Homo sapiens
tagtcgctcaaggatcccccggaggcgttgaatggccagacgttcgctgagcggcgcgagcggagcttcagccggtcctggagcgaccccacccccatgaaagccgacacttcccacgactcccgagacagcagtgacctgcagagctcccactgcacgctggacgaggccttcgaggacctggactgggacactgagaagggcctggaggctgtggcctgcgacaccgaaggcttcgtgccaccaaaggtcatgctcatttcctccaaggtgcccaaggctgagtacatccccactatcatccgccgggatgacccctccatcatccccatcctctacgtgagtcccgccccgggcctgcccccaacagatgccctcttgcggccccaccctgggccagcgccggcaccccaggtccccagggtgctgtggcgctgctggctctgacgcagccttgatgtggccttgtggcctgtgtctgtccccaggaccatgagcacgcaaccttcgaggacatccttgaggagatagagaggaagctgaacgtctaccacaagggagccaagatctggaaaatgctgattttctgccagggaggtcctggacacctctatctcctcaagaacaaggtggccacctttgccaaagtggagaaggaagaggacatgattcacttctggaagcggctgagccgcctgatgagcaaagtgaacccagagccgaacgtcatccacatcatgggctgctacattctggggaaccccaatggagagaagctgttccagaacctcaggaccctcatgactccttatagggtcaccttcgagtcacccctggagctctcagcccaagggaagcagatgatcgagacgtactttgacttccggttgtatcgcctgtggaagagccgccagcactcgaagctgctggactttgacgacgtcctgtgaggggcagaggcctccgcccagtcaccatcaggccactccctctgcaccgggacctggggctgggccgcctcgtgctccccgggactgtgtggctccggtctcgcctggagccacttcagggcacctcagacgttgctcaggttccccctgtgggttccggtcctcgctgcacccgtggccgcagaggctgcagtccctgggggccgggaggatcccgccctgtggcccgtggatgctcagcggccaggcactgacctgccatgcctcgcctggaggctcagctgtgggcatccctccatggggttcatagaaataagtgcaatttctacacccccgaaacaattcaaagggaagcagcatttcttgttaactagttaagcactatgctgctagttacagtgtaggcaccccggcccagcagcccagcagcccacatgtgttcaggaccctccctgcccaccccctccctgccgtatcgatcaccagcaccagggtggcccgtgtgcgtggggccagcgtcgccgggctgcccagcctggctctgtctacactggccgagtctctgggtctgtctacactggccgagtctccgactgtctgtgctttcacttacactcctcttgccaccccccatccctgcttacttagacctcagccggcgccggacccggtaggggcagtctgggcagcaggaaggaagggcgcagcgtcccctccttcagaggaggctctgggtggggcctgctccccatccccccaagcccacccagcactctcattgctgctgttgagttcagcttttaccagcctcagtgtggaggctccatcccagcacacaggcctggggcttggcaggggcccagctggggctgggccctgggttttgagaaactcgctggcaccacagtgggcccctggacccggccgcgcagctggtggactgtaggggctcctgactgggcacaggagctcccagcttttgtccacggccagcaggatgggctgtcgtgtatatagctggggcgagggggcaggccccccttgtgcagagccaggggtctgagggcacctggctgtgttcccagctgagggagggctggggcgggggccgggcttggaacgatgtacgataccctcatagtgaccattaaacctgatcctccaccgcg

SEQ ID NO: 104149 - DNA, 3053 bp, Homo sapiens
atccttaattaaattaatccccctcccccctcgggtccgggcagcgctctcccgggagcggcggcacgcgcggagcgccgggtgcggccatgcggggaccgggcccgaccccgagcccgaccccgagcccaagcccgagccggagcccgagcgagaccccgagcccgagcccgagcgcgacccccggtgcggcgcggctaccccggcggaggcggcgggcgcggggcgcgctctgaggcccgggggatgcgccgccgcctcgaccatgggcgccgccgcctccaggaggagggcgctgaggagcgaggccatgtcctcggtggcggccaaagtgcgagcagcccgagcgtttggagagtacctgtcccagagtcaccctgagaaccgcaacggcgcagatcacctgctggctgatgcctactctggccacgacgggtcccccgagatgcagccggccccccagaacaagcgccgcctgtccctcgtctccaacggctgctacgagggcagcctctcagaggagcccagcattaggaagcccgcaggcgagggccctcagcctcgagtgtacaccatctctggggagcctgccctgctgcccagccctgaggcggaggccattgagctggcggtggtgaaggggcggcggcagcggcaccctcaccatcacagccagcccctgcgcgccagccctggtggcagccgggaggacgtcagcaggccctgccagagctgggcgggcagccgccagggctccaaggagtgccccggatgtgcccagctggctcctggccccacccctcgggcctttgggctggaccagccacctctgcctgagacctccggtcgccgcaagaagctggagaggatgtacagcgttgaccgtgtgtctgacgacatccctattcgtacctggttccccaaggaaaatcttttcagcttccagacagcaaccacaactatgcaagccatctcggtgttcaggggctacgcggagaggaagcgccggaaacgggagaatgattccgcgtctgtaatccagaggaacttccgcaaacacctgcgcatggtcggcagccggagggtgaaggcccagacgttcgctgagcggcgcgagcggagcttcagccggtcctggagcgaccccacccccatgaaagccgacacttcccacgactcccgagacagcagtgacctgcagagctcccactgcacgctggacgaggccttcgaggacctggactgggacactgagaagggcctggaggctgtggcctgcgacaccgaaggcttcgtgccaccaaaggtcatgctcatttcctccaaggtgcccaaggctgagtacatccccactatcatccgccgggatgacccctccatcatccccatcctctacgaccatgagcacgcaaccttcgaggacatccttgaggagatagagaggaagctgaacgtctaccacaagggagccaagatctggaaaatgctgattttctgccagggaggtcctggacacctctatctcctcaagaacaaggtggccacctttgccaaagtggagaaggaagaggacatgattcacttctggaagcggctgagccgcctgatgagcaaagtgaacccagagccgaacgtcatccacatcatgggctgctacattctggggaaccccaatggagagaagctgttccagaacctcaggaccctcatgactccttatagggtcaccttcgagtcacccctggagctctcagcccaagggaagcagatgatcgagacgtactttgacttccggttgtatcgcctgtggaagagccgccagcactcgaagctgctggactttgacgacgtcctgtgaggggcagaggcctccgcccagtcaccatcaggccactccctctgcaccgggacctggggctgggccgcctcgtgctccccgggactgtgtggctccggtctcgcctggagccacttcagggcacctcagacgttgctcaggttccccctgtgggttccggtcctcgctgcacccgtggccgcagaggctgcagtccctgggggccgggaggatcccgccctgtggcccgtggatgctcagcggccaggcactgacctgccatgcctcgcctggaggctcagctgtgggcatccctccatggggttcatagaaataagtgcaatttctacacccccgaaacaattcaaagggaagcagcatttcttgttaactagttaagcactatgctgctagttacagtgtaggcaccccggcccagcagcccagcagcccacatgtgtgctgtgttcccagctgagggagggctggggcgggggccgggcttggaacgatgtacgataccctcatagtgaccattaaacctgatcctccaccgcggccgccgcgtgggtctgtcctctcagtgctttccaggggccttcctgtgcccagcttctgggcccactcctgtgaggtcactgctgcagggccttcctgcctggacagagttggagctaggccactagaccaccccacagggcatagccagggggaccagcacaggaggggacggagaggagctgcaggagggctggggggaggctgcagtctcggaggggggcctcgccgggtctggaggggacagcagagacagcccgttccccctgccgcctgagggcaccagggagagggctgtatgtccctcacgccacactgtgtgtgcagtcagcagtgtggccacagatgggggccactctctcaacctcaggtgtcctcagggcccagaccgctgctgggcacagccaggctggctgccagctggttccctgccccgtggctgggggacagagcagcacgtatcagctgggctagggtcagggggccactggtgcgcagcctggcacagcctggcaggcttgaggcccagtgtgctgggggtggtcacacagccgtcagccacctccagctcttccagggcattctagatggggtcccgggagggggcaggttttggtgccaatttgagtgtataaagttttaggtaaataccaaatgc

SEQ ID NO: 104150 - DNA, 2478 bp, Homo sapiens
atccttaattaaattaatccccctcccccctcgggtccgggcagcgctctcccgggagcggcggcacgcgcggagcgccgggtgcggccatgcggggaccgggcccgaccccgagcccgaccccgagcccaagcccgagccggagcccgagcgagaccccgagcccgagcccgagcgcgacccccggtgcggcgcggctaccccggcggaggcggcgggcgcggggcgcgctctgaggcccgggggatgcgccgccgcctcgaccatgggcgccgccgcctccaggaggagggcgctgaggagcgaggccatgtcctcggtggcggccaaagtgcgagcagcccgagcgtttggagagtacctgtcccagagtcaccctgagaaccgcaacggcgcagatcacctgctggctgatgcctactctggccacgacgggtcccccgagatgcagccggccccccagaacaagcgccgcctgtccctcgtctccaacggctgctacgagggcagcctctcagaggagcccagcattaggaagcccgcaggcgagggccctcagcctcgagtgtacaccatctctggggagcctgccctgctgcccagccctgaggcggaggccattgagctggcggtggtgaaggggcggcggcagcggcaccctcaccatcacagccagcccctgcgcgccagccctggtggcagccgggaggacgtcagcaggccctgccagagctgggcgggcagccgccagggctccaaggagtgccccggatgtgcccagctggctcctggccccacccctcgggcctttgggctggaccagccacctctgcctgagacctccggtcgccgcaagaagctggagaggatgtacagcgttgaccgtgtgtctgacgacatccctattcgtacctggttccccaaggaaaatcttttcagcttccagacagcaaccacaactatgcaagccatctcggtgttcaggggctacgcggagaggaagcgccggaaacgggagaatgattccgcgtctgtaatccagaggaacttccgcaaacacctgcgcatggtcggcagccggagggtgaaggcccagacgttcgctgagcggcgcgagcggagcttcagccggtcctggagcgaccccacccccatgaaagccgacacttcccacgactcccgagacagcagtgacctgcagagctcccactgcacgctggacgaggccttcgaggacctggactgggacactgagaagggcctggaggctgtggcctgcgacaccgaaggcttcgtgccaccaaaggtcatgctcatttcctccaaggtgcccaaggctgagtacatccccactatcatccgccgggatgacccctccatcatccccatcctctacgaccatgagcacgcaaccttcgaggacatccttgaggagatagagaggaagctgaacgtctaccacaagggagccaagatctggaaaatgctgattttctgccagggaggtcctggacacctctatctcctcaagaacaaggtggccacctttgccaaagtggagaaggaagaggacatgattcacttctggaagcggctgagccgcctgatgagcaaagtgaacccagagccgaacgtcatccacatcatgggctgctacattctggggaaccccaatggagagaagctgttccagaacctcaggaccctcatgactccttatagggtcaccttcgagtcacccctggagctctcagcccaagggaagcagatgatcgagacgtactttgacttccggttgtatcgcctgtggaagagccgccagcactcgaagctgctggactttgacgacgtcctgtgaggggcagaggcctccgcccagtcaccatcaggccactccctctgcaccgggacctggggctgggccgcctcgtgctccccgggactgtgtggctccggtctcgcctggagccacttcagggcacctcagacgttgctcaggttccccctgtgggttccggtcctcgctgcacccgtggccgcagaggctgcagtccctgggggccgggaggatcccgccctgtggcccgtggatgctcagcggccaggcactgacctgccatgcctcgcctggaggctcagctgtgggcatccctccatggggttcatagaaataagtgcaatttctacacccccgaaacaattcaaagggaagcagcatttcttgttaactagttaagcactatgctgctagttacagtgtaggcaccccggcccagcagcccagcagcccacatgtgttcaggaccctccctgcccaccccctggagctctcagcccaagggaagcagatgatcgagacgtactttgacttccggttgtatgctgtgttcccagctgagggagggctggggcgggggccgggcttggaacgatgtacgataccctcatagtgaccattaaacctgatcctccaccgcg

SEQ ID NO: 104151 - DNA, 2430 bp, Homo sapiens
atccttaattaaattaatccccctcccccctcgggtccgggcagcgctctcccgggagcggcggcacgcgcggagcgccgggtgcggccatgcggggaccgggcccgaccccgagcccgaccccgagcccaagcccgagccggagcccgagcgagaccccgagcccgagcccgagcgcgacccccggtgcggcgcggctaccccggcggaggcggcgggcgcggggcgcgctctgaggcccgggggatgcgccgccgcctcgaccatgggcgccgccgcctccaggaggagggcgctgaggagcgaggccatgtcctcggtggcggccaaagtgcgagcagcccgagcgtttggagagtacctgtcccagagtcaccctgagaaccgcaacggcgcagatcacctgctggctgatgcctactctggccacgacgggtcccccgagatgcagccggccccccagaacaagcgccgcctgtccctcgtctccaacggctgctacgagggcagcctctcagaggagcccagcattaggaagcccgcaggcgagggccctcagcctcgagtgtacaccatctctggggagcctgccctgctgcccagccctgaggcggaggccattgagctggcggtggtgaaggggcggcggcagcggcaccctcaccatcacagccagcccctgcgcgccagccctggtggcagccgggaggacgtcagcaggccctgccagagctgggcgggcagccgccagggctccaaggagtgccccggatgtgcccagctggctcctggccccacccctcgggcctttgggctggaccagccacctctgcctgagacctccggtcgccgcaagaagctggagaggatgtacagcgttgaccgtgtgtctgacgacatccctattcgtacctggttccccaaggaaaatcttttcagcttccagacagcaaccacaactatgcaagccatctcggtgttcaggggctacgcggagaggaagcgccggaaacgggagaatgattccgcgtctgtaatccagaggaacttccgcaaacacctgcgcatggtcggcagccggagggtgaaggcccagacgttcgctgagcggcgcgagcggagcttcagccggtcctggagcgaccccacccccatgaaagccgacacttcccacgactcccgagacagcagtgacctgcagagctcccactgcacgctggacgaggccttcgaggacctggactgggacactgagaagggcctggaggctgtggcctgcgacaccgaaggcttcgtgccaccaaaggtcatgctcatttcctccaaggtgcccaaggctgagtacatccccactatcatccgccgggatgacccctccatcatccccatcctctacgaccatgagcacgcaaccttcgaggacatccttgaggagatagagaggaagctgaacgtctaccacaagggagccaagatctggaaaatgctgattttctgccagggaggtcctggacacctctatctcctcaagaacaaggtggccacctttgccaaagtggagaaggaagaggacatgattcacttctggaagcggctgagccgcctgatgagcaaagtgaacccagagccgaacgtcatccacatcatgggctgctacattctggggaaccccaatggagagaagctgttccagaacctcaggaccctcatgactccttatagggtcaccttcgagtcacccctggagctctcagcccaagggaagcagatgatcgagacgtactttgacttccggttgtatcgcctgtggaagagccgccagcactcgaagctgctggactttgacgacgtcctgtgaggggcagaggcctccgcccagtcaccatcaggccactccctctgcaccgggacctggggctgggccgcctcgtgctccccgggactgtgtggctccggtctcgcctggagccacttcagggcacctcagacgttgctcaggttccccctgtgggttccggtcctcgctgcacccgtggccgcagaggctgcagtccctgggggccgggaggatcccgccctgtggcccgtggatgctcagcggccaggcactgacctgccatgcctcgcctggaggctcagctgtgggcatccctccatggggttcatagaaataagtgcaatttctacacccccgaaacaattcaaagggaagcagcatttcttgttaactagttaagcactatgctgctagttacagtgtaggcaccccggcccagcagcccagcagcccacatgtgtccccttgtgcagagccaggggtctgagggcacctggctgtgttcccagctgagggagggctggggcgggggccgggcttggaacgatgtacgataccctcatagtgaccattaaacctgatcctccaccgcg

SEQ ID NO: 104152 - DNA, 1015 bp, Homo sapiens
  misc_feature (791)..(791): n is a, c, g, or t
  misc_feature (806)..(806): n is a, c, g, or t
  misc_feature (814)..(814): n is a, c, g, or t
  misc_feature (884)..(884): n is a, c, g, or t
  misc_feature (890)..(890): n is a, c, g, or t
  misc_feature (895)..(895): n is a, c, g, or t
  misc_feature (899)..(899): n is a, c, g, or t
  misc_feature (1014)..(1014): n is a, c, g, or t
atccttaattaaattaatccccctcccccctcgggtccgggcagcgctctcccgggagcggcggcacgcgcggagcgccgggtgcggccatgcggggaccgggcccgaccccgagcccgaccccgagcccaagcccgagccggagcccgagcgagaccccgagcccgagcccgagcgcgacccccggtgcggcgcggctaccccggcggaggcggcgggcgcggggcgcgctctgaggcccgggggatgcgccgccgcctcgaccatgggcgccgccgcctccaggaggagggcgctgaggagcgaggccatgtcctcggtggcggccaaagtgcgagcagcccgagcgtttggagagtacctgtcccagagtcaccctgagaaccgcaacggcgcagatcacctgctggctgatgcctactctggccacgacgggtcccccgagatgcagccggccccccagaacaagcgccgcctgtccctcgtctccaacggctgctacgagggcagcctctcagaggagcccagcattaggaagcccgcaggcgagggccctcagcctcgagtgtacaccatctctggggagcctgccctgctgcccagccctgaggcggaggccattgagctggcggtggtgaaggggcggcggcagcggcaccctcaccatcacagccagcccctgcgcgccagccctggtggcagccgggaggacgtcagcaggccctgccagagctgggcgggcagccgccagggctccaaggagtgccccggatgtgcccagctgctctgcncactctcggtctttngctgacancactctgctaactctgtgcgcaaagtgaagattacgtacgttttataatctatgtctgttcagaatttantcaaanacaanatanattgactcgaaactgtatgtgacgagtagcaagtgtatgtcacgactactgtctgacacaccatatatcaatcaaatatatatataagtaatatgatagtattttaagttcaagnt

SEQ ID NO: 104153 - DNA, 327 bp, Homo sapiens
tccctgcggagggccctgcagtgcctcggaaggaacccacccagcctttgggaagcacccgtgagaggccctgggtgggaccctgcagcatggcaggggctcgccaggtctccagacccctggctgcgcataggacagaatccccatccccggcattgccacagaccattaattctgggctctcatgctctcaggaagcctcacccgggcccctggctcctgctgcacagccaggagggggttggattccggttccggtgacactgtcgggggctgctcctcacccccaggtgtgcacctggcacagccactgtcccaggatccctg

SEQ ID NO: 104154 - DNA, 208 bp, Homo sapiens
ccgggaacctagcccggacggcctcgttctccacattaattcgtggtccaccagttcagcagcctgtcctctcagcttcttctagggtggcttataatgaaggtagcaagttcaatgttttcttgttttttttttttttcctcctggagggaggattatgtgaatttaaaatctcctaggcattcaaaaccaaaaccaaaaccaacca

SEQ ID NO: 104155 - DNA, 413 bp, Homo sapiens
tgctctagtcacgccctcaaaactgggtaaagtacctctctcgtcatctccctaatacccattcttggaaatgaaagcaatgtcactttataatctctttcctgatctttattttcccactagactagtgattattaaccatagtgatgtgattgtcaggtgtgtcacagtaatctagttttcagagtcacactgacttccatgcttaagctggcaggtaatttatcatacatacgatcttagattccaaatcttttttatttgactgttacatttgccttatgtgtttcagaagatggaacaacaatgtcgggcattatagtctgtgtaccaatatatatcctgaaaatctctctggaaatgggttactccttcaatgtggctctaacacagagctgcactatcccataaac

SEQ ID NO: 104156 - DNA, 451 bp, Homo sapiens
agatccttgaagacttggagcagagcctccagtcagtgctcagtggatgtataacatgaaagagaataaaatctttgttattataacctagtcaaatctgactgctacagttggtattaattaatgtcttctttaaaggaacatttatcaaataaacacatctcagataaaaacagttgttctcccatggtgtatgtatcttcatgtttgtccttagtggttataataatctgtataaattatgaagagaatctgctggaatgattagtaaggtgctttatttgtgggccaaatagtagcaggtattagatacgttggtgggccaagaaatgaagggaagccaagaatggagtgatacatcttacaaaagagaccaaatttcatacccgatgacatcaaattttatacctaatgatgtcaaatataggccatttgtttcaggaaaaaaaaa

SEQ ID NO: 104157 - DNA, 421 bp, Homo sapiens
attaggaattgaaatccaggaagccattgcttagaagcaaaaatcatatcttagaaaagtttcaaaaatgaaattcccattagtacctggaaatattacatgggaataaataaatatcaaaggtaacactgaaatttccatggtaatacaacatccctaacagatggacatctagctgtgtttgaatgtttctggtatgtggcagttactaccattctacaattttaagctttaactgtagaatatcattaaggtaaccacatctacctctgctgggcttggtggctcatgcctgtaaccctgacattttgggaaagcaaggtaggccaattgcttgagctgaggatttcgagactagcctgggcaacatggcaaaaccctgtctctacaacaaatacaaaaattaactgggcatagtggt

SEQ ID NO: 104158 - DNA, 480 bp, Homo sapiens
agaagagagagttaactttgacaacggcaataacagaacaaagaatgtactttatgtatgttttctttgttctttgtttaccccattctagcaatgcagaaacagttagaagacactcaccgagccccacctggcttcccacctgtgaccaggtgaggcaacagtgtgggggaggatgaggcagctgccctcggcattgcctgtggcaaggccagcaacacaacccaggaaaggggaccgttttcagtgtctagtgggataataatatctagcatttactgggcatactcaatcttgctaccaccctggttttgaaaacacaaatctgttcaaatgcagttgatacatgggggagcactttgtgcatgatgtaattttgcattctcctatgaatgatgaatgacgggttgctagtctggttgaacagttacagatggatttgtaagctagacagtgtccctcaggaccatggaatgtgtg

SEQ ID NO: 104159 - DNA, 353 bp, Homo sapiens
tagttctgcgcactaaaaaagtggataagacattaatcttttaaaagtgctctgtgcctccagaatatgtgtcagccatggctgggcgccgtggctcatgcctgtaatcccagcactttgggaggctgaggcaggcagatcacgaagtcagtagtttgagaccagcctggccaacataatgaaaccccgtctctactaaaaatacaaaaattagctgggcgtggtggcacacgactgcaatcccagctactcgggaggctgaggcaggagaattgcttgaacccgggaggcagaggtggcagtgagctgagatcacgccattacactccagcctggatgacagagcgagactc

SEQ ID NO: 104160 - DNA, 360 bp, Homo sapiens
cattgcaattcttatgtaaatctaaaagcattctaaagtaaaaagtctacttaaaaaaaataaatgatgtctttactatctgacttctcaaatgctttaatatgctgagacattttgagtattcccaaattaatatgactaaagaactgaatagctgttacattctcgggtcctagggttctctagaatagttaggaatgataataataatagctaacatttattagagaggctctgagcttcgtggttaataactttatcccgtgagccagactccctgctcacctatgaccatcactacttaagagctgtataatcaaggctgggcatggtggctctcccctgtaatcccagcatttt

SEQ ID NO: 104161 - DNA, 387 bp, Homo sapiens
tttttttttttttttttttggtagagatgagttctcattatgttacccaggttgatcttgaactcctgggctcaggtgatcctcccccctcagcttctggagtagctggaacaacaggcataagccaccatgcctggcttcagtgttttttacaatagccaaaaaaaaccccaaaaaaatcagaaattaacaaaatacctcttggggctactgaagtcacaaataatatttagagtgcactaacctcaggtcagcccttgtctgaagggttttgcatgccttatctcatttagttctgacaaccactgaagaaagtcttggtataacccatctttataatcaaggaaagtaaggctcaggacactatgtaacttgtccaaggaagta

SEQ ID NO: 104162 - DNA, 420 bp, Homo sapiens
gtgttatctgaatccagaaattctacagcagaggtttggctccacctcaccattgatttcctttcggtgattttgtaagtcatcactttgtaatgcaatttctctctgtatgaaacaaacgagtatttttttttaccaccccttctgagactgttgataaaacacactcgacaaacgttttacagcacccttgtgaggcactaaggaatggggagaaatctacacctaaccaccaccaccaccaggcatcccagtgtgctcagggcagcgccagtttttgcagaagtattaatagcccctcctttcactcccccaagcgtcttcgatgggatggttagttataaggtcacgctacagaaaacataacaccaggcctggagaagttcagagtcagggtgagagaaaagactgggaggagga

SEQ ID NO: 104163 - DNA, 369 bp, Homo sapiens
cgttttgccatgttgcccaggctcatctcgaattcctgagctcatgcgatctgcctggcctcggtctcccagagtgctaggattacaggcatgagccaccgtgccagttcttatcattttaatttcaaagagtgtttttgttcatcttctgaatgttcctttctgtagcatctgtgtttttgtttttttgagacagaatcttgccctgtcaccccggctggagtgcaatggtgcaatcttggcttactccaacctctacctcccgggttcaaacgattctcatacctcagtctcctgagtagctgagattacaggcatctgccaccatacctggctaatttttgtatttttagtagagacgtgatttca

SEQ ID NO: 104164 - DNA, 3306 bp, Homo sapiens
  misc_feature (1336)..(1336): n is a, c, g, or t
  misc_feature (1492)..(1492): n is a, c, g, or t
  misc_feature (1497)..(1497): n is a, c, g, or t
  misc_feature (2759)..(2759): n is a, c, g, or t
gatcaccatgacagatataataacataatagtaacagaaaagtttgaaaaatgcaaattaccaaaatgtgagctcatggttttggagaaaatggttccaatagactcaccagatgcagggttgccacaaatcttcaatttgtaaaaaacgcaatatctctgaaccacagtaaagttgaagtgcaacaaaattaggtatgcctgtatggaaacgcagagctcacacccttctgatgaacagacagaagtgtcagatccttttctatgctagcaaaggattttaagggtttggaattctctaaaagtgtaaagctcttaggagggcgttacttggcaaagcagtgctttatcccattctcttgtttgcctgttcaaacttcccacccattgtagacccacttgctgtgttattgcaggttaagcccccaagacccttttctctcaccttttttgttcacttcccatcccctttccttctcaggtcatcctccatgcccttctgatgtccacatgtctcttcattttcttctcaggcctcctctttctctcaccatctaagttattgaaattcttgaaatcctaagcaggcctggcactgagaggtaagcacctgagagtgtcagtcttccctagataaatggaactgtgtgcagatctgggactgctggaagggtgtggggtagggatttaaggatggcgcaagtagggtggggctaaaaaagaccttgtcttctttatataggagcatcgagattaaagggtgtgaggtaggggtttaaggatggcgcaagtcaggtggggctaaaaaagaccttgtcttctttatataggagcatcgagattaaacactgaattcagcagtgttcaattcatttcttattttccactgtatttcatttcaacccatcctctatattttgtgagcccaaagcctttagatatgtgtagaggaaggtgtgatacagctttcaacttcttgaaatttgcccaagaaatactttgtatcatgaggtctgcagttatttatacaaatccctgaaaatatttcatggcaaatctgtagcacccagttgagatgagaccaaactggaaaaatctctgtggctgtggttattgtcagttctgtaagatgaagatgggaccagtgacaagaatgtgcactatttactgagcactcacctgcacggggccatgtgcttttcagacattgcctctttcagtcttgagcacaatgccagttgtgccatcccctgacatatagatgagatgaagatccagacataaccagcaagggcagggctgggatgcgatccatgtgtgcctggttcccagggttngcatgtttgcagtgttctctccataatggtttgccttaatgaagagaggattcaggatgtccagtttcagcctcactggctgggctggaatcttccattgacccttccactctacattcctccctggcctgggatgctcactcgagtgggcttctngctgngcttggccagtgggggttgccatcaggagacaacagggcatctgcttctccagggcatcccccagggcacagtgctttgtgactcaagggtctgcccctcttggtttccctaaacctcactcctctctttgtaaacagcccctttataaattacgcaccttgagggtgtcatctgctttctttcaggagcaggactgactcactagcatcactcctaaataatgtgaacttgttttgattttttgtttgaggcagagtctctcacagtgttcctaggctggagtgcagtggcatggtcttggctcattctgggctcaagcaatcctttcaccttagccatctcagtagctgggactataggcatgcgccaccatgctcggctaatttttaaaatatttgtagagatggggtcttgctatgttgccaggctggtcttgaactccagggctcaagtgatccttctgcctcggcttcctaaagtgttgggattacaggtatgagccactgcacctgcccaatgatgtgaacttttagtaagtcacttcagttatctgggcccaacttgctttacctgtcaagcagggaccatggtgcctggtctcccagattgtgaatgtcaaagaaaacaggtagagaggcactttggaagataaacactcctcagaatgggagctagcagtgtaattccacaaggcacagaatgggcattcactgcatagcctgactggaagtggagcatcctttgtgagaaaaggaaacctctgagacagtgaatatgttcccattttgaaaagcttgatgcaatcaaaatagaagaaagagcaccgctgaagagaataagagaagagatctttgttttgtttttgcttgtttctttgtggtagtgacagcgtatttcatgtaggaacctgtgacaaagctccccataataaacatcagaaagtcaaggatgatggttttggccaaggagcaaatgacacatgccacagctctcctggcaggtccccttttcgagattgtgtcctcccggataggactctcaagcagctgcaacaggcatcttccagctgggaaaggccacttgacctctttttctctttcgaaagccgggcagctgtgagtccaggcttgtcactcctgggtgcaggctcaggaattgaaggcgggtctgccaagccacacaccctcgttgaaacacctctgctctgtggccaggcttttcagcccctccccactccccatcagcagtggcttctggaatntccctgtctgtagaatgagaatagttacatcaaaatttcttcccaaggagctaattggaatattgtaatacaaatatttgcagagaattaatactgagagatgctaaaggagaatttagctcatgtaattactaatcagtgtcttttttccaggtactctgtaagggagctgaaacttccagcctttcttcctattcacaaacccacctttacccgcccccaatgctggactttggtttttcatattgcttttgcagaactttaaaacatttgaatctttccctgatgagtttttgtcctgaggggccagtgcagttttcttgccactttgttttcctctcatataacttttccctgtcaataaggcatttaggctgagagaaaaagttattgagcatgtgcatccaaatttgagatgattgttatttcattacctaatgactttaacttctttgatactgtgtttgtcttatgaatataatggctttctcactttaatgaaaagttatacaataaaattgaaaagtaagtactgtatctgtaaaaa

SEQ ID NO: 104165 - DNA, 558 bp, Homo sapiens
tctaatgttattgatagtttgctccagatgacggtggaatctagtcatcctccatgcccttctgatgtccacatgtctcttcattttcttctcaggcctcctctttctctcaccatctaagttattgaaattcttgaaatcctaagcaggcctggcactgagaggtactctgtaagggagctgaaacttccagcctttcttcctattcacaaacccacctttacccgcccccaatgctggactttggtttttcatattgcttttgcagaactttaaaacatttgaatctttccctgatgagtttttgtcctgaggggccagtgcagttttcttgccactttgttttcctctcatataacttttccctgtcaataaggcatttaggctgagagaaaaagttattgagcatgtgcatccaaatttgagatgattgttatttcattacctaatgactttaacttctttgatactgtgtttgtcttatgaatataatggctttctcactttaatgaaaagttatacaataaaattgaaaagtaagtactgtatctgtaaaaa

SEQ ID NO: 104166 - DNA, 3087 bp, Homo sapiens
gcggggcgggccggcggcggaggccgggccgcggagccaggagtgactagcagcagttggccgtgccgtagcagcgtcccgcgcgcggcgggcagcggcccaggaggcgcgtggtgcgggtttcggcggcggctgaggaagaagcgcgggcggcgccttcgggaggcgagcaggcagcagttggccgtgccgtagcagcgtcccgcgcgcggcgggcagcggcccaggaggcgcgtggcggcgctcggcctcgcggcggcggcggcggcagcggcccagcagttggcggcgagcgcgtctgcgcctgcgcggcgggccccgcgcccctcctccccccctgggcgcccccggcggcgtgtgaatggcggcctccgcggcggcagcctcggcagcagcggcctcggccgcctctggcagcccgggcccgggcgagggctccgctggcggcgaaaagcgctccaccgccccttcggccgcagcctcggcctctgcctcagccgcggcgtcgtcgcccgcggggggcggcgccgaggcgctggagctgctggagcactgcggcgtgtgcagagagcgcctgcgacccgagagggagccccgcctgctgccctgtttgcactcggcctgtagtgcctgcttagggcccgcggcccccgccgccgccaacagctcgggggacggcggggcggcgggcgacggcaccgtggtggactgtcccgtgtgcaagcaacagtgcttctccaaagacatcgtggagaattatttcatgcgtgatagtggcagcaaggctgccaccgacgcccaggatgcgaaccagtgctgcactagctgtgaggataatgccccagccaccagctactgtgtggagtgctcggagcctctgtgtgagacctgtgtagaggcgcaccagcgggtgaagtacaccaaggaccatactgtgcgctctactgggccagccaagtctcgggatggtgaacgtactgtctattgcaacgtacacaagcatgaaccccttgtgctgttttgtgagagctgtgatactctcacctgccgagactgccagctcaatgcccacaaggaccaccagtaccagttcttagaggatgcagtgaggaaccagcgcaagctcctggcctcactggtgaagcgccttggggacaaacatgcaacattgcagaagagcaccaaggaggttcgcagctcaatccgccaggtgtctgacgtacagaagcgtgtgcaagtggatgtcaagatggccatcctgcagatcatgaaggagctgaataagcggggccgtgtgctggtcaatgatgcccagaaggtgactgaggggcagcaggagcgcctggagcggcagcactggaccatgaccaagatccagaagcaccaggagcacattctgcgctttgcctcttgggctctggagagtgacaacaacacagcccttttgctttctaagaagttgatctacttccagctgcaccgggccctcaagatgattgtggatcccgtggagccacatggcgagatgaagtttcagtgggacctcaatgcctggaccaagagtgccgaggcctttggcaagattgtggcagagcgtcctggcactaactcaacaggccctgcacccatggcccctccaagagccccaggcccctgagcaagcagggctctggcagcagccagcccatggaggtgcaggaaggctatggctttgggtcaggagatgatccctactcaagtgcagagccccatgtgtcaggtgtgaaacggtcccgctcaggtgagggcgaggtgagcggccttatgcgcaaggtgccacgagtgagccttgaacgcctggacctggacctcacagctgacagccagccacccgtcttcaaggtcttcccaggcagtaccactgaggactacaaccttattgttattgaacgtggcgctgccgctgcagctaccggccagccagggactgcgcctgcaggaacccctggtgccccacccctggctggcatggccattgtcaaggaggaggagacggaggctgccattggagcccctcctactgccactgagggccctgagaccaaacctgtgcttatggctcttgcggagggtcctggtgctgagggtccccgcctggcctcacctagtggcagcaccagctcagggctggaggtggtggctcctgagggtacctcagccccaggtggtggcccgggaaccctggatgacagtgccaccatttgccgtgtctgccagaagccaggcgatctggttatgtgcaaccagtgtgagttttgtttccacctggactgtcacctgccggccctgcaggatgtaccaggggaggagtggagctgctcactctgccatgtgctccctgacctgaaggaggaggatggcagcctcagcctggatggtgcagacagcactggcgtggtggccaagctctcaccagccaaccagcggaaatgtgagcgtgtactgctggccctattctgtcacgaaccctgccgccccctgcatcagctggctaccgactccaccttctccctggaccagcccggtggcaccctggatctgaccctgatccgtgcccgcctccaggagaagttgtcacctccctacagctccccacaggagtttgcccaggatgtgggccgcatgttcaagcaattcaacaagttaactgaggacaaggcagacgtgcagtccatcatcggcctgcagcgcttcttcgagacgcgcatgaacgaggccttcggtgacaccaagttctctgctgtgctggtggagcccccgccgatgagcctgcctggtgctggcctgagttcccaggagctgtctggtggccctggtgatggcccctgaggctggagcccccatggccagcccagcctggctctgttctctgtcctgtcaccccatccccactcccctggtggcctgactcccactccctggtggccccatcccccagttcctcacgatatggtttttacttctgtggatttaataaaaacttcaccagttcctcaggcgttggctggttgggggactgtggtcctggggcctggtttattgactgta

SEQ ID NO: 104167 - DNA, 533 bp, Homo sapiens
tccctagcaactctgtggggagctgtagggaggtgacacacttctcctggaggcgggcacggatcaggtcagatccaggtgcaccgggctggtcagggagaaggtggagtcggtagccagctgatgcagtgtggcggcagtgcttcgtgacagaatagggccgcatgttcaagcaattcaacaagttaactgaggacaaggcagacgtgcagtccatcatcggcctgcagcgcttcttcgagacgcgcatgaacgaggccttcggtgacaccaagttctctgctgtgctggtggagcccccgccgatgagcctgcctggtgctggcctgagttcccaggagctgtctggtggccctggtgatggcccctgaggctggagcccccatggccagcccagcctggctctgttctctgtcctgtcaccccatccccactcccctggtggcctgactcccactccctggtggccccatcccccagttcctcacgatatggtttttacttctgtggatttaataaaaacttcaccagtt

SEQ ID NO: 104168 - DNA, 208 bp, Homo sapiens
gcggccgcctactactactactactgctcgaattcaagcttctaacgatgtacggggacatggccagcccagcctggctctgttctctgtcctgtcaccccatccccactcccctggtggcctgactcccactccctggtggccccatcccccagttcctcacgatatggtttttacttctgtggatttaataaaaacttcaccagtt

SEQ ID NO: 104169 - DNA, 265 bp, Homo sapiens
gcggccgcctactactactactactgctcgaattcaagcttctaacgatgtacggggacatggccagcccagcctggctctgttctctgtcctgtcaccccatccccactcccctggtggcctgactcccactccctggtggccccatcccccagttcctcacgatatggtttttacttctgtggatttaataaaaacttcaccagttcctcaggcgttggctggttgggggactgtggtcctggggcctggtttattgactgta

SEQ ID NO: 104170 - DNA, 2831 bp, Homo sapiens
cggcggcgaagagacgcgggttgaggaagagggacggattgcccatgcgcttgggcgcacagcggcccgcttctgtgtggtctggaggtggagctgagaggggaatcacactctataaaggttcgcataccccactggcggattcaattgcggcagtgacgtcacagaggccccgccccgcccccacaagagccccaccgacgtggggttggcggtggtggaaggactaggagttggcgcgtgcgtactggcggcctctcccgcaccgaccggcctgggccccgcccccgggcgtgaggcgcccaatgcgcgtgcgcggcggcgtcggcgccagttatttctgtcccgccccccggcctcggctctttctgcgagcgggcgcgcgggcgagcggttgtgcttgtgcttgtggcgcgtggtgcgggtttcggcggcggctgaggaagaagcgcgggcggcgccaacagctcgggggacggcggggcggcgggcgacggcaccgtggtggactgtcccgtgtgcaagcaacagtgcttctccaaagacatcgtggagaattatttcatgcgtgatagtggcagcaaggctgccaccgacgcccaggatgcgaaccagtgctgcactagctgtgaggataatgccccagccaccagctactgtgtggagtgctcggagcctctgtgtgagacctgtgtagaggcgcaccagcgggtgaagtacaccaaggaccatactgtgcgctctactgggccagccaagtctcgggatggtgaacgtactgtctattgcaacgtacacaagcatgaaccccttgtgctgttttgtgagagctgtgatactctcacctgccgagactgccagctcaatgcccacaaggaccaccagtaccagttcttagaggatgcagtgaggaaccagcgcaagctcctggcctcactggtgaagcgccttggggacaaacatgcaacattgcagaagagcaccaaggaggttcgcagctcaatccgccaggtgtctgacgtacagaagcgtgtgcaagtggatgtcaagatggccatcctgcagatcatgaaggagctgaataagcggggccgtgtgctggtcaatgatgcccagaaggtgactgaggggcagcaggagcgcctggagcggcagcactggaccatgaccaagatccagaagcaccaggagcacattctgcgctttgcctcttgggctctggagagtgacaacaacacagcccttttgctttctaagaagttgatctacttccagctgcaccgggccctcaagatgattgtggatcccgtggagccacatggcgagatgaagtttcagtgggacctcaatgcctggaccaagagtgccgaggcctttggcaagattgtggcagagcgtcctggcactaactcaacaggccctgcacccatggcccctccaagagccccaggcccctgagcaagcagggctctggcagcagccagcccatggaggtgcaggaaggctatggctttgggtcaggagatgatccctactcaagtgcagagccccatgtgtcaggtgtgaaacggtcccgctcaggtgagggcgaggtgagcggccttatgcgcaaggtgccacgagtgagccttgaacgcctggacctggacctcacagctgacagccagccacccgtcttcaaggtcttcccaggcagtaccactgaggactacaaccttattgttattgaacgtggcgctgccgctgcagctaccggccagccagggactgcgcctgcaggaacccctggtgccccacccctggctggcatggccattgtcaaggaggaggagacggaggctgccattggagcccctcctactgccactgagggccctgagaccaaacctgtgcttatggctcttgcggagggtcctggtgctgagggtccccgcctggcctcacctagtggcagcaccagctcagggctggaggtggtggctcctgagggtacctcagccccaggtggtggcccgggaaccctggatgacagtgccaccatttgccgtgtctgccagaagccaggcgatctggttatgtgcaaccagtgtgagttttgtttccacctggactgtcacctgccggccctgcaggatgtaccaggggaggagtggagctgctcactctgccatgtgctccctgacctgaaggaggaggatggcagcctcagcctggatggtgcagacagcactggcgtggtggccaagctctcaccagccaaccagcggaaatgtgagcgtgtactgctggccctattctgtcacgaaccctgccgccccctgcatcagctggctaccgactccaccttctccctggaccagcccggtggcaccctggatctgaccctgatccgtgcccgcctccaggagaagttgtcacctccctacagctccccacaggagtttgcccaggatgtgggccgcatgttcaagcaattcaacaagttaactgaggacaaggcagacgtgcagtccatcatcggcctgcagcgcttcttcgagacgcgcatgaacgaggccttcggtgacaccaagttctctgctgtgctggtggagcccccgccgatgagcctgcctggtgctggcctgagttcccaggagctgtctggtggccctggtgatggcccctgaggctggagcccccatggccagcccagcctggctctgttctctgtcctgtcaccccatccccactcccctggtggcctgactcccactccctggtggccccatcccccagttcctcacgatatggtttttacttctgtggatttaataaaaacttcaccagtt

SEQ ID NO: 104171 - DNA, 2421 bp, Homo sapiens
  misc_feature (31)..(31): n is a, c, g, or t
  misc_feature (64)..(64): n is a, c, g, or t
  misc_feature (83)..(83): n is a, c, g, or t
gtctctctgagatgcgtcatagtggctcgcntcagctcctggttgtgccgcccagcatcctgangcccacagctactggatcnccgctgctgctccagtccaagcttctggttgattaatgagggcatggggtggtccctcaagaccttcccctaccttttgtgaaaccagtgatgcctcaaagacagtgtccccttccagccagtgctgcactagctgtgaggataatgccccagccaccagctactgtgtggagtgctcggagcctctgtgtgagacctgtgtagaggcgcaccagcgggtgaagtacaccaaggaccatactgtgcgctctactgggccagccaagtctcgggatggtgaacgtactgtctattgcaacgtacacaagcatgaaccccttgtgctgttttgtgagagctgtgatactctcacctgccgagactgccagctcaatgcccacaaggaccaccagtaccagttcttagaggatgcagtgaggaaccagcgcaagctcctggcctcactggtgaagcgccttggggacaaacatgcaacattgcagaagagcaccaaggaggttcgcagctcaatccgccaggtgtctgacgtacagaagcgtgtgcaagtggatgtcaagatggccatcctgcagatcatgaaggagctgaataagcggggccgtgtgctggtcaatgatgcccagaaggtgactgaggggcagcaggagcgcctggagcggcagcactggaccatgaccaagatccagaagcaccaggagcacattctgcgctttgcctcttgggctctggagagtgacaacaacacagcccttttgctttctaagaagttgatctacttccagctgcaccgggccctcaagatgattgtggatcccgtggagccacatggcgagatgaagtttcagtgggacctcaatgcctggaccaagagtgccgaggcctttggcaagattgtggcagagcgtcctggcactaactcaacaggccctgcacccatggcccctccaagagccccaggcccctgagcaagcagggctctggcagcagccagcccatggaggtgcaggaaggctatggctttgggtcaggagatgatccctactcaagtgcagagccccatgtgtcaggtgtgaaacggtcccgctcaggtgagggcgaggtgagcggccttatgcgcaaggtgccacgagtgagccttgaacgcctggacctggacctcacagctgacagccagccacccgtcttcaaggtcttcccaggcagtaccactgaggactacaaccttattgttattgaacgtggcgctgccgctgcagctaccggccagccagggactgcgcctgcaggaacccctggtgccccacccctggctggcatggccattgtcaaggaggaggagacggaggctgccattggagcccctcctactgccactgagggccctgagaccaaacctgtgcttatggctcttgcggagggtcctggtgctgagggtccccgcctggcctcacctagtggcagcaccagctcagggctggaggtggtggctcctgagggtacctcagccccaggtggtggcccgggaaccctggatgacagtgccaccatttgccgtgtctgccagaagccaggcgatctggttatgtgcaaccagtgtgagttttgtttccacctggactgtcacctgccggccctgcaggatgtaccaggggaggagtggagctgctcactctgccatgtgctccctgacctgaaggaggaggatggcagcctcagcctggatggtgcagacagcactggcgtggtggccaagctctcaccagccaaccagcggaaatgtgagcgtgtactgctggccctattctgtcacgaaccctgccgccccctgcatcagctggctaccgactccaccttctccctggaccagcccggtggcaccctggatctgaccctgatccgtgcccgcctccaggagaagttgtcacctccctacagctccccacaggagtttgcccaggatgtgggccgcatgttcaagcaattcaacaagttaactgaggacaaggcagacgtgcagtccatcatcggcctgcagcgcttcttcgagacgcgcatgaacgaggccttcggtgacaccaagttctctgctgtgctggtggagcccccgccgatgagcctgcctggtgctggcctgagttcccaggagctgtctggtggccctggtgatggcccctgaggctggagcccccatggccagcccagcctggctctgttctctgtcctgtcaccccatccccactcccctggtggcctgactcccactccctggtggccccatcccccagttcctcacgatatggtttttacttctgtggatttaataaaaacttcaccagtt

SEQ ID NO: 104172 - DNA, 2255 bp, Homo sapiens
cggctaggtcgaggcccgggggtaatcggccgaggacagtgctgcactagctgtgaggataatgccccagccaccagctactgtgtggagtgctcggagcctctgtgtgagacctgtgtagaggcgcaccagcgggtgaagtacaccaaggaccatactgtgcgctctactgggccagccaagtctcgggatggtgaacgtactgtctattgcaacgtacacaagcatgaaccccttgtgctgttttgtgagagctgtgatactctcacctgccgagactgccagctcaatgcccacaaggaccaccagtaccagttcttagaggatgcagtgaggaaccagcgcaagctcctggcctcactggtgaagcgccttggggacaaacatgcaacattgcagaagagcaccaaggaggttcgcagctcaatccgccaggtgtctgacgtacagaagcgtgtgcaagtggatgtcaagatggccatcctgcagatcatgaaggagctgaataagcggggccgtgtgctggtcaatgatgcccagaaggtgactgaggggcagcaggagcgcctggagcggcagcactggaccatgaccaagatccagaagcaccaggagcacattctgcgctttgcctcttgggctctggagagtgacaacaacacagcccttttgctttctaagaagttgatctacttccagctgcaccgggccctcaagatgattgtggatcccgtggagccacatggcgagatgaagtttcagtgggacctcaatgcctggaccaagagtgccgaggcctttggcaagattgtggcagagcgtcctggcactaactcaacaggccctgcacccatggcccctccaagagccccaggcccctgagcaagcagggctctggcagcagccagcccatggaggtgcaggaaggctatggctttgggtcaggagatgatccctactcaagtgcagagccccatgtgtcaggtgtgaaacggtcccgctcaggtgagggcgaggtgagcggccttatgcgcaaggtgccacgagtgagccttgaacgcctggacctggacctcacagctgacagccagccacccgtcttcaaggtcttcccaggcagtaccactgaggactacaaccttattgttattgaacgtggcgctgccgctgcagctaccggccagccagggactgcgcctgcaggaacccctggtgccccacccctggctggcatggccattgtcaaggaggaggagacggaggctgccattggagcccctcctactgccactgagggccctgagaccaaacctgtgcttatggctcttgcggagggtcctggtgctgagggtccccgcctggcctcacctagtggcagcaccagctcagggctggaggtggtggctcctgagggtacctcagccccaggtggtggcccgggaaccctggatgacagtgccaccatttgccgtgtctgccagaagccaggcgatctggttatgtgcaaccagtgtgagttttgtttccacctggactgtcacctgccggccctgcaggatgtaccaggggaggagtggagctgctcactctgccatgtgctccctgacctgaaggaggaggatggcagcctcagcctggatggtgcagacagcactggcgtggtggccaagctctcaccagccaaccagcggaaatgtgagcgtgtactgctggccctattctgtcacgaaccctgccgccccctgcatcagctggctaccgactccaccttctccctggaccagcccggtggcaccctggatctgaccctgatccgtgcccgcctccaggagaagttgtcacctccctacagctccccacaggagtttgcccaggatgtgggccgcatgttcaagcaattcaacaagttaactgaggacaaggcagacgtgcagtccatcatcggcctgcagcgcttcttcgagacgcgcatgaacgaggccttcggtgacaccaagttctctgctgtgctggtggagcccccgccgatgagcctgcctggtgctggcctgagttcccaggagctgtctggtggccctggtgatggcccctgaggctggagcccccatggccagcccagcctggctctgttctctgtcctgtcaccccatccccactcccctggtggcctgactcccactccctggtggccccatcccccagttcctcacgatatggtttttacttctgtggatttaataaaaacttcaccagtt

SEQ ID NO: 104173 - DNA, 2332 bp, Homo sapiens
attcgcaccaaggccgggggccaaccacaagggcttttccaagaacatgggggaaaataatttctggcgggaaaatgggaacaaaggctgccaccgacccccagaatgcgaaccagtgctgcactagctgtgaggataatgccccagccaccagctactgtgtggagtgctcggagcctctgtgtgagacctgtgtagaggcgcaccagcgggtgaagtacaccaaggaccatactgtgcgctctactgggccagccaagtctcgggatggtgaacgtactgtctattgcaacgtacacaagcatgaaccccttgtgctgttttgtgagagctgtgatactctcacctgccgagactgccagctcaatgcccacaaggaccaccagtaccagttcttagaggatgcagtgaggaaccagcgcaagctcctggcctcactggtgaagcgccttggggacaaacatgcaacattgcagaagagcaccaaggaggttcgcagctcaatccgccaggtgtctgacgtacagaagcgtgtgcaagtggatgtcaagatggccatcctgcagatcatgaaggagctgaataagcggggccgtgtgctggtcaatgatgcccagaaggtgactgaggggcagcaggagcgcctggagcggcagcactggaccatgaccaagatccagaagcaccaggagcacattctgcgctttgcctcttgggctctggagagtgacaacaacacagcccttttgctttctaagaagttgatctacttccagctgcaccgggccctcaagatgattgtggatcccgtggagccacatggcgagatgaagtttcagtgggacctcaatgcctggaccaagagtgccgaggcctttggcaagattgtggcagagcgtcctggcactaactcaacaggccctgcacccatggcccctccaagagccccaggcccctgagcaagcagggctctggcagcagccagcccatggaggtgcaggaaggctatggctttgggtcaggagatgatccctactcaagtgcagagccccatgtgtcaggtgtgaaacggtcccgctcaggtgagggcgaggtgagcggccttatgcgcaaggtgccacgagtgagccttgaacgcctggacctggacctcacagctgacagccagccacccgtcttcaaggtcttcccaggcagtaccactgaggactacaaccttattgttattgaacgtggcgctgccgctgcagctaccggccagccagggactgcgcctgcaggaacccctggtgccccacccctggctggcatggccattgtcaaggaggaggagacggaggctgccattggagcccctcctactgccactgagggccctgagaccaaacctgtgcttatggctcttgcggagggtcctggtgctgagggtccccgcctggcctcacctagtggcagcaccagctcagggctggaggtggtggctcctgagggtacctcagccccaggtggtggcccgggaaccctggatgacagtgccaccatttgccgtgtctgccagaagccaggcgatctggttatgtgcaaccagtgtgagttttgtttccacctggactgtcacctgccggccctgcaggatgtaccaggggaggagtggagctgctcactctgccatgtgctccctgacctgaaggaggaggatggcagcctcagcctggatggtgcagacagcactggcgtggtggccaagctctcaccagccaaccagcggaaatgtgagcgtgtactgctggccctattctgtcacgaaccctgccgccccctgcatcagctggctaccgactccaccttctccctggaccagcccggtggcaccctggatctgaccctgatccgtgcccgcctccaggagaagttgtcacctccctacagctccccacaggagtttgcccaggatgtgggccgcatgttcaagcaattcaacaagttaactgaggacaaggcagacgtgcagtccatcatcggcctgcagcgcttcttcgagacgcgcatgaacgaggccttcggtgacaccaagttctctgctgtgctggtggagcccccgccgatgagcctgcctggtgctggcctgagttcccaggagctgtctggtggccctggtgatggcccctgaggctggagcccccatggccagcccagcctggctctgttctctgtcctgtcaccccatccccactcccctggtggcctgactcccactccctggtggccccatcccccagttcctcacgatatggtttttacttctgtggatttaataaaaacttcaccagtt

SEQ ID NO: 104174 - DNA, 3503 bp, Homo sapiens
  misc_feature (3359)..(3359): n is a, c, g, or t
cggcggcgaagagacgcgggttgaggaagagggacggattgcccatgcgcttgggcgcacagcggcccgcttctgtgtggtctggaggtggagctgagaggggaatcacactctataaaggttcgcataccccactggcggattcaattgcggcagtgacgtcacagaggccccgccccgcccccacaagagccccaccgacgtggggttggcggtggtggaaggactaggagttggcgcgtgcgtactggcggcctctcccgcaccgaccggcctgggccccgcccccgggcgtgaggcgcccaatgcgcgtgcgcggcggcgtcggcgccagttatttctgtcccgccccccggcctcggctctttctgcgagcgggcgcgcgggcgagcggttgtgcttgtgcttgtggcgcgtggtgcgggtttcggcggcggctgaggaagaagcgcgggcggcgccttcgggaggcgagcaggcagcagttggccgtgccgtagcagcgtcccgcgcgcggcgggcagcggcccaggaggcgcgtggcggcgctcggcctcgcggcggcggcggcggcagcggcccagcagttggcggcgagcgcgtctgcgcctgcgcggcgggccccgcgcccctcctccccccctgggcgcccccggcggcgtgtgaatggcggcctccgcggcggcagcctcggcagcagcggcctcggccgcctctggcagcccgggcccgggcgagggctccgctggcggcgaaaagcgctccaccgccccttcggccgcagcctcggcctctgcctcagccgcggcgtcgtcgcccgcggggggcggcgccgaggcgctggagctgctggagcactgcggcgtgtgcagagagcgcctgcgacccgagagggagccccgcctgctgccctgtttgcactcggcctgtagtgcctgcttagggcccgcggcccccgccgccgccaacagctcgggggacggcggggcggcgggcgacggcaccgtggtggactgtcccgtgtgcaagcaacagtgcttctccaaagacatcgtggagaattatttcatgcgtgatagtggcagcaaggctgccaccgacgcccaggatgcgaaccagtgctgcactagctgtgaggataatgccccagccaccagctactgtgtggagtgctcggagcctctgtgtgagacctgtgtagaggcgcaccagcgggtgaagtacaccaaggaccatactgtgcgctctactgggccagccaagtctcgggatggtgaacgtactgtctattgcaacgtacacaagcatgaaccccttgtgctgttttgtgagagctgtgatactctcacctgccgagactgccagctcaatgcccacaaggaccaccagtaccagttcttagaggatgcagtgaggaaccagcgcaagctcctggcctcactggtgaagcgccttggggacaaacatgcaacattgcagaagagcaccaaggaggttcgcagctcaatccgccaggtgtctgacgtacagaagcgtgtgcaagtggatgtcaagatggccatcctgcagatcatgaaggagctgaataagcggggccgtgtgctggtcaatgatgcccagaaggtgactgaggggcagcaggagcgcctggagcggcagcactggaccatgaccaagatccagaagcaccaggagcacattctgcgctttgcctcttgggctctggagagtgacaacaacacagcccttttgctttctaagaagttgatctacttccagctgcaccgggccctcaagatgattgtggatcccgtggagccacatggcgagatgaagtttcagtgggacctcaatgcctggaccaagagtgccgaggcctttggcaagattgtggcagagcgtcctggcactaactcaacaggccctgcacccatggcccctccaagagccccaggcccctgagcaagcagggctctggcagcagccagcccatggaggtgcaggaaggctatggctttgggtcaggagatgatccctactcaagtgcagagccccatgtgtcaggtgtgaaacggtcccgctcaggtgagggcgaggtgagcggccttatgcgcaaggtgccacgagtgagccttgaacgcctggacctggacctcacagctgacagccagccacccgtcttcaaggtcttcccaggcagtaccactgaggactacaaccttattgttattgaacgtggcgctgccgctgcagctaccggccagccagggactgcgcctgcaggaacccctggtgccccacccctggctggcatggccattgtcaaggaggaggagacggaggctgccattggagcccctcctactgccactgagggccctgagaccaaacctgtgcttatggctcttgcggagggtcctggtgctgagggtccccgcctggcctcacctagtggcagcaccagctcagggctggaggtggtggctcctgagggtacctcagccccaggtggtggcccgggaaccctggatgacagtgccaccatttgccgtgtctgccagaagccaggcgatctggttatgtgcaaccagtgtgagttttgtttccacctggactgtcacctgccggccctgcaggatgtaccaggggaggagtggagctgctcactctgccatgtgctccctgacctgaaggaggaggatggcagcctcagcctggatggtgcagacagcactggcgtggtggccaagctctcaccagccaaccagcggaaatgtgagcgtgtactgctggccctattctgtcacgaaccctgccgccccctgcatcagctggctaccgactccaccttctccctggaccagcccggtggcaccctggatctgaccctgatccgtgcccgcctccaggagaagttgtcacctccctacagctccccacaggagtttgcccaggatgtgggccgcatgttcaagcaattcaacaagttaactgaggacaaggcagacgtgcagtccatcatcggcctgcagcgcttcttcgagacgcgcatgaacgaggccttcggtgacaccaagttctctgctgtgctggtggagcccccgccgatgagcctgcctggtgctggcctgagttcccaggagctgtctggtggccctggtgatggcccctgaggctggagcccccatggccagcccagcctggctctgttctctgtcctgtcaccccatccccactcccctggtggcctgactcccactccctggtggccccatcccccagttcctcacgatatggtttttacttctgtggatttaataaaaacttcaccagttaaaaaaaaaaaaaaaaaaaaaaanaaaaaaaaaggaaaagaaaaaaaaaaaaaaaggagagcaaaagcaagaaaaagaaaacacaagaaaaggcgagaaaaaaaaaaaaaaaaagagcggcggccgagcacgcaaagacctccccgggggggcagtaaatagcgagcg

SEQ ID NO: 104175 - DNA, 3337 bp, Homo sapiens
cggcggcgaagagacgcgggttgaggaagagggacggattgcccatgcgcttgggcgcacagcggcccgcttctgtgtggtctggaggtggagctgagaggggaatcacactctataaaggttcgcataccccactggcggattcaattgcggcagtgacgtcacagaggccccgccccgcccccacaagagccccaccgacgtggggttggcggtggtggaaggactaggagttggcgcgtgcgtactggcggcctctcccgcaccgaccggcctgggccccgcccccgggcgtgaggcgcccaatgcgcgtgcgcggcggcgtcggcgccagttatttctgtcccgccccccggcctcggctctttctgcgagcgggcgcgcgggcgagcggttgtgcttgtgcttgtggcgcgtggtgcgggtttcggcggcggctgaggaagaagcgcgggcggcgccttcgggaggcgagcaggcagcagttggccgtgccgtagcagcgtcccgcgcgcggcgggcagcggcccaggaggcgcgtggcggcgctcggcctcgcggcggcggcggcggcagcggcccagcagttggcggcgagcgcgtctgcgcctgcgcggcgggccccgcgcccctcctccccccctgggcgcccccggcggcgtgtgaatggcggcctccgcggcggcagcctcggcagcagcggcctcggccgcctctggcagcccgggcccgggcgagggctccgctggcggcgaaaagcgctccaccgccccttcggccgcagcctcggcctctgcctcagccgcggcgtcgtcgcccgcggggggcggcgccgaggcgctggagctgctggagcactgcggcgtgtgcagagagcgcctgcgacccgagagggagccccgcctgctgccctgtttgcactcggcctgtagtgcctgcttagggcccgcggcccccgccgccgccaacagctcgggggacggcggggcggcgggcgacggcaccgtggtggactgtcccgtgtgcaagcaacagtgcttctccaaagacatcgtggagaattatttcatgcgtgatagtggcagcaaggctgccaccgacgcccaggatgcgaaccagtgctgcactagctgtgaggataatgccccagccaccagctactgtgtggagtgctcggagcctctgtgtgagacctgtgtagaggcgcaccagcgggtgaagtacaccaaggaccatactgtgcgctctactgggccagccaagtctcgggatggtgaacgtactgtctattgcaacgtacacaagcatgaaccccttgtgctgttttgtgagagctgtgatactctcacctgccgagactgccagctcaatgcccacaaggaccaccagtaccagttcttagaggatgcagtgaggaaccagcgcaagctcctggcctcactggtgaagcgccttggggacaaacatgcaacattgcagaagagcaccaaggaggttcgcagctcaatccgccaggtgtctgacgtacagaagcgtgtgcaagtggatgtcaagatggccatcctgcagatcatgaaggagctgaataagcggggccgtgtgctggtcaatgatgcccagaaggtgactgaggggcagcaggagcgcctggagcggcagcactggaccatgaccaagatccagaagcaccaggagcacattctgcgctttgcctcttgggctctggagagtgacaacaacacagcccttttgctttctaagaagttgatctacttccagctgcaccgggccctcaagatgattgtggatcccgtggagccacatggcgagatgaagtttcagtgggacctcaatgcctggaccaagagtgccgaggcctttggcaagattgtggcagagcgtcctggcactaactcaacaggccctgcacccatggcccctccaagagccccaggcccctgagcaagcagggctctggcagcagccagcccatggaggtgcaggaaggctatggctttgggtcaggagatgatccctactcaagtgcagagccccatgtgtcaggtgtgaaacggtcccgctcaggtgagggcgaggtgagcggccttatgcgcaaggtgccacgagtgagccttgaacgcctggacctggacctcacagctgacagccagccacccgtcttcaaggtcttcccaggcagtaccactgaggactacaaccttattgttattgaacgtggcgctgccgctgcagctaccggccagccagggactgcgcctgcaggaacccctggtgccccacccctggctggcatggccattgtcaaggaggaggagacggaggctgccattggagcccctcctactgccactgagggccctgagaccaaacctgtgcttatggctcttgcggagggtcctggtgctgagggtccccgcctggcctcacctagtggcagcaccagctcagggctggaggtggtggctcctgagggtacctcagccccaggtggtggcccgggaaccctggatgacagtgccaccatttgccgtgtctgccagaagccaggcgatctggttatgtgcaaccagtgtgagttttgtttccacctggactgtcacctgccggccctgcaggatgtaccaggggaggagtggagctgctcactctgccatgtgctccctgacctgaaggaggaggatggcagcctcagcctggatggtgcagacagcactggcgtggtggccaagctctcaccagccaaccagcggaaatgtgagcgtgtactgctggccctattctgtcacgaaccctgccgccccctgcatcagctggctaccgactccaccttctccctggaccagcccggtggcaccctggatctgaccctgatccgtgcccgcctccaggagaagttgtcacctccctacagctccccacaggagtttgcccaggatgtgggccgcatgttcaagcaattcaacaagttaactgaggacaaggcagacgtgcagtccatcatcggcctgcagcgcttcttcgagacgcgcatgaacgaggccttcggtgacaccaagttctctgctgtgctggtggagcccccgccgatgagcctgcctggtgctggcctgagttcccaggagctgtctggtggccctggtgatggcccctgaggctggagcccccatggccagcccagcctggctctgttctctgtcctgtcaccccatccccactcccctggtggcctgactcccactccctggtggccccatcccccagttcctcacgatataatcccggctgtgattataatacctctcgcgcgtcttttcgg

SEQ ID NO: 104176 - DNA, 3427 bp, Homo sapiens
cggcggcgaagagacgcgggttgaggaagagggacggattgcccatgcgcttgggcgcacagcggcccgcttctgtgtggtctggaggtggagctgagaggggaatcacactctataaaggttcgcataccccactggcggattcaattgcggcagtgacgtcacagaggccccgccccgcccccacaagagccccaccgacgtggggttggcggtggtggaaggactaggagttggcgcgtgcgtactggcggcctctcccgcaccgaccggcctgggccccgcccccgggcgtgaggcgcccaatgcgcgtgcgcggcggcgtcggcgccagttatttctgtcccgccccccggcctcggctctttctgcgagcgggcgcgcgggcgagcggttgtgcttgtgcttgtggcgcgtggtgcgggtttcggcggcggctgaggaagaagcgcgggcggcgccttcgggaggcgagcaggcagcagttggccgtgccgtagcagcgtcccgcgcgcggcgggcagcggcccaggaggcgcgtggcggcgctcggcctcgcggcggcggcggcggcagcggcccagcagttggcggcgagcgcgtctgcgcctgcgcggcgggccccgcgcccctcctccccccctgggcgcccccggcggcgtgtgaatggcggcctccgcggcggcagcctcggcagcagcggcctcggccgcctctggcagcccgggcccgggcgagggctccgctggcggcgaaaagcgctccaccgccccttcggccgcagcctcggcctctgcctcagccgcggcgtcgtcgcccgcggggggcggcgccgaggcgctggagctgctggagcactgcggcgtgtgcagagagcgcctgcgacccgagagggagccccgcctgctgccctgtttgcactcggcctgtagtgcctgcttagggcccgcggcccccgccgccgccaacagctcgggggacggcggggcggcgggcgacggcaccgtggtggactgtcccgtgtgcaagcaacagtgcttctccaaagacatcgtggagaattatttcatgcgtgatagtggcagcaaggctgccaccgacgcccaggatgcgaaccagtgctgcactagctgtgaggataatgccccagccaccagctactgtgtggagtgctcggagcctctgtgtgagacctgtgtagaggcgcaccagcgggtgaagtacaccaaggaccatactgtgcgctctactgggccagccaagtctcgggatggtgaacgtactgtctattgcaacgtacacaagcatgaaccccttgtgctgttttgtgagagctgtgatactctcacctgccgagactgccagctcaatgcccacaaggaccaccagtaccagttcttagaggatgcagtgaggaaccagcgcaagctcctggcctcactggtgaagcgccttggggacaaacatgcaacattgcagaagagcaccaaggaggttcgcagctcaatccgccaggtgtctgacgtacagaagcgtgtgcaagtggatgtcaagatggccatcctgcagatcatgaaggagctgaataagcggggccgtgtgctggtcaatgatgcccagaaggtgactgaggggcagcaggagcgcctggagcggcagcactggaccatgaccaagatccagaagcaccaggagcacattctgcgctttgcctcttgggctctggagagtgacaacaacacagcccttttgctttctaagaagttgatctacttccagctgcaccgggccctcaagatgattgtggatcccgtggagccacatggcgagatgaagtttcagtgggacctcaatgcctggaccaagagtgccgaggcctttggcaagattgtggcagagcgtcctggcactaactcaacaggccctgcacccatggcccctccaagagccccaggcccctgagcaagcagggctctggcagcagccagcccatggaggtgcaggaaggctatggctttgggtcaggagatgatccctactcaagtgcagagccccatgtgtcaggtgtgaaacggtcccgctcaggtgagggcgaggtgagcggccttatgcgcaaggtgccacgagtgagccttgaacgcctggacctggacctcacagctgacagccagccacccgtcttcaaggtcttcccaggcagtaccactgaggactacaaccttattgttattgaacgtggcgctgccgctgcagctaccggccagccagggactgcgcctgcaggaacccctggtgccccacccctggctggcatggccattgtcaaggaggaggagacggaggctgccattggagcccctcctactgccactgagggccctgagaccaaacctgtgcttatggctcttgcggagggtcctggtgctgagggtccccgcctggcctcacctagtggcagcaccagctcagggctggaggtggtggctcctgagggtacctcagccccaggtggtggcccgggaaccctggatgacagtgccaccatttgccgtgtctgccagaagccaggcgatctggttatgtgcaaccagtgtgagttttgtttccacctggactgtcacctgccggccctgcaggatgtaccaggggaggagtggagctgctcactctgccatgtgctccctgacctgaaggaggaggatggcagcctcagcctggatggtgcagacagcactggcgtggtggccaagctctcaccagccaaccagcggaaatgtgagcgtgtactgctggccctattctgtcacgaaccctgccgccccctgcatcagctggctaccgactccaccttctccctggaccagcccggtggcaccctggatctgaccctgatccgtgcccgcctccaggagaagttgtcacctccctacagctccccacaggagtttgcccaggatgtgggccgcatgttcaagcaattcaacaagttaactgaggacaaggcagacgtgcagtccatcatcggcctgcagcgcttcttcgagacgcgcatgaacgaggccttcggtgacaccaagttctctgctgtgctggtggagcccccgccgatgagcctgcctggtgctggcctgagttcccaggagctgtctggtggccctggtgatggcccctgaggctggagcccccatggccagcccagcctggctctgttctctgtcctgtcaccccatccccactcccctggtggcctgactcccactccctggtggccccatcccccagttcctcacgatacaggaaacaacacggggatactgaaccaagccccaagacacaccaagggggcgtagcacagcacagggcgatacaacggacggagcacagcaggaaccgcggccacaccctcgaccctcacggcgcagcgcgc

SEQ ID NO: 104177 - DNA, 2052 bp, Homo sapiens
tgaccagaggattatggatcatgcagtctgaagcactgtaggtggggagctgccccagcctcccagctgggagagactcactgcagccaattgggaacccatactggcattgccccagaggacgctggctttctctcctgtgtgtctcagccacagtgttgcatggaccccattcggatccatgcaggtttgcaagaagagcaccaaggaggttcgcagctcaatccgccaggtgtctgacgtacagaagcgtgtgcaagtggatgtcaagatggccatcctgcagatcatgaaggagctgaataagcggggccgtgtgctggtcaatgatgcccagaaggtgactgaggggcagcaggagcgcctggagcggcagcactggaccatgaccaagatccagaagcaccaggagcacattctgcgctttgcctcttgggctctggagagtgacaacaacacagcccttttgctttctaagaagttgatctacttccagctgcaccgggccctcaagatgattgtggatcccgtggagccacatggcgagatgaagtttcagtgggacctcaatgcctggaccaagagtgccgaggcctttggcaagattgtggcagagcgtcctggcactaactcaacaggccctgcacccatggcccctccaagagccccaggcccctgagcaagcagggctctggcagcagccagcccatggaggtgcaggaaggctatggctttgggtcaggagatgatccctactcaagtgcagagccccatgtgtcaggtgtgaaacggtcccgctcaggtgagggcgaggtgagcggccttatgcgcaaggtgccacgagtgagccttgaacgcctggacctggacctcacagctgacagccagccacccgtcttcaaggtcttcccaggcagtaccactgaggactacaaccttattgttattgaacgtggcgctgccgctgcagctaccggccagccagggactgcgcctgcaggaacccctggtgccccacccctggctggcatggccattgtcaaggaggaggagacggaggctgccattggagcccctcctactgccactgagggccctgagaccaaacctgtgcttatggctcttgcggagggtcctggtgctgagggtccccgcctggcctcacctagtggcagcaccagctcagggctggaggtggtggctcctgagggtacctcagccccaggtggtggcccgggaaccctggatgacagtgccaccatttgccgtgtctgccagaagccaggcgatctggttatgtgcaaccagtgtgagttttgtttccacctggactgtcacctgccggccctgcaggatgtaccaggggaggagtggagctgctcactctgccatgtgctccctgacctgaaggaggaggatggcagcctcagcctggatggtgcagacagcactggcgtggtggccaagctctcaccagccaaccagcggaaatgtgagcgtgtactgctggccctattctgtcacgaaccctgccgccccctgcatcagctggctaccgactccaccttctccctggaccagcccggtggcaccctggatctgaccctgatccgtgcccgcctccaggagaagttgtcacctccctacagctccccacaggagtttgcccaggatgtgggccgcatgttcaagcaattcaacaagttaactgaggacaaggcagacgtgcagtccatcatcggcctgcagcgcttcttcgagacgcgcatgaacgaggccttcggtgacaccaagttctctgctgtgctggtggagcccccgccgatgagcctgcctggtgctggcctgagttcccaggagctgtctggtggccctggtgatggcccctgaggctggagcccccatggccagcccagcctggctctgttctctgtcctgtcaccccatccccactcccctggtggcctgactcccactccctggtggccccatcccccagttcctcacgatatggtttttacttctgtggatttaataaaaacttcaccagtt

SEQ ID NO: 104178 - DNA, 3424 bp, Homo sapiens
cggcggcgaagagacgcgggttgaggaagagggacggattgcccatgcgcttgggcgcacagcggcccgcttctgtgtggtctggaggtggagctgagaggggaatcacactctataaaggttcgcataccccactggcggattcaattgcggcagtgacgtcacagaggccccgccccgcccccacaagagccccaccgacgtggggttggcggtggtggaaggactaggagttggcgcgtgcgtactggcggcctctcccgcaccgaccggcctgggccccgcccccgggcgtgaggcgcccaatgcgcgtgcgcggcggcgtcggcgccagttatttctgtcccgccccccggcctcggctctttctgcgagcgggcgcgcgggcgagcggttgtgcttgtgcttgtggcgcgtggtgcgggtttcggcggcggctgaggaagaagcgcgggcggcgccttcgggaggcgagcaggcagcagttggccgtgccgtagcagcgtcccgcgcgcggcgggcagcggcccaggaggcgcgtggcggcgctcggcctcgcggcggcggcggcggcagcggcccagcagttggcggcgagcgcgtctgcgcctgcgcggcgggccccgcgcccctcctccccccctgggcgcccccggcggcgtgtgaatggcggcctccgcggcggcagcctcggcagcagcggcctcggccgcctctggcagcccgggcccgggcgagggctccgctggcggcgaaaagcgctccaccgccccttcggccgcagcctcggcctctgcctcagccgcggcgtcgtcgcccgcggggggcggcgccgaggcgctggagctgctggagcactgcggcgtgtgcagagagcgcctgcgacccgagagggagccccgcctgctgccctgtttgcactcggcctgtagtgcctgcttagggcccgcggcccccgccgccgccaacagctcgggggacggcggggcggcgggcgacggcaccgtggtggactgtcccgtgtgcaagcaacagtgcttctccaaagacatcgtggagaattatttcatgcgtgatagtggcagcaaggctgccaccgacgcccaggatgcgaaccagtgctgcactagctgtgaggataatgccccagccaccagctactgtgtggagtgctcggagcctctgtgtgagacctgtgtagaggcgcaccagcgggtgaagtacaccaaggaccatactgtgcgctctactgggccagccaagtctcgggatggtgaacgtactgtctattgcaacgtacacaagcatgaaccccttgtgctgttttgtgagagctgtgatactctcacctgccgagactgccagctcaatgcccacaaggaccaccagtaccagttcttagaggatgcagtgaggaaccagcgcaagctcctggcctcactggtgaagcgccttggggacaaacatgcaacattgcagaagagcaccaaggaggttcgcagctcaatccgccaggtgtctgacgtacagaagcgtgtgcaagtggatgtcaagatggccatcctgcagatcatgaaggagctgaataagcggggccgtgtgctggtcaatgatgcccagaaggtgactgaggggcagcaggagcgcctggagcggcagcactggaccatgaccaagatccagaagcaccaggagcacattctgcgctttgcctcttgggctctggagagtgacaacaacacagcccttttgctttctaagaagttgatctacttccagctgcaccgggccctcaagatgattgtggatcccgtggagccacatggcgagatgaagtttcagtgggacctcaatgcctggaccaagagtgccgaggcctttggcaagattgtggcagagcgtcctggcactaactcaacaggccctgcacccatggcccctccaagagccccaggcccctgagcaagcagggctctggcagcagccagcccatggaggtgcaggaaggctatggctttgggtcaggagatgatccctactcaagtgcagagccccatgtgtcaggtgtgaaacggtcccgctcaggtgagggcgaggtgagcggccttatgcgcaaggtgccacgagtgagccttgaacgcctggacctggacctcacagctgacagccagccacccgtcttcaaggtcttcccaggcagtaccactgaggactacaaccttattgttattgaacgtggcgctgccgctgcagctaccggccagccagggactgcgcctgcaggaacccctggtgccccacccctggctggcatggccattgtcaaggaggaggagacggaggctgccattggagcccctcctactgccactgagggccctgagaccaaacctgtgcttatggctcttgcggagggtcctggtgctgagggtccccgcctggcctcacctagtggcagcaccagctcagggctggaggtggtggctcctgagggtacctcagccccaggtggtggcccgggaaccctggatgacagtgccaccatttgccgtgtctgccagaagccaggcgatctggttatgtgcaaccagtgtgagttttgtttccacctggactgtcacctgccggccctgcaggatgtaccaggggaggagtggagctgctcactctgccatgtgctccctgacctgaaggaggaggatggcagcctcagcctggatggtgcagacagcactggcgtggtggccaagctctcaccagccaaccagcggggtgagggctggggttacttaggtggggttgcccagagaggctttataggtgctgcccagagctgtgacatcccttacaatgtttgtagaaatgtgagcgtgtactgctggccctattctgtcacgaaccctgccgccccctgcatcagctggctaccgactccaccttctccctggaccagcccggtggcaccctggatctgaccctgatccgtgcccgcctccaggagaagttgtcacctccctacagctccccacaggagtttgcccaggatgtgggccgcatgttcaagcaattcaacaagttaactgaggacaaggcagacgtgcagtccatcatcggcctgcagcgcttcttcgagacgcgcatgaacgaggccttcggtgacaccaagttctctgctgtgctggtggagcccccgccgatgagcctgcctggtgctggcctgagttcccaggagctgtctggtggccctggtgatggcccctgaggctggagcccccatggccagcccagcctggctctgttctctgtcctgtcaccccatccccactcccctggtggcctgactcccactccctggtggccccatcccccagttcctcacgatatggtttttacttctgtggatttaataaaaacttcaccagtt

SEQ ID NO: 104179 - DNA, 3427 bp, Homo sapiens
cggcggcgaagagacgcgggttgaggaagagggacggattgcccatgcgcttgggcgcacagcggcccgcttctgtgtggtctggaggtggagctgagaggggaatcacactctataaaggttcgcataccccactggcggattcaattgcggcagtgacgtcacagaggccccgccccgcccccacaagagccccaccgacgtggggttggcggtggtggaaggactaggagttggcgcgtgcgtactggcggcctctcccgcaccgaccggcctgggccccgcccccgggcgtgaggcgcccaatgcgcgtgcgcggcggcgtcggcgccagttatttctgtcccgccccccggcctcggctctttctgcgagcgggcgcgcgggcgagcggttgtgcttgtgcttgtggcgcgtggtgcgggtttcggcggcggctgaggaagaagcgcgggcggcgccttcgggaggcgagcaggcagcagttggccgtgccgtagcagcgtcccgcgcgcggcgggcagcggcccaggaggcgcgtggcggcgctcggcctcgcggcggcggcggcggcagcggcccagcagttggcggcgagcgcgtctgcgcctgcgcggcgggccccgcgcccctcctccccccctgggcgcccccggcggcgtgtgaatggcggcctccgcggcggcagcctcggcagcagcggcctcggccgcctctggcagcccgggcccgggcgagggctccgctggcggcgaaaagcgctccaccgccccttcggccgcagcctcggcctctgcctcagccgcggcgtcgtcgcccgcggggggcggcgccgaggcgctggagctgctggagcactgcggcgtgtgcagagagcgcctgcgacccgagagggagccccgcctgctgccctgtttgcactcggcctgtagtgcctgcttagggcccgcggcccccgccgccgccaacagctcgggggacggcggggcggcgggcgacggcaccgtggtggactgtcccgtgtgcaagcaacagtgcttctccaaagacatcgtggagaattatttcatgcgtgatagtggcagcaaggctgccaccgacgcccaggatgcgaaccagtgctgcactagctgtgaggataatgccccagccaccagctactgtgtggagtgctcggagcctctgtgtgagacctgtgtagaggcgcaccagcgggtgaagtacaccaaggaccatactgtgcgctctactgggccagccaagtctcgggatggtgaacgtactgtctattgcaacgtacacaagcatgaaccccttgtgctgttttgtgagagctgtgatactctcacctgccgagactgccagctcaatgcccacaaggaccaccagtaccagttcttagaggatgcagtgaggaaccagcgcaagctcctggcctcactggtgaagcgccttggggacaaacatgcaacattgcagaagagcaccaaggaggttcgcagctcaatccgccaggtgtctgacgtacagaagcgtgtgcaagtggatgtcaagatggccatcctgcagatcatgaaggagctgaataagcggggccgtgtgctggtcaatgatgcccagaaggtgactgaggggcagcaggagcgcctggagcggcagcactggaccatgaccaagatccagaagcaccaggagcacattctgcgctttgcctcttgggctctggagagtgacaacaacacagcccttttgctttctaagaagttgatctacttccagctgcaccgggccctcaagatgattgtggatcccgtggagccacatggcgagatgaagtttcagtgggacctcaatgcctggaccaagagtgccgaggcctttggcaagattgtggcagagcgtcctggcactaactcaacaggccctgcacccatggcccctccaagagccccaggcccctgagcaagcagggctctggcagcagccagcccatggaggtgcaggaaggctatggctttgggtcaggagatgatccctactcaagtgcagagccccatgtgtcaggtgtgaaacggtcccgctcaggtgagggcgaggtgagcggccttatgcgcaaggtgccacgagtgagccttgaacgcctggacctggacctcacagctgacagccagccacccgtcttcaaggtcttcccaggcagtaccactgaggactacaaccttattgttattgaacgtggcgctgccgctgcagctaccggccagccagggactgcgcctgcaggaacccctggtgccccacccctggctggcatggccattgtcaaggaggaggagacggaggctgccattggagcccctcctactgccactgagggccctgagaccaaacctgtgcttatggctcttgcggagggtcctggtgctgagggtccccgcctggcctcacctagtggcagcaccagctcagggctggaggtggtggctcctgagggtacctcagccccaggtggtggcccgggaaccctggatgacagtgccaccatttgccgtgtctgccagaagccaggcgatctggttatgtgcaaccagtgtgagttttgtttccacctggactgtcacctgccggccctgcaggatgtaccaggggaggagtggagctgctcactctgccatgtgctccctgacctgaaggaggaggatggcagcctcagcctggatggtgcagacagcactggcgtggtggccaagctctcaccagccaaccagcggaaatgtgagcgtgtactgctggccctattctgtcacgaaccctgccgccccctgcatcagctggctaccgactccaccttctccctggaccagcccggtggcaccctggatctgaccctgatccgtgcccgcctccaggagaagttgtcacctccctacagctccccacaggagtttgcccaggatgtgggccgcatgttcaagcaattcaacaagttaactgaggtgagccagtggaatggagaggctgtgggcagggggagatgtgaaggaaagaactaggacccattcatccactgcattcctgcttggcccaggacaaggcagacgtgcagtccatcatcggcctgcagcgcttcttcgagacgcgcatgaacgaggccttcggtgacaccaagttctctgctgtgctggtggagcccccgccgatgagcctgcctggtgctggcctgagttcccaggagctgtctggtggccctggtgatggcccctgaggctggagcccccatggccagcccagcctggctctgttctctgtcctgtcaccccatccccactcccctggtggcctgactcccactccctggtggccccatcccccagttcctcacgatatggtttttacttctgtggatttaataaaaacttcaccagtt

SEQ ID NO: 104180 - DNA, 1597 bp, Homo sapiens
aaaattacggctaggtacgaggcctggtgatctacttccagctgcaccgggccctcaagatgattgtggatcccgtggagccacatggcgagatgaagtttcagtgggacctcaatgcctggaccaagagtgccgaggcctttggcaagattgtggcagagcgtcctggcactaactcaacaggccctgcacccatggcccctccaagagccccaggcccctgagcaagcagggctctggcagcagccagcccatggaggtgcaggaaggctatggctttgggtcaggagatgatccctactcaagtgcagagccccatgtgtcaggtgtgaaacggtcccgctcaggtgagggcgaggtgagcggccttatgcgcaaggtgccacgagtgagccttgaacgcctggacctggacctcacagctgacagccagccacccgtcttcaaggtcttcccaggcagtaccactgaggactacaaccttattgttattgaacgtggcgctgccgctgcagctaccggccagccagggactgcgcctgcaggaacccctggtgccccacccctggctggcatggccattgtcaaggaggaggagacggaggctgccattggagcccctcctactgccactgagggccctgagaccaaacctgtgcttatggctcttgcggagggtcctggtgctgagggtccccgcctggcctcacctagtggcagcaccagctcagggctggaggtggtggctcctgagggtacctcagccccaggtggtggcccgggaaccctggatgacagtgccaccatttgccgtgtctgccagaagccaggcgatctggttatgtgcaaccagtgtgagttttgtttccacctggactgtcacctgccggccctgcaggatgtaccaggggaggagtggagctgctcactctgccatgtgctccctgacctgaaggaggaggatggcagcctcagcctggatggtgcagacagcactggcgtggtggccaagctctcaccagccaaccagcggaaatgtgagcgtgtactgctggccctattctgtcacgaaccctgccgccccctgcatcagctggctaccgactccaccttctccctggaccagcccggtggcaccctggatctgaccctgatccgtgcccgcctccaggagaagttgtcacctccctacagctccccacaggagtttgcccaggatgtgggccgcatgttcaagcaattcaacaagttaactgaggacaaggcagacgtgcagtccatcatcggcctgcagcgcttcttcgagacgcgcatgaacgaggccttcggtgacaccaagttctctgctgtgctggtggagcccccgccgatgagcctgcctggtgctggcctgagttcccaggagctgtctggtggccctggtgatggcccctgaggctggagcccccatggccagcccagcctggctctgttctctgtcctgtcaccccatccccactcccctggtggcctgactcccactccctggtggccccatcccccagttcctcacgatatggtttttacttctgtggatttaataaaaacttcaccagtt

SEQ ID NO: 104181 - DNA, 3514 bp, Homo sapiens
  misc_feature (2177)..(2177): n is a, c, g, or t
  misc_feature (2208)..(2208): n is a, c, g, or t
  misc_feature (2218)..(2218): n is a, c, g, or t
  misc_feature (2224)..(2224): n is a, c, g, or t
  misc_feature (2241)..(2241): n is a, c, g, or t
  misc_feature (2243)..(2243): n is a, c, g, or t
  misc_feature (2247)..(2247): n is a, c, g, or t
  misc_feature (2360)..(2360): n is a, c, g, or t
cggcggcgaagagacgcgggttgaggaagagggacggattgcccatgcgcttgggcgcacagcggcccgcttctgtgtggtctggaggtggagctgagaggggaatcacactctataaaggttcgcataccccactggcggattcaattgcggcagtgacgtcacagaggccccgccccgcccccacaagagccccaccgacgtggggttggcggtggtggaaggactaggagttggcgcgtgcgtactggcggcctctcccgcaccgaccggcctgggccccgcccccgggcgtgaggcgcccaatgcgcgtgcgcggcggcgtcggcgccagttatttctgtcccgccccccggcctcggctctttctgcgagcgggcgcgcgggcgagcggttgtgcttgtgcttgtggcgcgtggtgcgggtttcggcggcggctgaggaagaagcgcgggcggcgccttcgggaggcgagcaggcagcagttggccgtgccgtagcagcgtcccgcgcgcggcgggcagcggcccaggaggcgcgtggcggcgctcggcctcgcggcggcggcggcggcagcggcccagcagttggcggcgagcgcgtctgcgcctgcgcggcgggccccgcgcccctcctccccccctgggcgcccccggcggcgtgtgaatggcggcctccgcggcggcagcctcggcagcagcggcctcggccgcctctggcagcccgggcccgggcgagggctccgctggcggcgaaaagcgctccaccgccccttcggccgcagcctcggcctctgcctcagccgcggcgtcgtcgcccgcggggggcggcgccgaggcgctggagctgctggagcactgcggcgtgtgcagagagcgcctgcgacccgagagggagccccgcctgctgccctgtttgcactcggcctgtagtgcctgcttagggcccgcggcccccgccgccgccaacagctcgggggacggcggggcggcgggcgacggcaccgtggtggactgtcccgtgtgcaagcaacagtgcttctccaaagacatcgtggagaattatttcatgcgtgatagtggcagcaaggctgccaccgacgcccaggatgcgaaccagtgctgcactagctgtgaggataatgccccagccaccagctactgtgtggagtgctcggagcctctgtgtgagacctgtgtagaggcgcaccagcgggtgaagtacaccaaggaccatactgtgcgctctactgggccagccaagtctcgggatggtgaacgtactgtctattgcaacgtacacaagcatgaaccccttgtgctgttttgtgagagctgtgatactctcacctgccgagactgccagctcaatgcccacaaggaccaccagtaccagttcttagaggatgcagtgaggaaccagcgcaagctcctggcctcactggtgaagcgccttggggacaaacatgcaacattgcagaagagcaccaaggaggttcgcagctcaatccgccaggtgtctgacgtacagaagcgtgtgcaagtggatgtcaagatggccatcctgcagatcatgaaggagctgaataagcggggccgtgtgctggtcaatgatgcccagaaggtgactgaggggcagcaggagcgcctggagcggcagcactggaccatgaccaagatccagaagcaccaggagcacattctgcgctttgcctcttgggctctggagagtgacaacaacacagcccttttgctttctaagaagttgatctacttccagctgcaccgggccctcaagatgattgtggatcccgtggagccacatggcgagatgaagtttcagtgggacctcaatgcctggaccaagagtgccgaggcctttggcaagattgtggcagagcgtcctggcactaactcaacaggccctgcacccatggcccctccaagagccccaggcccctgagcaagcagggctctggcagcagccagcccatggaggtgcaggaaggctatggctttgggtcaggagatgatccctactcaagtgcagagccccatgtgtcaggtgtgaaacggtcccgctcaggtgagggcgaggtgagcggccttatgcgcaaggtgccacgagtgagccttgaacgcctgagcgccctgcgtaccatggcaccgctcacaatncttatgacaatgccaccaggcctccatcacncagttccatntccganacgcgcgtcatttcccncnaagngtccatgctaacccaatccttgaatgcgtatcttaaccataactcgtataacttcgcttcatttgaaactgattggcagcctgcccgtcgttgccaaagcttatcctgagccnctaaggcgccacatgtgcgaatcatttgtcctgactcttttgtcaagggggaaaacccctcccctttgggttaggtccaccccccaaagccccgcccccagttggtggcctttgtggccaatttgtgcccactttgtcaaaggacggaggaggagacggaggctgccattggagcccctcctactgccactgagggccctgagaccaaacctgtgcttatggctcttgcggagggtcctggtgctgagggtccccgcctggcctcacctagtggcagcaccagctcagggctggaggtggtggctcctgagggtacctcagccccaggtggtggcccgggaaccctggatgacagtgccaccatttgccgtgtctgccagaagccaggcgatctggttatgtgcaaccagtgtgagttttgtttccacctggactgtcacctgccggccctgcaggatgtaccaggggaggagtggagctgctcactctgccatgtgctccctgacctgaaggaggaggatggcagcctcagcctggatggtgcagacagcactggcgtggtggccaagctctcaccagccaaccagcggaaatgtgagcgtgtactgctggccctattctgtcacgaaccctgccgccccctgcatcagctggctaccgactccaccttctccctggaccagcccggtggcaccctggatctgaccctgatccgtgcccgcctccaggagaagttgtcacctccctacagctccccacaggagtttgcccaggatgtgggccgcatgttcaagcaattcaacaagttaactgaggacaaggcagacgtgcagtccatcatcggcctgcagcgcttcttcgagacgcgcatgaacgaggccttcggtgacaccaagttctctgctgtgctggtggagcccccgccgatgagcctgcctggtgctggcctgagttcccaggagctgtctggtggccctggtgatggcccctgaggctggagcccccatggccagcccagcctggctctgttctctgtcctgtcaccccatccccactcccctggtggcctgactcccactccctggtggccccatcccccagttcctcacgatatggtttttacttctgtggatttaataaaaacttcaccagtt

SEQ ID NO: 104182 - DNA, 3629 bp, Homo sapiens
  misc_feature (2999)..(2999): n is a, c, g, or t
  misc_feature (3063)..(3063): n is a, c, g, or t
  misc_feature (3080)..(3080): n is a, c, g, or t
  misc_feature (3096)..(3096): n is a, c, g, or t
  misc_feature (3514)..(3514): n is a, c, g, or t
  misc_feature (3519)..(3519): n is a, c, g, or t
cggcggcgaagagacgcgggttgaggaagagggacggattgcccatgcgcttgggcgcacagcggcccgcttctgtgtggtctggaggtggagctgagaggggaatcacactctataaaggttcgcataccccactggcggattcaattgcggcagtgacgtcacagaggccccgccccgcccccacaagagccccaccgacgtggggttggcggtggtggaaggactaggagttggcgcgtgcgtactggcggcctctcccgcaccgaccggcctgggccccgcccccgggcgtgaggcgcccaatgcgcgtgcgcggcggcgtcggcgccagttatttctgtcccgccccccggcctcggctctttctgcgagcgggcgcgcgggcgagcggttgtgcttgtgcttgtggcgcgtggtgcgggtttcggcggcggctgaggaagaagcgcgggcggcgccttcgggaggcgagcaggcagcagttggccgtgccgtagcagcgtcccgcgcgcggcgggcagcggcccaggaggcgcgtggcggcgctcggcctcgcggcggcggcggcggcagcggcccagcagttggcggcgagcgcgtctgcgcctgcgcggcgggccccgcgcccctcctccccccctgggcgcccccggcggcgtgtgaatggcggcctccgcggcggcagcctcggcagcagcggcctcggccgcctctggcagcccgggcccgggcgagggctccgctggcggcgaaaagcgctccaccgccccttcggccgcagcctcggcctctgcctcagccgcggcgtcgtcgcccgcggggggcggcgccgaggcgctggagctgctggagcactgcggcgtgtgcagagagcgcctgcgacccgagagggagccccgcctgctgccctgtttgcactcggcctgtagtgcctgcttagggcccgcggcccccgccgccgccaacagctcgggggacggcggggcggcgggcgacggcaccgtggtggactgtcccgtgtgcaagcaacagtgcttctccaaagacatcgtggagaattatttcatgcgtgatagtggcagcaaggctgccaccgacgcccaggatgcgaaccagtgctgcactagctgtgaggataatgccccagccaccagctactgtgtggagtgctcggagcctctgtgtgagacctgtgtagaggcgcaccagcgggtgaagtacaccaaggaccatactgtgcgctctactgggccagccaagtctcgggatggtgaacgtactgtctattgcaacgtacacaagcatgaaccccttgtgctgttttgtgagagctgtgatactctcacctgccgagactgccagctcaatgcccacaaggaccaccagtaccagttcttagaggatgcagtgaggaaccagcgcaagctcctggcctcactggtgaagcgccttggggacaaacatgcaacattgcagaagagcaccaaggaggttcgcagctcaatccgccaggtgtctgacgtacagaagcgtgtgcaagtggatgtcaagatggccatcctgcagatcatgaaggagctgaataagcggggccgtgtgctggtcaatgatgcccagaaggtgactgaggggcagcaggagcgcctggagcggcagcactggaccatgaccaagatccagaagcaccaggagcacattctgcgctttgcctcttgggctctggagagtgacaacaacacagcccttttgctttctaagaagttgatctacttccagctgcaccgggccctcaagatgattgtggatcccgtggagccacatggcgagatgaagtttcagtgggacctcaatgcctggaccaagagtgccgaggcctttggcaagattgtggcagagcgtcctggcactaactcaacaggccctgcacccatggcccctccaagagccccaggcccctgagcaagcagggctctggcagcagccagcccatggaggtgcaggaaggctatggctttgggtcaggagatgatccctactcaagtgcagagccccatgtgtcaggtgtgaaacggtcccgctcaggtgagggcgaggtgagcggccttatgcgcaaggtgccacgagtgagccttgaacgcctggacctggacctcacagctgacagccagccacccgtcttcaaggtcttcccaggcagtaccactgaggactacaaccttattgttattgaacgtggcgctgccgctgcagctaccggccagccagggactgcgcctgcaggaacccctggtgccccacccctggctggcatggccattgtcaaggaggaggagacggaggctgccattggagcccctcctactgccactgagggccctgagaccaaacctgtgcttatggctcttgcggagggtcctggtgctgagggtccccgcctggcctcacctagtggcagcaccagctcagggctggaggtggtggctcctgagggtacctcagccccaggtggtggcccgggaaccctggatgacagtgccaccatttgccgtgtctgccagaagccaggcgatctggttatgtgcaaccagtgtgagttttgtttccacctggactgtcacctgccggccctgcaggatgtaccaggggaggagtggagctgctcactctgccatgtgctccctgacctgaaggaggaggatggcagcctcagcctggatggtgcagacagcactggcgtggtggccaagctctcaccagccaaccagcggaaatgtgagcgtgtactgctggccctattctgtcacgaaccctgccgccccctgcatcagctggctaccgactccaccttctccctggaccagcccggtggcaccctggatctgaccctgatccgtgcccgcctccaggagaagttgtcacctccctacagctccccacaggagtttgcccaggatgtgggccgcatgttcaagcaattcaacaagttaactgagaanggggggaaaaaaaacccaaaagggccccaagacgtgcagtccatcatcggcctcgcacgcgctntcttttcccgggaaggnaacgggccggcccaantttggaaaaaccccggggaaaacggggggggggccccccccccttttttttccggcagagcgcgtgaggaacccccaaaccccgccccaaagaagagggcagcgttttcctttcccggctttttcccccaccgttttgggagggccccccccacattttttgtggggggctatttgtgggggcgcccccacctttttggcgggcgcgcgcgcgcgacttttgaggggcggggggcaaaaaacacgggggccgcctctcccccactaccagacacccctgacacccgtggggggtggacaccccacatgccccccaggggggggcacaccaaccactttttggggggcaacacaagaggggaccccgccccccctgggttgtggggcccccaacccccccctcctttttgtgggggcgngggancccttatgtgggggacgcccactttttggtggggggggggtaccccctcccaccctgcttttttgggggcgaaaaaccggggcgagctttttttttttttccccacaccg

SEQ ID NO: 104183 - DNA, 2918 bp, Homo sapiens
cggcggcgaagagacgcgggttgaggaagagggacggattgcccatgcgcttgggcgcacagcggcccgcttctgtgtggtctggaggtggagctgagaggggaatcacactctataaaggttcgcataccccactggcggattcaattgcggcagtgacgtcacagaggccccgccccgcccccacaagagccccaccgacgtggggttggcggtggtggaaggactaggagttggcgcgtgcgtactggcggcctctcccgcaccgaccggcctgggccccgcccccgggcgtgaggcgcccaatgcgcgtgcgcggcggcgtcggcgccagttatttctgtcccgccccccggcctcggctctttctgcgagcgggcgcgcgggcgagcggttgtgcttgtgcttgtggcgcgtggtgcgggtttcggcggcggctgaggaagaagcgcgggcggcgccttcgggaggcgagcaggcagcagttggccgtgccgtagcagcgtcccgcgcgcggcgggcagcggcccaggaggcgcgtggcggcgctcggcctcgcggcggcggcggcggcagcggcccagcagttggcggcgagcgcgtctgcgcctgcgcggcgggccccgcgcccctcctccccccctgggcgcccccggcggcgtgtgaatggcggcctccgcggcggcagcctcggcagcagcggcctcggccgcctctggcagcccgggcccgggcgagggctccgctggcggcgaaaagcgctccaccgccccttcggccgcagcctcggcctctgcctcagccgcggcgtcgtcgcccgcggggggcggcgccgaggcgctggagctgctggagcactgcggcgtgtgcagagagcgcctgcgacccgagagggagccccgcctgctgccctgtttgcactcggcctgtagtgcctgcttagggcccgcggcccccgccgccgccaacagctcgggggacggcggggcggcgggcgacggcaccgtggtggactgtcccgtgtgcaagcaacagtgcttctccaaagacatcgtggagaattatttcatgcgtgatagtggcagcaaggctgccaccgacgcccaggatgcgaaccagtgctgcactagctgtgaggataatgccccagccaccagctactgtgtggagtgctcggagcctctgtgtgagacctgtgtagaggcgcaccagcgggtgaagtacaccaaggaccatactgtgcgctctactgggccagccaagtctcgggatggtgaacgtactgtctattgcaacgtacacaagcatgaaccccttgtgctgttttgtgagagctgtgatactctcacctgccgagactgccagctcaatgcccacaaggaccaccagtaccagttcttagaggatgcagtgaggaaccagcgcaagctcctggcctcactggtgaagcgccttggggacaaacatgcaacattgcagaagagcaccaaggaggttcgcagctcaatccgccaggtgtctgacgtacagaagcgtgtgcaagtggatgtcaagatggccatcctgcagatcatgaaggagctgaataagcggggccgtgtgctggtcaatgatgcccagaaggtgactgaggggcagcaggagcgcctggagcggcagcactggaccatgaccaagatccagaagcaccaggagcacattctgcgctttgcctcttgggctctggagagtgacaacaacacagcccttttgctttctaagaagttgatctacttccagctgcaccgggccctcaagatgattgtggatcccgtggagccacatggcgagatgaagtttcagtgggacctcaatgcctggaccaagagtgccgaggcctttggcaagattgtggcagagcgtcctggcactaactcaacaggccctgcacccatggcccctccaagagccccaggcccctgagcaagcagggctctggcagcagccagcccatggaggtgcaggaaggctatggctttgggtcaggagatgatccctactcaagtgcagagccccatgtgtcaggtgtgaaacggtcccgctcaggtgagggcgaggtgagcggccttatgcgcaaggtgccacgagtgagccttgaacgcctggacctggacctcacagctgacagccagccacccgtcttcaaggtcttcccaggcagtaccactgaggactacaaccttattgttattgaacgtggcgctgccgctgcagctaccggccagccagggactgcgcctgcaggaacccctggtgccccacccctggctggcatggccattgtcaaggaggaggagacggaggctgccattggagcccctcctactgccactgagggccctgagaccaaacctgtgcttatggctcttgcggagggtcctggtgctgagggtccccgcctggcctcacctagtggcagcaccagctcagggctggaggtggtggctcctgagggtacctcagccccaggtggtggcccgggaaccctggatgacagtgccaccatttgccgtgtctgccagaagccaggcgatctggttatgtgcaaccagtgtgagttttgtttccacctggactgtcacctgccggccctgcaggatgtaccaggggaggagtggagctgctcactctgccatgtgctccctgacctgaaggaggaggatggcagcctcagcctggatggtgcagacagcactggcgtggtggccaagctctcaccagccaaccagcggaaatgtgagcgtgtactgctggccctattctgtcacgaaccctgccgccccctgcatcagctgactcccactccctggtggccccatcccccagttcctcacgatatggtttttacttctgtggatttaataaaaacttcaccagtt

SEQ ID NO: 104184 - DNA, 3416 bp, Homo sapiens
cggcggcgaagagacgcgggttgaggaagagggacggattgcccatgcgcttgggcgcacagcggcccgcttctgtgtggtctggaggtggagctgagaggggaatcacactctataaaggttcgcataccccactggcggattcaattgcggcagtgacgtcacagaggccccgccccgcccccacaagagccccaccgacgtggggttggcggtggtggaaggactaggagttggcgcgtgcgtactggcggcctctcccgcaccgaccggcctgggccccgcccccgggcgtgaggcgcccaatgcgcgtgcgcggcggcgtcggcgccagttatttctgtcccgccccccggcctcggctctttctgcgagcgggcgcgcgggcgagcggttgtgcttgtgcttgtggcgcgtggtgcgggtttcggcggcggctgaggaagaagcgcgggcggcgccttcgggaggcgagcaggcagcagttggccgtgccgtagcagcgtcccgcgcgcggcgggcagcggcccaggaggcgcgtggcggcgctcggcctcgcggcggcggcggcggcagcggcccagcagttggcggcgagcgcgtctgcgcctgcgcggcgggccccgcgcccctcctccccccctgggcgcccccggcggcgtgtgaatggcggcctccgcggcggcagcctcggcagcagcggcctcggccgcctctggcagcccgggcccgggcgagggctccgctggcggcgaaaagcgctccaccgccccttcggccgcagcctcggcctctgcctcagccgcggcgtcgtcgcccgcggggggcggcgccgaggcgctggagctgctggagcactgcggcgtgtgcagagagcgcctgcgacccgagagggagccccgcctgctgccctgtttgcactcggcctgtagtgcctgcttagggcccgcggcccccgccgccgccaacagctcgggggacggcggggcggcgggcgacggcaccgtggtggactgtcccgtgtgcaagcaacagtgcttctccaaagacatcgtggagaattatttcatgcgtgatagtggcagcaaggctgccaccgacgcccaggatgcgaaccagtgctgcactagctgtgaggataatgccccagccaccagctactgtgtggagtgctcggagcctctgtgtgagacctgtgtagaggcgcaccagcgggtgaagtacaccaaggaccatactgtgcgctctactgggccagccaagtctcgggatggtgaacgtactgtctattgcaacgtacacaagcatgaaccccttgtgctgttttgtgagagctgtgatactctcacctgccgagactgccagctcaatgcccacaaggaccaccagtaccagttcttagaggatgcagtgaggaaccagcgcaagctcctggcctcactggtgaagcgccttggggacaaacatgcaacattgcagaagagcaccaaggaggttcgcagctcaatccgccaggtgtctgacgtacagaagcgtgtgcaagtggatgtcaagatggccatcctgcagatcatgaaggagctgaataagcggggccgtgtgctggtcaatgatgcccagcagcaaggtgcactgcaggggcagccaggcagcgcacatggagcaggcagacaacatggacccatgaccaaagatccaagaagcaacacaggaggacaacaattcgtgcagctatagcctcattggagcatctggagacgtgacaacaaccacagcccatatttgactattctcacagaagttgatctacttccagacatgccaccggagacctcaagcatgcattgtcggcatcccgtggcagccacatggcgagatgacagtatccagaagggaccatcaatgcctggcaccaaagaagtagccgaaggactatacggcgaacgcaaagatggcaagcgcagtccctgagcaataaactccaagcagagcccatgagagcgcaatggaaccactccaaagcagcccccagggaccccagaagcaaagcagggctctggcagcagccagcccatggaggtgcaggaaggctatggcttgggtcaggagatgatccctactcaagtgcagagccccatgtgtcaggtgtgaaacggtcccgctcaggtgagggcgaggtgagcggccttatgcgcaaggtgccacgagtgagccttgaacgcctggacctggacctcacagctgacagccagccacccgtcttcaaggtcttcccaggcagtaccactgaggactacaaccttattgttattgaacgtggcgctgccgctgcagctaccggccagccagggactgcgcctgcaggaacccctggtgccccacccctggctggcatggccattgtcaaggaggaggagacggaggctgccattggagcccctcctactgccactgagggccctgagaccaaacctgtgcttatggctcttgcggagggtcctggtgctgagggtccccgcctggcctcacctagtggcagcaccagctcagggctggaggtggtggctcctgagggtacctcagccccaggtggtggcccgggaaccctggatgacagtgccaccatttgccgtgtctgccagaagccaggcgatctggttatgtgcaaccagtgtgagttttgtttccacctggactgtcacctgccggccctgcaggatgtaccaggggaggagtggagctgctcactctgccatgtgctccctgacctgaaggaggaggatggcagcctcagcctggatggtgcagacagcactggcgtggtggccaagctctcaccagccaaccagcggaaatgtgagcgtgtactgctggccctattctgtcacgaaccctgccgccccctgcatcagctggctaccgactccaccttctccctggaccagcccggtggcaccctggatctgaccctgatccgtgcccgcctccaggagaagttgtcacctccctacagctccccacaggagtttgcccaggatgtgggccgcatgttcaagcaattcaacaagttaactgaggacaaggcagacgtgcagtccatcatcggcctgcagcgcttcttcgagacgcgcatgaacgaggccttcggtgacaccaagttctctgctgtgctggtggagcccccgccgatgagcctgcctggtgctggcctgagttcccaggagctgtctggtggccctggtgatggcccctgaggctggagcccccatggccagcccagcctggctctgttctctgtcctgtcaccccatccccactcccctggtggcctgactcccactccctggtggccccatcccccagttcctcacgatatggtttttacttctgtggatttaataaaaacttcaccagtt

SEQ ID NO: 104185 - DNA, 3008 bp, Homo sapiens
cggcggcgaagagacgcgggttgaggaagagggacggattgcccatgcgcttgggcgcacagcggcccgcttctgtgtggtctggaggtggagctgagaggggaatcacactctataaaggttcgcataccccactggcggattcaattgcggcagtgacgtcacagaggccccgccccgcccccacaagagccccaccgacgtggggttggcggtggtggaaggactaggagttggcgcgtgcgtactggcggcctctcccgcaccgaccggcctgggccccgcccccgggcgtgaggcgcccaatgcgcgtgcgcggcggcgtcggcgccagttatttctgtcccgccccccggcctcggctctttctgcgagcgggcgcgcgggcgagcggttgtgcttgtgcttgtggcgcgtggtgcgggtttcggcggcggctgaggaagaagcgcgggcggcgccttcgggaggcgagcaggcagcagttggccgtgccgtagcagcgtcccgcgcgcggcgggcagcggcccaggaggcgcgtggcggcgctcggcctcgcggcggcggcggcggcagcggcccagcagttggcggcgagcgcgtctgcgcctgcgcggcgggccccgcgcccctcctccccccctgggcgcccccggcggcgtgtgaatggcggcctccgcggcggcagcctcggcagcagcggcctcggccgcctctggcagcccgggcccgggcgagggctccgctggcggcgaaaagcgctccaccgccccttcggccgcagcctcggcctctgcctcagccgcggcgtcgtcgcccgcggggggcggcgccgaggcgctggagctgctggagcactgcggcgtgtgcagagagcgcctgcgacccgagagggagccccgcctgctgccctgtttgcactcggcctgtagtgcctgcttagggcccgcggcccccgccgccgccaacagctcgggggacggcggggcggcgggcgacggcaccgtggtggactgtcccgtgtgcaagcaacagtgcttctccaaagacatcgtggagaattatttcatgcgtgatagtggcagcaaggctgccaccgacgcccaggatgcgaaccagtgctgcactagctgtgaggataatgccccagccaccagctactgtgtggagtgctcggagcctctgtgtgagacctgtgtagaggcgcaccagcgggtgaagtacaccaaggaccatactgtgcgctctactgggccagccaagtctcgggatggtgaacgtactgtctattgcaacgtacacaagcatgaaccccttgtgctgttttgtgagagctgtgatactctcacctgccgagactgccagctcaatgcccacaaggaccaccagtaccagttcttagaggatgcagtgaggaaccagcgcaagctcctggcctcactggtgaagcgccttggggacaaacatgcaacattgcagaagagcaccaaggaggttcgcagctcaatccgccaggtgtctgacgtacagaagcgtgtgcaagtggatgtcaagatggccatcctgcagatcatgaaggagctgaataagcggggccgtgtgctggtcaatgatgcccagaaggtgactgaggggcagcaggagcgcctggagcggcagcactggaccatgaccaagatccagaagcaccaggagcacattctgcgctttgcctcttgggctctggagagtgacaacaacacagcccttttgctttctaagaagttgatctacttccagctgcaccgggccctcaagatgattgtggatcccgtggagccacatggcgagatgaagtttcagtgggacctcaatgcctggaccaagagtgccgaggcctttggcaagattgtggcagagcgtcctggcactaactcaacaggccctgcacccatggcccctccaagagccccaggcccctgagcaagcagggctctggcagcagccagcccatggaggtgcaggaaggctatggctttgggtcaggagatgatccctactcaagtgcagagccccatgtgtcaggtgtgaaacggtcccgctcaggtgagggcgaggtgagcggccttatgcgcaaggtgccacgagtgagccttgaacgcctggacctggacctcacagctgacagccagccacccgtcttcaaggtcttcccaggcagtaccactgaggactacaaccttattgttattgaacgtggcgctgccgctgcagctaccggccagccagggactgcgcctgcaggaacccctggtgccccacccctggctggcatggccattgtcaaggaggaggagacggaggctgccattggagcccctcctactgccactgagggccctgagaccaaacctgtgcttatggctcttgcggagggtcctggtgctgagggtccccgcctggcctcacctagtggcagcaccagctcagggctggaggtggtggctcctgagggtacctcagccccaggtggtggcccgggaaccctggatgacagtgccaccatttgccgtgtctgccagaagccaggcgatctggttatgtgcaaccagtgtgagttttgtttccacctggactgtcacctgccggccctgcaggatgtaccaggggaggagtggagctgctcactctgccatgtgctccctgacctgaaggaggaggatggcagcctcagcctggatggtgcagacagcactggcgtggtggccaagctctcaccagccaaccagcggcccccgccgatgagcctgcctggtgctggcctgagttcccaggagctgtctggtggccctggtgatggcccctgaggctggagcccccatggccagcccagcctggctctgttctctgtcctgtcaccccatccccactcccctggtggcctgactcccactccctggtggccccatcccccagttcctcacgatatggtttttacttctgtggatttaataaaaacttcaccagtt

SEQ ID NO: 104186 - DNA, 2798 bp, Homo sapiens
  misc_feature (2735)..(2735): n is a, c, g, or t
  misc_feature (2739)..(2739): n is a, c, g, or t
  misc_feature (2742)..(2742): n is a, c, g, or t
  misc_feature (2745)..(2745): n is a, c, g, or t
  misc_feature (2757)..(2757): n is a, c, g, or t
  misc_feature (2764)..(2764): n is a, c, g, or t
cggcggcgaagagacgcgggttgaggaagagggacggattgcccatgcgcttgggcgcacagcggcccgcttctgtgtggtctggaggtggagctgagaggggaatcacactctataaaggttcgcataccccactggcggattcaattgcggcagtgacgtcacagaggccccgccccgcccccacaagagccccaccgacgtggggttggcggtggtggaaggactaggagttggcgcgtgcgtactggcggcctctcccgcaccgaccggcctgggccccgcccccgggcgtgaggcgcccaatgcgcgtgcgcggcggcgtcggcgccagttatttctgtcccgccccccggcctcggctctttctgcgagcgggcgcgcgggcgagcggttgtgcttgtgcttgtggcgcgtggtgcgggtttcggcggcggctgaggaagaagcgcgggcggcgccttcgggaggcgagcaggcagcagttggccgtgccgtagcagcgtcccgcgcgcggcgggcagcggcccaggaggcgcgtggcggcgctcggcctcgcggcggcggcggcggcagcggcccagcagttggcggcgagcgcgtctgcgcctgcgcggcgggccccgcgcccctcctccccccctgggcgcccccggcggcgtgtgaatggcggcctccgcggcggcagcctcggcagcagcggcctcggccgcctctggcagcccgggcccgggcgagggctccgctggcggcgaaaagcgctccaccgccccttcggccgcagcctcggcctctgcctcagccgcggcgtcgtcgcccgcggggggcggcgccgaggcgctggagctgctggagcactgcggcgtgtgcagagagcgcctgcgacccgagagggagccccgcctgctgccctgtttgcactcggcctgtagtgcctgcttagggcccgcggcccccgccgccgccaacagctcgggggacggcggggcggcgggcgacggcaccgtggtggactgtcccgtgtgcaagcaacagtgcttctccaaagacatcgtggagaattatttcatgcgtgatagtggcagcaaggctgccaccgacgcccaggatgcgaaccagtgctgcactagctgtgaggataatgccccagccaccagctactgtgtggagtgctcggagcctctgtgtgagacctgtgtagaggcgcaccagcgggtgaagtacaccaaggaccatactgtgcgctctactgggccagccaagtctcgggatggtgaacgtactgtctattgcaacgtacacaagcatgaaccccttgtgctgttttgtgagagctgtgatactctcacctgccgagactgccagctcaatgcccacaaggaccaccagtaccagttcttagaggatgcagtgaggaaccagcgcaagctcctggcctcactggtgaagcgccttggggacaaacatgcaacattgcagaagagcaccaaggaggttcgcagctcaatccgccaggtgtctgacgtacagaagcgtgtgcaagtggatgtcaagatggccatcctgcagatcatgaaggagctgaataagcggggccgtgtgctggtcaatgatgcccagaaggtgactgaggggcagcaggagcgcctggagcggcagcactggaccatgaccaagatccagaagcaccaggagcacattctgcgctttgcctcttgggctctggagagtgacaacaacacagcccttttgctttctaagaagttgatctacttccagctgcaccgggccctcaagatgattgtggatcccgtggagccacatggcgagatgaagtttcagtgggacctcaatgcctggaccaagagtgccgaggcctttggcaagattgtggcagagcgtcctggcactaactcaacaggccctgcacccatggcccctccaagagccccaggcccctgagcaagcagggctctggcagcagccagcccatggaggtgcaggaaggctatggctttgggtcaggagatgatccctactcaagtgcagagccccatgtgtcaggtgtgaaacggtcccgctcaggtgagggcgaggtgagcggccttatgcgcaaggtgccacgagtgagccttgaacgcctggacctggacctcacagctgacagccagccacccgtcttcaaggtcttcccaggcagtaccactgaggactacaaccttattgttattgaacgtggcgctgccgctgcagctaccggccagccagggactgcgcctgcaggaacccctggtgccccacccctggctggcatggccattgtcaaggaggaggagacggaggctgccattggagcccctcctactgccactgagggccctgagaccaaacctgtgcttatggctcttgcggagggtcctggtgctgagggtccccgcctggcctcacctagtggcagcaccagctcagggctggaggtggtggctcctgagggtacctcagccccaggtggtggcccgggaaccctggatgacagtgccaccatttgccgtgtctgccagaagccaggcgatctggttatgtgcaaccagtgtgagttttgtttccacctggactgtcacctgccggccctgcaggatgtaccaggggaggagtggagctgctcactctgccatgtgctccctgacctgaaggagagggggtgggctctcctggtgtgggaccctgctgggccngccnccnccncgggagtggggntgtggcntttgaacgccccgtttggtcccttccggcgggct

SEQ ID NO: 104187 - DNA, 3319 bp, Homo sapiens
  misc_feature (3175)..(3175): n is a, c, g, or t
cggcggcgaagagacgcgggttgaggaagagggacggattgcccatgcgcttgggcgcacagcggcccgcttctgtgtggtctggaggtggagctgagaggggaatcacactctataaaggttcgcataccccactggcggattcaattgcggcagtgacgtcacagaggccccgccccgcccccacaagagccccaccgacgtggggttggcggtggtggaaggactaggagttggcgcgtgcgtactggcggcctctcccgcaccgaccggcctgggccccgcccccgggcgtgaggcgcccaatgcgcgtgcgcggcggcgtcggcgccagttatttctgtcccgccccccggcctcggctctttctgcgagcgggcgcgcgggcgagcggttgtgcttgtgcttgtggcgcgtggtgcgggtttcggcggcggctgaggaagaagcgcgggcggcgccttcgggaggcgagcaggcagcagttggccgtgccgtagcagcgtcccgcgcgcggcgggcagcggcccaggaggcgcgtggcggcgctcggcctcgcggcggcggcggcggcagcggcccagcagttggcggcgagcgcgtctgcgcctgcgcggcgggccccgcgcccctcctccccccctgggcgcccccggcggcgtgtgaatggcggcctccgcggcggcagcctcggcagcagcggcctcggccgcctctggcagcccgggcccgggcgagggctccgctggcggcgaaaagcgctccaccgccccttcggccgcagcctcggcctctgcctcagccgcggcgtcgtcgcccgcggggggcggcgccgaggcgctggagctgctggagcactgcggcgtgtgcagagagcgcctgcgacccgagagggagccccgcctgctgccctgtttgcactcggcctgtagtgcctgcttagggcccgcggcccccgccgccgccaacagctcgggggacggcggggcggcgggcgacggcaccgtggtggactgtcccgtgtgcaagcaacagtgcttctccaaagacatcgtggagaattatttcatgcgtgatagtggcagcaaggctgccaccgacgcccaggatgcgaaccagtgctgcactagctgtgaggataatgccccagccaccagctactgtgtggagtgctcggagcctctgtgtgagacctgtgtagaggcgcaccagcgggtgaagtacaccaaggaccatactgtgcgctctactgggccagccaagtctcgggatggtgaacgtactgtctattgcaacgtacacaagcatgaaccccttgtgctgttttgtgagagctgtgatactctcacctgccgagactgccagctcaatgcccacaaggaccaccagtaccagttcttagaggatgcagtgaggaaccagcgcaagctcctggcctcactggtgaagcgccttggggacaaacatgcaacattgcagaagagcaccaaggaggttcgcagctcaatccgccaggtgtctgacgtacagaagcgtgtgcaagtggatgtcaagatggccatcctgcagatcatgaaggagctgaataagcggggccgtgtgctggtcaatgatgcccagaaggtgactgaggggcagcaggagcgcctggagcggcagcactggaccatgaccaagatccagaagcaccaggagcacattctgcgctttgcctcttgggctctggagagtgacaacaacacagcccttttgctttctaagaagttgatctacttccagctgcaccgggccctcaagatgattgtggatcccgtggagccacatggcgagatgaagtttcagtgggacctcaatgcctggaccaagagtgccgaggcctttggcaagattgtggcagagcgtcctggcactaactcaacaggccctgcacccatggcccctccaagagccccaggcccctgagcaagcagggctctggcagcagccagcccatggaggtgcaggaaggctatggctttgggtcaggagatgatccctactcaagtgcagagccccatgtgtcaggtgtgaaacggtcccgctcaggtgagggcgaggtgagcggccttatgcgcaaggtgccacgagtgagccttgaacgcctggacctggacctcacagctgacagccagccacccgtcttcaaggtcttcccaggcagtaccactgaggactacaaccttattgttattgaacgtggcgctgccgctgcagctaccggccagccagggactgcgcctgcaggaacccctggtgccccacccctggctggcatggccattgtcaaggaggaggagacggaggctgccattggagcccctcctactgccactgagggccctgagaccaaacctgtgcttatggctcttgcggagggtcctggtgctgagggtccccgcctggcctcacctagtggcagcaccagctcagggctggaggtggtggctcctgagggtacctcagccccaggtggtggcccgggaaccctggatgacagtgccaccatttgccgtgtctgccagaagccaggcgatctggttatgtgcaaccagtgtgagttttgtttccacctggactgtcacctgccggccctgcaggatgtaccagggtgtgtgtatgtgtgatctctgccctggaccagcccggtggcaccctggatctgaccctgatccgtgcccgcctccaggagaagttgtcacctccctacagctccccacaggagtttgcccaggatgtgggccgcatgttcaagcaattcaacaagttaactgaggacaaggcagacgtgcagtccatcatcggcctgcagcgcttcttcgagacgcgcatgaacgaggccttcggtgacaccaagttctctgctgtgctggtggagcccccgccgatgagcctgcctggtgctggcctgagttcccaggagctgtctggtggccctggtgatggcccctgaggctggagcccccatggccagcccagcctggctctgttctctgtcctgtcaccccatccccactcccctggtggcctgactcccactccctggtggccccatcccccagttcctcacgatatggtttttacttctgtggatttaataaaaacttcaccagttaaaaaaaaaaaaaaaaaaaaaaanaaaaaaaaaggaaaagaaaaaaaaaaaaaaaggagagcaaaagcaagaaaaagaaaacacaagaaaaggcgagaaaaaaaaaaaaaaaaagagcggcggccgagcacgcaaagacctccccgggggggcagtaaatagcgagcg

SEQ ID NO: 104188 - DNA, 1179 bp, Homo sapiens
gccagtgcaaacaggttagcgcatactatacggcaggtcagcgggtggcgaacgcagtacaaccttattgttattgaacgtggcgctgccgctgcagctaccggccagccagggactgcgcctgcaggaacccctggtgccccacccctggctggcatggccattgtcaaggaggaggagacggaggctgccattggagcccctcctactgccactgagggccctgagaccaaacctgtgcttatggctcttgcggagggtcctggtgctgagggtccccgcctggcctcacctagtggcagcaccagctcagggctggaggtggtggctcctgagggtacctcagccccaggtggtggcccgggaaccctggatgacagtgccaccatttgccgtgtctgccagaagccaggcgatctggttatgtgcaaccagtgtgagttttgtttccacctggactgtcacctgccggccctgcaggatgtaccaggggaggagtggagctgctcactctgccatgtgctccctgacctgaaggaggaggatggcagcctcagcctggatggtgcagacagcactggcgtggtggccaagctctcaccagccaaccagcggaaatgtgagcgtgtactgctggccctattctgtcacgaaccctgccgccccctgcatcagctggctaccgactccaccttctccctggaccagcccggtggcaccctggatctgaccctgatccgtgcccgcctccaggagaagttgtcacctccctacagctccccacaggagtttgcccaggatgtgggccgcatgttcaagcaattcaacaagttaactgaggacaaggcagacgtgcagtccatcatcggcctgcagcgcttcttcgagacgcgcatgaacgaggccttcggtgacaccaagttctctgctgtgctggtggagcccccgccgatgagcctgcctggtgctggcctgagttcccaggagctgtctggtggccctggtgatggcccctgaggctggagcccccatggccagcccagcctggctctgttctctgtcctgtcaccccatccccactcccctggtggcctgactcccactccctggtggccccatcccccagttcctcacgatatggtttttacttctgtggatttaataaaaacttcaccagtt

SEQ ID NO: 104189 - DNA, 2984 bp, Homo sapiens
cggcggcgaagagacgcgggttgaggaagagggacggattgcccatgcgcttgggcgcacagcggcccgcttctgtgtggtctggaggtggagctgagaggggaatcacactctataaaggttcgcataccccactggcggattcaattgcggcagtgacgtcacagaggccccgccccgcccccacaagagccccaccgacgtggggttggcggtggtggaaggactaggagttggcgcgtgcgtactggcggcctctcccgcaccgaccggcctgggccccgcccccgggcgtgaggcgcccaatgcgcgtgcgcggcggcgtcggcgccagttatttctgtcccgccccccggcctcggctctttctgcgagcgggcgcgcgggcgagcggttgtgcttgtgcttgtggcgcgtggtgcgggtttcggcggcggctgaggaagaagcgcgggcggcgccttcgggaggcgagcaggcagcagttggccgtgccgtagcagcgtcccgcgcgcggcgggcagcggcccaggaggcgcgtggcggcgctcggcctcgcggcggcggcggcggcagcggcccagcagttggcggcgagcgcgtctgcgcctgcgcggcgggccccgcgcccctcctccccccctgggcgcccccggcggcgtgtgaatggcggcctccgcggcggcagcctcggcagcagcggcctcggccgcctctggcagcccgggcccgggcgagggctccgctggcggcgaaaagcgctccaccgccccttcggccgcagcctcggcctctgcctcagccgcggcgtcgtcgcccgcggggggcggcgccgaggcgctggagctgctggagcactgcggcgtgtgcagagagcgcctgcgacccgagagggagccccgcctgctgccctgtttgcactcggcctgtagtgcctgcttagggcccgcggcccccgccgccgccaacagctcgggggacggcggggcggcgggcgacggcaccgtggtggactgtcccgtgtgcaagcaacagtgcttctccaaagacatcgtggagaattatttcatgcgtgatagtggcagcaaggctgccaccgacgcccaggatgcgaaccagtgctgcactagctgtgaggataatgccccagccaccagctactgtgtggagtgctcggagcctctgtgtgagacctgtgtagaggcgcaccagcgggtgaagtacaccaaggaccatactgtgcgctctactgggccagccaagtctcgggatggtgaacgtactgtctattgcaacgtacacaagcatgaaccccttgtgctgttttgtgagagctgtgatactctcacctgccgagactgccagctcaatgcccacaaggaccaccagtaccagttcttagaggatgcagtgaggaaccagcgcaagctcctggcctcactggtgaagcgccttggggacaaacatgcaacattgcagaagagcaccaaggaggttcgcagctcaatccgccaggtgtctgacgtacagaagcgtgtgcaagtggatgtcaagatggccatcctgcagatcatgaaggagctgaataagcggggccgtgtgctggtcaatgatgcccagcaagatccagaagcaccaggagcacattctgcgctttgcctcttgggctctggagagtgacaacaacacagcccttttgctttctaagaagttgatctacttccagctgcaccgggccctcaagatgattgtggatcccgtggagccacatggcgagatgaagtttcagtgggacctcaatgcctggaccaagagtgccgaggcctttggcaagattgtggcagagcgtcctggcactaactcaacaggccctgcacccatggcccctccaagagccccaggcccctgagcaagcagggctctggcagcagccagcccatggaggtgcaggaaggctatggctttgggtcaggagatgatccctactcaagtgcagagccccatgtgtcaggtgtgaaacggtcccgctcaggtgagggcgaggtgagcggccttatgcgcaaggtgccacgagtgagccttgaacgcctggacctggacctcacagctgacagccagccacccgtcttcaaggtcttcccaggcagtaccactgaggactacaaccttattgttattgaacgtggcgctgccgctgcagctaccggccagccagggactgcgcctgcaggaacccctggtgccccacccctggctggcatggccattgtcaaggaggaggagacggaggctgcatggaggagtggagctgctcactctgccatgtgctccctgacctgaaggaggaggatggcagcctcagcctggatggtgcagacagcactggcgtggtggccaagctctcaccagccaaccagcggaaatgtgagcgtgtactgctggccctattctgtcacgaaccctgccgccccctgcatcagctggctaccgactccaccttctccctggaccagcccggtggcaccctggatctgaccctgatccgtgcccgcctccaggagaagttgtcacctccctacagctccccacaggagtttgcccaggatgtgggccgcatgttcaagcaattcaacaagttaactgaggacaaggcagacgtgcagtccatcatcggcctgcagcgcttcttcgagacgcgcatgaacgaggccttcggtgacaccaagttctctgctgtgctggtggagcccccgccgatgagcctgcctggtgctggcctgagttcccaggagctgtctggtggccctggtgatggcccctgaggctggagcccccatggccagcccagcctggctctgttctctgtcctgtcaccccatccccactcccctggtggcctgactcccactccctggtggccccatcccccagttcctcacgatatggtttttacttctgtggatttaataaaaacttcaccagtt

SEQ ID NO: 104190 - DNA, 2558 bp, Homo sapiens
  misc_feature (2148)..(2148): n is a, c, g, or t
cggcggcgaagagacgcgggttgaggaagagggacggattgcccatgcgcttgggcgcacagcggcccgcttctgtgtggtctggaggtggagctgagaggggaatcacactctataaaggttcgcataccccactggcggattcaattgcggcagtgacgtcacagaggccccgccccgcccccacaagagccccaccgacgtggggttggcggtggtggaaggactaggagttggcgcgtgcgtactggcggcctctcccgcaccgaccggcctgggccccgcccccgggcgtgaggcgcccaatgcgcgtgcgcggcggcgtcggcgccagttatttctgtcccgccccccggcctcggctctttctgcgagcgggcgcgcgggcgagcggttgtgcttgtgcttgtggcgcgtggtgcgggtttcggcggcggctgaggaagaagcgcgggcggcgccttcgggaggcgagcaggcagcagttggccgtgccgtagcagcgtcccgcgcgcggcgggcagcggcccaggaggcgcgtggcggcgctcggcctcgcggcggcggcggcggcagcggcccagcagttggcggcgagcgcgtctgcgcctgcgcggcgggccccgcgcccctcctccccccctgggcgcccccggcggcgtgtgaatggcggcctccgcggcggcagcctcggcagcagcggcctcggccgcctctggcagcccgggcccgggcgagggctccgctggcggcgaaaagcgctccaccgccccttcggccgcagcctcggcctctgcctcagccgcggcgtcgtcgcccgcggggggcggcgccgaggcgctggagctgctggagcactgcggcgtgtgcagagagcgcctgcgacccgagagggagccccgcctgctgccctgtttgcactcggcctgtagtgcctgcttagggcccgcggcccccgccgccgccaacagctcgggggacggcggggcggcgggcgacggcaccgtggtggactgtcccgtgtgcaagcaacagtgcttctccaaagacatcgtggagaattatttcatgcgtgatagtggcagcaaggctgccaccgacgcccaggatgcgaaccagtgctgcactagctgtgaggataatgccccagccaccagctactgtgtggagtgctcggagcctctgtgtgagacctgtgtagaggcgcaccagcgggtgaagtacaccaaggaccatactgtgcgctctactgggccagccaagtctcgggatggtgaacgtactgtctattgcaacgtacacaagcatgaaccccttgtgctgttttgtgagagctgtgatactctcacctgccgagactgccagctcaatgcccacaaggaccaccagtaccagttcttagaggatgcagtgaggaaccagcgcaagctcctggcctcactggtgaagcgccttggggacaaacatgcaacattgcagaagagcaccaaggaggttcgcagctcaatccgccaggtgtctgacgtacagaagcgtgtgcaagtggatgtcaagatggccatcctgcagatcatgaaggagctgaataagcggggccgtgtgctggtcaatgatgcccagaaggtgactgaggggcagcaggagcgcctggagcggcagcactggaccatgaccaagatccagaagcaccaggagcacattctgcgctttgcctcttgggctctggagagtgacaacaacacagcccttttgctttctaagaagttgatctacttccagctgcaccgggccctcaagatgattgtggatcccgtggagccacatggcgagatgaagtttcagtgggacctcaatgcctggaccaagagtgccgaggcctttggcaagattgtggcagagcgtcctggcactaactcaacaggccctgcacccatggcccctccaagagccccaggcccctgagcaagcagggctctggcagcagccagcccatggaggtgcaggaaggctatggctttgggtcaggagatgatccctactcaagtgcagagccccatgtgtcaggtgtgaaacggtcccgctcaggtgagggcgaggtgagcggccttatgcgcaaggtgccacgagtgagccttgaacgcctggacncaacagatggaagcaagcaaccggttaacaggcgtcccagggaggacactgggggcatcaagaccgttatagggagtagacagtgggggctacgcgagagagagaacgggcaagcagggttgggcagggaagaaccccgggtggtgcacacacgggtgtggacggtgcacaggtaacgaggaggaatacaaaggactacaatagggcaaccacaaatagaaagaagggcgcgcaaaaaaaaatgacgctgagccctgaaagcaacgacacaaagacgagcacagcgagcaactcatcgacgcaacacagagcgagagggtgacgcacagacaacacaataaggaggcagacaacgaaacaacgaatagacagcagacagaacgacgacgccgacagaggagaagacaaga

SEQ ID NO: 104191 - DNA, 2261 bp, Homo sapiens
cggcggcgaagagacgcgggttgaggaagagggacggattgcccatgcgcttgggcgcacagcggcccgcttctgtgtggtctggaggtggagctgagaggggaatcacactctataaaggttcgcataccccactggcggattcaattgcggcagtgacgtcacagaggccccgccccgcccccacaagagccccaccgacgtggggttggcggtggtggaaggactaggagttggcgcgtgcgtactggcggcctctcccgcaccgaccggcctgggccccgcccccgggcgtgaggcgcccaatgcgcgtgcgcggcggcgtcggcgccagttatttctgtcccgccccccggcctcggctctttctgcgagcgggcgcgcgggcgagcggttgtgcttgtgcttgtggcgcgtggtgcgggtttcggcggcggctgaggaagaagcgcgggcggcgccttcgggaggcgagcaggcagcagttggccgtgccgtagcagcgtcccgcgcgcggcgggcagcggcccaggaggcgcgtggcggcgctcggcctcgcggcggcggcggcggcagcggcccagcagttggcggcgagcgcgtctgcgcctgcgcggcgggccccgcgcccctcctccccccctgggcgcccccggcggcgtgtgaatggcggcctccgcggcggcagcctcggcagcagcggcctcggccgcctctggcagcccgggcccgggcgagggctccgctggcggcgaaaagcgctccaccgccccttcggccgcagcctcggcctctgcctcagccgcggcgtcgtcgcccgcggggggcggcgccgaggcgctggagctgctggagcactgcggcgtgtgcagagagcgcctgcgacccgagagggagccccgcctgctgccctgtttgcactcggcctgtagtgcctgcttagggcccgcggcccccgccgccgccaacagctcgggggacggcggggcggcgggcgacggcaccgtggtggactgtcccgtgtgcaagcaacagtgcttctccaaagacatcgtggagaattatttcatgcgtgatagtggcagcaaggctgccaccgacgcccaggatgcgaaccagtgctgcactagctgtgaggataatgccccagccaccagctactgtgtggagtgctcggagcctctgtgtgagacctgtgtagaggcgcaccagcgggtgaagtacaccaaggaccatactgtgcgctctactgggccagccaagtctcgggatggtgaacgtactgtctattgcaacgtacacaagcatgaaccccttgtgctgttttgtgagagctgtgatactctcacctgccgagactgccagctcaatgcccacaaggaccaccagtaccagttcttagaggatgcagtgaggaaccagcgcaagctcctggcctcactggtgaagcgccttggggacaaacatgcaacattgcagaagagcaccaaggaggttcgcagctcaatccgccaggtgtctgacgtacagaagcgtgtgcaagtggatgtcaagatggccatcctgcagatcatgaaggagctgaataagcggggccgtgtgctggtcaatgatgcccagaaggtgactgaggggcagcaggagcgcctggagcggcagcactggaccatgaccaagatccagaagcaccaggagcacattctgcgctttgcctcttgggctctggagagtgacaacaacacagcccttttgctttctaagaagttgatctacttccagctgcaccgggccctcaagatgattgtggatcccgtggagccacatggcgagatgaagtttcagtgggacctcaatgcctggaccaagagtgccgaggcctttggcaagattgtggcagagcgtcctggcactaactcaacaggccctgcacccatggcccctccaagagccccaggcccctgagcaagcagggctctggcagcagccagcccatggaggtgcaggaaggctatggctttgggtcaggagatgatccctactcaagtgcagagccccatgtgtcaggtgtgaaacggtccgtcaggtgagggcgaggtggggggctttgcgcaggtgccgagtgagcctgaacgctggactggactcaagtgaggcagcccgtcttcggtcttccgggcgtcctgggctcactttggtttgagtggggcgcggggacggcacaggtggccggggaccggggcccccggggtggttgtgggggg

SEQ ID NO: 104192 - DNA, 1875 bp, Homo sapiens
cggcggcgaagagacgcgggttgaggaagagggacggattgcccatgcgcttgggcgcacagcggcccgcttctgtgtggtctggaggtggagctgagaggggaatcacactctataaaggttcgcataccccactggcggattcaattgcggcagtgacgtcacagaggccccgccccgcccccacaagagccccaccgacgtggggttggcggtggtggaaggactaggagttggcgcgtgcgtactggcggcctctcccgcaccgaccggcctgggccccgcccccgggcgtgaggcgcccaatgcgcgtgcgcggcggcgtcggcgccagttatttctgtcccgccccccggcctcggctctttctgcgagcgggcgcgcgggcgagcggttgtgcttgtgcttgtggcgcgtggtgcgggtttcggcggcggctgaggaagaagcgcgggcggcgccttcgggaggcgagcaggcagcagttggccgtgccgtagcagcgtcccgcgcgcggcgggcagcggcccaggaggcgcgtggcggcgctcggcctcgcggcggcggcggcggcagcggcccagcagttggcggcgagcgcgtctgcgcctgcgcggcgggccccgcgcccctcctccccccctgggcgcccccggcggcgtgtgaatggcggcctccgcggcggcagcctcggcagcagcggcctcggccgcctctggcagcccgggcccgggcgagggctccgctggcggcgaaaagcgctccaccgccccttcggccgcagcctcggcctctgcctcagccgcggcgtcgtcgcccgcggggggcggcgccgaggcgctggagctgctggagcactgcggcgtgtgcagagagcgcctgcgacccgagagggagccccgcctgctgccctgtttgcactcggcctgtagtgcctgcttagggcccgcggcccccgccgccgccaacagctcgggggacggcggggcggcgggcgacggcaccgtggtggactgtcccgtgtgcaagcaacagtgcttctccaaagacatcgtggagaattatttcatgcgtgatagtggcagcaaggctgccaccgacgcccaggatgcgaaccagtgctgcactagctgtgaggataatgccccagccaccagctactgtgtggagtgctcggagcctctgtgtgagacctgtgtagaggcgcaccagcgggtgaagtacaccaaggaccatactgtgcgctctactgggccagccaagtctcgggatggtgaacgtactgtctattgcaacgtacacaagcatgaaccccttgtgctgttttgtgagagctgtgatactctcacctgccgagactgccagctcaatgcccacaaggaccaccagtaccagttcttagaggatgcagtgaggaaccagcgcaagctcctggcctcactggtgaagcgccttggggacaaacatgcaacattgcagaagagcaccaaggaggttcgcagctcaatccgccaggtgtctgacgtacagaagcgtgtgcaagtggatgtcaagatggccatcctgcagatcatgaaggagctgaataagcggggccgtgtgctggtcaatgatgcccagaaggtgactgaggggcagcaggagcgcctggagcggcagcactggaccatgaccaagatccagaagcaccaggagcacattctgcgctttgcctcttgggctctggagagtgacaacaacacagcccttttgctttctaagaagttgatctacttccagctgcaccgggccctcaagatgattgtggatcccgtggagccacatggggctctgcacttgagtagggatcatctcctgacccaaagccatagcctt

SEQ ID NO: 104193 - DNA, 1235 bp, Homo sapiens
gggacctggacctcacagctgacagccagccacccgtcttcacctgagcaagcagggctctggcagcagccagcccatggaggtgcaggaaggctatggcttgggtcaggagatgatccctactcaagtgcagagccccatgtgtcaggtgtgaaacggtcccgctcaggtgagggcgaggtgagcggccttatgcgcaaggtgccacgagtgagccttgaacgcctggacctggacctcacagctgacagccagccacccgtcttcaaggtcttcccaggcagtaccactgaggactacaaccttattgttattgaacgtggcgctgccgctgcagctaccggccagccagggactgcgcctgcaggaacccctggtgccccacccctggctggcatggccattgtcaaggaggaggagacggaggctgccattggagcccctcctactgccactgagggccctgagaccaaacctgtgcttatggctcttgcggagggtcctggtgctgagggtccccgcctggcctcacctagtggcagcaccagctcagggctggaggtggtggctcctgagggtacctcagccccaggtggtggcccgggaaccctggatgacagtgccaccatttgccgtgtctgccagaagccaggcgatctggttatgtgcaaccagtgtgagttttgtttccacctggactgtcacctgccggccctgcaggatgtaccagggtgtgtgtatgtgtgatctctgccctggaccagcccggtggcaccctggatctgaccctgatccgtgcccgcctccaggagaagttgtcacctccctacagctccccacaggagtttgcccaggatgtgggccgcatgttcaagcaattcaacaagttaactgaggacaaggcagacgtgcagtccatcatcggcctgcagcgcttcttcgagacgcgcatgaacgaggccttcggtgacaccaagttctctgctgtgctggtggagcccccgccgatgagcctgcctggtgctggcctgagttcccaggagctgtctggtggccctggtgatggcccctgaggctggagcccccatggccagcccagcctggctctgttctctgtcctgtcaccccatccccactcccctggtggcctgactcccactccctggtggccccatcccccagttcctcacgatatggtttttacttctgtggatttaataaaaacttcaccagtt

SEQ ID NO: 104194 - DNA, 403 bp, Homo sapiens
atctctagaagctagaagaaagggatgtgtttctcagctatgttggggcagaggattctgggagcaaggagttgggcttgcaggcctgtgttcttccctggccacaccctctacatcttcccaataaatggcccagtgtcacagaacaggccggaaatgaggccccaactcattctgcttcctgagttgggggtggtgaagggcaaggtccagccttatgattcccactccccagggccagccaagtctcgggatggtgaacgtactgtctattgcaacgtacacaagcatgaaccccttgtgctgttttgtgagagctgtgatactctcacctgccgagactgccagctcaatgcccacaaggaccaccagtgagtcccaaggcatagtggttgggtgggtg

SEQ ID NO: 104195 - DNA, 185 bp, Homo sapiens
tgggtcaagggaccaatcttaaatctccggttgtattttctgggatgtaaacgtggatctatcaagttgtcttgccttctctgaccctgcctttgtctggcagtgctgcactagctgtgaggataatgccccagccaccagctactgtgtggagtgctcggagcctctgtgtgagacctgtgtag

SEQ ID NO: 104196 - DNA, 636 bp, Homo sapiens
gtcttcccaggcagtaccactgaggactacaaccttattgttattgaacgtggcgctgccgctgcagctaccggccagccagggactgcgcctgcaggaacccctggtgccccacccctggctggcatggccattgtcaaggtaagcctgtcccaaggaactatagctgtaggatgaagcctgtagtccaggtctggaccctgttgaacacccctcatcaccaccttgcaggaggaggagacggaggctgccattggagcccctcctactgccactgagggccctgagaccaaacctgtgcttatggctcttgcggagggtcctggtgctgagggtccccgcctggcctcacctagtggcagcaccagctcagggctggaggtggtggctcctgagggtacctcagccccaggtggtggcccgggaaccctggatgacagtgccaccatttgccgtgtctgccagaagccaggcgatctggttatgtgcaaccagtgtgagttttgtttccacctggactgtcacctgccggccctgcaggatgtaccagggtgagtgtgaggctggtgggggtcaagtctgggtgttgggctgtctggacaggatcatgtgcagacccttattttcttcacccta

SEQ ID NO: 104197 - DNA, 655 bp, Homo sapiens
gacagccagccacccgtcttcaaggtcttcccaggcagtaccactgaggactacaaccttattgttattgaacgtggcgctgccgctgcagctaccggccagccagggactgcgcctgcaggaacccctggtgccccacccctggctggcatggccattgtcaaggtaagcctgtcccaaggaactatagctgtaggatgaagcctgtagtccaggtctggaccctgttgaacacccctcatcaccaccttgcaggaggaggagacggaggctgccattggagcccctcctactgccactgagggccctgagaccaaacctgtgcttatggctcttgcggagggtcctggtgctgagggtccccgcctggcctcacctagtggcagcaccagctcagggctggaggtggtggctcctgagggtacctcagccccaggtggtggcccgggaaccctggatgacagtgccaccatttgccgtgtctgccagaagccaggcgatctggttatgtgcaaccagtgtgagttttgtttccacctggactgtcacctgccggccctgcaggatgtaccagggtgagtgtgaggctggtgggggtcaagtctgggtgttgggctgtctggacaggatcatgtgcagacccttattttcttca

SEQ ID NO: 104198 - DNA, 3335 bp, Homo sapiens
cggcggcgaagagacgcgggttgaggaagagggacggattgcccatgcgcttgggcgcacagcggcccgcttctgtgtggtctggaggtggagctgagaggggaatcacactctataaaggttcgcataccccactggcggattcaattgcggcagtgacgtcacagaggccccgccccgcccccacaagagccccaccgacgtggggttggcggtggtggaaggactaggagttggcgcgtgcgtactggcggcctctcccgcaccgaccggcctgggccccgcccccgggcgtgaggcgcccaatgcgcgtgcgcggcggcgtcggcgccagttatttctgtcccgccccccggcctcggctctttctgcgagcgggcgcgcgggcgagcggttgtgcttgtgcttgtggcgcgtggtgcgggtttcggcggcggctgaggaagaagcgcgggcggcgccttcgggaggcgagcaggcagcagttggccgtgccgtagcagcgtcccgcgcgcggcgggcagcggcccaggaggcgcgtggcggcgctcggcctcgcggcggcggcggcggcagcggcccagcagttggcggcgagcgcgtctgcgcctgcgcggcgggccccgcgcccctcctccccccctgggcgcccccggcggcgtgtgaatggcggcctccgcggcggcagcctcggcagcagcggcctcggccgcctctggcagcccgggcccgggcgagggctccgctggcggcgaaaagcgctccaccgccccttcggccgcagcctcggcctctgcctcagccgcggcgtcgtcgcccgcggggggcggcgccgaggcgctggagctgctggagcactgcggcgtgtgcagagagcgcctgcgacccgagagggagccccgcctgctgccctgtttgcactcggcctgtagtgcctgcttagggcccgcggcccccgccgccgccaacagctcgggggacggcggggcggcgggcgacggcaccgtggtggactgtcccgtgtgcaagcaacagtgcttctccaaagacatcgtggagaattatttcatgcgtgatagtggcagcaaggctgccaccgacgcccaggatgcgaaccagtgctgcactagctgtgaggataatgccccagccaccagctactgtgtggagtgctcggagcctctgtgtgagacctgtgtagaggcgcaccagcgggtgaagtacaccaaggaccatactgtgcgctctactgggccagccaagtctcgggatggtgaacgtactgtctattgcaacgtacacaagcatgaaccccttgtgctgttttgtgagagctgtgatactctcacctgccgagactgccagctcaatgcccacaaggaccaccagtaccagttcttagaggatgcagtgaggaaccagcgcaagctcctggcctcactggtgaagcgccttggggacaaacatgcaacattgcagaagagcaccaaggaggttcgcagctcaatccgccaggtgtctgacgtacagaagcgtgtgcaagtggatgtcaagatggccatcctgcagatcatgaaggagctgaataagcggggccgtgtgctggtcaatgatgcccagaaggtgactgaggggcagcaggagcgcctggagcggcagcactggaccatgaccaagatccagaagcaccaggagcacattctgcgctttgcctcttgggctctggagagtgacaacaacacagcccttttgctttctaagaagttgatctacttccagctgcaccgggccctcaagatgattgtggatcccgtggagccacatggcgagatgaagtttcagtgggacctcaatgcctggaccaagagtgccgaggcctttggcaagattgtggcagagcgtcctggcactaactcaacaggccctgcacccatggcccctccaagagccccaggcccctgagcaagcagggctctggcagcagccagcccatggaggtgcaggaaggctatggctttgggtcaggagatgatccctactcaagtgcagagccccatgtgtcaggtgtgaaacggtcccgctcaggtgagggcgaggtgagcggccttatgcgcaaggtgccacgagtgagccttgaacgcctggacctggacctcacagctgacagccagccacccgtcttcaaggtcttcccaggcagtaccactgaggactacaaccttattgttattgaacgtggcgctgccgctgcagctaccggccagccagggactgcgcctgcaggaacccctggtgccccacccctggctggcatggccattgtcaaggaggaggagacggaggctgccattggagcccctcctactgccactgagggccctgagaccaaacctgtgcttatggctcttgcggagggtcctggtgctgagggtccccgcctggcctcacctagtggcagcaccagctcagggctggaggtggtggctcctgagggtacctcagccccaggtggtggcccgggaaccctggatgacagtgccaccatttgccgtgtctgccagaagccaggcgatctggttatgtgcaaccagtgtgagttttgtttccacctggactgtcacctgccggccctgcaggatgtaccaggggaggagtggagctgctcactctgccatgtgctccctgacctgaaggaggaggatggcagcctcagcctggatggtgcagacagcactggcgtggtggccaagctctcaccagccaaccagcggaaatgtgagcgtgtactgctggccctattctgtcacgaaccctgccgccccctgcatcagctggctaccgactccaccttctccctggaccagcccggtggcaccctggatctgaccctgatccgtgcccgcctccaggagaagttgtcacctccctacagctccccacaggagtttgcccaggatgtgggccgcatgttcaagcaattcaacaagttaactgaggacaaggcagacgtgcagtccatcatcggcctgcagcgcttcttcgagacgcgcatgaacgaggccttcggtgacaccaagttctctgctgtgctggtggagcccccgccgatgagcctgcctggtgctggcctgagttcccaggagctgtctggtggccctggtgatggcccctgaggctggagcccccatggccagcccagcctggctctgttctctgtcctgtcaccccatccccactcccctggtggcctgactcccactccctggtggccccatcccccagttcctcacgatatggtttttacttctgtggatttaataaaaacttcaccagtt

SEQ ID NO: 104199 - DNA, 763 bp, Homo sapiens
ctcagcctggatggtgcagacagcacatggcagaggctgccatcctcctccttcaggtcagggagcagaggatggcagcctcagcctggatggtgcagacagcactggcgtggtggccaagctctcaccagccaaccagcggaaatgtgagcgtgtactgctggccctattctgtcacgaaccctgccgccccctgcatcagctggctaccgactccaccttctccctggaccagcccggtggcaccctggatctgaccctgatccgtgcccgcctccaggagaagttgtcacctccctacagctccccacaggagtttgcccaggatgtgggccgcatgttcaagcaattcaacaagttaactgaggacaaggcagacgtgcagtccatcatcggcctgcagcgcttcttcgagacgcgcatgaacgaggccttcggtgacaccaagttctctgctgtgctggtggagcccccgccgatgagcctgcctggtgctggcctgagttcccaggagctgtctggtggccctggtgatggcccctgaggctggagcccccatggccagcccagcctggctctgttctctgtcctgtcaccccatccccactcccctggtggcctgactcccactccctggtggccccatcccccagttcctcacgatatggtttttacttctgtggatttaataaaaacttcaccagttcctcaggcgttggctggttgggggactgtggtcctggggcctggtttattgactgta

SEQ ID NO: 104200 - DNA, 572 bp, Homo sapiens
cgacccacgcgtccggacccacgcgtccgggagtttgcccaggatgtgggccgcatgttcaagcaattcaacaagttaactgaggtgagccagtggaatggagaggctgtgggcagggggagatgtgaaggaaagaactaggacccattcatccactgcattcctgcttggcccaggacaaggcagacgtgcagtccatcatcggcctgcagcgcttcttcgagacgcgcatgaacgaggccttcggtgacaccaagttctctgctgtgctggtggagcccccgccgatgagcctgcctggtgctggcctgagttcccaggagctgtctggtggccctggtgatggcccctgaggctggagcccccatggccagcccagcctggctctgttctctgtcctgtcaccccatccccactcccctggtggcctgactcccactccctggtggccccatcccccagttcctcacgatatggtttttacttctgtggatttaataaaaacttcaccagttcctcaggcgttggctggttgggggactgtggtcctggggcctggtttattgactgta

SEQ ID NO: 104201 - DNA, 2595 bp, Homo sapiens
tgcagagatgaggatgccacctgggcgagaggatgggggcccggacagggcacgggaaatactttctgggtcctgcatacgaacgtgggtttgtgctggccgctgagatgggacatctgactaaagttggagaaaagaaggctcggggaggggaggggctggttcgctgcgggataatggtcgggggcccacccagcaggggaatggtgggggccataacctgggtgggaacttgtaacagtctcccacatccctgcttctcgaagtggtggactgtcccgtgtgcaagcaacagtgcttctccaaagacatcgtggagaattatttcatgcgtgatagtggcagcaaggctgccaccgacgcccaggatgcgaaccagtgctgcactagctgtgaggataatgccccagccaccagctactgtgtggagtgctcggagcctctgtgtgagacctgtgtagaggcgcaccagcgggtgaagtacaccaaggaccatactgtgcgctctactgggccagccaagtctcgggatggtgaacgtactgtctattgcaacgtacacaagcatgaaccccttgtgctgttttgtgagagctgtgatactctcacctgccgagactgccagctcaatgcccacaaggaccaccagtaccagttcttagaggatgcagtgaggaaccagcgcaagctcctggcctcactggtgaagcgccttggggacaaacatgcaacattgcagaagagcaccaaggaggttcgcagctcaatccgccaggtgtctgacgtacagaagcgtgtgcaagtggatgtcaagatggccatcctgcagatcatgaaggagctgaataagcggggccgtgtgctggtcaatgatgcccagaaggtgactgaggggcagcaggagcgcctggagcggcagcactggaccatgaccaagatccagaagcaccaggagcacattctgcgctttgcctcttgggctctggagagtgacaacaacacagcccttttgctttctaagaagttgatctacttccagctgcaccgggccctcaagatgattgtggatcccgtggagccacatggcgagatgaagtttcagtgggacctcaatgcctggaccaagagtgccgaggcctttggcaagattgtggcagagcgtcctggcactaactcaacaggccctgcacccatggcccctccaagagccccaggcccctgagcaagcagggctctggcagcagccagcccatggaggtgcaggaaggctatggctttgggtcaggagatgatccctactcaagtgcagagccccatgtgtcaggtgtgaaacggtcccgctcaggtgagggcgaggtgagcggccttatgcgcaaggtgccacgagtgagccttgaacgcctggacctggacctcacagctgacagccagccacccgtcttcaaggtcttcccaggcagtaccactgaggactacaaccttattgttattgaacgtggcgctgccgctgcagctaccggccagccagggactgcgcctgcaggaacccctggtgccccacccctggctggcatggccattgtcaaggaggaggagacggaggctgccattggagcccctcctactgccactgagggccctgagaccaaacctgtgcttatggctcttgcggagggtcctggtgctgagggtccccgcctggcctcacctagtggcagcaccagctcagggctggaggtggtggctcctgagggtacctcagccccaggtggtggcccgggaaccctggatgacagtgccaccatttgccgtgtctgccagaagccaggcgatctggttatgtgcaaccagtgtgagttttgtttccacctggactgtcacctgccggccctgcaggatgtaccaggggaggagtggagctgctcactctgccatgtgctccctgacctgaaggaggaggatggcagcctcagcctggatggtgcagacagcactggcgtggtggccaagctctcaccagccaaccagcggaaatgtgagcgtgtactgctggccctattctgtcacgaaccctgccgccccctgcatcagctggctaccgactccaccttctccctggaccagcccggtggcaccctggatctgaccctgatccgtgcccgcctccaggagaagttgtcacctccctacagctccccacaggagtttgcccaggatgtgggccgcatgttcaagcaattcaacaagttaactgaggacaaggcagacgtgcagtccatcatcggcctgcagcgcttcttcgagacgcgcatgaacgaggccttcggtgacaccaagttctctgctgtgctggtggagcccccgccgatgagcctgcctggtgctggcctgagttcccaggagctgtctggtggccctggtgatggcccctgaggctggagcccccatggccagcccagcctggctctgttctctgtcctgtcaccccatccccactcccctggtggcctgactcccactccctggtggccccatcccccagttcctcacgatatggtttttacttctgtggatttaataaaaacttcaccagtt

SEQ ID NO: 104202 - DNA, 2324 bp, Homo sapiens
gttgttatctctagaagctagaagaaagggatgtgtttctcagctatgttggggcagaggattctgggagcaaggagttgggcttgcaggcctgtgttcttccctggccacaccctctacatcttcccaataaatggcccagtgtcacagaacaggccggaaatgaggccccaactcattctgcttcctgagttgggggtggtgaagggcaaggtccagccttatgattcccactccccagggccagccaagtctcgggatggtgaacgtactgtctattgcaacgtacacaagcatgaaccccttgtgctgttttgtgagagctgtgatactctcacctgccgagactgccagctcaatgcccacaaggaccaccagtaccagttcttagaggatgcagtgaggaaccagcgcaagctcctggcctcactggtgaagcgccttggggacaaacatgcaacattgcagaagagcaccaaggaggttcgcagctcaatccgccaggtgtctgacgtacagaagcgtgtgcaagtggatgtcaagatggccatcctgcagatcatgaaggagctgaataagcggggccgtgtgctggtcaatgatgcccagaaggtgactgaggggcagcaggagcgcctggagcggcagcactggaccatgaccaagatccagaagcaccaggagcacattctgcgctttgcctcttgggctctggagagtgacaacaacacagcccttttgctttctaagaagttgatctacttccagctgcaccgggccctcaagatgattgtggatcccgtggagccacatggcgagatgaagtttcagtgggacctcaatgcctggaccaagagtgccgaggcctttggcaagattgtggcagagcgtcctggcactaactcaacaggccctgcacccatggcccctccaagagccccaggcccctgagcaagcagggctctggcagcagccagcccatggaggtgcaggaaggctatggctttgggtcaggagatgatccctactcaagtgcagagccccatgtgtcaggtgtgaaacggtcccgctcaggtgagggcgaggtgagcggccttatgcgcaaggtgccacgagtgagccttgaacgcctggacctggacctcacagctgacagccagccacccgtcttcaaggtcttcccaggcagtaccactgaggactacaaccttattgttattgaacgtggcgctgccgctgcagctaccggccagccagggactgcgcctgcaggaacccctggtgccccacccctggctggcatggccattgtcaaggaggaggagacggaggctgccattggagcccctcctactgccactgagggccctgagaccaaacctgtgcttatggctcttgcggagggtcctggtgctgagggtccccgcctggcctcacctagtggcagcaccagctcagggctggaggtggtggctcctgagggtacctcagccccaggtggtggcccgggaaccctggatgacagtgccaccatttgccgtgtctgccagaagccaggcgatctggttatgtgcaaccagtgtgagttttgtttccacctggactgtcacctgccggccctgcaggatgtaccaggggaggagtggagctgctcactctgccatgtgctccctgacctgaaggaggaggatggcagcctcagcctggatggtgcagacagcactggcgtggtggccaagctctcaccagccaaccagcggaaatgtgagcgtgtactgctggccctattctgtcacgaaccctgccgccccctgcatcagctggctaccgactccaccttctccctggaccagcccggtggcaccctggatctgaccctgatccgtgcccgcctccaggagaagttgtcacctccctacagctccccacaggagtttgcccaggatgtgggccgcatgttcaagcaattcaacaagttaactgaggacaaggcagacgtgcagtccatcatcggcctgcagcgcttcttcgagacgcgcatgaacgaggccttcggtgacaccaagttctctgctgtgctggtggagcccccgccgatgagcctgcctggtgctggcctgagttcccaggagctgtctggtggccctggtgatggcccctgaggctggagcccccatggccagcccagcctggctctgttctctgtcctgtcaccccatccccactcccctggtggcctgactcccactccctggtggccccatcccccagttcctcacgatatggtttttacttctgtggatttaataaaaacttcaccagtt

SEQ ID NO: 104203 - DNA, 3371 bp, Homo sapiens
cggcggcgaagagacgcgggttgaggaagagggacggattgcccatgcgcttgggcgcacagcggcccgcttctgtgtggtctggaggtggagctgagaggggaatcacactctataaaggttcgcataccccactggcggattcaattgcggcagtgacgtcacagaggccccgccccgcccccacaagagccccaccgacgtggggttggcggtggtggaaggactaggagttggcgcgtgcgtactggcggcctctcccgcaccgaccggcctgggccccgcccccgggcgtgaggcgcccaatgcgcgtgcgcggcggcgtcggcgccagttatttctgtcccgccccccggcctcggctctttctgcgagcgggcgcgcgggcgagcggttgtgcttgtgcttgtggcgcgtggtgcgggtttcggcggcggctgaggaagaagcgcgggcggcgccttcgggaggcgagcaggcagcagttggccgtgccgtagcagcgtcccgcgcgcggcgggcagcggcccaggaggcgcgtggcggcgctcggcctcgcggcggcggcggcggcagcggcccagcagttggcggcgagcgcgtctgcgcctgcgcggcgggccccgcgcccctcctccccccctgggcgcccccggcggcgtgtgaatggcggcctccgcggcggcagcctcggcagcagcggcctcggccgcctctggcagcccgggcccgggcgagggctccgctggcggcgaaaagcgctccaccgccccttcggccgcagcctcggcctctgcctcagccgcggcgtcgtcgcccgcggggggcggcgccgaggcgctggagctgctggagcactgcggcgtgtgcagagagcgcctgcgacccgagagggagccccgcctgctgccctgtttgcactcggcctgtagtgcctgcttagggcccgcggcccccgccgccgccaacagctcgggggacggcggggcggcgggcgacggcaccgtggtggactgtcccgtgtgcaagcaacagtgcttctccaaagacatcgtggagaattatttcatgcgtgatagtggcagcaaggctgccaccgacgcccaggatgcgaaccagtgctgcactagctgtgaggataatgccccagccaccagctactgtgtggagtgctcggagcctctgtgtgagacctgtgtagaggcgcaccagcgggtgaagtacaccaaggaccatactgtgcgctctactgggccagccaagtctcgggatggtgaacgtactgtctattgcaacgtacacaagcatgaaccccttgtgctgttttgtgagagctgtgatactctcacctgccgagactgccagctcaatgcccacaaggaccaccagtaccagttcttagaggatgcagtgaggaaccagcgcaagctcctggcctcactggtgaagcgccttggggacaaacatgcaacattgcagaagagcaccaaggaggttcgcagctcaatccgccaggtgtctgacgtacagaagcgtgtgcaagtggatgtcaagatggccatcctgcagatcatgaaggagctgaataagcggggccgtgtgctggtcaatgatgcccagaaggtgactgaggggcagcaggagcgcctggagcggcagcactggaccatgaccaagatccagaagcaccaggagcacattctgcgctttgcctcttgggctctggagagtgacaacaacacagcccttttgctttctaagaagttgatctacttccagctgcaccgggccctcaagatgattgtggatcccgtggagccacatggcgagatgaagtttcagtgggacctcaatgcctggaccaagagtgccgaggcctttggcaagattgtggcagagcgtcctggcactaactcaacaggccctgcacccatggcccctccaagagccccaggcccctgagcaagcagggctctggcagcagccagcccatggaggtgcaggaaggctatggctttgggtcaggagatgatccctactcaagtgcagagccccatgtgtcaggtgtgaaacggtcccgctcaggtgagggcgaggtgagcggccttatgcgcaaggtgccacgagtgagccttgaacgcctggacctggacctcacagctgacagccagccacccgtcttcaaggtcttcccaggcagtaccactgaggactacaaccttattgttattgaacgtggcgctgccgctgcagctaccggccagccagggactgcgcctgcaggaacccctggtgccccacccctggctggcatggccattgtcaaggaggaggagacggaggctgccattggagcccctcctactgccactgagggccctgagaccaaacctgtgcttatggctcttgcggagggtcctggtgctgagggtccccgcctggcctcacctagtggcagcaccagctcagggctggaggtggtggctcctgagggtacctcagccccaggtggtggcccgggaaccctggatgacagtgccaccatttgccgtgtctgccagaagccaggcgatctggttatgtgcaaccagtgtgagttttgtttccacctggactgtcacctgccggccctgcaggatgtaccaggggaggagtggagctgctcactctgccatgtgctccctgacctgaaggaggaggatggcagcctcagcctggatggtgcagacagcactggcgtggtggccaagctctcaccagccaaccagcggaaatgtgagcgtgtactgctggccctattctgtcacgaaccctgccgccccctgcatcagctggctaccgactccaccttctccctggaccagcccggtggcaccctggatctgaccctgatccgtgcccgcctccaggagaagttgtcacctccctacagctccccacaggagtttgcccaggatgtgggccgcatgttcaagcaattcaacaagttaactgaggacaaggcagacgtgcagtccatcatcggcctgcagcgcttcttcgagacgcgcatgaacgaggccttcggtgacaccaagttctctgctgtgctggtggagcccccgccgatgagcctgcctggtgctggcctgagttcccaggagctgtctggtggccctggtgatggcccctgaggctggagcccccatggccagcccagcctggctctgttctctgtcctgtcaccccatccccactcccctggtggcctgactcccactccctggtggccccatcccccagttcctcacgatatggtttttacttctgtggatttaataaaaacttcaccagttgtccacggccccgcccctagtagtagtagcgcccgc

SEQ ID NO: 104204 - DNA, 1860 bp, Homo sapiens
ctacctagcctgacctgctgtgtcccctagaatccgccaggtgtctgacgtacagaagcgtgtgcaagtggatgtcaagatggccatcctgcagatcatgaaggagctgaataagcggggccgtgtgctggtcaatgatgcccagaaggtgactgaggggcagcaggagcgcctggagcggcagcactggaccatgaccaagatccagaagcaccaggagcacattctgcgctttgcctcttgggctctggagagtgacaacaacacagcccttttgctttctaagaagttgatctacttccagctgcaccgggccctcaagatgattgtggatcccgtggagccacatggcgagatgaagtttcagtgggacctcaatgcctggaccaagagtgccgaggcctttggcaagattgtggcagagcgtcctggcactaactcaacaggccctgcacccatggcccctccaagagccccaggcccctgagcaagcagggctctggcagcagccagcccatggaggtgcaggaaggctatggctttgggtcaggagatgatccctactcaagtgcagagccccatgtgtcaggtgtgaaacggtcccgctcaggtgagggcgaggtgagcggccttatgcgcaaggtgccacgagtgagccttgaacgcctggacctggacctcacagctgacagccagccacccgtcttcaaggtcttcccaggcagtaccactgaggactacaaccttattgttattgaacgtggcgctgccgctgcagctaccggccagccagggactgcgcctgcaggaacccctggtgccccacccctggctggcatggccattgtcaaggaggaggagacggaggctgccattggagcccctcctactgccactgagggccctgagaccaaacctgtgcttatggctcttgcggagggtcctggtgctgagggtccccgcctggcctcacctagtggcagcaccagctcagggctggaggtggtggctcctgagggtacctcagccccaggtggtggcccgggaaccctggatgacagtgccaccatttgccgtgtctgccagaagccaggcgatctggttatgtgcaaccagtgtgagttttgtttccacctggactgtcacctgccggccctgcaggatgtaccaggggaggagtggagctgctcactctgccatgtgctccctgacctgaaggaggaggatggcagcctcagcctggatggtgcagacagcactggcgtggtggccaagctctcaccagccaaccagcggaaatgtgagcgtgtactgctggccctattctgtcacgaaccctgccgccccctgcatcagctggctaccgactccaccttctccctggaccagcccggtggcaccctggatctgaccctgatccgtgcccgcctccaggagaagttgtcacctccctacagctccccacaggagtttgcccaggatgtgggccgcatgttcaagcaattcaacaagttaactgaggacaaggcagacgtgcagtccatcatcggcctgcagcgcttcttcgagacgcgcatgaacgaggccttcggtgacaccaagttctctgctgtgctggtggagcccccgccgatgagcctgcctggtgctggcctgagttcccaggagctgtctggtggccctggtgatggcccctgaggctggagcccccatggccagcccagcctggctctgttctctgtcctgtcaccccatccccactcccctggtggcctgactcccactccctggtggccccatcccccagttcctcacgatatggtttttacttctgtggatttaataaaaacttcaccagtt

SEQ ID NO: 104205 - DNA, 3282 bp, Homo sapiens
cggcggcgaagagacgcgggttgaggaagagggacggattgcccatgcgcttgggcgcacagcggcccgcttctgtgtggtctggaggtggagctgagaggggaatcacactctataaaggttcgcataccccactggcggattcaattgcggcagtgacgtcacagaggccccgccccgcccccacaagagccccaccgacgtggggttggcggtggtggaaggactaggagttggcgcgtgcgtactggcggcctctcccgcaccgaccggcctgggccccgcccccgggcgtgaggcgcccaatgcgcgtgcgcggcggcgtcggcgccagttatttctgtcccgccccccggcctcggctctttctgcgagcgggcgcgcgggcgagcggttgtgcttgtgcttgtggcgcgtggtgcgggtttcggcggcggctgaggaagaagcgcgggcggcgccttcgggaggcgagcaggcagcagttggccgtgccgtagcagcgtcccgcgcgcggcgggcagcggcccaggaggcgcgtggcggcgctcggcctcgcggcggcggcggcggcagcggcccagcagttggcggcgagcgcgtctgcgcctgcgcggcgggccccgcgcccctcctccccccctgggcgcccccggcggcgtgtgaatggcggcctccgcggcggcagcctcggcagcagcggcctcggccgcctctggcagcccgggcccgggcgagggctccgctggcggcgaaaagcgctccaccgccccttcggccgcagcctcggcctctgcctcagccgcggcgtcgtcgcccgcggggggcggcgccgaggcgctggagctgctggagcactgcggcgtgtgcagagagcgcctgcgacccgagagggagccccgcctgctgccctgtttgcactcggcctgtagtgcctgcttagggcccgcggcccccgccgccgccaacagctcgggggacggcggggcggcgggcgacggcaccgtggtggactgtcccgtgtgcaagcaacagtgcttctccaaagacatcgtggagaattatttcatgcgtgatagtggcagcaaggctgccaccgacgcccaggatgcgaaccagtgctgcactagctgtgaggataatgccccagccaccagctactgtgtggagtgctcggagcctctgtgtgagacctgtgtagaggcgcaccagcgggtgaagtacaccaaggaccatactgtgcgctctactgggccagccaagtctcgggatggtgaacgtactgtctattgcaacgtacacaagcatgaaccccttgtgctgttttgtgagagctgtgatactctcacctgccgagactgccagctcaatgcccacaaggaccaccagtaccagttcttagaggatgcagtgaggaaccagcgcaagctcctggcctcactggtgaagcgccttggggacaaacatgcaacattgcagaagagcaccaaggaggttcgcagctcaatccgccaggtgtctgacgtacagaagcgtgtgcaagtggatgtcaagatggccatcctgcagatcatgaaggagctgaataagcggggccgtgtgctggtcaatgatgcccagcaagatccagaagcaccaggagcacattctgcgctttgcctcttgggctctggagagtgacaacaacacagcccttttgctttctaagaagttgatctacttccagctgcaccgggccctcaagatgattgtggatcccgtggagccacatggcgagatgaagtttcagtgggacctcaatgcctggaccaagagtgccgaggcctttggcaagattgtggcagagcgtcctggcactaactcaacaggccctgcacccatggcccctccaagagccccaggcccctgagcaagcagggctctggcagcagccagcccatggaggtgcaggaaggctatggctttgggtcaggagatgatccctactcaagtgcagagccccatgtgtcaggtgtgaaacggtcccgctcaggtgagggcgaggtgagcggccttatgcgcaaggtgccacgagtgagccttgaacgcctggacctggacctcacagctgacagccagccacccgtcttcaaggtcttcccaggcagtaccactgaggactacaaccttattgttattgaacgtggcgctgccgctgcagctaccggccagccagggactgcgcctgcaggaacccctggtgccccacccctggctggcatggccattgtcaaggaggaggagacggaggctgccattggagcccctcctactgccactgagggccctgagaccaaacctgtgcttatggctcttgcggagggtcctggtgctgagggtccccgcctggcctcacctagtggcagcaccagctcagggctggaggtggtggctcctgagggtacctcagccccaggtggtggcccgggaaccctggatgacagtgccaccatttgccgtgtctgccagaagccaggcgatctggttatgtgcaaccagtgtgagttttgtttccacctggactgtcacctgccggccctgcaggatgtaccaggggaggagtggagctgctcactctgccatgtgctccctgacctgaaggaggaggatggcagcctcagcctggatggtgcagacagcactggcgtggtggccaagctctcaccagccaaccagcggaaatgtgagcgtgtactgctggccctattctgtcacgaaccctgccgccccctgcatcagctggctaccgactccaccttctccctggaccagcccggtggcaccctggatctgaccctgatccgtgcccgcctccaggagaagttgtcacctccctacagctccccacaggagtttgcccaggatgtgggccgcatgttcaagcaattcaacaagttaactgaggacaaggcagacgtgcagtccatcatcggcctgcagcgcttcttcgagacgcgcatgaacgaggccttcggtgacaccaagttctctgctgtgctggtggagcccccgccgatgagcctgcctggtgctggcctgagttcccaggagctgtctggtggccctggtgatggcccctgaggctggagcccccatggccagcccagcctggctctgttctctgtcctgtcaccccatccccactcccctggtggcctgactcccactccctggtggccccatcccccagttcctcacgatatggtttttacttctgtggatttaataaaaacttcaccagtt

SEQ ID NO: 104206 - DNA, 3444 bp, Homo sapiens
cggcggcgaagagacgcgggttgaggaagagggacggattgcccatgcgcttgggcgcacagcggcccgcttctgtgtggtctggaggtggagctgagaggggaatcacactctataaaggttcgcataccccactggcggattcaattgcggcagtgacgtcacagaggccccgccccgcccccacaagagccccaccgacgtggggttggcggtggtggaaggactaggagttggcgcgtgcgtactggcggcctctcccgcaccgaccggcctgggccccgcccccgggcgtgaggcgcccaatgcgcgtgcgcggcggcgtcggcgccagttatttctgtcccgccccccggcctcggctctttctgcgagcgggcgcgcgggcgagcggttgtgcttgtgcttgtggcgcgtggtgcgggtttcggcggcggctgaggaagaagcgcgggcggcgccttcgggaggcgagcaggcagcagttggccgtgccgtagcagcgtcccgcgcgcggcgggcagcggcccaggaggcgcgtggcggcgctcggcctcgcggcggcggcggcggcagcggcccagcagttggcggcgagcgcgtctgcgcctgcgcggcgggccccgcgcccctcctccccccctgggcgcccccggcggcgtgtgaatggcggcctccgcggcggcagcctcggcagcagcggcctcggccgcctctggcagcccgggcccgggcgagggctccgctggcggcgaaaagcgctccaccgccccttcggccgcagcctcggcctctgcctcagccgcggcgtcgtcgcccgcggggggcggcgccgaggcgctggagctgctggagcactgcggcgtgtgcagagagcgcctgcgacccgagagggagccccgcctgctgccctgtttgcactcggcctgtagtgcctgcttagggcccgcggcccccgccgccgccaacagctcgggggacggcggggcggcgggcgacggcaccgtggtggactgtcccgtgtgcaagcaacagtgcttctccaaagacatcgtggagaattatttcatgcgtgatagtggcagcaaggctgccaccgacgcccaggatgcgaaccagtgctgcactagctgtgaggataatgccccagccaccagctactgtgtggagtgctcggagcctctgtgtgagacctgtgtagaggcgcaccagcgggtgaagtacaccaaggaccatactgtgcgctctactgggccagccaagtctcgggatggtgaacgtactgtctattgcaacgtacacaagcatgaaccccttgtgctgttttgtgagagctgtgatactctcacctgccgagactgccagctcaatgcccacaaggaccaccagtaccagttcttagaggatgcagtgaggaaccagcgcaagctcctggcctcactggtgaagcgccttggggacaaacatgcaacattgcagaagagcaccaaggaggttcgcagctcaatccgccaggtgtctgacgtacagaagcgtgtgcaagtggatgtcaagatggccatcctgcagatcatgaaggagctgaataagcggggccgtgtgctggtcaatgatgcccagaaggtgactgaggggcagcaggagcgcctggagcggcagcactggaccatgaccaagatccagaagcaccaggagcacattctgcgctttgcctcttgggctctggagagtgacaacaacacagcccttttgctttctaagaagttgatctacttccagctgcaccgggccctcaagatgattgtggatcccgtggagccacatggcgagatgaagtttcagtgggacctcaatgcctggaccaagagtgccgaggcctttggcaagattgtggcagagcgtcctggcactaactcaacaggccctgcacccatggcccctccaagagccccaggcccctgagcaagcagggctctggcagcagccagcccatggaggtgcaggaaggctatggctttgggtcaggagatgatccctactcaagtgcagagccccatgtgtcaggtgtgaaacggtcccgctcaggtgagggcgaggtgagcggccttatgcgcaaggtgccacgagtgagccttgaacgcctggacctggacctcacagctgacagccagccacccgtcttcaaggtcttcccaggcagtaccactgaggactacaaccttattgttattgaacgtggcgctgccgctgcagctaccggccagccagggactgcgcctgcaggaacccctggtgccccacccctggctggcatggccattgtcaaggaggaggagacggaggctgccattggagcccctcctactgccactgagggccctgagaccaaacctgtgcttatggctcttgcggagggtcctggtgctgagggtccccgcctggcctcacctagtggcagcaccagctcagggctggaggtggtggctcctgagggtacctcagccccaggtggtggcccgggaaccctggatgacagtgccaccatttgccgtgtctgccagaagccaggcgatctggttatgtgcaaccagtgtgagttttgtttccacctggactgtcacctgccggccctgcaggatgtaccaggggaggagtggagctgctcactctgccatgtgctccctgacctgaaggaggaggatggcagcctcagcctggatggtgcagacagcactggcgtggtggccaagctctcaccagccaaccagcggaaatgtgagcgtgtactgctggccctattctgtcacgaaccctgccgccccctgcatcagctggctaccgactccaccttctccctggtgagtcctaggatgggaaaggggaagggggtggtggctgctgggtctcgccctcaacctgtgcatgtatatgtgtgtctttgtgtgtgtatgtgtgatctctgccctggaccagcccggtggcaccctggatctgaccctgatccgtgcccgcctccaggagaagttgtcacctccctacagctccccacaggagtttgcccaggatgtgggccgcatgttcaagcaattcaacaagttaactgaggacaaggcagacgtgcagtccatcatcggcctgcagcgcttcttcgagacgcgcatgaacgaggccttcggtgacaccaagttctctgctgtgctggtggagcccccgccgatgagcctgcctggtgctggcctgagttcccaggagctgtctggtggccctggtgatggcccctgaggctggagcccccatggccagcccagcctggctctgttctctgtcctgtcaccccatccccactcccctggtggcctgactcccactccctggtggccccatcccccagttcctcacgatatggtttttacttctgtggatttaataaaaacttcaccagtt

SEQ ID NO: 104207 - DNA, 1625 bp, Homo sapiens
cggtaagctacgtcgaccagcgtcgaacaaacatccgttgcgctttctatgaagttgatctacttccagctgcaccgggccctcaagatgattgtggatcccgtggagccacatggcgagatgaagtttcagtgggacctcaatgcctggaccaagagtgccgaggcctttggcaagattgtggcagagcgtcctggcactaactcaacaggccctgcacccatggcccctccaagagccccaggcccctgagcaagcagggctctggcagcagccagcccatggaggtgcaggaaggctatggctttgggtcaggagatgatccctactcaagtgcagagccccatgtgtcaggtgtgaaacggtcccgctcaggtgagggcgaggtgagcggccttatgcgcaaggtgccacgagtgagccttgaacgcctggacctggacctcacagctgacagccagccacccgtcttcaaggtcttcccaggcagtaccactgaggactacaaccttattgttattgaacgtggcgctgccgctgcagctaccggccagccagggactgcgcctgcaggaacccctggtgccccacccctggctggcatggccattgtcaaggaggaggagacggaggctgccattggagcccctcctactgccactgagggccctgagaccaaacctgtgcttatggctcttgcggagggtcctggtgctgagggtccccgcctggcctcacctagtggcagcaccagctcagggctggaggtggtggctcctgagggtacctcagccccaggtggtggcccgggaaccctggatgacagtgccaccatttgccgtgtctgccagaagccaggcgatctggttatgtgcaaccagtgtgagttttgtttccacctggactgtcacctgccggccctgcaggatgtaccaggggaggagtggagctgctcactctgccatgtgctccctgacctgaaggaggaggatggcagcctcagcctggatggtgcagacagcactggcgtggtggccaagctctcaccagccaaccagcggaaatgtgagcgtgtactgctggccctattctgtcacgaaccctgccgccccctgcatcagctggctaccgactccaccttctccctggaccagcccggtggcaccctggatctgaccctgatccgtgcccgcctccaggagaagttgtcacctccctacagctccccacaggagtttgcccaggatgtgggccgcatgttcaagcaattcaacaagttaactgaggacaaggcagacgtgcagtccatcatcggcctgcagcgcttcttcgagacgcgcatgaacgaggccttcggtgacaccaagttctctgctgtgctggtggagcccccgccgatgagcctgcctggtgctggcctgagttcccaggagctgtctggtggccctggtgatggcccctgaggctggagcccccatggccagcccagcctggctctgttctctgtcctgtcaccccatccccactcccctggtggcctgactcccactccctggtggccccatcccccagttcctcacgatatggtttttacttctgtggatttaataaaaacttcaccagtt

SEQ ID NO: 104208 - DNA, 3484 bp, Homo sapiens
cggcggcgaagagacgcgggttgaggaagagggacggattgcccatgcgcttgggcgcacagcggcccgcttctgtgtggtctggaggtggagctgagaggggaatcacactctataaaggttcgcataccccactggcggattcaattgcggcagtgacgtcacagaggccccgccccgcccccacaagagccccaccgacgtggggttggcggtggtggaaggactaggagttggcgcgtgcgtactggcggcctctcccgcaccgaccggcctgggccccgcccccgggcgtgaggcgcccaatgcgcgtgcgcggcggcgtcggcgccagttatttctgtcccgccccccggcctcggctctttctgcgagcgggcgcgcgggcgagcggttgtgcttgtgcttgtggcgcgtggtgcgggtttcggcggcggctgaggaagaagcgcgggcggcgccttcgggaggcgagcaggcagcagttggccgtgccgtagcagcgtcccgcgcgcggcgggcagcggcccaggaggcgcgtggcggcgctcggcctcgcggcggcggcggcggcagcggcccagcagttggcggcgagcgcgtctgcgcctgcgcggcgggccccgcgcccctcctccccccctgggcgcccccggcggcgtgtgaatggcggcctccgcggcggcagcctcggcagcagcggcctcggccgcctctggcagcccgggcccgggcgagggctccgctggcggcgaaaagcgctccaccgccccttcggccgcagcctcggcctctgcctcagccgcggcgtcgtcgcccgcggggggcggcgccgaggcgctggagctgctggagcactgcggcgtgtgcagagagcgcctgcgacccgagagggagccccgcctgctgccctgtttgcactcggcctgtagtgcctgcttagggcccgcggcccccgccgccgccaacagctcgggggacggcggggcggcgggcgacggcaccgtggtggactgtcccgtgtgcaagcaacagtgcttctccaaagacatcgtggagaattatttcatgcgtgatagtggcagcaaggctgccaccgacgcccaggatgcgaaccagtgctgcactagctgtgaggataatgccccagccaccagctactgtgtggagtgctcggagcctctgtgtgagacctgtgtagaggcgcaccagcgggtgaagtacaccaaggaccatactgtgcgctctactgggccagccaagtctcgggatggtgaacgtactgtctattgcaacgtacacaagcatgaaccccttgtgctgttttgtgagagctgtgatactctcacctgccgagactgccagctcaatgcccacaaggaccaccagtaccagttcttagaggatgcagtgaggaaccagcgcaagctcctggcctcactggtgaagcgccttggggacaaacatgcaacattgcagaagagcaccaaggaggttcgcagctcaatccgccaggtgtctgacgtacagaagcgtgtgcaagtggatgtcaagatggccatcctgcagatcatgaaggagctgaataagcggggccgtgtgctggtcaatgatgcccagaaggtgactgaggggcagcaggagcgcctggagcggcagcactggaccatgaccaagatccagaagcaccaggagcacattctgcgctttgcctcttgggctctggagagtgacaacaacacagcccttttgctttctaagaagttgatctacttccagctgcaccgggccctcaagatgattgtggatcccgtggagccacatggcgagatgaagtttcagtgggacctcaatgcctggaccaagagtgccgaggcctttggcaagattgtggcagagcgtcctggcactaactcaacaggccctgcacccatggcccctccaagagccccaggcccctgagcaagcagggctctggcagcagccagcccatggaggtgcaggaaggctatggctttgggtcaggagatgatccctactcaagtgcagagccccatgtgtcaggtgtgaaacggtcccgctcaggtgagggcgaggtgagcggccttatgcgcaaggtgccacgagtgagccttgaacgcctggacctggacctcacagctgacagccagccacccgtcttcaaggtcttcccaggcagtaccactgaggactacaaccttattgttattgaacgtggcgctgccgctgcagctaccggccagccagggactgcgcctgcaggaacccctggtgccccacccctggctggcatggccattgtcaaggaggaggagacggaggctgccattggagcccctcctactgccactgagggccctgagaccaaacctgtgcttatggctcttgcggagggtcctggtgctgagggtccccgcctggcctcacctagtggcagcaccagctcagggctggaggtggtggctcctgagggtacctcagccccaggtggtggcccgggaaccctggatgacagtgccaccatttgccgtgtctgccagaagccaggcgatctggttatgtgcaaccagtgtgagttttgtttccacctggactgtcacctgccggccctgcaggatgtaccaggggaggagtggagctgctcactctgccatgtgctccctgacctgaaggaggaggatggcagcctcagcctggatggtgcagacagcactggcgtggtggccaagctctcaccagccaaccagcggaaatgtgagcgtgtactgctggccctattctgtcacgaaccctgccgccccctgcatcagctggctaccgactccaccttctccctggaccagcccggtggcaccctggatctgaccctgatccgtgcccgcctccaggagaagttgtcacctccctacagctccccacaggagtttgcccaggatgtgggccgcatgttcaagcaattcaacaagttaactgaggtgagccagtggaatggagaggctgtgggcagggggagatgtgaaggaaagaactaggacccattcatccactgcattcctgcttggcccaggacaaggcagacgtgcagtccatcatcggcctgcagcgcttcttcgagacgcgcatgaacgaggccttcggtgacaccaagttctctgctgtgctggtggagcccccgccgatgagcctgcctggtgctggcctgagttcccaggagctgtctggtggccctggtgatggcccctgaggctggagcccccatggccagcccagcctggctctgttctctgtcctgtcaccccatccccactcccctggtggcctgactcccactccctggtggccccatcccccagttcctcacgatatggtttttacttctgtggatttaataaaaacttcaccagttcctcaggcgttggctggttgggggactgtggtcctggggcctggtttattgactgta

SEQ ID NO: 104209 - DNA, 3612 bp, Homo sapiens
  misc_feature (3468)..(3468): n is a, c, g, or t
cggcggcgaagagacgcgggttgaggaagagggacggattgcccatgcgcttgggcgcacagcggcccgcttctgtgtggtctggaggtggagctgagaggggaatcacactctataaaggttcgcataccccactggcggattcaattgcggcagtgacgtcacagaggccccgccccgcccccacaagagccccaccgacgtggggttggcggtggtggaaggactaggagttggcgcgtgcgtactggcggcctctcccgcaccgaccggcctgggccccgcccccgggcgtgaggcgcccaatgcgcgtgcgcggcggcgtcggcgccagttatttctgtcccgccccccggcctcggctctttctgcgagcgggcgcgcgggcgagcggttgtgcttgtgcttgtggcgcgtggtgcgggtttcggcggcggctgaggaagaagcgcgggcggcgccttcgggaggcgagcaggcagcagttggccgtgccgtagcagcgtcccgcgcgcggcgggcagcggcccaggaggcgcgtggcggcgctcggcctcgcggcggcggcggcggcagcggcccagcagttggcggcgagcgcgtctgcgcctgcgcggcgggccccgcgcccctcctccccccctgggcgcccccggcggcgtgtgaatggcggcctccgcggcggcagcctcggcagcagcggcctcggccgcctctggcagcccgggcccgggcgagggctccgctggcggcgaaaagcgctccaccgccccttcggccgcagcctcggcctctgcctcagccgcggcgtcgtcgcccgcggggggcggcgccgaggcgctggagctgctggagcactgcggcgtgtgcagagagcgcctgcgacccgagagggagccccgcctgctgccctgtttgcactcggcctgtagtgcctgcttagggcccgcggcccccgccgccgccaacagctcgggggacggcggggcggcgggcgacggcaccgtggtggactgtcccgtgtgcaagcaacagtgcttctccaaagacatcgtggagaattatttcatgcgtgatagtggcagcaaggctgccaccgacgcccaggatgcgaaccagtgctgcactagctgtgaggataatgccccagccaccagctactgtgtggagtgctcggagcctctgtgtgagacctgtgtagaggcgcaccagcgggtgaagtacaccaaggaccatactgtgcgctctactgggccagccaagtctcgggatggtgaacgtactgtctattgcaacgtacacaagcatgaaccccttgtgctgttttgtgagagctgtgatactctcacctgccgagactgccagctcaatgcccacaaggaccaccagtaccagttcttagaggatgcagtgaggaaccagcgcaagctcctggcctcactggtgaagcgccttggggacaaacatgcaacattgcagaagagcaccaaggaggttcgcagctcaatccgccaggtgtctgacgtacagaagcgtgtgcaagtggatgtcaagatggccatcctgcagatcatgaaggagctgaataagcggggccgtgtgctggtcaatgatgcccagaaggtgactgaggggcagcaggagcgcctggagcggcagcactggaccatgaccaagatccagaagcaccaggagcacattctgcgctttgcctcttgggctctggagagtgacaacaacacagcccttttgctttctaagaagttgatctacttccagctgcaccgggccctcaagatgattgtggatcccgtggagccacatggcgagatgaagtttcagtgggacctcaatgcctggaccaagagtgccgaggcctttggcaagattgtggcagagcgtcctggcactaactcaacaggccctgcacccatggcccctccaagagccccaggcccctgagcaagcagggctctggcagcagccagcccatggaggtgcaggaaggctatggctttgggtcaggagatgatccctactcaagtgcagagccccatgtgtcaggtgtgaaacggtcccgctcaggtgagggcgaggtgagcggccttatgcgcaaggtgccacgagtgagccttgaacgcctggacctggacctcacagctgacagccagccacccgtcttcaaggtcttcccaggcagtaccactgaggactacaaccttattgttattgaacgtggcgctgccgctgcagctaccggccagccagggactgcgcctgcaggaacccctggtgccccacccctggctggcatggccattgtcaaggaggaggagacggaggctgccattggagcccctcctactgccactgagggccctgagaccaaacctgtgcttatggctcttgcggagggtcctggtgctgagggtccccgcctggcctcacctagtggcagcaccagctcagggctggaggtggtggctcctgagggtacctcagccccaggtggtggcccgggaaccctggatgacagtgccaccatttgccgtgtctgccagaagccaggcgatctggttatgtgcaaccagtgtgagttttgtttccacctggactgtcacctgccggccctgcaggatgtaccaggggaggagtggagctgctcactctgccatgtgctccctgacctgaaggaggaggatggcagcctcagcctggatggtgcagacagcactggcgtggtggccaagctctcaccagccaaccagcggaaatgtgagcgtgtactgctggccctattctgtcacgaaccctgccgccccctgcatcagctggctaccgactccaccttctccctggtgagtcctaggatgggaaaggggaagggggtggtggctgctgggtctcgccctcaacctgtgcatgtatatgtgtgtctttgtgtgtgtatgtgtgatctctgccctggaccagcccggtggcaccctggatctgaccctgatccgtgcccgcctccaggagaagttgtcacctccctacagctccccacaggagtttgcccaggatgtgggccgcatgttcaagcaattcaacaagttaactgaggacaaggcagacgtgcagtccatcatcggcctgcagcgcttcttcgagacgcgcatgaacgaggccttcggtgacaccaagttctctgctgtgctggtggagcccccgccgatgagcctgcctggtgctggcctgagttcccaggagctgtctggtggccctggtgatggcccctgaggctggagcccccatggccagcccagcctggctctgttctctgtcctgtcaccccatccccactcccctggtggcctgactcccactccctggtggccccatcccccagttcctcacgatatggtttttacttctgtggatttaataaaaacttcaccagttaaaaaaaaaaaaaaaaaaaaaaanaaaaaaaaaggaaaagaaaaaaaaaaaaaaaggagagcaaaagcaagaaaaagaaaacacaagaaaaggcgagaaaaaaaaaaaaaaaaagagcggcggccgagcacgcaaagacctccccgggggggcagtaaatagcgagcg

SEQ ID NO: 104210 - DNA, 3037 bp, Homo sapiens
cggcggcgaagagacgcgggttgaggaagagggacggattgcccatgcgcttgggcgcacagcggcccgcttctgtgtggtctggaggtggagctgagaggggaatcacactctataaaggttcgcataccccactggcggattcaattgcggcagtgacgtcacagaggccccgccccgcccccacaagagccccaccgacgtggggttggcggtggtggaaggactaggagttggcgcgtgcgtactggcggcctctcccgcaccgaccggcctgggccccgcccccgggcgtgaggcgcccaatgcgcgtgcgcggcggcgtcggcgccagttatttctgtcccgccccccggcctcggctctttctgcgagcgggcgcgcgggcgagcggttgtgcttgtgcttgtggcgcgtggtgcgggtttcggcggcggctgaggaagaagcgcgggcggcgccttcgggaggcgagcaggcagcagttggccgtgccgtagcagcgtcccgcgcgcggcgggcagcggcccaggaggcgcgtggcggcgctcggcctcgcggcggcggcggcggcagcggcccagcagttggcggcgagcgcgtctgcgcctgcgcggcgggccccgcgcccctcctccccccctgggcgcccccggcggcgtgtgaatggcggcctccgcggcggcagcctcggcagcagcggcctcggccgcctctggcagcccgggcccgggcgagggctccgctggcggcgaaaagcgctccaccgccccttcggccgcagcctcggcctctgcctcagccgcggcgtcgtcgcccgcggggggcggcgccgaggcgctggagctgctggagcactgcggcgtgtgcagagagcgcctgcgacccgagagggagccccgcctgctgccctgtttgcactcggcctgtagtgcctgcttagggcccgcggcccccgccgccgccaacagctcgggggacggcggggcggcgggcgacggcaccgtggtggactgtcccgtgtgcaagcaacagtgcttctccaaagacatcgtggagaattatttcatgcgtgatagtggcagcaaggctgccaccgacgcccaggatgcgaaccagtgctgcactagctgtgaggataatgccccagccaccagctactgtgtggagtgctcggagcctctgtgtgagacctgtgtagaggcgcaccagcgggtgaagtacaccaaggaccatactgtgcgctctactgggccagccaagtctcgggatggtgaacgtactgtctattgcaacgtacacaagcatgaaccccttgtgctgttttgtgagagctgtgatactctcacctgccgagactgccagctcaatgcccacaaggaccaccagtaccagttcttagaggatgcagtgaggaaccagcgcaagctcctggcctcactggtgaagcgccttggggacaaacatgcaacattgcagaagagcaccaaggaggttcgcagctcaatccgccaggtgtctgacgtacagaagcgtgtgcaagtggatgtcaagatggccatcctgcagatcatgaaggagctgaataagcggggccgtgtgctggtcaatgatgcccagaaggtgactgaggggcagcaggagcgcctggagcggcagcactggaccatgaccaagatccagaagcaccaggagcacattctgcgctttgcctcttgggctctggagagtgacaacaacacagcccttttgctttctaagaagttgatctacttccagctgcaccgggccctcaagatgattgtggatcccgtggagccacatggcgagatgaagtttcagtgggacctcaatgcctggaccaagagtgccgaggcctttggcaagattgtggcagagcgtcctggcactaactcaacaggccctgcacccatggcccctccaagagccccaggcccctgagcaagcagggctctggcagcagccagcccatggaggtgcaggaaggctatggctttgggtcaggagatgatccctactcaagtgcagagccccatgtgtcaggtgtgaaacggtcccgctcaggtgagggcgaggtgagcggccttatgcgcaaggtgccacgagtgagccttgaacgcctggacctggacctcacagctgacagccagccacccgtcttcaaggtcttcccaggcagtaccactgaggactacaaccttattgttattgaacgtggcgctgccgctgcagctaccggccagccagggactgcgcctgcaggaacccctggtgccccacccctggctggcatggccattgtcaaggaggaggagacggaggctgcatggaggagtggagctgctcactctgccatgtgctccctgacctgaaggaggaggatggcagcctcagcctggatggtgcagacagcactggcgtggtggccaagctctcaccagccaaccagcggaaatgtgagcgtgtactgctggccctattctgtcacgaaccctgccgccccctgcatcagctggctaccgactccaccttctccctggaccagcccggtggcaccctggatctgaccctgatccgtgcccgcctccaggagaagttgtcacctccctacagctccccacaggagtttgcccaggatgtgggccgcatgttcaagcaattcaacaagttaactgaggacaaggcagacgtgcagtccatcatcggcctgcagcgcttcttcgagacgcgcatgaacgaggccttcggtgacaccaagttctctgctgtgctggtggagcccccgccgatgagcctgcctggtgctggcctgagttcccaggagctgtctggtggccctggtgatggcccctgaggctggagcccccatggccagcccagcctggctctgttctctgtcctgtcaccccatccccactcccctggtggcctgactcccactccctggtggccccatcccccagttcctcacgatatggtttttacttctgtggatttaataaaaacttcaccagtt

SEQ ID NO: 104211 - DNA, 3009 bp, Homo sapiens
  misc_feature (2890)..(2890): n is a, c, g, or t
  misc_feature (2896)..(2896): n is a, c, g, or t
cggcggcgaagagacgcgggttgaggaagagggacggattgcccatgcgcttgggcgcacagcggcccgcttctgtgtggtctggaggtggagctgagaggggaatcacactctataaaggttcgcataccccactggcggattcaattgcggcagtgacgtcacagaggccccgccccgcccccacaagagccccaccgacgtggggttggcggtggtggaaggactaggagttggcgcgtgcgtactggcggcctctcccgcaccgaccggcctgggccccgcccccgggcgtgaggcgcccaatgcgcgtgcgcggcggcgtcggcgccagttatttctgtcccgccccccggcctcggctctttctgcgagcgggcgcgcgggcgagcggttgtgcttgtgcttgtggcgcgtggtgcgggtttcggcggcggctgaggaagaagcgcgggcggcgccttcgggaggcgagcaggcagcagttggccgtgccgtagcagcgtcccgcgcgcggcgggcagcggcccaggaggcgcgtggcggcgctcggcctcgcggcggcggcggcggcagcggcccagcagttggcggcgagcgcgtctgcgcctgcgcggcgggccccgcgcccctcctccccccctgggcgcccccggcggcgtgtgaatggcggcctccgcggcggcagcctcggcagcagcggcctcggccgcctctggcagcccgggcccgggcgagggctccgctggcggcgaaaagcgctccaccgccccttcggccgcagcctcggcctctgcctcagccgcggcgtcgtcgcccgcggggggcggcgccgaggcgctggagctgctggagcactgcggcgtgtgcagagagcgcctgcgacccgagagggagccccgcctgctgccctgtttgcactcggcctgtagtgcctgcttagggcccgcggcccccgccgccgccaacagctcgggggacggcggggcggcgggcgacggcaccgtggtggactgtcccgtgtgcaagcaacagtgcttctccaaagacatcgtggagaattatttcatgcgtgatagtggcagcaaggctgccaccgacgcccaggatgcgaaccagtgctgcactagctgtgaggataatgccccagccaccagctactgtgtggagtgctcggagcctctgtgtgagacctgtgtagaggcgcaccagcgggtgaagtacaccaaggaccatactgtgcgctctactgggccagccaagtctcgggatggtgaacgtactgtctattgcaacgtacacaagcatgaaccccttgtgctgttttgtgagagctgtgatactctcacctgccgagactgccagctcaatgcccacaaggaccaccagtaccagttcttagaggatgcagtgaggaaccagcgcaagctcctggcctcactggtgaagcgccttggggacaaacatgcaacattgcagaagagcaccaaggaggttcgcagctcaatccgccaggtgtctgacgtacagaagcgtgtgcaagtggatgtcaagatggccatcctgcagatcatgaaggagctgaataagcggggccgtgtgctggtcaatgatgcccagaaggtgactgaggggcagcaggagcgcctggagcggcagcactggaccatgaccaagatccagaagcaccaggagcacattctgcgctttgcctcttgggctctggagagtgacaacaacacagcccttttgctttctaagaagttgatctacttccagctgcaccgggccctcaagatgattgtggatcccgtggagccacatggcgagatgaagtttcagtgggacctcaatgcctggaccaagagtgccgaggcctttggcaagattgtggcagagcgtcctggcactaactcaacaggccctgcacccatggcccctccaagagccccaggcccctgagcaagcagggctctggcagcagccagcccatggaggtgcaggaaggctatggctttgggtcaggagatgatccctactcaagtgcagagccccatgtgtcaggtgtgaaacggtcccgctcaggtgagggcgaggtgagcggccttatgcgcaaggtgccacgagtgagccttgaacgcctggacctggacctcacagctgacagccagccacccgtcttcaaggtcttcccaggcagtaccactgaggactacaaccttattgttattgaacgtggcgctgccgctgcagctaccggccagccagggactgcgcctgcaggaacccctggtgccccacccctggctggcatggccattgtcaaggaggaggagacggaggctgccattggagcccctcctactgccactgagggccctgagaccaaacctgtgcttatggctcttgcggagggtcctggtgctgagggtccccgcctggcctcacctagtggcagcaccagctcagggctggaggtggtggctcctgagggtacctcagccccaggtggtggcccgggaaccctggatgacagtgccaccatttgccgtgtctgccagaagccaggcgatctggttatgtgcaaccagtgtgagttttgtttccacctggactgtcacctgccggccctgcaggatgtaccaggggaggagtggagctgctcactctgccatgtgctccctgacctgaaggaggaggatggcagcctcagcctggatggtgcagacagcactggcgtggtggccaagctctcaccagccaaccagcggacacagcggaaatgtgagcgtgtactggtggcctattctgtcacgaacctgcgccctgatcagtggtacgatcactttcctggacagccgtggcctggttgacctgtcgggccgtcggnaagtgnctcctaagcccaaggtgcaggtggggggtcagctccagtctggcggggtcggccagggggggtgagcgaaggtggcacctttgttggcccggtgtgggacagtggtgcggtcc

SEQ ID NO: 104212 - DNA, 2975 bp, Homo sapiens
cggcggcgaagagacgcgggttgaggaagagggacggattgcccatgcgcttgggcgcacagcggcccgcttctgtgtggtctggaggtggagctgagaggggaatcacactctataaaggttcgcataccccactggcggattcaattgcggcagtgacgtcacagaggccccgccccgcccccacaagagccccaccgacgtggggttggcggtggtggaaggactaggagttggcgcgtgcgtactggcggcctctcccgcaccgaccggcctgggccccgcccccgggcgtgaggcgcccaatgcgcgtgcgcggcggcgtcggcgccagttatttctgtcccgccccccggcctcggctctttctgcgagcgggcgcgcgggcgagcggttgtgcttgtgcttgtggcgcgtggtgcgggtttcggcggcggctgaggaagaagcgcgggcggcgccttcgggaggcgagcaggcagcagttggccgtgccgtagcagcgtcccgcgcgcggcgggcagcggcccaggaggcgcgtggcggcgctcggcctcgcggcggcggcggcggcagcggcccagcagttggcggcgagcgcgtctgcgcctgcgcggcgggccccgcgcccctcctccccccctgggcgcccccggcggcgtgtgaatggcggcctccgcggcggcagcctcggcagcagcggcctcggccgcctctggcagcccgggcccgggcgagggctccgctggcggcgaaaagcgctccaccgccccttcggccgcagcctcggcctctgcctcagccgcggcgtcgtcgcccgcggggggcggcgccgaggcgctggagctgctggagcactgcggcgtgtgcagagagcgcctgcgacccgagagggagccccgcctgctgccctgtttgcactcggcctgtagtgcctgcttagggcccgcggcccccgccgccgccaacagctcgggggacggcggggcggcgggcgacggcaccgtggtggactgtcccgtgtgcaagcaacagtgcttctccaaagacatcgtggagaattatttcatgcgtgatagtggcagcaaggctgccaccgacgcccaggatgcgaaccagtgctgcactagctgtgaggataatgccccagccaccagctactgtgtggagtgctcggagcctctgtgtgagacctgtgtagaggcgcaccagcgggtgaagtacaccaaggaccatactgtgcgctctactgggccagccaagtctcgggatggtgaacgtactgtctattgcaacgtacacaagcatgaaccccttgtgctgttttgtgagagctgtgatactctcacctgccgagactgccagctcaatgcccacaaggaccaccagtaccagttcttagaggatgcagtgaggaaccagcgcaagctcctggcctcactggtgaagcgccttggggacaaacatgcaacattgcagaagagcaccaaggaggttcgcagctcaatccgccaggtgtctgacgtacagaagcgtgtgcaagtggatgtcaagatggccatcctgcagatcatgaaggagctgaataagcggggccgtgtgctggtcaatgatgcccagaaggtgactgaggggcagcaggagcgcctggagcggcagcactggaccatgaccaagatccagaagcaccaggagcacattctgcgctttgcctcttgggctctggagagtgacaacaacacagcccttttgctttctaagaagttgatctacttccagctgcaccgggccctcaagatgattgtggatcccgtggagccacatggcgagatgaagtttcagtgggacctcaatgcctggaccaagagtgccgaggcctttggcaagattgtggcagagcgtcctggcactaactcaacaggccctgcacccatggcccctccaagagccccaggcccctgagcaagcagggctctggcagcagccagcccatggaggtgcaggaaggctatggctttgggtcaggagatgatccctactcaagtgcagagccccatgtgtcaggtgtgaaacggtcccgctcaggtgagggcgaggtgagcggccttatgcgcaaggtgccacgagtgagccttgaacgcctggacctggacctcacagctgacagccagccacccgtcttcaaggtcttcccaggcagtaccactgaggactacaaccttattgttattgaacgtggcgctgccgctgcagctaccggccagccagggactgcgcctgcaggaacccctggtgccccacccctggctggcatggccattgtcaaggaggaggagacggaggctgccattggagcccctcctactgccactgagggccctgagaccaaacctgtgcttatggctcttgcggagggtcctggtgctgagggtccccgcctggcctcacctagtggcagcaccagctcagggctggaggtggtggctcctgagggtacctcagccccaggtggtggcccgggaaccctggatgacagtgccaccatttgccgtgtctgccagaagccaggcgatctggttatgtgcaaccagtgtgagttttgtttccacctggactgtcacctgccggccctgcaggatgtaccaggggaggagtggagctgctcactctgccatgtgctccctgacctgaaggaggaggatggcagcctcagcctggatggtgcagacagcactggccccccgccgatgagcctgcctggtgctggcctgagttcccaggagctgtctggtggccctggtgatggcccctgaggctggagcccccatggccagcccagcctggctctgttctctgtcctgtcaccccatccccactcccctggtggcctgactcccactccctggtggccccatcccccagttcctcacgatatggtttttacttctgtggatttaataaaaacttcaccagtt

SEQ ID NO: 104213 - DNA, 1360 bp, Homo sapiens
cgcgatctagaactaggcacctccatgggctggctatggctttgggtcaggagatgatccctactcaagtgcagagccccatgtgtcaggtgtgaaacggtcccgctcaggtgagggcgaggtgagcggccttatgcgcaaggtgccacgagtgagccttgaacgcctggacctggacctcacagctgacagccagccacccgtcttcaaggtcttcccaggcagtaccactgaggactacaaccttattgttattgaacgtggcgctgccgctgcagctaccggccagccagggactgcgcctgcaggaacccctggtgccccacccctggctggcatggccattgtcaaggaggaggagacggaggctgccattggagcccctcctactgccactgagggccctgagaccaaacctgtgcttatggctcttgcggagggtcctggtgctgagggtccccgcctggcctcacctagtggcagcaccagctcagggctggaggtggtggctcctgagggtacctcagccccaggtggtggcccgggaaccctggatgacagtgccaccatttgccgtgtctgccagaagccaggcgatctggttatgtgcaaccagtgtgagttttgtttccacctggactgtcacctgccggccctgcaggatgtaccaggggaggagtggagctgctcactctgccatgtgctccctgacctgaaggaggaggatggcagcctcagcctggatggtgcagacagcactggcgtggtggccaagctctcaccagccaaccagcggaaatgtgagcgtgtactgctggccctattctgtcacgaaccctgccgccccctgcatcagctggctaccgactccaccttctccctggaccagcccggtggcaccctggatctgaccctgatccgtgcccgcctccaggagaagttgtcacctccctacagctccccacaggagtttgcccaggatgtgggccgcatgttcaagcaattcaacaagttaactgaggacaaggcagacgtgcagtccatcatcggcctgcagcgcttcttcgagacgcgcatgaacgaggccttcggtgacaccaagttctctgctgtgctggtggagcccccgccgatgagcctgcctggtgctggcctgagttcccaggagctgtctggtggccctggtgatggcccctgaggctggagcccccatggccagcccagcctggctctgttctctgtcctgtcaccccatccccactcccctggtggcctgactcccactccctggtggccccatcccccagttcctcacgatatggtttttacttctgtggatttaataaaaacttcaccagtt

SEQ ID NO: 104214 - DNA, 856 bp, Homo sapiens
aataagtcatagtgcgaggcgggtgtgaatcgtcagaggcgggaacctggatgacagtgccaccatttgccgtgtctgccagaagccaggcgatctggttatgtgcaaccagtgtgagttttgtttccacctggactgtcacctgccggccctgcaggatgtaccaggggaggagtggagctgctcactctgccatgtgctccctgacctgaaggaggaggatggcagcctcagcctggatggtgcagacagcactggcgtggtggccaagctctcaccagccaaccagcggaaatgtgagcgtgtactgctggccctattctgtcacgaaccctgccgccccctgcatcagctggctaccgactccaccttctccctggaccagcccggtggcaccctggatctgaccctgatccgtgcccgcctccaggagaagttgtcacctccctacagctccccacaggagtttgcccaggatgtgggccgcatgttcaagcaattcaacaagttaactgaggacaaggcagacgtgcagtccatcatcggcctgcagcgcttcttcgagacgcgcatgaacgaggccttcggtgacaccaagttctctgctgtgctggtggagcccccgccgatgagcctgcctggtgctggcctgagttcccaggagctgtctggtggccctggtgatggcccctgaggctggagcccccatggccagcccagcctggctctgttctctgtcctgtcaccccatccccactcccctggtggcctgactcccactccctggtggccccatcccccagttcctcacgatatggtttttacttctgtggatttaataaaaacttcaccagtt

SEQ ID NO: 104215 - DNA, 2590 bp, Homo sapiens
cggcggcgaagagacgcgggttgaggaagagggacggattgcccatgcgcttgggcgcacagcggcccgcttctgtgtggtctggaggtggagctgagaggggaatcacactctataaaggttcgcataccccactggcggattcaattgcggcagtgacgtcacagaggccccgccccgcccccacaagagccccaccgacgtggggttggcggtggtggaaggactaggagttggcgcgtgcgtactggcggcctctcccgcaccgaccggcctgggccccgcccccgggcgtgaggcgcccaatgcgcgtgcgcggcggcgtcggcgccagttatttctgtcccgccccccggcctcggctctttctgcgagcgggcgcgcgggcgagcggttgtgcttgtgcttgtggcgcgtggtgcgggtttcggcggcggctgaggaagaagcgcgggcggcgccttcgggaggcgagcaggcagcagttggccgtgccgtagcagcgtcccgcgcgcggcgggcagcggcccaggaggcgcgtggcggcgctcggcctcgcggcggcggcggcggcagcggcccagcagttggcggcgagcgcgtctgcgcctgcgcggcgggccccgcgcccctcctccccccctgggcgcccccggcggcgtgtgaatggcggcctccgcggcggcagcctcggcagcagcggcctcggccgcctctggcagcccgggcccgggcgagggctccgctggcggcgaaaagcgctccaccgccccttcggccgcagcctcggcctctgcctcagccgcggcgtcgtcgcccgcggggggcggcgccgaggcgctggagctgctggagcactgcggcgtgtgcagagagcgcctgcgacccgagagggagccccgcctgctgccctgtttgcactcggcctgtagtgcctgcttagggcccgcggcccccgccgccgccaacagctcgggggacggcggggcggcgggcgacggcaccgtggtggactgtcccgtgtgcaagcaacagtgcttctccaaagacatcgtggagaattatttcatgcgtgatagtggcagcaaggctgccaccgacgcccaggatgcgaaccagtgctgcactagctgtgaggataatgccccagccaccagctactgtgtggagtgctcggagcctctgtgtgagacctgtgtagaggcgcaccagcgggtgaagtacaccaaggaccatactgtgcgctctactgggccagccaagtctcgggatggtgaacgtactgtctattgcaacgtacacaagcatgaaccccttgtgctgttttgtgagagctgtgatactctcacctgccgagactgccagctcaatgcccacaaggaccaccagtaccagttcttagaggatgcagtgaggaaccagcgcaagctcctggcctcactggtgaagcgccttggggacaaacatgcaacattgcagaagagcaccaaggaggttcgcagctcaatccgccaggtgtctgacgtacagaagcgtgtgcaagtggatgtcaagatggccatcctgcagatcatgaaggagctgaataagcggggccgtgtgctggtcaatgatgcccagaaggtgactgaggggcagcaggagcgcctggagcggcagcactggaccatgaccaagatccagaagcaccaggagcacattctgcgctttgcctcttgggctctggagagtgacaacaacacagcccttttgctttctaagaagttgatctacttccagctgcaccgggccctcaagatgattgtggatcccgtggagccacatggcgagatgaagtttcagtgggacctcaatgcctggaccaagagtgccgaggcctttggcaagattgtggcagagcgtcctggcactaactcaacaggccctgcacccatggcccctccaagagccccaggcccctgagcaagcagggctctggcagcagccagcccatggaggtgcaggaaggctatggctttgggtcaggagatgatccctactcaagtgcagagccccatgtgtcaggtgtgaaacggtcccgacaccagtgaagggaagaagagcgagggacatctatgagcaaggcgcaaagagccgcacacatgcaaagaatgcgccctgcaaataaagcactggcagacccgcaaaaagacttcacggatattacaggcacgtcaaaccgcgggatccaacaactttcggtgacttcgagaagggcgcgctcggcgatcgaccacttcagggaacagaacggcggcccgcgaacggagcaaccacagggtgggcacaccacaccgatcgcgatgggaacatggcgcccgacgcggacgcacaagacgcggcgccaccgggccaacctaatcgcggccgtcggggaggtgaagcgaggagagaatgcggatcgcaaagaagaagaagaagaaaaagccgcgcggaactgagaaaaaccccccgtgctcgcggtcgctgccgcccacacgcgtgccgcacgccgcagccccccgagcgccacacagcggtgcccgacgaggcgacgagcccagcgggcagc

SEQ ID NO: 104216 - DNA, 2120 bp, Homo sapiens
cggcggcgaagagacgcgggttgaggaagagggacggattgcccatgcgcttgggcgcacagcggcccgcttctgtgtggtctggaggtggagctgagaggggaatcacactctataaaggttcgcataccccactggcggattcaattgcggcagtgacgtcacagaggccccgccccgcccccacaagagccccaccgacgtggggttggcggtggtggaaggactaggagttggcgcgtgcgtactggcggcctctcccgcaccgaccggcctgggccccgcccccgggcgtgaggcgcccaatgcgcgtgcgcggcggcgtcggcgccagttatttctgtcccgccccccggcctcggctctttctgcgagcgggcgcgcgggcgagcggttgtgcttgtgcttgtggcgcgtggtgcgggtttcggcggcggctgaggaagaagcgcgggcggcgccttcgggaggcgagcaggcagcagttggccgtgccgtagcagcgtcccgcgcgcggcgggcagcggcccaggaggcgcgtggcggcgctcggcctcgcggcggcggcggcggcagcggcccagcagttggcggcgagcgcgtctgcgcctgcgcggcgggccccgcgcccctcctccccccctgggcgcccccggcggcgtgtgaatggcggcctccgcggcggcagcctcggcagcagcggcctcggccgcctctggcagcccgggcccgggcgagggctccgctggcggcgaaaagcgctccaccgccccttcggccgcagcctcggcctctgcctcagccgcggcgtcgtcgcccgcggggggcggcgccgaggcgctggagctgctggagcactgcggcgtgtgcagagagcgcctgcgacccgagagggagccccgcctgctgccctgtttgcactcggcctgtagtgcctgcttagggcccgcggcccccgccgccgccaacagctcgggggacggcggggcggcgggcgacggcaccgtggtggactgtcccgtgtgcaagcaacagtgcttctccaaagacatcgtggagaattatttcatgcgtgatagtggcagcaaggctgccaccgacgcccaggatgcgaaccagtgctgcactagctgtgaggataatgccccagccaccagctactgtgtggagtgctcggagcctctgtgtgagacctgtgtagaggcgcaccagcgggtgaagtacaccaaggaccatactgtgcgctctactgggccagccaagtctcgggatggtgaacgtactgtctattgcaacgtacacaagcatgaaccccttgtgctgttttgtgagagctgtgatactctcacctgccgagactgccagctcaatgcccacaaggaccaccagtaccagttcttagaggatgcagtgaggaaccagcgcaagctcctggcctcactggtgaagcgccttggggacaaacatgcaacattgcagaagagcaccaaggaggttcgcagctcaatccgccaggtgtctgacgtacagaagcgtgtgcaagtggatgtcaagatggccatcctgcagatcatgaaggagctgaataagcggggccgtgtgctggtcaatgatgcccagaaggtgactgaggggcagcaggagcgcctggagcggcagcactggaccatgaccaagatccagaagcaccaggagcacattctgcgctttgcctcttgggctctggagagtgacaacaacacagcccttttgctttctaagaagttgatctacttccagctgcaccgggccctcaagatgattgtggatcccgtggagccacatggcgagatgaagtttcagtgggacctcaatgcctggaccaagagtgccgaggcctttggcaagattgtggcagagcgtcctggcactaactcaacaggccctgcacccatggcccctccaagagccccaggcccctgagcaagcagggctctggcagcagccagcccatggaggtgcaggaaggctatggctttgggtcaggagatgatccctactcaagtgcagagccccatgtgtcaggtgtgaaacggtccaggtccaggcgttcaaggctcactcgtgcaccttacgcatag

SEQ ID NO: 104217 - DNA, 1303 bp, Homo sapiens
cggcggcgaagagacgcgggttgaggaagagggacggattgcccatgcgcttgggcgcacagcggcccgcttctgtgtggtctggaggtggagctgagaggggaatcacactctataaaggttcgcataccccactggcggattcaattgcggcagtgacgtcacagaggccccgccccgcccccacaagagccccaccgacgtggggttggcggtggtggaaggactaggagttggcgcgtgcgtactggcggcctctcccgcaccgaccggcctgggccccgcccccgggcgtgaggcgcccaatgcgcgtgcgcggcggcgtcggcgccagttatttctgtcccgccccccggcctcggctctttctgcgagcgggcgcgcgggcgagcggttgtgcttgtgcttgtggcgcgtggtgcgggtttcggcggcggctgaggaagaagcgcgggcggcgccttcgggaggcgagcaggcagcagttggccgtgccgtagcagcgtcccgcgcgcggcgggcagcggcccaggaggcgcgtggcggcgctcggcctcgcggcggcggcggcggcagcggcccagcagttggcggcgagcgcgtctgcgcctgcgcggcgggccccgcgcccctcctccccccctgggcgcccccggcggcgtgtgaatggcggcctccgcggcggcagcctcggcagcagcggcctcggccgcctctggcagcccgggcccgggcgagggctccgctggcggcgaaaagcgctccaccgccccttcggccgcagcctcggcctctgcctcagccgcggcgtcgtcgcccgcggggggcggcgccgaggcgctggagctgctggagcactgcggcgtgtgcagagagcgcctgcgacccgagagggagccccgcctgctgccctgtttgcactcggcctgtagtgcctgcttagggcccgcggcccccgccgccgccaacagctcgggggacggcggggcggcgggcgacggcaccgtggtggactgtcccgtgtgcaagcaacagtgcttctccaaagacatcgtggagaattatttcatgcgtgatagtggcagcaaggctgccaccgacgcccaggatgcgaaccagtgctgcactagctgtgaggataatgccccagccaccagctactgtgtggagtgctcggagcctctgtgtgagacctgtgtagaggcgcaccagcgggtgaagtacaccaaggaccatactgtgcgctctactgcgacaccagcgcagtcatcagatcaccacgacaaagtgcaccacgacacag

SEQ ID NO: 104218 - DNA, 178 bp, Homo sapiens
catgaactatattatatattcaatgcaacatcttgagaccttagatagtatccactggccaaatatgagggcaattttgagagtataagtcacaccgaaagcctgtgacagttcagggtagcataagtgatatggattcaactccagcatcactttcttcatcagaaacatctatagg

SEQ ID NO: 104219 - DNA, 250 bp, Homo sapiens
tgagaaagagcacaaaataagtttatttcataggatagaaaaacccatgtgaaagggattttcccagttcagagcaacagagaaaatgggtaataaaagataatagcagaagatacaggcagtcatgctagaatccataaaacatacctacacattcttgctgtaaaataaatctcaaaaagtcccccctcaacagaatggagaatccagaaatcaagctgcacacctgcagccatttgatctttgacaa

SEQ ID NO: 104220 - DNA, 220 bp, Homo sapiens
tccccatatctgaggagaacgtccactgagttcttatctacagttacactagtgaagaacgctgggtctggaatcagaagcctcaggtcttagttctgtcatcaactattttgcgaccttggacaaaagacttgatcactcacagtcccagtttcccacaaggttactgtaaagcacacaatttaaaaaaagacaaaatacacataatagtatgttaact

SEQ ID NO: 104221 - DNA, 168 bp, Homo sapiens
tctccttccattccctttggaacccacccccactagggttccatctctatcactccactgcaactgctcttgtcaaggtcacctgaaaagacttaatgttaaatttgttatcaatgctcagccctatctcctttgacctatcagccagcagtatgcaacacagttaat

SEQ ID NO: 104222 - DNA, 389 bp, Homo sapiens
ggtgacagagatgtttagaatcaggaatcttgtgtatttagggaacccactggtgtaagaaaaggagttgttaatgttggtgctgtatagccagggccgtgggaatatgtgtatgtaaacggtgggagacaacttctgcttcaagctctaccttccctcttctaacctgtattggaattcaaaattcaatacaccaagcactttctccctgtcttcttcccacctcctaattttgttctcaggagaatctgttcatttccagggcctctgaggtatagcacccttatgattatgccaaaaattaaaatattcacagtgtcaggggaagtagaatgaatatgtgatgctggtatatgtaggtgatagggagtggtgggagctgtggtgaa

SEQ ID NO: 104223 - DNA, 176 bp, Homo sapiens
ctgccccttctgtgttttcagctcactcaaggctccagtcataccataattctccctttcctcatcagacctgggagtgtattctgttcccattgttgctaaaccttgaatgcattcactcggtttccctcaatagcttctctccaaaatcattttctccttcgctgataccatga

SEQ ID NO: 104224 - DNA, 225 bp, Homo sapiens
aaaaactttaacgacttcctagttgagagaaaacttgacatataaaaggctgtgaatttttctgcttggaggaagagcccaaccttggttgctttgaagttacaagcccccttgtgccaggtgaggggcttgtgagtcatttttgtctccatttgaggaagagtggtattcgttgtgactaggagcaagggaaagtggagttatttttgtttgtgcaaattattt

SEQ ID NO: 104225 - DNA, 104 bp, Homo sapiens
tgttcttggggaagatcccgacttagccattttccagtggcacctcttccaccatgagttcctgaggcagtccgatggggctactttattccagaacaatcaca

SEQ ID NO: 104226 - DNA, 465 bp, Homo sapiens
atctccccaacctcacagatcttatctccactggcagatggtcaaattctttccactgacactgcctcaggcataagtggcattagcctggaattcaagcagcttttgccactacctggtaagcctcggtggtgggaagtgtccctggagactgatggaagcagagctaaaagagccacatgaggctgggcacagtggctcacgcctgtaatcccagcactttgggaggctgaggcaggtggatcatttgaggtcaggagttcgagaccagcctggtcaacatggtgaaatccggtcgctactaaaaatacagaaattagacaggtgtggtgatacacgcttgtaatcccagctactcgggaggctgaggcagaattgcttgaacccgggagacggaggttgcagtgagccgagaccgcaccactgcactccagcctgagcaacgaagtgagactccgtctcaaa

SEQ ID NO: 104227 - DNA, 984 bp, Homo sapiens
agggtgggaggcttcaggactgcatgaactgagtagaaagatttggcctttggggacagagcatgcaacgggcagctgttcccggtgacctgggcatctgggacttactgagggagagacgtgatcttggcctagctgaccaccatcgaaaccactcatcggaggcgtggatgcagtttgctgggaagatgagcaccgatctgtctggtggtcacatggagggctttgcagatctctgacactggatatttccccttgccctggtgccaaggactaggggagagatcactctgggcttgagtcagggacagggatgccaggcacagcgaaagaagatgactgtggtacaaacccagctgatgaagtggaaaataaataaaagagaaggaatcaagctggttcatgtaggaagcatgcacacactcatcccatccattgttccacatcgggcacctccctgagctagctgccactcctgctgcactctgccactccttggaaggcagcacagggcagtggttagagccttctctttcagtgtcagacaggcctgggttcatgtccaggtctgccactttacttactagctgtgggatgctgatgagcccaagctctctcctagcctgcttcttgatcagtaaaatgacaatgactagagtacctagtatatggagttactgcaggacttgaatgtgccaatacatctaacatgcttagcatagggcctgatcatggttggcatttgataagtgctagttgttatcattattaatattactaatcatcaaagaaagatcttcagttggatatttgggcaaaattatgaaatttatccctaatcttttgatttacagattggtgtggatctgttattaagtgttttctttttttttttttaagttatcttgtttcctgactcctgaattgaagagtgtttcttctatgaatttcttttcttacagaaataaaattgaaagaactttt

SEQ ID NO: 104228 - DNA, 212 bp, Homo sapiens
ccagggagtggctatcccacacatgctcaagggaaggaggtattatacaggggtgtgcacaccaagggggctgggagttttgctttccacaaagctctggttcctttctttcttcctctctctctctctctctctctctctctctctccccctctctccccctctctccctccctcctccctccctcccctctctcccctctctcccctctc

SEQ ID NO: 104229 - DNA, 165 bp, Homo sapiens
ggtgaccgtttgtgctttgaagctactatcataggaacatttcataggctaacattagtaaggcacagattgtcaataagaaatttggatatcagcacacatggatttgctatacagatgagtaagagttttcaccaattaagaagtacctaactaaaaaaaaaa

SEQ ID NO: 104230 - DNA, 468 bp, Homo sapiens
tttttttttaaagctggtaacagacttcaaaaaaaaaaaacaacttctggacaggccaggattacagcactttgggaggctgagatgggaggaacgcttgagcccaggagtttgagaccagccttggcaacatggcaagaccccatctctattttatataatttaatatatagtaaaagaaaaaaaatacaacttcttggagaggtcaataaacctatacacgtcttctccagtgagcctaaaattgttttgtctattaaagattaaattatgttaaatttatattgatgctatctgtactttgcacagatattttttgttgctagttaacgtctgcaccagcacagaccactaagcattttggataaagtggatactctaaagatgtgaggcctagagaaatcaatgtcaagtccacaggcatcacttgccattaaggatttaaaggtctactatatttttatattc

SEQ ID NO: 104231 - DNA, 566 bp, Homo sapiens
tagcataaaatagttgctcaataaatccttattgtttaaaatcagattcattttttttcttccttcaaacttcccttagagccatgagaagattgagatgcaggttctaccataaccaccctggcaccttactaaaatccatccagccagatattccttcattttggttctttgttttttattactatgaggttgaaagttgaaggtaaaaagctgcaaagctgaaataaccaaagatctatctatctgaagcattcagaagaaagaagaaggactcaggatgtactctgaagggacttacgtagttactaggataatgacatgtaaaggagtgagaaatctaaggagaagccaggccaagctggtccataggacagtcactgtgtgtgtgtgtgtgtgtgtgtgtgtgtgtgtgtgtgtgtgtgtgaaagagagagagacagacgagggcagaggagagagagcgaggctttgagagaaagagcaagtatttttggagtctgatttctcctctgagcctatgaatatttgtactgatagagctaagaatgtgagagttatttttg

SEQ ID NO: 104232 - DNA, 932 bp, Homo sapiens
ggctaactcttaaagtaattagcacgatgattggaacggagcattctctccaacacagcatttcttttggcactttgcttcttgtgcagtttagctccagaaagtattaaggaatgactttagtgctcatttggatgcagtaagtggtttgatctcagggtggcaaaaagaatgctttttttataccttttcacattcggataacttgtttagaagacagaggttctaactaggttttggcctattaagaactgcaaactagcagcagcagaactctggctaaaggggcaagcttattaggaaattgagtatttaaaagttgagctaccatatgatccaacaatcccactgctgggtatatacccagaagaaaatcggtatatcaaagagatatctgcactcctatgtttgttgtagcactgtttataatagctaagatttagaagcaaccttagtgtccatcgggatgaatggataaagaaaatgtacctatacgcggccaggcacggtggcttgtgcctagcactttggaaagccgaggcgggtggatcacctgaggtcaggagttcgagaccagcctggccaagatagtgaaaccccgtctctagtaaaaatacaaaaattagccgggcttgtggtgtgggcctgtaatctcagccacccgggaggctgaggcaggagaatcgctggaacctgggaggcagaggctgcagtgagccgagatcacgccactgtactccagcctgggcgacagagcaagactccatctcaaaaaaaaaaaaacaccacaaaaaaaaggggggggaaaaaattccggggggcatgccccgtttggaaaagggcccaggggaaaaaagggggggaaaagcggggaacgggctggagaccccggggcggggccccaaacggaaatgggggacctcgggtgaaca

SEQ ID NO: 104233 - DNA, 190 bp, Homo sapiens
atgcagtattaacttggcagcaatgtgaagcagatgtattctctccgtgctagtaagtcggttagaagagttctgtctctaatcagcagcaaaagcagaggtgacttcaggagcatcagggagcacaggaagagagaagcaacaacaggaccatccctcacaaacccctactcaccaggccatgaagggg

SEQ ID NO: 104234 - DNA, 472 bp, Homo sapiens
agcagaataaaaagtcagtctgcttcataaggaccacctctggaaaattctgtgagtgtgtaaaggaccccaccagataaatagcatgatctcttggcacagtcggtttcactctactggttatggtaaagtgagggtgaaatacctattttgtattctaccattgtgataaatgtgttcataaataaacgaaacccaaagtttcaaggacctgggaagccccagtggaggcctgtggcagaagagtagagcagggattctcaaccagggctacccatggaaatcacttaggcagctttaaaagacaaatgccttagtcccacttacagagatccaaatttgtttgctctgcatgtgttcgggctatctgaatgttgaatctggccagttcaactctgcagctaaagtggaagagctccggtgtaaagccttgctagataaggccagacgcacgttcagcgacacccctgga

SEQ ID NO: 104235 - DNA, 721 bp, Homo sapiens
aacgggttctttttaattgacactggtagaggcagtagacttccaagtaagctagacctgctggaattccagtactgctagttttgagagcttggtcgggttaataggctgagtttactacatccagatttgaccaataataccacccttgaaggacatttgtgaggaatagaaataatcaatgcagagtgcctaatatgagtatctggcagtgaatgctgccagtcaaagtagttgttattgttatgatataaacaaatatttatggactaagttgtagtattctgatataaaaataaggattataatttttaagctatatatagaatttatatttaatttttcctatttggaagtgtggtatatagaacaagttaccttcaaacatggtacacatttaaagcataaatagtgtccattaaattgtagatgaattaatgatatatccatgacatataaagaaaagattggaacttgagacatccactcttgacttttgaagagcgttttagaggcttccaaccctgcttgttcacagctattgaggccttgacctctgtgggagatagtcttgagtttggtgggtggatgggtccacagaagagacaactgtttttcatgcttttgtgttttttgaaatctgacattgaggatgttatttctgctgtatatttaccttgtattcaagaatcattttggtatgaggtcagaacactagtgt

SEQ ID NO: 104236 - DNA, 436 bp, Homo sapiens
acgagacacgataccagcttactccgagtccataggacgaccttattagaaacgaaagcacatatccacacaaaaacttgcacacaagtgttcagagcagccaaaaggtggaaacaacccacacggtcatcactgaacagtgtgatgaagattttatcacgacgacctcattgtgagtggatggacaaaactcggtctatttatacaatgaaaccctagtcagcaataaaaataaagggctgagagatgctaccacgtggaggagtctcaaagccatgacgtgaagtggaaggagccagatggaaggatagcgcatggagcaactctgttcccacgagaggtccagaaccggcaaacccagagaaaaagcgcatgggtgtggctgtcaggccctgggggctgactgctaatgtgtgatgaaaatttcccttctaaa

SEQ ID NO: 104237 - DNA, 231 bp, Homo sapiens
aaagaagcaatttggtgatggggcccttagaatgtccttgaaaacagctggaatttactgctagcatatattgggtcagatgaatgagggagcatgggtttggctgatttgcaatgttcaagaaatattgatattcttagaagacaatacagaatatatgttgggtcttattttccaaaatgtcaaagtgtccttcatatgccttttgttctgtgagataacagttgttgg

SEQ ID NO: 104238 - DNA, 336 bp, Homo sapiens
ccagatgactttatttctaccactaagtaggcacaaagaaaaaaagaggctgttttaacttaactccatctttcttcacattgtttgacacctgaaaatagtattttgcttaagtcacagaagcccatatagtgcgtcttcaaaaagaatgttatgttgcgaatacacgacagaaagtccactttatatatctgaatttcacaaacttaggacctatgctcttttgttctcaaaacaggctcattaagttaaattataagaggtcagctgggggaaaaaagtttgaaaacagggcactggtttgctgcttttaaaacgtcattactctgactagtt

SEQ ID NO: 104239 - DNA, 288 bp, Homo sapiens
cagcagccaatacaaagcctcaatcccacttggcattcggcacttttgcatcagaaactgcctgtgttattgtgccagtggttgccctaggtgttcatcatgagcacttaaaatgattgcttttgcagttgcagatggctgtaccggttccaaacaaagagggtcactgagggctctgcttatagagtgcagtttctggaaggaattcaccacagattgtacaatgaagcccaagctcgctggactctgctggcccagggaatttttacaaggttaagtcagccataa

SEQ ID NO: 104240 - DNA, 330 bp, Homo sapiens
tgcttgttgagtcagtgaggaaaaatgtgccaggttagataatactgagcaagttcctctgctgcaggacttctcaggacctttaatctctgataccctgtccgagaatgtgatgattattagaccttggcacccttcttcaagaaacaaccaccaacatctcaatgaatgcttgccttctgagcactgctgcctgggaaaggctattttcctgatactattgtgttttctaaaaacattgtgaaaaaaaaaatgaaatgtctccaacagtgaaaataagaacaactgtaattatttatactcattgacaacaagaataggatttattct

SEQ ID NO: 104241 - DNA, 544 bp, Homo sapiens
ctctccccctccttccctcctggagctgggacacccttcttttcctgcccttggacatcagaaactccaggttctcctgccttgggattccgggacgtgcaccaatagccccttgggttctcaggccttcagccttaaactgaaccagttatggactttcctcattgtctagcttgagatggcatagtgtgggacttagcctccataatctcatgagccaattccccgaataaatcccatctctatccatatgtatgtatcctattggtgctttctggagaacacttactaacacatcaggtaagggcaatcctcaagcttctaaacagtcatgagtcatgctatgctcaacccacaagcacagttgaaagcaaccggcaatctagtccaagagagacaaaaacaataacttgctatacagcagacctttatatggtgtcaacacatagacagttcctcttcctttaaatgtgcaagactctgacgagatgccagcacacagtcatagtgaacaattgagctaaggagaacaggaagctggaag

SEQ ID NO: 104242 - DNA, 346 bp, Homo sapiens
tcgagatggagtcttgctctgtccacccaggccggagtgcactggtgtgatctcagctcactgcaacctccgcctcccgggttgaagccattctcctgcctcagcctcccgagcagctgggattacaggtataagccaccactcccagctagaaatcacaattttcacttctgtcatcatcaatgaattttgttgttcgtgacctttaaatggaaccatacagtatgtactcttttgtgctcagatgtttttttcactgagcatagtgtctatgagtactatgtggtggtgttggtagttcattccttcttactgctgagtagtattccacctttggctatgccaa

SEQ ID NO: 104243 - DNA, 208 bp, Homo sapiens
ttgccagcctcctgtccctcaaacatgctgttcctccttcctggacaactttgcccagcacttactcagcatgcaggtctcagcttcagcagaacctcctccaggaggaacctcttctcttgagttcctgagagcctctcttgttctcctgagtcctcaacctatgtgctatctttgcctggtcaccatcagctctttgatatagacc

SEQ ID NO: 104244 - DNA, 333 bp, Homo sapiens
aaataaatgagtacatgtaagatggggctgtctcacactaaggggtcaggaaggggctttctgaggaggtgatattggcactgagacctgaacaaccagaagaatcagccatgtaaggattgtggggaaaggcatcccaggagacgagaagagcaaatgcaaaatccccaaggggtattgaggtgtgtgcatatgaggggcagagaaaaccaacacagccgccacactgtgagcaaaaggtagggagaggatgttgtagaagatgaggatacagaggcttataggagcccttctgggccttaaaggtcacagcaaggagactgatgttcattt

SEQ ID NO: 104245 - DNA, 383 bp, Homo sapiens
aagactaaaggcaaaaggatctggctgtaaacactgtgctctagctgatggagtttttttcccacagggtgtgggttaacagttctgataccactgtgcaggtatactgaaaatgaaccatgaactcaaggaatggtgaattgacaggtaggcaagtggaggaggctagaacgatccatctggtaacagatgagggctggagacatcagcacacactcatgtttggcttcatacagctacagatggccacagacagaaataccgatagattcctgtatagacataggttagtatgtatacatatatgtatttgctctgccagctgagagcctgaaaaagggatacttcagtagcaacctgaaatgatgatagtgaacgctgcc

SEQ ID NO: 104246 - DNA, 201 bp, Homo sapiens
cccaacctctcttaacctcgtttcttttcctataaaatgcagcattatctaatgaccttacaagctattatgagggccaaatgactataatgaaactgtacttcagaagtgctatacaacttgtagcacatatattcatgatgtaaaacagcaccattagtaataataaacatgcatctcatgaaaaaaatttatgccact

SEQ ID NO: 104247 - DNA, 702 bp, Homo sapiens
attttgacatctttgtcagataatgcaaaactcaatccttaagaagatctttgcattatctgacaaagatgtcaaaataatgatactaagtatgctcaataacaaaaatagaacaaagatcttcttaaggattgagttttggaaatttatttcttcaagtggggtatgttttctgtcttttttttttatgttacgtgatccttttatgaaatttgaaaacttaaaaacagccatctaatctaatatttaaagacttgcttaaagaatggctgtagcaatgagccacgctatagattttttagtgcttcacaaacatgttctcagttatgtctttgaacttttgtgtgtaatttctaagttaaagagattttttcctcattttcttgtcagattctataatcttttgcttccttagatgactgtggcatggcagttcctctagtattataacaacattcaccttctagcagatacaaactgtaattctcattactccatcattttcatgttaagggagacagactctattaatcagaactttaaacagacctgttgttttagatttctcttgaggataatactgggagttgattgtgttttacttagaccaattgctgttgaaggaaagaaaggttgtgttggaaagtctttaagctagacctggttaccttctgcagcatagaaagtattactggaatgtga

SEQ ID NO: 104248 - DNA, 759 bp, Homo sapiens
gtgtcaaaactggaagacaaccagtcacctttctgaagtatattttcctagctgttttcctgatttaatcttagctcaataagcatttcttaatgttggcatcatttgctttctgtatagactgagaattttcaaaacaatcaaaacctgctgtctctttgtttaacagtctgcattaagctgctcttgcattgctataaagaaatatctcagctggcgcagtggctcatgcctgtaatcccagcactttgggaggccagggcgggcagatcacctgaggtcgggagttcaaggtcagcctggccaacatggcaaaaccccatctctactaaaaatacaaaacttagccgggcgtggtggcaggcccctgtgatcccagctattggggaggctgaggcaggagaatcacttgaacccaggaggcagagtgagccaagatcgtgccattgcactccagcctgggtgacagaacgaggctccttctcaaaaaaaaacaaaacaaaacaaaaaaaactcagcctggccaacgtggtgaaaccccgtctactaaaaatacaaaagttagctgggcgcagtagcacatgtctgtaatcccagctactcaggaggctgaggcaggagaatcgctggaacccaagaggcagaggttgcaatgagccgagattgtcattgcaccccagcctgggtgacagagtgagactgtctcgagaaaagaaaagaaaaaaagaaatacctgaggttgagtaatctataaagaaa

SEQ ID NO: 104249 - DNA, 447 bp, Homo sapiens
caagaataatataaccttttttaaaaaaatactaccttcttcatacataatgggtaaagataagcactatattggatccttatttgaagtgttcagttcccagctttctcagtgtaattccattcctctttaactcccacttggacaaaagtacatatgaatgaataaaattgatgttgtagcaagaatccaaaatttactgtgctttatcgaaatgagtaattctttccaaaaacttgctgtgattcaaatgatcatgttatatccccatgtttccacatagaggctgagaatagttaacttggaaccttctatggagaagggaagaggctggttattccttacattagaatacaaaggaagttaaattacaaaggaagatgactatgatgtggcatagagttttacaagtgagataataattatacgatatagggtagttctgat

SEQ ID NO: 104250 - DNA, 312 bp, Homo sapiens
gcctactactactatactactactaaattcacggcgctcgactttaaaaatttttttagtagaggtggggtttcactacgtattggccaggctggtctggaactcctgacctcaggtgatccacccaccttggcctcccaaagttctgggattacaggcgtgagccaccacaccgggcctccctgttaagcccagtttatccagtatttctaggtgttttgtacaaaagagttttcagggcatttagcctaacataaagcagaaacaaaagtcaggatgagtcaagtaacagtatttgagaaaacttcagag

SEQ ID NO: 104251 - DNA, 278 bp, Homo sapiens
agtagctgggattacaggcatgcgccaccacgcctggctaatttttttgtatttttagtagaaatggcgttcaccatgttggtcaggctggtctcgaactcctgaactcaaatgatcctcctgctttggcctcccaaagtgttgggattataggcatgagccaccatgcccagcctggaattgattttaatgtatagcatgaggtttgctgtagaattttatctgtttatgaaatgatctatgtgaagataattttatttcttcatagttacagtcac

SEQ ID NO: 104252 - DNA, 140 bp, Homo sapiens
tgagaattggagcgggttccagatgtctgcaactgtgaggagggctgctaaggagaggcagctccgtgttttatgtggaagctgcatagccttcccgtgggtgtccacgcggtcgctgggagcgcatcatctgccttggt

SEQ ID NO: 104253 - DNA, 706 bp, Homo sapiens
taccgaaaaacagtacggaggttcctcacaaattaaaagtagaattgccatacaatccaacaatcccactgtggctagatattcacaaagcaaagtgaattatttccaaataattcaaggagatacttgcacacccatgttcatcacaagactatttccaatagccaagaggtgaagcaactcaaatgtccatcaacaggtgaatagataatgaaaatgtggcatatacatacagtgaaaaaccatgcaaccttagtaaaggaaggaaatcatgtcacatacacacatggatgaaccttgaggatattatgcgaagtggaagaaagcccagtgaccaaaaggataaatacctataggattccccactccctatgatgtattccatagcagtccaaaatccatagacacagacagtagaaaggtggttatccaagggctggtaggagagggagttagtatttagtggtatagagttttagtgtttcccgggtaaaaatgttcctagagatctgttgcaaccatgtgaatatacttaacactaccgtactgtacactgaaaaaatggttaagaggataaatttaaatggttaagaggaaaaatggttaagaggataatgttgttttgttaccacagtagtaacttttaaaaaccctcatgtatgttctttccctttcatggcaaataaacttaaatgtggaaaaaaaa

SEQ ID NO: 104254 - DNA, 281 bp, Homo sapiens
gaggagtggagtgggccaaatgcttgtaaactgcctgggagagaggtagagaatggcaagtggatctaaaacaaaataaaatacccagaccctgctgttggcaaaacatcaattggcctagttaatacaggggaaacttaggggaaccttctggttagactgagaggtaaaactaaagaataactggagttgccagaaaagtggatggtagcatgatgtcataaatttgacaggcagacctgcatgttaggaaaagcacacggttcaggaaaggctcaagt

SEQ ID NO: 104255 - DNA, 853 bp, Homo sapiens
atgaaataataaaatatttagtacagtgcctggcatacaataagtgctcaataaatgttaacggctattttaaattctattcattgtaatggcagataataagggatgactagtaatacatttatcaagaaatctgcagaatttagattaagcatacttaaaataactcttttaagagataaagaggaatccatacatttcttaaatagggagattcaaaactgtaatgatgtcttttatttctaaatatgttaggtcagtgtaccatccgatgcaaaatctcataaggatttttttaagtcttaaaattagttcctagttaatctaaaaggataagtatttagtaatactaagggaaattttagaaaaatattttgagaatttttacttaccagttttagtatgatatacaatataccgttgtacataccataaagttaagagaacttaaaccctatggtataaccataggaatagatatgcttatctattcaggcatagtcctgaaatagtttatgataaaggtgttggtatagctatgtgagaaagagaaactgttcattaattgtgacaactcttctccagtcatctggaaataatcttaggcctaatacattctggaaggctcataaacatgtaaaaatgaacattcataagcatggaaaaaaaaataggtgaatgttaatatatttaatatattgcagtgaggaagacccttctaaggatgattgaaaagtaagaaagcataaagtaaaaattgtcgggttaaaattagtcatttttatactgcaaaatatctaaagttagaaacaaattatggaatgggggaaatatctgtaacacaaaatgctaa

SEQ ID NO: 104256 - DNA, 794 bp, Homo sapiens
tcccggggaatgcaacagctgattcacctgctccacgctgattaataatcaaactaccattgtgtggggcctatcttcctactggacctcaaaacccacctactccacaagtttatcttcacaattatgagctacctgcttcacgtcacactacagcacctaaaagcaaataataaagtttattcttgagttaacctgcctctgtgttcagccaatccctcctgcacgtgagtgatgcacctggatgctgcataaggagagatggaaatacctaaggtgtggtccttacttccaaggggcttatagcagaacgaagactcgaaagcaagcacacccacaaccacaacacagccgctggcacacacagcaggaaagacaccgggtttaatggagcagagaaagggggcgtcatctccaggcacagctccatgaagaagatgacattgacctgggagctctgagccttcatataatgagtaagctttcagctggaagaaatcccaagtggagaaacaggaagctataaaagagcaatggttttggattcacaaaacctgcctgagtgaacctggttgccattctagcacagagatcctgtctcaaaaaaaaaaaaaaaagaggcctgagagaacgtgtttatgtcttttcccatgtgaagacacagctagaaagcaccatccttgaaactgagagcaagccctcatcagtcagtgaatctgctgatgccatgttcttggaattcccagcttccagaactgtgagcaataaatgtacatagattgcaaattaaaaaa

SEQ ID NO: 104257 - DNA, 426 bp, Homo sapiens
tgggcaggcagctgggggctgtcacagcacacacacgatgccgacggagtcaagatctcggagtagaaagcaaagcggtgagtaccaggattataggaaaggggaaacggagacgagagggaggcaggtgaaattaacatagtgaaccataaactggctgccctgaagacttcagcaaggtactctactaaagaatattttgatgagatatctggaaatggaagagttttcaaacatacggaaattaaaaactgaatcaaattaactttcatttgcaaacaaagagaaggtttccaaccaaacccactttttgtaaccatcatgctgttttagagcagcgatatacccaaatggcaaacatagccagaaagtcaaatcatgtgttaaacgggaagtaaagggggcagggggaggactgggcaacac

SEQ ID NO: 104258 - DNA, 530 bp, Homo sapiens
gaataacaccagtgagggtgaaggatacagaataacaccagtgagggtgaaggatacagaattggggcaagggtgggattgaactggtgatgctgtttaatggagacctcagctgacctgaggctgtcctttagggttgtcctaaatgaagcaagtggggctggccttctctatcctgactcaagtaatctttcatgcaggctatttccaagaagtggggtgtggccttgggtgagcgacttaatttggatgagagcattccttgaagaaagatttagatctacattacatttctagatggtattgcacaatcggatgtaactatttggccattttcaacccattttcttcttttgtaagatgccgaaaaggaagaggggaataggaactaggaaggatatagattgaagcagattagctgtaagatcatttaaagtatgagaggtttttgggcagtatcttgaattttatatatttctcacttacctttctctgtaaatatttgagggaaaaaaaggaaatcattcttt

SEQ ID NO: 104259 - DNA, 99 bp, Homo sapiens
agtgcttattactatggaccggcatgtcccccacctcaccaaatttatatgttgaagataatgctgaatatgatgcttcggaaatgagccctttgggag

SEQ ID NO: 104260 - DNA, 485 bp, Homo sapiens
tgatgacagatttctgtcttccagtcccgatctgttccttcacgaaaatgagcccagtagcccgtccaagccagaaatggacttttagcccccaccccctgccaactctgccctttccctcatccccagttgcttaaaccaaaacggattcctcttcctctcatgatccaaactcctgagtcccttcaccttttgcctacactatcacagtgacctccttgctgctttcacactggagagcgtgggctccctgtgatctactctccacatggcagccagtgtcatctggtaaacctttgctgaaaccctgccatgcccttcagttgccctggaaacctgaactcatcctcagcctggctcgcagagccctcatgccgctgggacgtcacgttatgtccctctcctgctggcccgctgcacccagccgcaccacatgccggccgcacctcacacacgctggcctcttggcccttcctcgaacacac

SEQ ID NO: 104261 - DNA, 171 bp, Homo sapiens
catcatctcatatagttacctttctttttgtgtgataagagtctccaaaatctactctcttagcaaatttccaatatacaatacaatattaactatagtcttcatgttccacatgagatttctagatttattctcctataggaaccacaactttgtactctttgacctaca

SEQ ID NO: 104262 - DNA, 474 bp, Homo sapiens
actatccaaaaccacacgaatctcacatgaaatgatcaaagcatgagaactcctcaccgcccagcagtcccactttagcccactctacacacaccatgcaaagatctacacacctaaaatgctgccttcaacacatcagccaataaacaacttataccatctctctgtgctcttaaggctgttgatcatctgtgctgttcttggaaacttctccctgatgacaagcacctctcttctactcctctgccggtctcaactactgtctcaactcttgctacccagcctgcaattaatccttccctaaaggtgagtctgtcacctccctggccgtctccagctttctctaacttcaaccaggcagagactcctctacctgcttccggccctggtcacagtcgctagcctgacccaacaacctgctgccaggtggatgcttcctccagacaatgtctcatgagtgccccacactgaaca

SEQ ID NO: 104263 - DNA, 744 bp, Homo sapiens
cttttaatcactatgctatggttgccgttaaggtattttaaaagtcaggcctaagcaaatgaaatagaatatttatcaaacttctttttttgttgttgtttttgaggcggagtcttgctctgtcgccaggcaggagtgcggtgccgcgatctcatctcactgcaacctccgcctcctgagttcaagcgattctcctgcctcagcctctcaagtagctgggattacagtcacctgccaccacgcccagctaatttttttgtatttttagtagagacggggtttcaccatgttggccaggatgctccccatctcctgactttgtgatctgtcctcctcagcctcccaaaatgctgggattacaggcatgagccaccatgcctggcctatatatagttttttaagacaatgtagagaggatacaaaatatttatctgtagccataaaaaagaacgagatcatttcctttgcagtgacatggttggagctggaggccattatccataacaaattaacaggaacagaaaaccaaataccccatgttctcacttataagtaagaactaaatgatgagaacacatggacacacagagtgaaacaacacacattggggcctattggaggacagagggtagggcgagggagaggaccaggaaaaataactagtgggtactaggctaaatacctgggtgatggaataatctgtacaacaaacccccatgacacaaatttacctacctaacaaac

SEQ ID NO: 104264 - DNA, 732 bp, Homo sapiens
aaggtatgaattttgcaaggtgctagtatacaagatcaatatatataaaacaattatttttctgtaaactgccgtatactaatacacgtacaaatgtgtgtgtgtgtgtgtgtgtgtgtgtgtgtgtgtgtgtgtgtatcagctggtggagtgaagaattaatattggtaagttgtccgtttcagccagaatccagaaagctggtctagggcagcagtccccaacctttttggcaccagaaactggtttcgtggaaaaaaatttttccatgggtagcggggggatggttttggaatgaaactattctcagacattagattctcataaggaatgtgaaacctagatcccttgcatgcgcagttcacaatagggttcgcactcctaagagcatctaatgccgctgctgatctgacaggaggcggagcttaggcggtaatatccgctcacctgccactcacctcctgctgtgtgacccagttcctaacaggccacagccagtactggtctgtggcctgggtgttggggacccctggtgtatggaattgctccaagacatattggccttataagactttttaagacagcatggatcttgcacctacctgatccgcatctcatgtccttgagcttggggagagatcccgcacagatagccgtgtggttggctgcaaggttaaattagaagagaaaggcctgatggtgtcaatgctgacagttgttggtttctgcaaa

SEQ ID NO: 104265 - DNA, 765 bp, Homo sapiens
cttcagataaggtgccttttgtcacttggccactggtaggttctgcgaaaggaagtgatgtcagggatttagggactttcttcgcagaattggaaaaaactactttaaagttcatatagaaccaaaaaagagcccacattgccaagacaatcctaagccaaaagaacaaagctggaggcatcatgctacctgacttcaaaccatactacaaggctacagtaaccaaaacagcatggtgctggtaccaaaacagagatgtagaccaatggaacagaacagaggcctcaaaaataacaccacacatctacaaccacctgatctttgacaaatgtgacaaaaacaagaaatggggaaaggattccctgtgtaataaatgatgctgggaaaactggctagccatatgtagaaagctgaaactggatcccttccttacaccttatacaaaaattaattcaagatggattaaagacttacatgttagacctaaaaccataaaaaccctagaagaaaacctaggcaataccattcaggacataggcatgggcaagaacttcatgactaaaacaccaaaagcaatggcaacaaaagccaaaatagacaaatgggatctaattaagctaaagagcttctgcacagcaaaagaaaccaccatcagagtgaacaggcaacctacagaaagggagaaaatttttgcaatctacccatctgacaaagggctaatatccagaatctacaaagaatttaaatttacaagaataaacaaac

SEQ ID NO: 104266 - DNA, 857 bp, Homo sapiens
  misc_feature (618)..(618): n is a, c, g, or t
  misc_feature (621)..(621): n is a, c, g, or t
cctagaggatcccgtctgcatttcagccgcccagcagccccgactattcgtgggcatgatcctgattctcatcttcgccgaggtgctcggcctctacggtctcatcgtcgccctcatcctctccacaaagtagaccctctccgagcccaccagccacagaatattatgtaaagaccacccctcctcattccagaacgaacagcctgacacatacgcacggggccgccgcccccagtagttggtcttgtacatgcgcagtgtcctagtgcccatcgtctgtttccccggccttgcccccgcccgccccgtgccgtggacatctgggcccactcatcgcccctccaggcccccggcgccccaccccctagagtgctctgtgtatgcggatgatttagaattgtcatttctctttactggatgtttatttataaagatctggcctgttcctgcgtctgcggagcggcccttgtctcccagctatctataaccttagctagagtgtcgccttgtgggttcctgttgctgagacttcctggatggagccgccctcaccgccgggcccgtggccctgcgcggagctgtgtccaataaagttcttggatgtgaaaaaaaaaccanaanaacacggcagggcccagtgcggggcggacaacaaaggcaggcagggcccaggtcatggggtcccagaccgggttcggtccagggagactgcgggcccaaaggaaggaaaacgcagcacaggtacggtagaccggaagagaagacgcgaggcgggagacacctgaccaaagcgcggcacgctggacaccaccaccgcgcgcgcacaacgatcacacgcaacggtgtccacgcccgcc

SEQ ID NO: 104267 - DNA, 1961 bp, Homo sapiens
  misc_feature (1)..(3): n is a, c, g, or t
  misc_feature (8)..(8): n is a, c, g, or t
  misc_feature (11)..(11): n is a, c, g, or t
nnnaagcncgngcggagggtgtgagatggcagacaggtttgcaggaaaccctcagaaagggggctggaggatttagccactctgtcctccccttccggcagtccagggcctcctcccgagcacagcggcgctatggactctccaggatacaactgcttcgtggacaaagacaagatggacgctgccatccaggacctggggcccaaggagctgagctgcactgaactgcaggaactgaagcagctggcgcgccagggctactgggcccaaagccacgccctgcggggaaaggtgtaccagcgcctgatccgggacattccctgccgcacggtcacgcctgacgccagcgtgtacagcgacatcgtgggcaagatcgtgggcaagcacagcagcagctgcctgccgctgcccgagttcgtggacaacacgcaggtgcccagctactgcctgaatgcacgcggcgagggggccgtgcgcaagatcctcctgtgcctggccaaccagttccccgacatctccttctgccccgccctgccggccgtggtggccctgctgctgcactacagcatcgacgaggccgagtgcttcgagaaggcctgccgcatcctggcctgcaatgaccccggcaggaggctgatcgaccagagcttcctggcctttgagtcgtcctgcatgacgtttggggacctggtgaacaagtactgccaggcggcccacaagctgatggtggccgtgtcggaggatgtcctgcaggtctatgcggactggcagcgctggctgtttggggagctgcccctctgctacttcgcccgggtctttgacgtcttcctggtggagggctacaaggtgctgtaccgcgtggcgctggccatcctcaagttcttccacaaggtgagggccgggcagccgctggagtcggacagcgtgaagcaggacatccgcacgttcgtcagagacatcgcgaagacggtgtcccctgagaagctgctggagaaagcgttcgccatccgcctcttctcccgcaaggagatccagctcctgcagatggccaatgagaaagccctgaagcagaagggcatcaccgtgaagcagaagaggtccctgggcgctgcctatggcacagccaagagcggtaccggcattgcggccatgtctgtcatgcggccggagcagatcatgaagtccatcatcccagtggtcatggctggcatcatcgccatctacggcctggtggtggcagtcctcatcgccaactccctgaatgacgacatcagcctctacaagagcttcctccagctgggcgccggcctgagcgtgggcctgagcggcctggcagccggctttgccatcggcatcgtgggggacgctggcgtgcggggcaccgcccagcagccccgactattcgtgggcatgatcctgattctcatcttcgccgaggtgctcggcctctacggtctcatcgtcgccctcatcctctccacaaagtagaccctctccgagcccaccagccacagaatattatgtaaagaccacccctcctcattccagaacgaacagcctgacacatacgcacggggccgccgcccccagtagttggtcttgtacatgcgcagtgtcctagtgcccatcgtctgtttccccggccttgcccccgcccgccccgtgccgtggacatctgggcccactcatcgcccctccaggcccccggcgccccaccccctagagtgctctgtgtatgcggatgatttagaattgtcatttctctttactggatgtttatttataaagatctggcctgttcctgcgtctgcggagcggcccttgtctcccagctatctataaccttagctagagtgtcgccttgtgggttcctgttgctgagacttcctggatggagccgccctcaccgccgggcccgtggccctgcgcggagctgtgtccaataaagttcttggatgtga

SEQ ID NO: 104268 - DNA, 4491 bp, Homo sapiens
  misc_feature (1)..(3): n is a, c, g, or t
  misc_feature (8)..(8): n is a, c, g, or t
  misc_feature (11)..(11): n is a, c, g, or t
  misc_feature (1102)..(1102): n is a, c, g, or t
  misc_feature (1105)..(1105): n is a, c, g, or t
  misc_feature (1107)..(1110): n is a, c, g, or t
  misc_feature (1325)..(1325): n is a, c, g, or t
nnnaagcncgngcggagggtgtgagatggcagacaggtttgcaggaaaccctcagaaagggggctggaggatttagccactctgtcctccccttccggcagtccagggcctcctcccgagcacagcggcgctatggactctccaggatacaactgcttcgtggacaaagacaagatggacgctgccatccaggacctggggcccaaggagctgagctgcactgaactgcaggaactgaagcagctggcgcgccagggctactgggcccaaagccacgccctgcggggaaaggtgtaccagcgcctgatccgggacattccctgccgcacggtcacgcctgacgccagcgtgtacagcgacatcgtgggcaagatcgtgggcaagcacagcagcagctgcctgccgctgcccgagttcgtggacaacacgcaggtgcccagctactgcctgaatgcacgcggcgagggggccgtgcgcaagatcctcctgtgcctggccaaccagttccccgacatctccttctgccccgccctgccggccgtggtggccctgctgctgcactacagcatcgacgaggccgagtgcttcgagaaggcctgccgcatcctggcctgcaatgaccccggcaggaggctgatcgaccagagcttcctggcctttgagtcgtcctgcatgacgtttggggacctggtgaacaagtactgccaggcggcccacaagctgatggtggccgtgtcggaggatgtcctgcaggtctatgcggactggcagcgctggctgtttggggagctgcccctctgctacttcgcccgggtctttgacgtcttcctggtggagggctacaaggtgctgtaccgcgtggcgctggccatcctcaagttcttccacaaggtgagggccgggcagccgctggagtcggacagcgtgaagcaggacatccgcacgttcgtcagagacatcgcgaagacggtgtcccctgagaagctgctggagaaagcgttcgccatccgcctcttctcccgcaaggagatccagctcctgcagatggccaatgagaaagccctgaagcagaagggcatcaccgtgaagcagaagaggttcnctncnnnnaggcagtttgtacacttggccgtccatgcagagaacttccgctcggagatcgtcagcgtgagggagatgagagacatctggtcctgggtccccgagcgctttgccctgtgccagccccttctgctgttctcctccctgcagcacgggtacagcctggccaggttctacttccagtgtgaaggacatgagcctaccctcttgctcatcaagaccangcagaaggaggtgtgtggtgcttacctgtccacagactggagtgagagaaataagtttggaggcaaactgggcttctttgggaccggagaatgctttgtgtttaggctgcagcctgaggtgcagcgctacgagtgggtggtgatcaagcaccccgagctgaccaagcccccacccttgatggctgccgagcccaccgccccactcagccactccgcctcctcagaccccgctgaccgcctctcgcccttcctggccgctcgccacttcaacctgccctccaagaccgagtccatgttcatggcggggggcagcgactgcctcatcgtcgggggaggaggcggccaggcgctctacatcgatggggacctgaaccggggccgcacaagccactgcgacaccttcaacaaccagcccctctgctccgagaacttcctcattgctgccgtggaggcctggggcttccaggaccctgacacccagtgacggcctgtgccacggtgactgagccgtggtggggcggtgggccgaggctgggctgccgcctcgggcagcagagagcagatgaaacccccatgtggtaggcagggttgggggacggcaggaccccatggccaagcctggcgttgcctggacctgctgctgcctctacctggggtttgggctgggcttccccagtccacctgcatctgggtcagagctggagggcctgctgtgcccccagccccacccagagctggcataggaagtaccttcctcctccgtggaggcttccatagcccaaggccttgggagtgtctgggtcttgctgcccctgagcctctctaggcagcctgagcccctggggtgggagtacaacggcagtgggaacgtgcagctaagggtgggcctgtggtgccccctgctggtgccgcatagcatcgcgccctcctgagcagggccctgcagcctggctggctggcgactgaatcccagcgtagatcccgagaacagactggcacccttgggcctgccccctggcggaccccagccccctgtcctgggcgtttgccccagttccctccccaggcctcctgggccacctctcacattaacccttcttggctgcctctgaggctcccctgggctgcgtttgggagctgctgggtgggaggaggagggtgggatttgtgctgggctccacccccagggagggtgggagctggagggggatgtcacatgtccttgtgtttctgcagagcctgaagcttttgctgggcctccctgcgtgttcccatctgaagaggtagccccgggagaggccctcagggaccgacccagaccagcaagctccatttccaggggtctgcccagagaagcctggacccagggggcttctcagctcccctcccttccagcccaggcctccttgagctcctgtagcctctgcagctgcccatttcacctctttgtcattgcaatgacctggggcccagggtcacgcccaagcccctctttgtggcatgctcatctcagtgcagccccaactgcttctctgcaccaggccccgtgccctcccctggccctggccacacagcacctccttggccaccttgcatggatgcatgtcctccctctgtccctcttgtggtgctgtggctggccacgtgtcagggttttctgtgagcctctcaccttacagcctttgggcccctgggcccctgccctgcctgagccctgcgctggccagacgcaggtaggtgccaggggaggccttgcctctgggcactatagggggcagccccctgccttgtgacctccctccatgccccatgacctccttcaactcgtcttgagggtctggtcaccacggaggggagaagggagacacagaggcccaagtggctgttctgggaccatggaagcctgggtcacagaggcaggtaccagcagtcctgcccccacccccgtccctgctggcctccagccagtgccacttggagtcccctgcaccgtgccactttccatccccacaccattgcctgctcctcccatggggctttagcctcccctgaccatctgctcatgtagcctctgactgggcgcacagtggtgcaggaggaaggaccgggaaccctgtgtggctttgggcaagctgacaaacccgtctggaactcagtttccccagctgtgaaatggggccagtccccatgccctgctgtcctcctcacaggactgttgagaggctcgcagggggatggggtgaatccctctcacggggagaggtatgggagggaagtcgccactcatctcagcccaccgcagccctccaggcccccgcctgagcccctgaggccctcatctgtaccgccagctttggtgttcattaaacatggtcttgctgcatcaactccagggctccaagctgagtctgatctcttcagccagaggggcctccgggggcttcctgggcctacagccaagcaggtgtgggaggctgcccgctgtagtgctcacccacattctatgactggaatgctgcaagcctcttccagagggagccctccaggagcagggaagtcatatccgtggaccatttgtaggtttccctctgcaaacttcctgaactgggtggtgatttttctggcgagttaagtccagcaggttctgcgtggctgcccccagggggccccacccgggccttccagtgatctggaccaggaagacggattgctgctgggtcatgatttccacatcatgagcgaagttctttgttttttgtgtgcatgcaaaatattgtttctttaaatttaatatcttttcctaacttttctactaacctagaaggtatgtgtgattattatcttttttattcttatcactgtacttgttagtatctgatattaggtattcccaaatagaacataatttattttgttaatgttctctatttcttcttgattatttattagctttggatgttaaaaattagccaaaagtggctgctctgcctatgaagtagccattctttgtttaaaaaaaaaaaaagccaacatttgttgaaactgcataataaattatcatttgtttttagaaacattcaaagaattattttttgattttttttttttttgggacagagtcacccaggctggagtgcagtggcatgatcttggctcactgcaacct

SEQ ID NO: 104269 - DNA, 1088 bp, Homo sapiens
cccctgcgccgggtctccctcttctcgctccgtctcccctctgctcctcccgttcgccgttcctgctcctcccgctttctcccgttctccccccctcttcgtttccgttgctccggcccagctcgcccgtcccgtctccgcgtctgtctcttctctctttctcctcctgtctgctgtcttcttgctctcctgctgtccctctcctgtccttcccgctcccctctgtcctctcccgtcctctccttttgttgtttgtgtttcttcttgctcgttgttttttcggtttggtttggcttttggtttgttcttgtcgtcgttggttttgttttcgcgtgtttgtcgctttggctgctggtttgtgttgtttgtttgtttgtttcgcgattatggtttctgctggtgttgttttctttggtctttgtggtataaaactgtgtgttctttaagccttatcttctgttttggtgttactttcttctttctgtttggtgatttttgctgcgcttgtttttatcccttcttgtacgctcttcaatacgtgctatacattccccccatggatgcgttctattgttcctggtgtgtgaacgtggttcccatattttcactatgcacacgtatttgaagtgttcgttaccactagagggtgcacacgctagactgcgttgttgccagcatccgtgactctgttttgtaactagctggtcccaggtgctcgttacttgttagtagatactgcctcctttaaatggatcccacgcttgtatcataacaaaactctggggaccgtcttaacttgtggccccttggggatattttggaaaaccccctcttttttttttttttttttttttttttttttttcacatccaagaactttattggacacagctccgcgcagggccacgggcccggcggtgagggcggctccatccaggaagtctcagcaacaggaacccacaaggcgacactctagctaaggttatagatagctgggagacaagggccgctccgcagacgcaggaacaggccagatctttataaataaacatccagtaaagagaaatgacaattctaaatcatccgca

SEQ ID NO: 104270 - DNA, 676 bp, Homo sapiens
  misc_feature (31)..(31): n is a, c, g, or t
attcggcatgagggcgccctggggaccatantggacgagccaagagcggtaccggcattgcggccatgtctgtcatgcggccggagcagatcatgaagtccatcatcccagtggtcatggctggcatcatcgccatctacggcctggtggtggcagtcctcatcgccaactccctgaatgacgacatcagcctctacaagagcttcctccagctgggcgccgctcaggcccacgctcaggcgggccggatcgccttcgccgccgcccgcccgcaaccttcgtgcccggcccgtcctcgcccccgggcatgcgccgacctgattcggggccgctgatgctttgatcctcttctcttcccggagacgtagctgcccagggttcagggacgcgatccctgaggtcatcgcatccgacatcgcgacgacagagattaataggggtcgatcctcggaagccgcaaaaaagtggtaatacaaactagatctcattgtgaaaacatagccatcaatgatcacactcaatctcaagaacagcgaaaccagggctgtagcacgaatcaagtcaacctggtcccatggcggcccgagcaataaaatcgagttaaggtctaattgaacaaggtcgactaattgctgatagtaatggaactcataacgtgtggtggtggaaacatcaa

SEQ ID NO: 104271 - DNA, 267 bp, Homo sapiens
tttagagcttctccatttttattacacaaaattgttaagttttcacatccaagaactttattggacacagctccgcgcagggccacgggcccggcggtgagggcggctccatccaggaagtctcagcaacaggaacccacaaggcgacactctagctaaggttatagatagctgggagacaagggccgctccgcagacgcaggaacaggccagatctttataaataaacatccagtaaagagaaatgacaattctaaatcatccgca

SEQ ID NO: 104272 - DNA, 1336 bp, Homo sapiens
cccggcgcgagaccggtccaacgctgcggagatccagaggccggcggcgcccggaaacacccgcggaggccgaggcagggcggggccgggcgccggggccgggtcgctgggcgggcggcacagcccgggggaggtcaacgggccggccgggcgtcccggggacgcgtctcccccacggtgcgaagtggtacggctcgcaggggcggggcccaggtcatgtgacgcggccgcggccgccattttgttctgcggtgctggtatttagagcgcagcggctgacgggccggatcgccttcgccgccgcccgcccgcaaaccttcgtgcccggcccgtcctcgcccccgcctccgccaccgcctcggcccgcagagcttgccccctccccacccgcagacatgtccgagtccaagagcggccccgagtatgcttcgtttttcgccgtcatgggcgcctcggccgccatggtcttcagcgccctgggcgctgcctatggcacagccaagagcggtaccggcattgcggccatgtctgtcatgcggccggagcagatcatgaagtccatcatcccagtggtcatggctggcatcatcgccatctacggcctggtggtggcagtcctcatcgccaactccctgaatgacgacatcagcctctacaagagcttcctccagctgggcgccggcctgagcgtgggcctgagcggcctggcagccggctttgccatcggcatcgtgggggacgctggcgtgcggggcaccgcccagcagccccgactattcgtgggcatgatcctgattctcatcttcgccgaggtgctcggcctctacggtctcatcgtcgccctcatcctctccacaaagtagaccctctccgagcccaccagccacagaatattatgtaaagaccacccctcctcattccagaacgaacagcctgacacatacgcacggggccgccgcccccagtagttggtcttgtacatgcgcagtgtcctagtgcccatcgtctgtttccccggccttgcccccgcccgccccgtgccgtggacatctgggcccactcatcgcccctccaggcccccggcgccccaccccctagagtgctctgtgtatgcggatgatttagaattgtcatttctctttactggatgtttatttataaagatctggcctgttcctgcgtctgcggagcggcccttgtctcccagctatctataaccttagctagagtgtcgccttgtgggttcctgttgctgagacttcctggatggagccgccctcaccgccgggcccgtggccctgcgcggagctgtgtccaataaagttcttggatgtga

SEQ ID NO: 104273 - DNA, 1587 bp, Homo sapiens
  misc_feature (1348)..(1348): n is a, c, g, or t
  misc_feature (1351)..(1351): n is a, c, g, or t
cccggcgcgagaccggtccaacgctgcggagatccagaggccggcggcgcccggaaacacccgcggaggccgaggcagggcggggccgggcgccggggccgggtcgctgggcgggcggcacagcccgggggaggtcaacgggccggccgggcgtcccggggacgcgtctcccccacggtgcgaagtggtacggctcgcaggggcggggcccaggtcatgtgacgcggccgcggccgccattttgttctgcggtgctggtatttagagcgcagcggctgacgggccggatcgccttcgccgccgcccgcccgcaaaccttcgtgcccggcccgtcctcgcccccgcctccgccaccgcctcggcccgcagagcttgccccctccccacccgcagacatgtccgagtccaagagcggccccgagtatgcttcgtttttcgccgtcatgggcgcctcggccgccatggtcttcagcgccctgggcgctgcctatggcacagccaagagcggtaccggcattgcggccatgtctgtcatgcggccggagcagatcatgaagtccatcatcccagtggtcatggctggcatcatcgccatctacggcctggtggtggcagtcctcatcgccaactccctgaatgacgacatcagcctctacaagagcttcctccagctgggcgccggcctgagcgtgggcctgagcggcctggcagccggctttgccatcggcatcgtgggggacgctggcgtgcggggcaccgcccagcagccccgactattcgtgggcatgatcctgattctcatcttcgccgaggtgctcggcctctacggtctcatcgtcgccctcatcctctccacaaagtagaccctctccgagcccaccagccacagaatattatgtaaagaccacccctcctcattccagaacgaacagcctgacacatacgcacggggccgccgcccccagtagttggtcttgtacatgcgcagtgtcctagtgcccatcgtctgtttccccggccttgcccccgcccgccccgtgccgtggacatctgggcccactcatcgcccctccaggcccccggcgccccaccccctagagtgctctgtgtatgcggatgatttagaattgtcatttctctttactggatgtttatttataaagatctggcctgttcctgcgtctgcggagcggcccttgtctcccagctatctataaccttagctagagtgtcgccttgtgggttcctgttgctgagacttcctggatggagccgccctcaccgccgggcccgtggccctgcgcggagctgtgtccaataaagttcttggatgtgaaaaaaaaaccanaanaacacggcagggcccagtgcggggcggacaacaaaggcaggcagggcccaggtcatggggtcccagaccgggttcggtccagggagactgcgggcccaaaggaaggaaaacgcagcacaggtacggtagaccggaagagaagacgcgaggcgggagacacctgaccaaagcgcggcacgctggacaccaccaccgcgcgcgcacaacgatcacacgcaacggtgtccacgcccgcc

SEQ ID NO: 104274 - DNA, 1090 bp, Homo sapiens
  misc_feature (1)..(1): n is a, c, g, or t
  misc_feature (33)..(33): n is a, c, g, or t
  misc_feature (47)..(48): n is a, c, g, or t
nagacaccccatttactggtgccattggtagcngtatggccttgtgnngtttgcagaaacttctgtgcatcgtaggtgccggcccgtcctcgcccccgcctccgccaccgcctcggcccgcagagcttgccccctccccacccgcagacatgtccgagtccaagagcggccccgagtatgcttcgtttttcgccgtcatgggcgcctcggccgccatggtcttcagcgccctgggcgctgcctatggcacagccaagagcggtaccggcattgcggccatgtctgtcatgcggccggagcagatcatgaagtccatcatcccagtggtcatggctggcatcatcgccatctacggcctggtggtggcagtcctcatcgccaactccctgaatgacgacatcagcctctacaagagcttcctccagctgggcgccggcctgagcgtgggcctgagcggcctggcagccggctttgccatcggcatcgtgggggacgctggcgtgcggggcaccgcccagcagccccgactattcgtgggcatgatcctgattctcatcttcgccgaggtgctcggcctctacggtctcatcgtcgccctcatcctctccacaaagtagaccctctccgagcccaccagccacagaatattatgtaaagaccacccctcctcattccagaacgaacagcctgacacatacgcacggggccgccgcccccagtagttggtcttgtacatgcgcagtgtcctagtgcccatcgtctgtttccccggccttgcccccgcccgccccgtgccgtggacatctgggcccactcatcgcccctccaggcccccggcgccccaccccctagagtgctctgtgtatgcggatgatttagaattgtcatttctctttactggatgtttatttataaagatctggcctgttcctgcgtctgcggagcggcccttgtctcccagctatctataaccttagctagagtgtcgccttgtgggttcctgttgctgagacttcctggatggagccgccctcaccgccgggcccgtggccctgcgcggagctgtgtccaataaagttcttggatgtga

SEQ ID NO: 104275 - DNA, 1320 bp, Homo sapiens
cccggcgcgagaccggtccaacgctgcggagatccagaggccggcggcgcccggaaacacccgcggaggccgaggcagggcggggccgggcgccggggccgggtcgctgggcgggcggcacagcccgggggaggtcaacgggccggccgggcgtcccggggacgcgtctcccccacggtgcgaagtggtacggctcgcaggggcggggcccaggtcatgtgacgcggccgcggccgccattttgttctgcggtgctggtatttagagcgcagcggctgacgggccggatcgccttcgccgccgcccgcccgcaaaccttcgtgcccggcccgtcctcgcccccgcctccgccaccgcctcggcccgcagagcttgccccctccccacccgcagacatgtccgagtccaagagcggccccgagtatgcttcgtttttcgccgtcatgggcgcctcggccgccatggtcttcagcgccctgggcgctgcctatggcacagccaagagcggtaccggcattgcggccatgtctgtcatgcggccggagcagatcatgaagtccatcatcccagtggtcatggctggcatcatcgccatctacggcctggtggtggcagtcctcatcgccaactccctgaatgacgacatcagcctctacaagagcttcctccagctgggcgccggcctgagcgtgggcctgagcggcctggcagccggctttgccatcggcatcgtgggggacgctggcgtgcggggcaccgcccagcagccccgactattcgtgggcatgatcctgattctcatcttcgccgaggtgctcggcctctacggtctcatcgtcgccctcatcctctccacaaagtagaccctctccgagcccaccagccacagaatattatgtaaagaccacccctcctcattccagaacgaacagcctgacacatacgcacggggccgccgcccccagtagttggtcttgtacatgcgcagtgtcctagtgcccatcgtctgtttccccggccttgcccccgcccgccccgtgccgtggacatctgggcccactcatcgcccctccaggcccccggcgccccaccccctagagtgctctgtgtatgcggatgatttagaattgtcatttctctttactggatgtttatttataaagatctggcctgttcctgcgtctgcggagcggcccttgtctcccagctatctataaccttagctagagtgtcgccttgtgggttcctgttgctgagacttcctggatggagccgccctcaccgccggcccataaccggcgactttcattttttttgttt

SEQ ID NO: 104276 - DNA, 1016 bp, Homo sapiens
aaggaacacagcacaaagctaagctaggacaggctgggatgaaatcggcagagggccccctccccacccgcagacatgtccgagtccaagagcggccccgagtatgcttcgtttttcgccgtcatgggcgcctcggccgccatggtcttcagcgccctgggcgctgcctatggcacagccaagagcggtaccggcattgcggccatgtctgtcatgcggccggagcagatcatgaagtccatcatcccagtggtcatggctggcatcatcgccatctacggcctggtggtggcagtcctcatcgccaactccctgaatgacgacatcagcctctacaagagcttcctccagctgggcgccggcctgagcgtgggcctgagcggcctggcagccggctttgccatcggcatcgtgggggacgctggcgtgcggggcaccgcccagcagccccgactattcgtgggcatgatcctgattctcatcttcgccgaggtgctcggcctctacggtctcatcgtcgccctcatcctctccacaaagtagaccctctccgagcccaccagccacagaatattatgtaaagaccacccctcctcattccagaacgaacagcctgacacatacgcacggggccgccgcccccagtagttggtcttgtacatgcgcagtgtcctagtgcccatcgtctgtttccccggccttgcccccgcccgccccgtgccgtggacatctgggcccactcatcgcccctccaggcccccggcgccccaccccctagagtgctctgtgtatgcggatgatttagaattgtcatttctctttactggatgtttatttataaagatctggcctgttcctgcgtctgcggagcggcccttgtctcccagctatctataaccttagctagagtgtcgccttgtgggttcctgttgctgagacttcctggatggagccgccctcaccgccgggcccgtggccctgcgcggagctgtgtccaataaagttcttggatgtga

SEQ ID NO: 104277 - DNA, 1007 bp, Homo sapiens
tcacatccaagaactttattggacacagctccgcgcagggccacggccccctccccacccgcagacatgtccgagtccaagagcggccccgagtatgcttcgtttttcgccgtcatgggcgcctcggccgccatggtcttcagcgccctgggcgctgcctatggcacagccaagagcggtaccggcattgcggccatgtctgtcatgcggccggagcagatcatgaagtccatcatcccagtggtcatggctggcatcatcgccatctacggcctggtggtggcagtcctcatcgccaactccctgaatgacgacatcagcctctacaagagcttcctccagctgggcgccggcctgagcgtgggcctgagcggcctggcagccggctttgccatcggcatcgtgggggacgctggcgtgcggggcaccgcccagcagccccgactattcgtgggcatgatcctgattctcatcttcgccgaggtgctcggcctctacggtctcatcgtcgccctcatcctctccacaaagtagaccctctccgagcccaccagccacagaatattatgtaaagaccacccctcctcattccagaacgaacagcctgacacatacgcacggggccgccgcccccagtagttggtcttgtacatgcgcagtgtcctagtgcccatcgtctgtttccccggccttgcccccgcccgccccgtgccgtggacatctgggcccactcatcgcccctccaggcccccggcgccccaccccctagagtgctctgtgtatgcggatgatttagaattgtcatttctctttactggatgtttatttataaagatctggcctgttcctgcgtctgcggagcggcccttgtctcccagctatctataaccttagctagagtgtcgccttgtgggttcctgttgctgagacttcctggatggagccgccctcaccgccgggcccgtggccctgcgcggagctgtgtccaataaagttcttggatgtga

SEQ ID NO: 104278 - DNA, 989 bp, Homo sapiens
aggctggtacggcacggagtggtggatgccccctccccacccgcagacatgtccgagtccaagagcggccccgagtatgcttcgtttttcgccgtcatgggcgcctcggccgccatggtcttcagcgccctgggcgctgcctatggcacagccaagagcggtaccggcattgcggccatgtctgtcatgcggccggagcagatcatgaagtccatcatcccagtggtcatggctggcatcatcgccatctacggcctggtggtggcagtcctcatcgccaactccctgaatgacgacatcagcctctacaagagcttcctccagctgggcgccggcctgagcgtgggcctgagcggcctggcagccggctttgccatcggcatcgtgggggacgctggcgtgcggggcaccgcccagcagccccgactattcgtgggcatgatcctgattctcatcttcgccgaggtgctcggcctctacggtctcatcgtcgccctcatcctctccacaaagtagaccctctccgagcccaccagccacagaatattatgtaaagaccacccctcctcattccagaacgaacagcctgacacatacgcacggggccgccgcccccagtagttggtcttgtacatgcgcagtgtcctagtgcccatcgtctgtttccccggccttgcccccgcccgccccgtgccgtggacatctgggcccactcatcgcccctccaggcccccggcgccccaccccctagagtgctctgtgtatgcggatgatttagaattgtcatttctctttactggatgtttatttataaagatctggcctgttcctgcgtctgcggagcggcccttgtctcccagctatctataaccttagctagagtgtcgccttgtgggttcctgttgctgagacttcctggatggagccgccctcaccgccgggcccgtggccctgcgcggagctgtgtccaataaagttcttggatgtga

SEQ ID NO: 104279 - DNA, 1555 bp, Homo sapiens
cccggcgcgagaccggtccaacgctgcggagatccagaggccggcggcgcccggaaacacccgcggaggccgaggcagggcggggccgggcgccggggccgggtcgctgggcgggcggcacagcccgggggaggtcaacgggccggccgggcgtcccggggacgcgtctcccccacggtgcgaagtggtacggctcgcaggggcggggcccaggtcatgtgacgcggccgcggccgccattttgttctgcggtgctggtatttagagcgcagcggctgacgggccggatcgccttcgccgccgcccgcccgcaaaccttcgtgcccggcccgtcctcgcccccgcctccgccaccgcctcggcccgcagagcttgccccctccccacccgcagacatgtccgagtccaagagcggccccgagtatgcttcgtttttcgccgtcatgggcgcctcggccgccatggtcttcagcggtgagcgcggaaggcagggagggactcgggggcgggggcgcgcgcagtcgctcatgcccgcagctcgccggggtccggtgtgtgacgtcactctgacgtaatcccagagctgacgggggcgcccgggcctcgtgtgacagcgggcgggggtcggcgccccgagggctgcggggagccgccgggggtccggggcgcagggcatgcgggcctggacggggtccctgggcgctgcctatggcacagccaagagcggtaccggcattgcggccatgtctgtcatgcggccggagcagatcatgaagtccatcatcccagtggtcatggctggcatcatcgccatctacggcctggtggtggcagtcctcatcgccaactccctgaatgacgacatcagcctctacaagagcttcctccagctgggcgccggcctgagcgtgggcctgagcggcctggcagccggctttgccatcggcatcgtgggggacgctggcgtgcggggcaccgcccagcagccccgactattcgtgggcatgatcctgattctcatcttcgccgaggtgctcggcctctacggtctcatcgtcgccctcatcctctccacaaagtagaccctctccgagcccaccagccacagaatattatgtaaagaccacccctcctcattccagaacgaacagcctgacacatacgcacggggccgccgcccccagtagttggtcttgtacatgcgcagtgtcctagtgcccatcgtctgtttccccggccttgcccccgcccgccccgtgccgtggacatctgggcccactcatcgcccctccaggcccccggcgccccaccccctagagtgctctgtgtatgcggatgatttagaattgtcatttctctttactggatgtttatttataaagatctggcctgttcctgcgtctgcggagcggcccttgtctcccagctatctataaccttagctagagtgtcgccttgtgggttcctgttgctgagacttcctggatggagccgccctcaccgccgggcccgtggccctgcgcggagctgtgtccaataaagttcttggatgtga

SEQ ID NO: 104280 - DNA, 1283 bp, Homo sapiens
cccggcgcgagaccggtccaacgctgcggagatccagaggccggcggcgcccggaaacacccgcggaggccgaggcagggcggggccgggcgccggggccgggtcgctgggcgggcggcacagcccgggggaggtcaacgggccggccgggcgtcccggggacgcgtctcccccacggtgcgaagtggtacggctcgcaggggcggggcccaggtcatgtgacgcggccgcggccgccattttgttctgcggtgctggtatttagagcgcagcggctgacgggccggatcgccttcgccgccgcccgcccgcaaaccttcgtgcccggcccgtcctcgcccccgcctccgccaccgcctcggcccgcagagcttgccccctccccacccgcagacatgtccgagtccaagagcggccccgaccctgggcgctgcctatggcacagccaagagcggtaccggcattgcggccatgtctgtcatgcggccggagcagatcatgaagtccatcatcccagtggtcatggctggcatcatcgccatctacggcctggtggtggcagtcctcatcgccaactccctgaatgacgacatcagcctctacaagagcttcctccagctgggcgccggcctgagcgtgggcctgagcggcctggcagccggctttgccatcggcatcgtgggggacgctggcgtgcggggcaccgcccagcagccccgactattcgtgggcatgatcctgattctcatcttcgccgaggtgctcggcctctacggtctcatcgtcgccctcatcctctccacaaagtagaccctctccgagcccaccagccacagaatattatgtaaagaccacccctcctcattccagaacgaacagcctgacacatacgcacggggccgccgcccccagtagttggtcttgtacatgcgcagtgtcctagtgcccatcgtctgtttccccggccttgcccccgcccgccccgtgccgtggacatctgggcccactcatcgcccctccaggcccccggcgccccaccccctagagtgctctgtgtatgcggatgatttagaattgtcatttctctttactggatgtttatttataaagatctggcctgttcctgcgtctgcggagcggcccttgtctcccagctatctataaccttagctagagtgtcgccttgtgggttcctgttgctgagacttcctggatggagccgccctcaccgccgggcccgtggccctgcgcggagctgtgtccaataaagttcttggatgtga

SEQ ID NO: 104281 - DNA, 1081 bp, Homo sapiens
ctcgtgacgaattcggcagtggctgtcctggcctccttttgcttgcccgtggctgttcctcctgggtcctcttgccctgggctggatgccttcttcggctccccctctgcatgtgataacttggggtggcccttggagctgtgccaaagctacacctcggggtcctagtctcaactggcctgcgtactgctgtgggctcaccccgccttcctcccacagccctgggcgctgcctatggcacagccaagagcggtaccggcattgcggccatgtctgtcatgcggccggagcagatcatgaagtccatcatcccagtggtcatggctggcatcatcgccatctacggcctggtggtggcagtcctcatcgccaactccctgaatgacgacatcagcctctacaagagcttcctccagctgggcgccggcctgagcgtgggcctgagcggcctggcagccggctttgccatcggcatcgtgggggacgctggcgtgcggggcaccgcccagcagccccgactattcgtgggcatgatcctgattctcatcttcgccgaggtgctcggcctctacggtctcatcgtcgccctcatcctctccacaaagtagaccctctccgagcccaccagccacagaatattatgtaaagaccacccctcctcattccagaacgaacagcctgacacatacgcacggggccgccgcccccagtagttggtcttgtacatgcgcagtgtcctagtgcccatcgtctgtttccccggccttgcccccgcccgccccgtgccgtggacatctgggcccactcatcgcccctccaggcccccggcgccccaccccctagagtgctctgtgtatgcggatgatttagaattgtcatttctctttactggatgtttatttataaagatctggcctgttcctgcgtctgcggagcggcccttgtctcccagctatctataaccttagctagagtgtcgccttgtgggttcctgttgctgagacttcctggatggagccgccctcaccgccgggcccgtggccctgcgcggagctgtgtccaataaagttcttggatgtga

SEQ ID NO: 104282 - DNA, 1572 bp, Homo sapiens
  misc_feature (558)..(558): n is a, c, g, or t
  misc_feature (641)..(642): n is a, c, g, or t
  misc_feature (644)..(646): n is a, c, g, or t
  misc_feature (657)..(657): n is a, c, g, or t
  misc_feature (663)..(663): n is a, c, g, or t
tttagagcttctccatttttattacacaaaattgttaagttttcacatccaagaactttattggacacagctccgcgcagggccacgggcccggcggtgagggcggctccatccaggaagtctcagcaacaggaacccacaaggcgacactctagctaaggttatagatagctgggagacaagggccgctccgcagacgcaggaacaggccagatctttataaataaacatccagtaaagagaaatgacaattctaaatcatccgcatacacagagcactctaggggggtggggcgccgggggcctggaggggcgatgagtgggcccagatgtccacggcacggggcgggcgggggcaaggccggggaaacagacgatgggcactaggacactgcgcatgtacaagaccaactactgggggcggcggccccgtgcgtatgtgtcaggctgttcgttctggaatacagaggggtggtctttacataatattctgtggctggtgggctcggagagggtctactttgtggagaggatgagggcgacgatgagaccgtagangccgagcacctcggcgaagatgagaatcaggatcatgcccacgaatagtcggggctgctgggcggtgcccgcacgccagcgtnncnnncgatgccgatngcaaanccggctgccaggccgctcaggccacgctcaggccggcgcccagctggaggaagctcttgtagaggctgatgtcgtcattcagggagttggcgatgaggactgccaccaccaggccgtagatggcgatgatgccagccatgaccactgggataatggcatcatcgccatctacggcctggtggtggcagtcctcatcgccaactccctgaatgacgacatcagcctctacaagagcttcctccagctgggcgccggcctgagcgtgggcctgagcggcctggcagccggctttgccatcggcatcgtgggggacgctggcgtgcggggcaccgcccagcagccccgactattcgtgggcatgatcctgattctcatcttcgccgaggtgctcggcctctacggtctcatcgtcgccctcatcctctccacaaagtagaccctctccgagcccaccagccacagaatattatgtaaagaccacccctcctcattccagaacgaacagcctgacacatacgcacggggccgccgcccccagtagttggtcttgtacatgcgcagtgtcctagtgcccatcgtctgtttccccggccttgcccccgcccgccccgtgccgtggacatctgggcccactcatcgcccctccaggcccccggcgccccaccccctagagtgctctgtgtatgcggatgatttagaattgtcatttctctttactggatgtttatttataaagatctggcctgttcctgcgtctgcggagcggcccttgtctcccagctatctataaccttagctagagtgtcgccttgtgggttcctgttgctgagacttcctggatggagccgccctcaccgccgggcccgtggccctgcgcggagctgtgtccaataaagttcttggatgtga

SEQ ID NO: 104283 - DNA, 2393 bp, Homo sapiens
  misc_feature (1379)..(1379): n is a, c, g, or t
  misc_feature (1462)..(1463): n is a, c, g, or t
  misc_feature (1465)..(1467): n is a, c, g, or t
  misc_feature (1478)..(1478): n is a, c, g, or t
  misc_feature (1484)..(1484): n is a, c, g, or t
cccctgcgccgggtctccctcttctcgctccgtctcccctctgctcctcccgttcgccgttcctgctcctcccgctttctcccgttctccccccctcttcgtttccgttgctccggcccagctcgcccgtcccgtctccgcgtctgtctcttctctctttctcctcctgtctgctgtcttcttgctctcctgctgtccctctcctgtccttcccgctcccctctgtcctctcccgtcctctccttttgttgtttgtgtttcttcttgctcgttgttttttcggtttggtttggcttttggtttgttcttgtcgtcgttggttttgttttcgcgtgtttgtcgctttggctgctggtttgtgttgtttgtttgtttgtttcgcgattatggtttctgctggtgttgttttctttggtctttgtggtataaaactgtgtgttctttaagccttatcttctgttttggtgttactttcttctttctgtttggtgatttttgctgcgcttgtttttatcccttcttgtacgctcttcaatacgtgctatacattccccccatggatgcgttctattgttcctggtgtgtgaacgtggttcccatattttcactatgcacacgtatttgaagtgttcgttaccactagagggtgcacacgctagactgcgttgttgccagcatccgtgactctgttttgtaactagctggtcccaggtgctcgttacttgttagtagatactgcctcctttaaatggatcccacgcttgtatcataacaaaactctggggaccgtcttaacttgtggccccttggggatattttggaaaaccccctcttttttttttttttttttttttttttttttttcacatccaagaactttattggacacagctccgcgcagggccacgggcccggcggtgagggcggctccatccaggaagtctcagcaacaggaacccacaaggcgacactctagctaaggttatagatagctgggagacaagggccgctccgcagacgcaggaacaggccagatctttataaataaacatccagtaaagagaaatgacaattctaaatcatccgcatacacagagcactctaggggggtggggcgccgggggcctggaggggcgatgagtgggcccagatgtccacggcacggggcgggcgggggcaaggccggggaaacagacgatgggcactaggacactgcgcatgtacaagaccaactactgggggcggcggccccgtgcgtatgtgtcaggctgttcgttctggaatacagaggggtggtctttacataatattctgtggctggtgggctcggagagggtctactttgtggagaggatgagggcgacgatgagaccgtagangccgagcacctcggcgaagatgagaatcaggatcatgcccacgaatagtcggggctgctgggcggtgcccgcacgccagcgtnncnnncgatgccgatngcaaanccggctgccaggccgctcaggccacgctcaggccggcgcccagctggaggaagctcttgtagaggctgatgtcgtcattcagggagttggcgatgaggactgccaccaccaggccgtagatggcgatgatgccagccatgaccactgggataatggcatcatcgccatctacggcctggtggtggcagtcctcatcgccaactccctgaatgacgacatcagcctctacaagagcttcctccagctgggcgccggcctgagcgtgggcctgagcggcctggcagccggctttgccatcggcatcgtgggggacgctggcgtgcggggcaccgcccagcagccccgactattcgtgggcatgatcctgattctcatcttcgccgaggtgctcggcctctacggtctcatcgtcgccctcatcctctccacaaagtagaccctctccgagcccaccagccacagaatattatgtaaagaccacccctcctcattccagaacgaacagcctgacacatacgcacggggccgccgcccccagtagttggtcttgtacatgcgcagtgtcctagtgcccatcgtctgtttccccggccttgcccccgcccgccccgtgccgtggacatctgggcccactcatcgcccctccaggcccccggcgccccaccccctagagtgctctgtgtatgcggatgatttagaattgtcatttctctttactggatgtttatttataaagatctggcctgttcctgcgtctgcggagcggcccttgtctcccagctatctataaccttagctagagtgtcgccttgtgggttcctgttgctgagacttcctggatggagccgccctcaccgccgggcccgtggccctgcgcggagctgtgtccaataaagttcttggatgtga

SEQ ID NO: 104284 - DNA, 2198 bp, Homo sapiens
  misc_feature (1184)..(1184): n is a, c, g, or t
  misc_feature (1267)..(1268): n is a, c, g, or t
  misc_feature (1270)..(1272): n is a, c, g, or t
  misc_feature (1283)..(1283): n is a, c, g, or t
  misc_feature (1289)..(1289): n is a, c, g, or t
cccctgcgccgggtctccctcttctcgctccgtctcccctctgctcctcccgttcgccgttcctgctcctcccgctttctcccgttctccccccctcttcgtttccgttgctccggcccagctcgcccgtcccgtctccgcgtctgtctcttctctctttctcctcctgtctgctgtcttcttgctctcctgctgtccctctcctgtccttcccgctcccctctgtcctctcccgtcctctccttttgttgtttgtgtttcttcttgctcgttgttttttcggtttggtttggcttttggtttgttcttgtcgtcgttggttttgttttcgcgtgtttgtcgctttggctgctggtttgtgttgtttgtttgtttgtttcgcgattatggtttctgctggtgttgttttctttggtctttgtggtataaaactgtgtgttctttaagccttatcttctgttttggtgttactttcttctttctgtttggtgatttttgctgcgcttgtttttatcccttcttgtacgctcttcaatacgtgctatacattccccccatggatgcgttctattgttcctggtgtgtgaacgtggttcccatattttcactatgcacacgtatttgaagtgttcgttaccactagagggtgcacacgctagactgcgttgttgccagcatccgtgactctgttttgtaactagctggtcccaggtgctcgttacttgttagtagatactgcctcctttaaatggatcccacgcttgtatcataacaaaactctggggaccgtcttaacttgtggccccttggggatattttggaaaaccccctcttttttttttttttttttttttttttttttttcacatccaagaactttattggacacagctccgcgcagggccacgggcccggcggtgagggcggctccatccaggaagtctcagcaacaggaacccacaaggcgacactctagctaaggttatagatagctgggagacaagggccgctccgcagacgcaggaacaggccagatctttataaataaacatccagtaaagagaaatgacaattctaaatcatccgcatacagaggggtggtctttacataatattctgtggctggtgggctcggagagggtctactttgtggagaggatgagggcgacgatgagaccgtagangccgagcacctcggcgaagatgagaatcaggatcatgcccacgaatagtcggggctgctgggcggtgcccgcacgccagcgtnncnnncgatgccgatngcaaanccggctgccaggccgctcaggccacgctcaggccggcgcccagctggaggaagctcttgtagaggctgatgtcgtcattcagggagttggcgatgaggactgccaccaccaggccgtagatggcgatgatgccagccatgaccactgggataatggcatcatcgccatctacggcctggtggtggcagtcctcatcgccaactccctgaatgacgacatcagcctctacaagagcttcctccagctgggcgccggcctgagcgtgggcctgagcggcctggcagccggctttgccatcggcatcgtgggggacgctggcgtgcggggcaccgcccagcagccccgactattcgtgggcatgatcctgattctcatcttcgccgaggtgctcggcctctacggtctcatcgtcgccctcatcctctccacaaagtagaccctctccgagcccaccagccacagaatattatgtaaagaccacccctcctcattccagaacgaacagcctgacacatacgcacggggccgccgcccccagtagttggtcttgtacatgcgcagtgtcctagtgcccatcgtctgtttccccggccttgcccccgcccgccccgtgccgtggacatctgggcccactcatcgcccctccaggcccccggcgccccaccccctagagtgctctgtgtatgcggatgatttagaattgtcatttctctttactggatgtttatttataaagatctggcctgttcctgcgtctgcggagcggcccttgtctcccagctatctataaccttagctagagtgtcgccttgtgggttcctgttgctgagacttcctggatggagccgccctcaccgccgggcccgtggccctgcgcggagctgtgtccaataaagttcttggatgtga

SEQ ID NO: 104285 - DNA, 1065 bp, Homo sapiens
cccggcgcgagaccggtccaacgctgcggagatccagaggccggcggcgcccggaaacacccgcggaggccgaggcagggcggggccgggcgccggggccgggtcgctgggcgggcggcacagcccgggggaggtcaacgggccggccgggcgtcccggggacgcgtctcccccacggtgcgaagtggtacggctcgcaggggcggggcccaggtcatgtgacgcggccgcggccgccattttgttctgcggtgctggtatttagagcgcagcggctgacgggccggatcgccttcgccgccgcccgcccgcaaaccttcgtgcccggcccgtcctcgcccccgcctccgccaccgcctcggcccgcagagcttgccccctccccacccgcagacatgtccgagtccaagagcggccccgagtatgcttcgtttttcgccgtcatgggcgcctcggccgccatggtcttcagcgccctgggcgctgcctatggcacagccaagagcggtaccggcattgcggccatgtctgtcatgcggccggagcagatcatgaagtccatcatcccagtggtcatggctggcatcatcgccatctacggcctggtggtggcagtcctcatcgccaactccctgaatgacgacatcagcctctacaagagcttcctccagctgggcgccggcctgagcgtgggcctgagcggcctggcagccggctttgccatcggcatcgtgggggacgctggcgtgcggggcaccgcccagcagccccgactattcgtgggcatgatcctgattctcatcttcgccgaggtgctcggcctctacggtctcatcgtcgccctcatcctctccacaaagtagaccctctccgagcccaccagccacagaatattatgtaaagaccacccctcctcattccagaacgaacagcctgacacatacgcacggggccgccgcccccagtagttggtcttgtacatgcgcagtgtcctagtgcccatcgtctgtttccccggccttgccccccattatttgcccttcgtgtcttggggtcttccccctt

SEQ ID NO: 104286 - DNA, 826 bp, Homo sapiens
atcgccaactccctgaatgacgacatcaggccgtagatggcgatgatgccagccatgaccactgggataatggcatcatcgccatctacggcctggtggtggcagtcctcatcgccaactccctgaatgacgacatcagcctctacaagagcttcctccagctgggcgccggcctgagcgtgggcctgagcggcctggcagccggctttgccatcggcatcgtgggggacgctggcgtgcggggcaccgcccagcagccccgactattcgtgggcatgatcctgattctcatcttcgccgaggtgctcggcctctacggtctcatcgtcgccctcatcctctccacaaagtagaccctctccgagcccaccagccacagaatattatgtaaagaccacccctcctcattccagaacgaacagcctgacacatacgcacggggccgccgcccccagtagttggtcttgtacatgcgcagtgtcctagtgcccatcgtctgtttccccggccttgcccccgcccgccccgtgccgtggacatctgggcccactcatcgcccctccaggcccccggcgccccaccccctagagtgctctgtgtatgcggatgatttagaattgtcatttctctttactggatgtttatttataaagatctggcctgttcctgcgtctgcggagcggcccttgtctcccagctatctataaccttagctagagtgtcgccttgtgggttcctgttgctgagacttcctggatggagccgccctcaccgccgggcccgtggccctgcgcggagctgtgtccaataaagttcttggatgtga

SEQ ID NO: 104287 - DNA, 1220 bp, Homo sapiens
  misc_feature (558)..(558): n is a, c, g, or t
tttagagcttctccatttttattacacaaaattgttaagttttcacatccaagaactttattggacacagctccgcgcagggccacgggcccggcggtgagggcggctccatccaggaagtctcagcaacaggaacccacaaggcgacactctagctaaggttatagatagctgggagacaagggccgctccgcagacgcaggaacaggccagatctttataaataaacatccagtaaagagaaatgacaattctaaatcatccgcatacacagagcactctaggggggtggggcgccgggggcctggaggggcgatgagtgggcccagatgtccacggcacggggcgggcgggggcaaggccggggaaacagacgatgggcactaggacactgcgcatgtacaagaccaactactgggggcggcggccccgtgcgtatgtgtcaggctgttcgttctggaatacagaggggtggtctttacataatattctgtggctggtgggctcggagagggtctactttgtggagaggatgagggcgacgatgagaccgtagangccgagcacctcggcgaagatgagaatcaggatcatgcccacgaatagtcggggctgctgggcggtgcccgcacgccagcgtccgcccagcagccccgactattcgtgggcatgatcctgattctcatcttcgccgaggtgctcggcctctacggtctcatcgtcgccctcatcctctccacaaagtagaccctctccgagcccaccagccacagaatattatgtaaagaccacccctcctcattccagaacgaacagcctgacacatacgcacggggccgccgcccccagtagttggtcttgtacatgcgcagtgtcctagtgcccatcgtctgtttccccggccttgcccccgcccgccccgtgccgtggacatctgggcccactcatcgcccctccaggcccccggcgccccaccccctagagtgctctgtgtatgcggatgatttagaattgtcatttctctttactggatgtttatttataaagatctggcctgttcctgcgtctgcggagcggcccttgtctcccagctatctataaccttagctagagtgtcgccttgtgggttcctgttgctgagacttcctggatggagccgccctcaccgccgggcccgtggccctgcgcggagctgtgtccaataaagttcttggatgtga

SEQ ID NO: 104288 - DNA, 1846 bp, Homo sapiens
  misc_feature (1184)..(1184): n is a, c, g, or t
cccctgcgccgggtctccctcttctcgctccgtctcccctctgctcctcccgttcgccgttcctgctcctcccgctttctcccgttctccccccctcttcgtttccgttgctccggcccagctcgcccgtcccgtctccgcgtctgtctcttctctctttctcctcctgtctgctgtcttcttgctctcctgctgtccctctcctgtccttcccgctcccctctgtcctctcccgtcctctccttttgttgtttgtgtttcttcttgctcgttgttttttcggtttggtttggcttttggtttgttcttgtcgtcgttggttttgttttcgcgtgtttgtcgctttggctgctggtttgtgttgtttgtttgtttgtttcgcgattatggtttctgctggtgttgttttctttggtctttgtggtataaaactgtgtgttctttaagccttatcttctgttttggtgttactttcttctttctgtttggtgatttttgctgcgcttgtttttatcccttcttgtacgctcttcaatacgtgctatacattccccccatggatgcgttctattgttcctggtgtgtgaacgtggttcccatattttcactatgcacacgtatttgaagtgttcgttaccactagagggtgcacacgctagactgcgttgttgccagcatccgtgactctgttttgtaactagctggtcccaggtgctcgttacttgttagtagatactgcctcctttaaatggatcccacgcttgtatcataacaaaactctggggaccgtcttaacttgtggccccttggggatattttggaaaaccccctcttttttttttttttttttttttttttttttttcacatccaagaactttattggacacagctccgcgcagggccacgggcccggcggtgagggcggctccatccaggaagtctcagcaacaggaacccacaaggcgacactctagctaaggttatagatagctgggagacaagggccgctccgcagacgcaggaacaggccagatctttataaataaacatccagtaaagagaaatgacaattctaaatcatccgcatacagaggggtggtctttacataatattctgtggctggtgggctcggagagggtctactttgtggagaggatgagggcgacgatgagaccgtagangccgagcacctcggcgaagatgagaatcaggatcatgcccacgaatagtcggggctgctgggcggtgcccgcacgccagcgtccgcccagcagccccgactattcgtgggcatgatcctgattctcatcttcgccgaggtgctcggcctctacggtctcatcgtcgccctcatcctctccacaaagtagaccctctccgagcccaccagccacagaatattatgtaaagaccacccctcctcattccagaacgaacagcctgacacatacgcacggggccgccgcccccagtagttggtcttgtacatgcgcagtgtcctagtgcccatcgtctgtttccccggccttgcccccgcccgccccgtgccgtggacatctgggcccactcatcgcccctccaggcccccggcgccccaccccctagagtgctctgtgtatgcggatgatttagaattgtcatttctctttactggatgtttatttataaagatctggcctgttcctgcgtctgcggagcggcccttgtctcccagctatctataaccttagctagagtgtcgccttgtgggttcctgttgctgagacttcctggatggagccgccctcaccgccgggcccgtggccctgcgcggagctgtgtccaataaagttcttggatgtga

SEQ ID NO: 104289 - DNA, 606 bp, Homo sapiens
cctagaggatcccgtctgcatttcagccgcccagcagccccgactattcgtgggcatgatcctgattctcatcttcgccgaggtgctcggcctctacggtctcatcgtcgccctcatcctctccacaaagtagaccctctccgagcccaccagccacagaatattatgtaaagaccacccctcctcattccagaacgaacagcctgacacatacgcacggggccgccgcccccagtagttggtcttgtacatgcgcagtgtcctagtgcccatcgtctgtttccccggccttgcccccgcccgccccgtgccgtggacatctgggcccactcatcgcccctccaggcccccggcgccccaccccctagagtgctctgtgtatgcggatgatttagaattgtcatttctctttactggatgtttatttataaagatctggcctgttcctgcgtctgcggagcggcccttgtctcccagctatctataaccttagctagagtgtcgccttgtgggttcctgttgctgagacttcctggatggagccgccctcaccgccgggcccgtggccctgcgcggagctgtgtccaataaagttcttggatgtga

SEQ ID NO: 104290 - DNA, 619 bp, Homo sapiens
attgagcaataacaggtctgtgatgcccttagatgtccgccgcccagcagccccgactattcgtgggcatgatcctgattctcatcttcgccgaggtgctcggcctctacggtctcatcgtcgccctcatcctctccacaaagtagaccctctccgagcccaccagccacagaatattatgtaaagaccacccctcctcattccagaacgaacagcctgacacatacgcacggggccgccgcccccagtagttggtcttgtacatgcgcagtgtcctagtgcccatcgtctgtttccccggccttgcccccgcccgccccgtgccgtggacatctgggcccactcatcgcccctccaggcccccggcgccccaccccctagagtgctctgtgtatgcggatgatttagaattgtcatttctctttactggatgtttatttataaagatctggcctgttcctgcgtctgcggagcggcccttgtctcccagctatctataaccttagctagagtgtcgccttgtgggttcctgttgctgagacttcctggatggagccgccctcaccgccgggcccgtggccctgcgcggagctgtgtccaataaagttcttggatgtga

SEQ ID NO: 104291 - DNA, 605 bp, Homo sapiens
gctgacttgaggatccgacactctaccgcccagcagccccgactattcgtgggcatgatcctgattctcatcttcgccgaggtgctcggcctctacggtctcatcgtcgccctcatcctctccacaaagtagaccctctccgagcccaccagccacagaatattatgtaaagaccacccctcctcattccagaacgaacagcctgacacatacgcacggggccgccgcccccagtagttggtcttgtacatgcgcagtgtcctagtgcccatcgtctgtttccccggccttgcccccgcccgccccgtgccgtggacatctgggcccactcatcgcccctccaggcccccggcgccccaccccctagagtgctctgtgtatgcggatgatttagaattgtcatttctctttactggatgtttatttataaagatctggcctgttcctgcgtctgcggagcggcccttgtctcccagctatctataaccttagctagagtgtcgccttgtgggttcctgttgctgagacttcctggatggagccgccctcaccgccgggcccgtggccctgcgcggagctgtgtccaataaagttcttggatgtga

SEQ ID NO: 104292 - DNA, 1303 bp, Homo sapiens
cccggcgcgagaccggtccaacgctgcggagatccagaggccggcggcgcccggaaacacccgcggaggccgaggcagggcggggccgggcgccggggccgggtcgctgggcgggcggcacagcccgggggaggtcaacgggccggccgggcgtcccggggacgcgtctcccccacggtgcgaagtggtacggctcgcaggggcggggcccaggtcatgtgacgcggccgcggccgccattttgttctgcggtgctggtatttagagcgcagcggctgacgggccggatcgccttcgccgccgcccgcccgcaaaccttcgtgcccggcccgtcctcgcccccgcctccgccaccgcctcggcccgcagagcttgccccctccccacccgcagacatgtccgagtccaagagcggccccgagtatgcttcgtttttcgccgtcatgggcgcctcggccgccatggtcttcagcgccctgggcgctgcctatggcacagccaagagcggtaccggcattgcggccatgtctgtcatgcggccggagcagatcatgaagtccatcatcccagtggtcatggctggcatcatcgccatctacggcctggtggtggcagtcctcatcgccaactccctgaatgacgacatcagcctctacaagagcttcctccagctgggcgccggcctgagcgtgggcctgagcggcctggcagccggctttgccatcggcatcgtgggggacgctggcgtgcggggcaccgcccagcagccccgactattcgtgggcatgatcctgattctcatcgtcgccctcatcctctccacaaagtagaccctctccgagcccaccagccacagaatattatgtaaagaccacccctcctcattccagaacgaacagcctgacacatacgcacggggccgccgcccccagtagttggtcttgtacatgcgcagtgtcctagtgcccatcgtctgtttccccggccttgcccccgcccgccccgtgccgtggacatctgggcccactcatcgcccctccaggcccccggcgccccaccccctagagtgctctgtgtatgcggatgatttagaattgtcatttctctttactggatgtttatttataaagatctggcctgttcctgcgtctgcggagcggcccttgtctcccagctatctataaccttagctagagtgtcgccttgtgggttcctgttgctgagacttcctggatggagccgccctcaccgccgggcccgtggccctgcgcggagctgtgtccaataaagttcttggatgtga

SEQ ID NO: 104293 - DNA, 1000 bp, Homo sapiens
tttagagcttctccatttttattacacaaaattgttaagttttcacatccaagaactttattggacacagctccgcgcagggccacgggcccggcggtgagggcggctccatccaggaagtctcagcaacaggaacccacaaggcgacactctagctaaggttatagatagctgggagacaagggccgctccgcagacgcaggaacaggccagatctttataaataaacatccagtaaagagaaatgacaattctaaatcatccgcatacacagagcactctaggggggtggggcgccgggggcctggaggggcgatgagtgggcccagatgtccacggcacggggcgggcgggggcaaggccggggaaacagacgatgggcactaggacactgcgcatgtacaagaccaactactgggggcggcggccccgtgcgtatgtgtcaggctgttcgttctggaatacagaggggtggtctttacataatattctgtggctggtgggctcggagagggtctactttgtggagaggatgagggcccaccagccacagaatattatgtaaagaccacccctcctcattccagaacgaacagcctgacacatacgcacggggccgccgcccccagtagttggtcttgtacatgcgcagtgtcctagtgcccatcgtctgtttccccggccttgcccccgcccgccccgtgccgtggacatctgggcccactcatcgcccctccaggcccccggcgccccaccccctagagtgctctgtgtatgcggatgatttagaattgtcatttctctttactggatgtttatttataaagatctggcctgttcctgcgtctgcggagcggcccttgtctcccagctatctataaccttagctagagtgtcgccttgtgggttcctgttgctgagacttcctggatggagccgccctcaccgccgggcccgtggccctgcgcggagctgtgtccaataaagttcttggatgtga

SEQ ID NO: 104294 - DNA, 1221 bp, Homo sapiens
cccggcgcgagaccggtccaacgctgcggagatccagaggccggcggcgcccggaaacacccgcggaggccgaggcagggcggggccgggcgccggggccgggtcgctgggcgggcggcacagcccgggggaggtcaacgggccggccgggcgtcccggggacgcgtctcccccacggtgcgaagtggtacggctcgcaggggcggggcccaggtcatgtgacgcggccgcggccgccattttgttctgcggtgctggtatttagagcgcagcggctgacgggccggatcgccttcgccgccgcccgcccgcaaaccttcgtgcccggcccgtcctcgcccccgcctccgccaccgcctcggcccgcagagcttgccccctccccacccgcagacatgtccgagtccaagagcggccccgagtatgcttcgtttttcgccgtcatgggcgcctcggccgccatggtcttcagcgccctgggcgctgcctatggcacagccaagagcggtaccggcattgcggccatgtctgtcatgcggccggagcagatcatgaagtccatcatcccagtggtcatggctggcatcatcgccatctacggcctggtggtggcagtcctcatcgccaactccctgaatgacgacatcagcctctacaagagcttcctccagctgggcgccggcctgagcgtgggcctgagcggcctggcagccggctttgccatcggcatcgtgggggacgctggcgtgcggggcaccgcccagcagccccgactattcgtgggcatgatcctgattctcatcttcgccgaggtgctcggcctctacggtctcatcgtcgccctcatcctctccacaaagtagaccctctccgagcccaccagccacagaatattatgtaaagaccacccctcgcccgccccgtgccgtggacatctgggcccactcatcgcccctccaggcccccggcgccccaccccctagagtgctctgtgtatgcggatgatttagaattgtcatttctctttactggatgtttatttataaagatctggcctgttcctgcgtctgcggagcggcccttgtctcccagctatctataaccttagctagagtgtcgccttgtgggttcctgttgctgagacttcctggatggagccgccctcaccgccgggcccgtggccctgcgcggagctgtgtccaataaagttcttggatgtga

SEQ ID NO: 104295 - DNA, 1135 bp, Homo sapiens
cccggcgcgagaccggtccaacgctgcggagatccagaggccggcggcgcccggaaacacccgcggaggccgaggcagggcggggccgggcgccggggccgggtcgctgggcgggcggcacagcccgggggaggtcaacgggccggccgggcgtcccggggacgcgtctcccccacggtgcgaagtggtacggctcgcaggggcggggcccaggtcatgtgacgcggccgcggccgccattttgttctgcggtgctggtatttagagcgcagcggctgacgggccggatcgccttcgccgccgcccgcccgcaaaccttcgtgcccggcccgtcctcgcccccgcctccgccaccgcctcggcccgcagagcttgccccctccccacccgcagacatgtccgagtccaagagcggccccgagtatgcttcgtttttcgccgtcatgggcgcctcggccgccatggtcttcagcgccctgggcgctgcctatggcacagccaagagcggtaccggcattgcggccatgtctgtcatgcggccggagcagatcatgaagtccatcatcccagtggtcatggctggcatcatcgccatctacggcctggtggtggcagtcctcatcgccaactccctgaatgacgacatcagcctctacaagagcttcctccagctgggcgccgctcaggcccacgctcaggcgggccggatcgccttcgccgccgcccgcccgcaaccttcgtgcccggcccgtcctcgcccccgggcatgcgccgacctgattcggggccgctgatgctttgatcctcttctcttcccggagacgtagctgcccagggttcagggacgcgatccctgaggtcatcgcatccgacatcgcgacgacagagattaataggggtcgatcctcggaagccgcaaaaaagtggtaatacaaactagatctcattgtgaaaacatagccatcaatgatcacactcaatctcaagaacagcgaaaccagggctgtagcacgaatcaagtcaacctggtcccatggcggcccgagcaataaaatcgagttaaggtctaattgaacaaggtcgactaattgctgatagtaatggaactcataacgtgtggtggtggaaacatcaa

SEQ ID NO: 104296 - DNA, 873 bp, Homo sapiens
cccggcgcgagaccggtccaacgctgcggagatccagaggccggcggcgcccggaaacacccgcggaggccgaggcagggcggggccgggcgccggggccgggtcgctgggcgggcggcacagcccgggggaggtcaacgggccggccgggcgtcccggggacgcgtctcccccacggtgcgaagtggtacggctcgcaggggcggggcccaggtcatgtgacgcggccgcggccgccattttgttctgcggtgctggtatttagagcgcagcggctgacgggccggatcgccttcgccgccgcccgcccgcaaaccttcgtgcccggcccgtcctcgcccccgcctccgccaccgcctcggcccgcagagcttgccccctccccacccgcagacatgtccgagtccaagagcggccccgagtatgcttcgtttttcgccgtcatgggcgcctcggccgccatggtcttcagcgccctgggcgctgcctatggcacagccaagagcggtaccggcattgcggccatgtctgtcatgcggccggagcagatcatgaagtccatcatcccagtggtcatggctggcatcatcgccatctacggcctggtggtggcagtcctcatcgccaacccctagagtgctctgtgtatgcggatgatttagaattgtcatttctctttactggatgtttatttataaagatctggcctgttcctgcgtctgcggagcggcccttgtctcccagctatctataaccttagctagagtgtcgccttgtgggttcctgttgctgagacttcctggatggagccgccctcaccgccgggcccgtggccctgcgcggagctgtgtccaataaagttcttggatgtga

SEQ ID NO: 104297 - DNA, 1048 bp, Homo sapiens
  misc_feature (809)..(809): n is a, c, g, or t
  misc_feature (812)..(812): n is a, c, g, or t
tttagagcttctccatttttattacacaaaattgttaagttttcacatccaagaactttattggacacagctccgcgcagggccacgggcccggcggtgagggcggctccatccaggaagtctcagcaacaggaacccacaaggcgacactctagctaaggttatagatagctgggagacaagggccgctccgcagacgcaggaacaggccagatctttataaataaacatccagtaaagagaaatgacaattctaaatcatccgcatacacagagcactctaggggggtggggcgccgggggcctggaggggcgatgagtgggcccagatgtccacggcacggggcgggcgggggcaaggccggggaaacagacgatgggcactaggacactgcgcatgtacaagaccaactactgggggcggcggccccgtgcgtatgtgtcaggctgttcgttctggaatacagaggggtggtctttacataatatgcccgccccgtgccgtggacatctgggcccactcatcgcccctccaggcccccggcgccccaccccctagagtgctctgtgtatgcggatgatttagaattgtcatttctctttactggatgtttatttataaagatctggcctgttcctgcgtctgcggagcggcccttgtctcccagctatctataaccttagctagagtgtcgccttgtgggttcctgttgctgagacttcctggatggagccgccctcaccgccgggcccgtggccctgcgcggagctgtgtccaataaagttcttggatgtgaaaaaaaaaccanaanaacacggcagggcccagtgcggggcggacaacaaaggcaggcagggcccaggtcatggggtcccagaccgggttcggtccagggagactgcgggcccaaaggaaggaaaacgcagcacaggtacggtagaccggaagagaagacgcgaggcgggagacacctgaccaaagcgcggcacgctggacaccaccaccgcgcgcgcacaacgatcacacgcaacggtgtccacgcccgcc

SEQ ID NO: 104298 - DNA, 606 bp, Homo sapiens
cccggcgcgagaccggtccaacgctgcggagatccagaggccggcggcgcccggaaacacccgcggaggccgaggcagggcggggccgggcgccggggccgggtcgctgggcgggcggcacagcccgggggaggtcaacgggccggccgggcgtcccggggacgcgtctcccccacggtgcgaagtggtacggctcgcaggggcggggcccaggtcatgtgacgcggccgcggccgccattttgttctgcggtgctggtatttagagcgcagcggctgacgggccggatcgccttcgccgccgcccgcccgcaaaccttcgtgcccggcccgtcctcgcccccgcctccgccaccgcctcggcccgcagagctttgcgcgccgcgtccccacaccgcggctaggactatgtccggagtccaaggaggcggaaccaccgagtatgcattcagtcatgtcagcacagatcactggtgctgctcatctgagacagctcgatggtcttttcagccggcgccatgggcggcttgacttactggctacatgcccaagatgcgcggtacgccaggcatagcggggcgatgtcttgtctaatgcgtgccgggag

SEQ ID NO: 104299 - DNA, 997 bp, Homo sapiens
cccggcgcgagaccggtccaacgctgcggagatccagaggccggcggcgcccggaaacacccgcggaggccccctccccacccgcagacatgtccgagtccaagagcggccccgagtatgcttcgtttttcgccgtcatgggcgcctcggccgccatggtcttcagcgccctgggcgctgcctatggcacagccaagagcggtaccggcattgcggccatgtctgtcatgcggccggagcagatcatgaagtccatcatcccagtggtcatggctggcatcatcgccatctacggcctggtggtggcagtcctcatcgccaactccctgaatgacgacatcagcctctacaagagcttcctccagctgggcgccggcctgagcgtgggcctgagcggcctggcagccggctttgccatcggcatcgtgggggacgctggcgtgcggggcaccgcccagcagccccgactattcgtgggcatgatcctgattctcatcgtcgccctcatcctctccacaaagtagaccctctccgagcccaccagccacagaatattatgtaaagaccacccctcctcattccagaacgaacagcctgacacatacgcacggggccgccgcccccagtagttggtcttgtacatgcgcagtgtcctagtgcccatcgtctgtttccccggccttgcccccgcccgccccgtgccgtggacatctgggcccactcatcgcccctccaggcccccggcgccccaccccctagagtgctctgtgtatgcggatgatttagaattgtcatttctctttactggatgtttatttataaagatctggcctgttcctgcgtctgcggagcggcccttgtctcccagctatctataaccttagctagagtgtcgccttgtgggttcctgttgctgagacttcctggatggagccgccctcaccgccgggcccgtggccctgcgcggagctgtgtccaataaagttcttggatgtga

SEQ ID NO: 104300 - DNA, 1061 bp, Homo sapiens
  misc_feature (558)..(558): n is a, c, g, or t
tttagagcttctccatttttattacacaaaattgttaagttttcacatccaagaactttattggacacagctccgcgcagggccacgggcccggcggtgagggcggctccatccaggaagtctcagcaacaggaacccacaaggcgacactctagctaaggttatagatagctgggagacaagggccgctccgcagacgcaggaacaggccagatctttataaataaacatccagtaaagagaaatgacaattctaaatcatccgcatacacagagcactctaggggggtggggcgccgggggcctggaggggcgatgagtgggcccagatgtccacggcacggggcgggcgggggcaaggccggggaaacagacgatgggcactaggacactgcgcatgtacaagaccaactactgggggcggcggccccgtgcgtatgtgtcaggctgttcgttctggaatacagaggggtggtctttacataatattctgtggctggtgggctcggagagggtctactttgtggagaggatgagggcgacgatgagaccgtagangccgagcacctcggcgaagatgagaatcaggatcatgcccacgaatagtcggggctgctgggcggtgcccgcacgccagcgtccgcccagcagccccgactattcgtgggcatgatcctgattctcatcttcgccgaggtgctcggcctctacggtctcatcgtcgccctcatcctctccacaaagtagaccctctccgagcccaccagccacagaatattatgtaaagaccacccctcctcattccagaacgaacagcctgacacatacgcacggggccgccgcccccagtagttggtcttgtacatgcgcagtgtcctagtgcccatcgtctgtttccccggccttgcccccatcgttcaggccttaccaaccacgtatggctcatcttgtcgattaaccacttacactgggggccagtaggaccgcgctgttataaagctggagatgagcagtggacctactcttgccgggacagtggttattcaccctaatgtgttcgt

SEQ ID NO: 104301 - DNA, 658 bp, Homo sapiens
ctataggctagtacgaggcctggtttgaattggccgaggctggtatttagagcgcagcggctgacgggccggatcgccttcgccgccgcccgcccgcaaaccttcgtgcccggcccgtcctcgcccccgcctccgccaccgcctcggcccgcagagcttgccccctccccacccgcagacatgtccgagtccaagagcggccccgagtatgcttcgtttttcgccgtcatgggcgcctcggccgccatggtcttcagcgccctgggcgctgcctatggcacagccaagagcggtaccggcattgcggccatgtctgtcatgcggccggagcagatcatgaagtccatcatcccagtggtcatggctggcatcatcgccatctacggcctggtggtggcagtcctcatcgccaacccctagagtgctctgtgtatgcggatgatttagaattgtcatttctctttactggatgtttatttataaagatctggcctgttcctgcgtctgcggagcggcccttgtctcccagctatctataaccttagctagagtgtcgccttgtgggttcctgttgctgagacttcctggatggagccgccctcaccgccgggcccgtggccctgcgcggagctgtgtccaataaagttcttggatgtga

SEQ ID NO: 104302 - DNA, 869 bp, Homo sapiens
  misc_feature (558)..(558): n is a, c, g, or t
  misc_feature (641)..(642): n is a, c, g, or t
  misc_feature (644)..(646): n is a, c, g, or t
  misc_feature (657)..(657): n is a, c, g, or t
  misc_feature (663)..(663): n is a, c, g, or t
  misc_feature (851)..(851): n is a, c, g, or t
tttagagcttctccatttttattacacaaaattgttaagttttcacatccaagaactttattggacacagctccgcgcagggccacgggcccggcggtgagggcggctccatccaggaagtctcagcaacaggaacccacaaggcgacactctagctaaggttatagatagctgggagacaagggccgctccgcagacgcaggaacaggccagatctttataaataaacatccagtaaagagaaatgacaattctaaatcatccgcatacacagagcactctaggggggtggggcgccgggggcctggaggggcgatgagtgggcccagatgtccacggcacggggcgggcgggggcaaggccggggaaacagacgatgggcactaggacactgcgcatgtacaagaccaactactgggggcggcggccccgtgcgtatgtgtcaggctgttcgttctggaatacagaggggtggtctttacataatattctgtggctggtgggctcggagagggtctactttgtggagaggatgagggcgacgatgagaccgtagangccgagcacctcggcgaagatgagaatcaggatcatgcccacgaatagtcggggctgctgggcggtgcccgcacgccagcgtnncnnncgatgccgatngcaaanccggctgccaggccgctcaggccacgctcaggccggcgcccagctggaggaagctcttgtagaggctgatgtcgtcattcagggagttggcgatgaggactgccaccaccaggccgtagatggcgatgatgccagccatgaccactgggataatggacttcatgatctgctccggccgcatgacaganatggccgccatgccggta

SEQ ID NO: 104303 - DNA, 307 bp, Homo sapiens
aaaaattgagttggagtctcactctgtcacccaggctggagtacagtggtgcaatcttggctctctgaaacctctgcctcccaaattcaaatggttctcatgtctcagcctcccaaaatgctgggattacaggcatgagctgctgtgcctggcctgtaatagctttttaatattagggaaattagttaccttataaaatatattactgatatttttctttgtcttttgactttgtgtgtgtgtctaatataaaatgaaaatgcttttatttttatagtcagatttttctgtttttttttctctttat

SEQ ID NO: 104304 - DNA, 400 bp, Homo sapiens
tcctgggttcttaaattaaaaatcgttgtttgtttatttattgaggtaccattttccaaatttcccacatttagtgaaagggcttttggcaaaatgagcaagctgttgaacgttcaagtctaacacattctgttaaacttccgtgatgcccctcggaaatattttatcttgacgtttcggacaattaaatgatacttgggcgctcacaacaccgcagcttgtagtctaaacaccttcccctaaagtgttacctttacttaatcctgaacagaatgaacttggggtggctcttttaacttatctgatctcacctatattatcaattacttgtttccagaaagattacagttgagtgatcttgagccagaaagagatttgaaagaattatttacagagtcaa

SEQ ID NO: 104305 - DNA, 698 bp, Homo sapiens
atgtgccaaaaagtaaggaaacatttaaagaaagatggatggggacatgtcagaaaacccacaggagccagcctgaaatagctcctaatgaccaaagataaaacaatttgagcaagaaaatagtattgttttttagcccctaaaataaaataaatatctatgagttcatactattgtaataaataaattaatgaattagtaaatctagaaggaaagagggaaatagagaattgctattaggcagataacacagtaataaatgttgcagacaagattcctcaaaggatgcaaaaattaatgggtagaaatttgagcaaggtacttacaaagtataaggtaaaactttatattacagaaacctgacagacaccaacttgacaaaatagtcaaggtaaacagcaccagtatataagacatatcagcatcatgaaccccttggtaaaatgcgctgagaagcagacattatttttttagcagtcttgccaaaaatgcataatttctatcatgaaaaaacttcagacaaacccatattgaggaacattctataaaataactgatcagtactctttagaggtatcaaagtcatacataaaagatgaggaaaaattgaggaattgttatagactagaggagactgtggagatatagcaactgaatgcaagtgggatcctggaattacaaaaaaaaaaaaaaaaaag

SEQ ID NO: 104306 - DNA, 351 bp, Homo sapiens
tcattccaacatttcttaatagtatttgttaaaagtatattatagtcaaacaacaactttaaatttgtcattcattcttaaagttttagatcatttactagaattttaaaatcacacataaatttggtaataacaatatacggatagaaaaaactcagaaatataaatagcagagagcaaaacatttaaagaatacatatttattggactactgaggatagataaaatgacttgaaagggggaaaatggagaggaaaaaatatatttattataagaaaatttgaggctgggtgtggtggctcacacctgtaatcccagcaccttgggaggtagagtcagaagaatcacttg

SEQ ID NO: 104307 - DNA, 436 bp, Homo sapiens
ggttagagaacataacatcctctataatttcagtcttttgaaatttattcaggcttgctttatgttctaatcatatggaatatgttggtgagtgttccatgagtacttgcaaagactatgtattctgcagttgttgagtgtagcattctataaatgtcatgaagatcaaatgtgttattagtattgttgaaatctctatatcttttctgattttttttgccatcttctatcagttactaaaaattctccactatgattgtagatatatctatttttccttttggttctatcactttttgctttgtatattttgagtccctgttattgggtgtatatatttagtataggttttgttttctagattaattgaccttattttttataaaacatctgtctttttacctgttaataaatacttcttttcttgcgtgtacct

SEQ ID NO: 104308 - DNA, 371 bp, Homo sapiens
gccccatcacaccgccttgctgtttttactgtgggacaaaagcactctgatctgcgtgttccggggggccctccccccagcccgacttgacgggaagtcagggttcaggtatcatctgtgcaccctggggcggggtagtctgcactgaacctgccagagtcccctcctcatttcactgaaagtcacagtctccagggctgtgttgctaaccttacgttctctccgtttgcttaatctattaagagccctaacaggagaggatgggctttctctgttgtctggggccctgctgttggccggtgctcttagcaagaggtcatttttctaggttgcgctgggacattgtgagtttggtgagggtcatggatgtg

SEQ ID NO: 104309 - DNA, 766 bp, Homo sapiens
cccaggctggagtgcagtggcagaatcttggctcactgcaagctctgcctcacgggttcacgccattctcctgcctcagcctcccaagtagctgggactacaggtgcccgccaccatgcccgggtaattttttgtatttttagtagagatggggtttcaccatgttagccaggatggtctcgatctcctgaccttgtgatccgcctgccttggcctcccaaagtgctgggattacaggtgtgagccaccgtgcccggcctaatctgcatgttaactccaagaagcatgtcttcctggacccacgctggaaagggtgtagagcagttaagcatcttaccagtgtctcacccatgaagtggtggggatgggattggaatgcagtcatctgactccaaaacactgcattttttcaggcactccagtattaagctactttgcactgtgcatataatggtatataaaactcatgactgccagcagggtgccagttgccatgggtttattgaacaagtgttagatggctagccaaattcccaatttactgaccacctgctgtgtccctgttctgcaagttggggataaagaagctgttctgtcttgaaagctctgaggtagttaatgacgatcccatgatctggcttctgttcctttctgtgaagtagcagatagtgtatgactgtgacgtgatagaaattgagagccaagaagatcagtgcagggaggctgggtcttggaaggcttccaggagacatacagcagtccccac

SEQ ID NO: 104310 - DNA, 197 bp, Homo sapiens
ttatagggttagattgtggggtgggcatgtgatcagttctagtccagcaagacacaagagtgcctgctgcagaccatctgggagaagcattttttgatcttcaagaggtataagaaagaatccttcaatctgcttaactctgtcaggtcttcacgaacattctggaccggcaataggcaacatgcagccgtgagtga

SEQ ID NO: 104311 - DNA, 363 bp, Homo sapiens
atttataaatactctatttatcaaccttttacagagtcagtctcctctagaaaatgagttttactctttgaaatcaggaataggtgaggacctgccacagcggtaactaaagaagaagtgaagtgttgcctcatttatgtttagaaactatcagaagtgcttttgttttaaaattacgtgcaaagactttagatcacacctacgtttcaaataccagaaattgaaatgaactgttaatgtattggagaacaaaagggcttagttttaggtaagaagtgtaggcaaaaaggcagtagtccattctgtgttcagttgtctttgaggtaataaaatttagtaacagtttgttagctaaaggataca

SEQ ID NO: 104312 - DNA, 843 bp, Homo sapiens
ctccaactccacacctcaagtgatccacctgcctcggcatcccaaagtactgggattacaggcgtgagccaccgcacccggcctatcatgtataattgtaactatttactgaagggtctctcccagtagattatacacttcttgtggccaaggctaataatgccttttctctttggaccctagtgcctagcatagtattcaacacatacgagtactatccctgagatactgcaaggtttatataatggtatgtagataccaatggtagtatctaaatacctgggtaaacaaatactttcaaaagcaagtctttttcaatgaatattttacatctgactgatttatttagcgaccgtaggttttatttttcaaaaatagccaccataatatatttcatttcacatgctacttgtacaatgagaaggtgacactcctcccatcaagtagtgtggcatatatcccctctgcttgaacttgtgcagtctccgtgactgccttgatcaacagtgtatatagctggaagtgatgccatatgacttccaaagatgggtcgtaaaaatgccatacattctgccttatcctcttgggacacattcttgggatccaaacactatgtaaggaaggcaagatcccatatggaaaggccacatgcaggtgttccagccagcagcagcctcagctgaggccccagccattcgccagcatcaactactagatatgtaagggactcggatggttgcagcccctaacagttgagtcaccagctgacactgcatggaaagaaataggctgtccccgcagagccctgcccaaattgcagatgcatgtgcaaaataaatgatg

SEQ ID NO: 104313 - DNA, 726 bp, Homo sapiens
tcaaatgttgctagtacggctgggcatggtggctcacgtctgtaatcccagcactttgggaggccgaggaggatggatcacctgaggtcaggagttcaagaccagcctggccaacatggcaaaaccccatctctactaaaaatccttgcatatttttcatgtcatattgtgatttatttttcttaaatattttattaatggatgctataataatagattctgatctgaaatgttcttgctagttcctccaataatgaacttttgatttcactgctgggacttaagggtgctgctcctctttcactctcacatttggaatcagatgtggggttcatccatgtggagctcagaatattggctttattactaataagcttgagtcagaagatgcagcttgaccagtcaggctccctagcattagacccacatgactgaaatgtaaacacctgattcctgggggaccagctcttctttaaaggaaggagggcaaagcaaaccggaccagctcagtttttctacagtcttaacagtcacagaagtcaactcttctcctttgggagaggaatgcttgaagaagaggaagtgctagaagttttctagcagaaaatctccccccacctggaaacatgaaggaagcgagaggaccctcctaaaaggccagttttataactagtattgtgtgttggtttcccagattaaaacgagggatactgtgcagtaaccaaa

SEQ ID NO: 104314 - DNA, 400 bp, Homo sapiens
caacctgctgaccgaccaaccctaggcggtgaattccttaaatgctgaagaatggagaggctgatcccagcaaactgtcaccaggaccccctgcccccaaccctgactcaagcctatggcctcaggccctgcagcctgaaaccagtgtacaaagcccatcatggttcccctgactgcactttacagtttgcaaagccttttgcttccatttggcctccggggtgtcccttggaacaacccagtgggtggacagggcggggaatatgaatcccattttacagatgtggcaactgaggcccagaggacccagagttgagttgctcaagatcacacaatgaggcagggacacgactgagatgtaccttccaggatccagaggtccccaggctggtgctctgcc

SEQ ID NO: 104315 - DNA, 349 bp, Homo sapiens
cgtggtggcatgtgcctgtagtctctgctactcgggaggctgaggtgggatgatcacttgagctgagtgatagaggctacagtgagctatgattgtaccaccgcatgcactctagcctgggtaaaagagcaagaccctgtctcaaaaaataaaataaagatgtttgggcttttgagttaagaaagctgtggaatttaagttcacagtgtttatgtgatatttatgttaggtggacggtatacttgtaaaaaaagaatttaggagcaaataatcgaattatttaaataaaactcaaagcaaactccttccccaaaaagatgttcatcagatgttagctaccatcctctgt

SEQ ID NO: 104316 - DNA, 258 bp, Homo sapiens
ttgttttaaaatttgcaagtatattctctttattaaatgactgtatattaggagaggctttatcaggtgcagaaataaacccccaaatctcaaaagcttaacatgaaagttgatctctcattcactcaaagactgctgctggtctagaggaattttcaggaatcatttttccaagcagtaatgaaagattttagactacttgcctacccattttagcaatgccatctgaaacatgtggccccccagggtcactatgaa

SEQ ID NO: 104317 - DNA, 552 bp, Homo sapiens
atggtggaaggtgaaggaagcacatcttatcatggcagagcaggaggtagagagagccaagagagaagtgctacacacttttaaaccatcagttcctgtgggaactcactactgtgagaacagcaagggggaaaccacccccatgatccaatcacctccaaccaggtccctctcctaacactgggaattacaattcaacatgagatttgcgtgaggacacagagccaaatcgtatcagccatgctactggcattctaggtgacctccagcttgcacgtggcctatcatgggacttctcagcctccataattgcgagagccaattcccctaataagtcttctcttacatatctatatatcctattggttctatttctctggagaatcctgattaatatggccacatagcctttagaatttatatcctaggctgggtgcagtggctcacgcctgtaatcccagcactttgagaggccgaggtggtcggatcacgaggtcaggagattgagaccaccctggctaacacggtgaaaccccatctctactaaaaata

SEQ ID NO: 104318 - DNA, 432 bp, Homo sapiens
aagagagaagaggagacattttatttgaacatgtgtgctgtagatgaaatgcacctgacaattcaatatgtggatccttcttggaagtaacagagcatgctggccaaagagttactgcaaaaatgctcctaaatcaagtaaacaaggaaaagaacaggagctgataatgctgttgtttgttaatgctcttattgtaaactactttttggaagataaaccttttgtgggaaggccaggtactaggctccttcattgccttagatgatccaagagactgagtaatcaagatggagcaaagagcaagaagagtgtctgcaacacttttaacttcacaaagaagttaccaggcagaaggggacaattgcagtgactgattttcctgacaaaatgacagtgtcttgacaatggctatgaagtcttgatgacccttaa

SEQ ID NO: 104319 - DNA, 260 bp, Homo sapiens
tggtctgtgccacatctgaggcctgtcagacaatttcaaacccaggttctcagggaagggtctggtgggaagcacccaagcgctgggtcctgggtcctgcagagcctggacttgggtggacactgtgctgcgaccccacccactgtgtaaggagtctccaaggctgcagctcggctcagctcagcacagtatagacggcctaagaggggtggggagggggcccagcgtgtgcatccctcccaaccccatgagaccaacca

SEQ ID NO: 104320 - DNA, 500 bp, Homo sapiens
gctgtccatcccattgcagagcacacacacagccacgcttgttcagactgggacaatgtgggcacacctgtgaatcgaacaggcacagttttggcatgtgggaaggaaccataggacctggagagaactcacacagacgtagggagaatgtgcaaacttcacacagacagggccccagtggggaattaatttttctcgtgaatgttacaccaaaacaactttgaatgaaatgatgctattccaggacatgcttacgcttgttaacagcatggtcattggcatcaaaagagcctgggtttgagttccatttctgcctcctgttagatctgtgaccttggataagtcgactaacacaatagtagtaccttcctcacaggctgtgtgatgattaaatgatacaatacttgtaacacacttaacatagaaattgacactgtaattgctcaataaattttagctattaatgctattatttaatacagatgttcttgtaaataggg

SEQ ID NO: 104321 - DNA, 530 bp, Homo sapiens
ccacaaatagctttacactgttccctgacttcaagccaacctcactgctacgataagcattttggttcttgaatccaactgtcttagtttcttcacagtatttccatcagggtcttcaagaaggctcatttctcagtctcagaaagggagggaaaatcatgaaaaaggtggccattttcaggcaaccttcctgtggccagaatttcttcttttttgtatgaggaagatttctttataagtatagcacttaggattttttttttgtttttccaggtattattctttttatattgacaaataaaatttgtatatatttatggaataaaacatgacattctgacatgtcatatatatgtgtgtgtgtatatatacataaacatatatatatatatacacacacacacacacacacacacacattgtggagtggctaaattgagctaattaacatgggcattacctcacatacttgccatttttgtgtgtggtgaaaacacaatctactctcttagcaatttgcaaatacatga

SEQ ID NO: 104322 - DNA, 498 bp, Homo sapiens
tgttaaatggtgacctagagaaagccaaacacattaggcacattataccaaaagaacttgacttttaaataatggttttagaaatggaagctggtgttcttctgcgctgtggacgcggaggagaatggagcaggtctgcacagccaaagtgcctcctttcactccagggtccaggcatccagcagccgaagcgcctcctttcactccagggtccacacatccagcagccgaagcgcctcctttcactccagggtccacacatccagcagccgaagcgcctcttttcactccagggtccacacatccagcagccgaagcgcctcctttcaatccagggtccacacatccagcagccgaagcgcctcctttcactccagggtccacacatccagcagccgaagcgcctcctttctctccagggtccacacatccagcagccgaagcgcctcctttcactccagggtccacacatccagcagccgaagcgcctcctttcac

SEQ ID NO: 104323 - DNA, 193 bp, Homo sapiens
ggaaaataatctagaaatgtccataaaaagtcattgttcctcttattaacgagaggaaataatgcctaaaaaaagaaaaagggtggaggggatgtgaaagggagaaaaaactctttgagtgatgtcaaagaactatttccagaaaactggggaaaaactgtacatataacttttaacctttaggtgagattta

SEQ ID NO: 104324 - DNA, 311 bp, Homo sapiens
tgaaactcttgagtacagtaagacgtgcccatcacgtgagagcatatgcaatcattacaaagctttggcatgcagttttctgcttggatcaagaatatcagtccttaccctaaaaatgaatccccataggcattcatttgaattgccaatacttttagaaaaaggaaatcgttaagtgccaccttgtagccattaaaaccatggccggacagttcactgaagctcagtcatagaaattcagccatgatttggaagcattgttttgcacaagcttaattacatcaagcaattcatctgtacaactccacaac

SEQ ID NO: 104325 - DNA, 675 bp, Homo sapiens
gtagcgtgatcatagctcactgcagccgtaaactcctgggctcaagcaatcctcctgccactgcctcttgattaggtggaaccacaggcatgcaccaccacacgtacctaattttatatatatatttttttatttttcatttttatttatttttgtttttttgagttgaagtctcactctgttgcccaggccggagtacagtggcacaatcttggctcactgcaacctctgcctcccaagatcaagcaattctcgtgcttcagcctccaaagtagctgagattacaggtacccaccataatgcctggctgatttttgtatttttcgtagagacaaggtttcaccttgttggccaggctgatctcaaactcctgacctcaagtgatccacctcccccggctacccaaagtactgggattataggtgtgagccaccatgcctgggtaacacccaactaattttaaatatatattttgtagagatggggtctagccttgttgcccacgctggtctcaaattcctgggctcaagtgatcctctcgcctgagcttcccaaagtggtagaattgcaggcatgaattgctgcacccagcctcatctgtgctgtgaattatgtgctgtattgactctcaagcatgatgaccattggtggtttctgtaccatttcctgttactt

SEQ ID NO: 104326 - DNA, 311 bp, Homo sapiens
ttaccagcaactcacggcaatcacacatacacacatacttacacaaatacagtaattacatacagttccttaaaaggtagattccctagcaccagggagtaactaaaaaaaaattgaagaatttcaaagctcgctgaaaaatgccctcacgaggatcacccaagacggagctcccaccgcatcctgatcacagcgttgcagagatcatgagacccggcctttgcaggcaagagttgcttgtcattcaaagcattttccctgaattccagacagcctctgcagtagtcctgacattcttccagaaaagcact

SEQ ID NO: 104327 - DNA, 123 bp, Homo sapiens
tggcttctgaaacctgtcacccgtccatggctccacttgaaccaggaactgactctctgtctgctatgcttagaaaacaaggtgccatgactggccccattccagcggattcacccggtgaag

SEQ ID NO: 104328 - DNA, 487 bp, Homo sapiens
ggaatcagaccagataccatgaccctcatctcctgtttcacattgattagatgcaaacttgagctgtagttcacatgatgttcaacatatgttgaatcttctgtgtttccctcaaaaatttaaaatatcctatggcatacagttttggagttgtggcatgaacacatttatcatcagaaaggatgttttaaagatgctagagatgaggtaagttaaaagaggaagagtactgaagtcaaatttcctgtttatggtcatactcttggacaaattactttacctctgttaaatgaaggtttttctatatacctcttttataacctctaaagttctttttcagttccaaaacacattaactctatggctcatctaaagcctttgctatattcttaataccaatgagccattcctttgctgctagaatttatttgcagatttgtaaatctaatgtaaataagttaccttcttgatgactatttaaatcttc

SEQ ID NO: 104329 - DNA, 282 bp, Homo sapiens
tgtagaatattctttgaaaatcatccttttttagctttcaaatgcaattatttgctgtcttactcctaagatataaatttcttgcaggtagaattggtttatttccttagaatagattgccaagaatattgttactggcccaactggtatgaacattttttcccattcttaacacttccaaggttttcaaaaggggttgtattaatttcactgtaatccttctaccacctggatattttgaaataaagaatctttttcaaacttggtaggggaaacaatata

SEQ ID NO: 104330 - DNA, 598 bp, Homo sapiens
gttttgtaaaactgctttcaggaagtaattaaggtagatacacacaagcccaagttgaacaacattatatctcacttactttgaatggcctagtcaggaatattgtatatatccataaacgtgaaagtaaaacatttgacgatgtattttctttaggtgtattaagatataaggccaggctgggcatggtggctcatacctgtaatcccaacactttgagtggctgaggtgggaagatcacttgagcccaggatttcaagacgagcctgggacacatagtgaaaccctgtctctacaaaaaaaaaaaaaaaaattatctaggtgtggtggcgcacacctgtagtcccagctactcggtaggctaagacagggaggatcactttagccctgaaggttgaggctgcagtgtgctatgatcatgccactgcactgcagtctggaagacagagtgagattctgtctcaaaaaataataataataatggtatgaggccagttcatcacagtaaaaaataatattgtggaaaatctatagtgttgagttagattcaacttagaaattagcaaacactgataactacttgtcaaaaatgctgata

SEQ ID NO: 104331 - DNA, 247 bp, Homo sapiens
ctctttagatagctaactttatttggggtttgtttctgaatgcaagataggcatactgtagtaaattcccttctttcaaccctgggttgaaatcctgtcaattaattagttgtatttagtcttacaatagataaaccaggtagtttcacatagcctgtttctagggttttatctaggacatcgtaggagtttcttgaaggaaaatatagctatagggaacattttaatttggatctgcttcattact

SEQ ID NO: 104332 - DNA, 756 bp, Homo sapiens
  misc_feature (1)..(1): n is a, c, g, or t
ncactggggcttggcactgaaatagctactgtggcggactacggacacgacggacactttgaggatcttgctggaatgaagccaaaggaggctttggcaaaggaaaaatatcaatattagaaatatctttcatgggaataagtctggccacaatgtacagaacagaccaaataacaagagtttggaaaggaggcaaatccggacctgaactagattaaggtcactattaaaaaaaggaaggaatgttaacaatactgacaaaacggaccctataggatgtggagagcaattattagacagatgtggcaaaggaaatgaaaaagtcaatgacaattaggaagttgagccttggggatgaatatacagtcatattactcactatgggcagtgcagtagagtgcaaagagttctatacttgtggatcagatcacctgtcctcaatttccaggtcagtgctaagtatataagctgttcttactaccttatataactgttggttcaaagattgaagtgaactgcagggtaggaaaaactggaaataaagtaaaaatgccttgtgtgctttgttgggagagaaacaaaggtgataaacacaggtagcaaggtcttgggaaaggaagattttaagagcatgcttggattaactttgaaaataaggggcttagggtacttctgaaatagcaacagagggaggaaaggatggaaatattgatggcaagagaaagaagctcacattagccatgctacacgctgtat

SEQ ID NO: 104333 - DNA, 354 bp, Homo sapiens
aaggaaatgacagaataaagagacaacccacagattgagaaaaaaatatttacaaaatatacattagatcagggactaatatccaaaatgtacaaactcagaccgctcaataacaataaaacaaataaccctattaaaaatgggcagggccaggtgcagtggctcatgcctgtagtcccagtactttgaggggctgaggcaggaggactgcttcaacccaggagtttgagacaagtctgggcaatatagtgtgaccccacctctaaaaaaataatgataatattaatacaaagcttctgggctgaattatgtcctcctcagaagttactgaagtcctaacctgccagtacccgt

SEQ ID NO: 104334 - DNA, 631 bp, Homo sapiens
ttggtagaaacgggggtcactatgttgcccaggctgggagaagctttcccattgatggattgattcagggtctcgcttgtctgtcacccagggtggagtgcagcagcgtgatctcgcctcactgcctcaacctctcaaactcaagtgatctccagcctcagcctcccaagtagctgggactacagatgcacaccaccatgcctggctaatttttgtactttttgtagagatggggtctcccctgtgttgtccaggctggtctgtaactcctgagctcaaatgatcacctgccttggccttccaatgtgttgggattacaggtgtgagccattgtgtctggccattcgccttttattagaagatggcagtctttcccaggggcttcagtacaattttttaatgtcatcaccaacaaagaaaaatgaggttagtgtgattggcttaggacagtcacagttcatgtcctgagatgccctctaatcaaatacaggtgtccggtaggaagttagaagtggggatttctattgtgtgataaccagcagtgtctgtctttagacagcttgagaactatgcttttatgagtcatacacgagttttattttgtggaaaggaatctgggtgttgaatggtg

SEQ ID NO: 104335 - DNA, 801 bp, Homo sapiens
attgttttctgttccatcaagagaaggagttaacaatcatctgtgcctctacttgtttttgcaaataaagttttattgggacacagctacagcctatgactgctttcaggccttgctggcagagttgagtggttgcagctgagcttgtatagcttacagaaccaaacaatatttcctatttgtccctttacacaaaatgtttggtggtccctgatccaggagcacaggaagtgcagcatttcttgcaagaatgtccactctcatctcggggatgttttttgttttttgtttttttggagacaaggtctcactgtcaccaggctggagtgcagtggtgtgatcatggctcactgcagcctcaaactcctgggctcaagcaatcctcccacctcagcttcctgagtagctaggactacaggtgtgtaccaccatgcctggctaatttttaaattattttttgttgacatggggtctcgctatgttgcccaggctgatctaaaactcctgggctcaggtaattcttccacctcagcctcccaaacctctgggattgtaggcgtgagccactgcgcccagcctgtgatggttcttaagtcctgtaaagtatttggttgctttgcaagaaaatcttggccaggcacggtggctcatgcctgtaatcctagaactttgggaggccaaggcgggtggattacctgagatcaggagtttgagactagcctggccaacatggcgaaaccctatctctactaaaaccttatctttactaaaaaaaaatacaaaaattagctaggcatggtg

SEQ ID NO: 104336 - DNA, 799 bp, Homo sapiens
tgtggaggtcccttcggcctctcaaatcaccatttacagggcagtcacctgatcacagggctgccctgtcccaacagcagcttgttggagtctttactaggccaggcttactgcttcaacaggttcatgagtccttggcctcctatcccatgcagcatccttggtgggagaggatgtgcttggtgctcaccctgaggcagagcagtcctgtggtccagagagccaccaaatgtctagagcagccacagcttatggagccatctccccagagagacaccaccagtaggcaggcagtgtggtgtcttccatggtagaagagtgtcctgggtttaaactctaactctgccactttctccatgaccttgccacataatatcaagcttcctagagctttagtttcctttataaaatgggggtgccgggagggttcaggagagctgtggtcagatgtaaggcattcagccaatgcctgtacacagcaagtgctcagtaagtagatgtatacatacagaatatagaagtcaccttttcatgagggcctaccacatgcaggcattgcaccaggccctgcagccacaccagcaagttattaaattattcaaatgcattatattctctagaaagttatagaaagagatgaaagtatggggaccccaaataggtacattcctatttcagaagaagctcaaagcccaactaagggcagacagcgaggtgtcattaaatgagcactggactggaagtccagccccacaggcctcaggcagcacccacacactgcggcaggctcggagcctcc

SEQ ID NO: 104337 - DNA, 189 bp, Homo sapiens
gaacatgacagagggccctgatggaagatgctgaaatcatctttctaacaagtcctgaggcctctggactccatgccaggcaccggcagacccagcctcagcctttaaggtgctccaagccattcttcatgccttctctatgccacaggcaggagtgacctggaggcctcttccccttgcactgctgag

SEQ ID NO: 104338 - DNA, 732 bp, Homo sapiens
agcaaaaacaaaaaataaaacaatttgtttgcctaagatccttcatctctatccatcacaaggctcattcttgcctgctagtgtggcctacatgccacttacattttaagttatttaggaatacaaaggacagacaaaaaagagccatatgcacaggcctcattttctcttatttttgttctgtctagtaattcttttcctgcctgtctcttctccattttccttcttatttttctttttcctttttaaacagttttcatactcttcactgtcttccatttggtcttgattaggtgcatccatctcttcacttggtcttccacaaacaaaaattctgccttcagacatttggtgttagtatttcacactcagttctccctctttttacataaggattgagttttttttaatgatgattttacttttatagcagttctgaattttgcattctgttgctagtattgattccgatacaccattaaaatacaacattctagaagtctgttaccttaggagttaattaaacatgatatttgaagaaaaatgaaatgctttatagttgtttgaggcataccaatgtgtatttgttttactggatcatgttttgaactgactagggagggtagcacctgcctcagatggtaccaacaattctatttcactgggtagtctaaaactagcttatagcttaacttaacttgtgtatgtgaatttagggatgaaaactttttt

SEQ ID NO: 104339 - DNA, 263 bp, Homo sapiens
ttggcatggggacctgcccaccgtgccctgcccaggctctgtgccaccagggggcccatgcatggttgcccagcttgctctggccttgctttacgcctgtgcccagcaagcccctccagtcctatgccgccacctccaaaaccctgcaagccccttctctcctgcacagcctccccaggttgccagcagctcatcctgcaaaccccctggcagggagcctcggagccagtgtcacgtgtgcagcgtagtgcagccacacagcc

SEQ ID NO: 104340 - DNA, 680 bp, Homo sapiens
aggctgcctccggcttcaccgctcctccccgagcacagcctttgtggggcctacggggcagtaggagacaggacgcttgtcctgcggaatggcaaggaatcagctctccatttcagggcaaagtggggcctggattgtgggccttgaacatgaaggcaggtgggcgagggactaggggaccgcgtgaggcccgacgtgcacacggcagggcccggcacccatggttgcgttcggtcggccttggccggctggctcctgcttggaaacttgctgggtggtgtctgcgggaaacagtactgagtctggtgaggaggcaaacgctcagaatctactgcaggtgttagttctgcagaggagtcttcctgcttaagggctcatttgatgttctggaaatttgccaggtactgaaatacagccagtcttcccaaagattcctccgctcctctgagtgcacgtgtgtgtgtgtgtgtgtgtgtgtgtgtgtgtacagccacacaaccgtgactctgtgttcacacacaggggccctggccgaagtgtgagggtctccacgtgacaaaggatagtgagtaaacaacttcaacattgtggtttccctctgaggcttgcaaagagggtgttaagagcacaagatctaaactcatacaactttattaaaagccaaacagcccaatgtgcga

SEQ ID NO: 104341 - DNA, 688 bp, Homo sapiens
atatctgggcctgctaactaatttgcctctgacatttgcaaagagtataactgcacgaagaacttggtgccctggtgtagtcaattcagtcatggagttctcaatcttctagcatttacagtaatggccctgtggcctccccgccttggactgcctcctgtcctgcacctattcactctttgtgggccttgcagggccaggaaaggagaagaggcagagatgagtcaacaatgctccttctcaggcacagtactcataaaaatgtttgacgggagggatggacgaatcaagactagggcaaagttcaaaaatattcatgaaaaatggacatggagacatatttaggaaggtaaatacagataccacacactatcaactttgaaaatcacagatcttctttctaaacttcagtataagagaaatcaaaagtcagtatagtcagtgacagaaagcatttaaaaaatgcttgtgactaatgacattgcttatagcataaggaattatatgggagaaaactgaaagaaaacagtaactgaagaatcaggatcactcttgaaatttgtcaagtgtcaagatgggctttttatctttacagggaaaaaaacaggttcaggagagtgcttcaaaaaattaccactgggaatttttaccaaaattaagcatgctattaagaaggtttacctgaaga

SEQ ID NO: 104342 - DNA, 490 bp, Homo sapiens
accgcttcgtagctggatgcctctgggtgagtcctggaagatctgtgctgtgggagggtgcctagtggacgatccctggctgctgctgaaatgtttcctgtgagttcctggaggccttgatgcccaggagcactgtggaagcactatgcatccctcacccttgtgaacactttggagctatgagccaggtcagcccagagtcccaggctcactgtggctggagggagaggcccacttaggggagttgaaggcttccctagcttcctatgaccagagaagtttgtaatcctggaggcctgtctgtgcaagggcctgggggtgactctgggggcgtccaggatagattgcctgagagtgggggtcaccagatggtgaagtgttgtgactggcaaatacagaaagccaggagtgtgtgtcctttgtccgcctctcttccctcaggtctcctgttctttgagattacactggtgaccatactacatggatgtgc

SEQ ID NO: 104343 - DNA, 648 bp, Homo sapiens
ttgtattgggaggcttaggtatttttgttgttgtttgtttgttttgagatagagacttactctgttgcccaggctggagtgcagtggtgcaatctcagctcactgtaccgtccacctcccgggttcaagcgattctcctgcttcagcctccagagtagctgggattacaggtgcctgccaccatgctgggctgattttttataattttaataggggtggggtttcacagtgttggccaggctggtcgcaaactcctgacctcaagtgatccacgtgcctcggcctcccaaagtgctgggattacaggtgtgagccaacatgcctggccagaaggttctggtttgttaaccaggtaaggtctgcacatttaaaactgagaaatgctagcttcctagcaagcagaatggaatatatagaattgactgcatggtctcctttacttcctatcggaaaagtctttttactctgctgactagagtgtatgtgtgtgtgtgtgtgtgtgtgtgtgtgtgtgtgtatttcttttgcttcaattcattaaaaaaaaaaatagaatgagctgggtttggaagctgaggcaggaggattgcttgagccctaggagtttgaatccagcctgtgcaatacagcaagatctcatctctggga

SEQ ID NO: 104344 - DNA, 1322 bp, Homo sapiens
taagtttcaccaggaggagggaatatccactcacaagaattttagtgtctgtttttttagtatcatggtctaaaacaattgggtgaaatacagaggtcttgtttacttcttttctactaatttgctatggaatgtggatttcaaatttctgtgtgtagaaaatgtcttccatttgtcaaagctcattttaagtcccacgacctctaagaagtgttatggactaaatagctatattctcataattcccaaaacaaataaaaataaaaattcttccactccttgattttagtatgttgtgaatgaggagttaaaaattatttttataactggatctccttttgaaatcaatatgttgaaggattgttgagccaggagaagttagcaggagatttgatgtttgagaattgctgggtacatcagatcttctagagactaaatagtttataaaatcttacttggtcatcagatgtaggtcttttcatgctacagtgcgagaaataataccataatgtaatattctagcataaatatattaggccaaaaaccaaacccagtggcgacagtggcatcaggataaggagaacataagggatatatatatacatgcagaagagtttaccttttcctttggaactagttcaagtcagttccaagtactggaaattgtagtgaaccaagattggggatattactgtgtcatcttaggcaaagtgatcaactcttctttgtcccagtttccttatgaaggtgttcctgttggattagttgcctctggggcccatcttgttgagggttgtcgagaaaaataaactctctctagtgggttttccttaaagctaaattcacttaactaggaaaaaaaagccacctgtaatcccagcactttgggagactaaagcaggaggattccttgagtccaggaattcaacaccagcctcggcaacatggccaaaccttgtctctacaaaagatttttaaaaactagccaggtgtggtggcacatgcttgtagtcccaactacttgggaggctgaggtgggaggattgcttgggccgaggaggtcaagggtgcagtgagccatgattgcaccactgtactccagccacagtaacagagtgacaccctgcctcaaaaaaagaaaaaagtatactattatgagattgcctttccttttttcttcattactatcctttctttcataaataatttttaatgatcttacttgtcaataaaaaaataaaagtaactttttcccaaaatatttatgttttcaaattttactggtccatgaactttaagagaagactagatagtttttaatg

SEQ ID NO: 104345 - DNA, 295 bp, Homo sapiens
caaattttaggaatgttagtgctctgcagaaatttagactggtgaatcactgaataagtagacaattggaaatttttgagcaggggagtggcatgataaaagtggtatttgaggaagcttgatctggagacaacctttttttatattataggcttaagccactgctggcaagcgtgggtgagggtcgcaggggtggagaagagggagacgcaagggtttaaagccatgctgaggaacagcttcctgtgtctttgtactttcatttccacatttgctcaagtgggatgtacttgct

SEQ ID NO: 104346 - DNA, 1016 bp, Homo sapiens
catcaagctagtacgagcccccgggttaatcggccgaggcagggaccagagcttatcgtggactatcagatgtatgattatagcttggacatgtggagtttgggctgtatgttagcaagcatgatctttcgaagggaaccattcttccatggacaggacaactatgaccagcttgttcgcattgccaaggttctgggtacagaagaactgtatgggtatctgaagaagtatcacatagacctagatccacacttcaacgatatcctgggacaacattcacggaaacgctgggaaaactttatccatagtgagaacagacaccttgtcagccctgaggccctagatcttctggacaaacttctgcgatacgaccatcaacagagactgactgccaaagaggccatggagcacccatacttctaccctgtggtgaaggagcagtcccagccttgtgcagacaatgctgtgctttccagtggtctcacggcagcacgatgaagactggaaagcgacgggtaatgcggcattgatgcttgccaataaaaccaaccaaccaaacacaaaccttgaaggaaaactacagtgtgataaaaagaaattcttatcattccttctaaatgcacagaagagtaaagacctaaaagtctgtcaaaaagcaagaaagaaactccccagtgctagtctccagggagctgtcactgtggcagcatggggatgcacctagttcaggatctgaaggagctctgcctttggaatgcatgggagatagagactcggagttgttgtacatttacctttgtttaacagggcaccactgttgaattaacccattcagtcaacaagctctgaatgtctgacttcctatctattccattgtggtctgggtttcctttggtgaaattcaggctcaagtcttagcgaaatgtcagcagtctatactgacacaccagcctcatttacaaaaaggagatattaaaacagtgacagtattttttttttaagctctttacaaatcc

SEQ ID NO: 104347 - DNA, 628 bp, Homo sapiens
  misc_feature (623)..(623): n is a, c, g, or t
tttttttttggcagccttgtaaggagaacttcaccatttcccagcacatccctatgtgtgcgcctattttaatgcacctctctgaaacagagacctttttgttcacaaccataactaaagctggaaagtcagtcttcaggcaaggcgagggaggaaaacatcccattagaattttttcaggaaagacttatggaaaaaaatatctctctcccacctccttttatccccatgagacacagtttcccactgtaatcagggtaatatgcatttgtaagttctgatatgtgatacatttatgtgatggcaaagataagtctgtcttgcatgcaggtactagagttgtgtgggcagggtcatctgaaactcaagcaactcagaggaatatacaaggggcttggggaagaaaatggtgctcccggagcaagtgttggatccattttgcaaaccttcatgttagcagagaaagctagagtttgtttaaacaaaaatagggctgatgtggtagacacctctagttctagcctaggtgtgtgaagtccccacagctgtgcatggccctgcagctggggtgaggggactgcctacaaaccatgttgctcctgagtccccaaaatgaaatcagncgtcg

SEQ ID NO: 104348 - DNA, 3386 bp, Homo sapiens
tttttttttggcagccttgtaaggagaacttcaccatttcccagcacatccctatgtgtgcgcctattttaatgcacctctctgaaacagagacctttttgttcacaaccataactaaagctggaaagtcagtcttcaggcaaggcgagggaggaaaacatcccattagaattttttcaggaaagacttatggaaaaaaatatctctctcccacctccttttatccccatgagacacagtttcccactgtaatcagggtaatatgcatttgtaagttctgatatgtgatacatttatgtgatggcaaagataagtctgtcttgcatgcaggtactagagttgtgtgggcagggtcatctgaaactcaagcaactcagaggaatatacaaggggcttggggaagaaaatggtgctcccggagcaagtgttggatccattttgcaaaccttcatgttagcagagaaagctagagtttgtttaaacaaaaatagggctgatttcattttggggactcaggagcaacatggtttgtaggcagtcccctcaccccagctgcagggccatgccacagctgtggggacttcacacacctaggctagaactagaggtgtctaccacatcaccctttaagatttctttattaactatttaataatgccatacatttttataaggttagatgtttgtttgaaacatttgtttacattccatattccaataaaatcttattggtattggtagcagatcctactctaaatgtagattctatttttgtcgtttggtctgtgggaacttaaaatacaaatgaaactcttctcttattatagagttgagtttatagagtaaaaaataaataagatcccaaagccaaggaatgcattcagttaaggttctcataccaatgctgcctgcttgcattgcacattctgtatactaatgtaaacatttgttctacctgaaaatcaaaagcaagatgtgagctctttggctaaacctgtattgatatgtcaggcagcaaaactcagtgtttgagattatcaaaagccttctaatatgcccttataggcaatcctgaagcattggttatcatcagggagatgtgccactgcgtgtctttcctgctccccctccaatctcctttatcaccccaccccactcctcagccctccctttttttttttaagttgcctgtctggaccaggcaagaggtgcctactggagggtcttggtgaagcggtaactccattcctttcccttgggtcccccaaaggtaataaaagtacctggaggagaatagtcaggtgattgacctctgcctgtctctctgacggtgatgtaggtgcagacaccgcctgcctgccttgtcctggggttttgtaactgcagctttgacacaggcattcttcctttgaagcacacagcttgcttttccagcacctagacttttacctctcttcatgccttagacttagaccataactgggcttgaaatgctcaccccttcctgggtctggtcttggcacctaggctattcctttccaaactgaagtgagtccagtttcagaccatctcttttcctgtctccaaaaaccatttttgtttccaaacctagctcccccgaaattttaagactatttacctagattcggagatggtcttggagagttccaaaaggggtgtgtgtgtgtctgtgtgtgtgtctgtgtgtgtgtctgtgtgtgtgtctgtgtgtgtgtctgtgtgtctaatatttagactaaaccatggtaaatgtacgcacccagtatccttttcagttagcatattctttcttaaactcatctcagtacttttcatttgtttgcttcattatcttaaacaggttaaaagtgcctatgataaggacttaattatttcctaaagaaaagcaaaaaatgtggggaacagggtagtgttatactatcatctcaggtactgcctatgttcaagaacatagacctggtatggtgagaacaaaaggttcctatgccaaatccagatggctatatcatttgttggctacaagtgagcctgactgcaaggtttgcttctgctgagaaatcccatggtgagagtagaactcatgaagtgctgagtcacatttgcacctctggtgtggtggcagttcactctcccctggatgctgtcagctggccttgctttcatcctatccctgtaggcagggtaggtggctgggtaggagaagctattgagtgtatgacgcagaccaagctttcctgggccttctcaccaactagagaagcgctgatgtcgttcattgaggcacttaaacaccagtcactcagccaggcctcctcccagacattctgtaacatgtcagcactcacaaggtttaaagcaaatgtgttcccttgcagagaggaaggtgctctcagactgatagattagaggagacagacaaactcgtaatccttggggacttgaagagagtggctaggggaagggctgttaaaagaaaagggaccaataagaaaatccatctaaaggtagctcttgaggaggaaattaacttcttgaggggataaattagagggtaccaagtttatgttctggaatgtaccctggggagggcgctgcccactggattggtcccagtggactgaaaggtggtgctctcgagtcaggcgcttagtcccagagagagctgggtgccgcggggctcgtggtctgtgcctactcagggaaatgacttaggttctcccaggtgctctgttgataaggatggaagcagaactactttgagacacaagcaacaattggaagagtttttttatatgaactgaaatagatctaagagagcctggttaacagtttcctttaataccagttcagattaaatggttactttaggaacctgtgttactgtgtgagcacccacagaaacaagcaaacttatttcctacaaaaaatgaggggataataaccgatcagagtcacagtcgtttcaatataaacccttccgaaagcaaaagcagggaccacatgagcacacaagaagccaaagtttgtcagtgatcttaataaattaagactgagtaacatcctgcctttagaaaaaaataaccccgaggtggagaccagggcaggggaggtggcggagaagcatcgggccagatcaaccgttaataacatgcttctgagctatgtggatgtataaatgaaaacacccccaactaggtattgtagaggctggaaaaagatgtgatgggattatacaggtgatgcatatttttgttttgagactcaacaatgtgctacaaatgtgatacttaaccctgaactgcatgtattggggattgttttttaaaaagaaaaaaaacaactttgaatcaataaattaacagttt

SEQ ID NO: 104349 - DNA, 3799 bp, Homo sapiens
cgcgggcagcagggcccgggtctacgccgaggtgaacagtctgaggagccgcgagtactgggactacgaggctcacgtcccgagctggggtaatcaagatgattaccaactggttcgaaaacttggtcggggaaaatatagtgaagtatttgaggccattaatatcaccaacaatgagagagtggttgtaaaaatcctgaagccagtgaagaaaaagaagataaaacgagaggttaagattctggagaaccttcgtggtggaacaaatatcattaagctgattgacactgtaaaggaccccgtgagtcaaagacaccagctttggtatttgaatatatcaataatacagattttaagcaactctaccagatcctgacagactttgatatccggttttatatgtatgaactacttaaagctctggattactgccacagcaagggaatcatgcacagggatgtgaaacctcacaatgtcatgatagatcaccaacagaaaaagctgcgactgatagattggggtctggcagaattctatcatcctgctcaggagtacaatgttcgtgtagcctcaaggtacttcaagggaccagagctcctcgtggactatcagatgtatgattatagcttggacatgtggagtttgggctgtatgttagcaagcatgatctttcgaagggaaccattcttccatggacaggacaactatgaccagcttgttcgcattgccaaggttctgggtacagaagaactgtatgggtatctgaagaagtatcacatagacctagatccacacttcaacgatatcctgggacaacattcacggaaacgctgggaaaactttatccatatttgcaaaccttcatgttagcagagaaagctagagtttgtttaaacaaaaatagggctgatttcattttggggactcaggagcaacatggtttgtaggcagtcccctcaccccagctgcagggccatgccacagctgtggggacttcacacacctaggctagaactagaggtgtctaccacatcaccctttaagatttctttattaactatttaataatgccatacatttttataaggttagatgtttgtttgaaacatttgtttacattccatattccaataaaatcttattggtattggtagcagatcctactctaaatgtagattctatttttgtcgtttggtctgtgggaacttaaaatacaaatgaaactcttctcttattatagagttgagtttatagagtaaaaaataaataagatcccaaagccaaggaatgcattcagttaaggttctcataccaatgctgcctgcttgcattgcacattctgtatactaatgtaaacatttgttctacctgaaaatcaaaagcaagatgtgagctctttggctaaacctgtattgatatgtcaggcagcaaaactcagtgtttgagattatcaaaagccttctaatatgcccttataggcaatcctgaagcattggttatcatcagggagatgtgccactgcgtgtctttcctgctccccctccaatctcctttatcaccccaccccactcctcagccctccctttttttttttaagttgcctgtctggaccaggcaagaggtgcctactggagggtcttggtgaagcggtaactccattcctttcccttgggtcccccaaaggtaataaaagtacctggaggagaatagtcaggtgattgacctctgcctgtctctctgacggtgatgtaggtgcagacaccgcctgcctgccttgtcctggggttttgtaactgcagctttgacacaggcattcttcctttgaagcacacagcttgcttttccagcacctagacttttacctctcttcatgccttagacttagaccataactgggcttgaaatgctcaccccttcctgggtctggtcttggcacctaggctattcctttccaaactgaagtgagtccagtttcagaccatctcttttcctgtctccaaaaaccatttttgtttccaaacctagctcccccgaaattttaagactatttacctagattcggagatggtcttggagagttccaaaaggggtgtgtgtgtgtctgtgtgtgtgtctgtgtgtgtgtctgtgtgtgtgtctgtgtgtgtgtctgtgtgtctaatatttagactaaaccatggtaaatgtacgcacccagtatccttttcagttagcatattctttcttaaactcatctcagtacttttcatttgtttgcttcattatcttaaacaggttaaaagtgcctatgataaggacttaattatttcctaaagaaaagcaaaaaatgtggggaacagggtagtgttatactatcatctcaggtactgcctatgttcaagaacatagacctggtatggtgagaacaaaaggttcctatgccaaatccagatggctatatcatttgttggctacaagtgagcctgactgcaaggtttgcttctgctgagaaatcccatggtgagagtagaactcatgaagtgctgagtcacatttgcacctctggtgtggtggcagttcactctcccctggatgctgtcagctggccttgctttcatcctatccctgtaggcagggtaggtggctgggtaggagaagctattgagtgtatgacgcagaccaagctttcctgggccttctcaccaactagagaagcgctgatgtcgttcattgaggcacttaaacaccagtcactcagccaggcctcctcccagacattctgtaacatgtcagcactcacaaggtttaaagcaaatgtgttcccttgcagagaggaaggtgctctcagactgatagattagaggagacagacaaactcgtaatccttggggacttgaagagagtggctaggggaagggctgttaaaagaaaagggaccaataagaaaatccatctaaaggtagctcttgaggaggaaattaacttcttgaggggataaattagagggtaccaagtttatgttctggaatgtaccctggggagggcgctgcccactggattggtcccagtggactgaaaggtggtgctctcgagtcaggcgcttagtcccagagagagctgggtgccgcggggctcgtggtctgtgcctactcagggaaatgacttaggttctcccaggtgctctgttgataaggatggaagcagaactactttgagacacaagcaacaattggaagagtttttttatatgaactgaaatagatctaagagagcctggttaacagtttcctttaataccagttcagattaaatggttactttaggaacctgtgttactgtgtgagcacccacagaaacaagcaaacttatttcctacaaaaaatgaggggataataaccgatcagagtcacagtcgtttcaatataaacccttccgaaagcaaaagcagggaccacatgagcacacaagaagccaaagtttgtcagtgatcttaataaattaagactgagtaacatcctgcctttagaaaaaaataaccccgaggtggagaccagggcaggggaggtggcggagaagcatcgggccagatcaaccgttaataacatgcttctgagctatgtggatgtataaatgaaaacacccccaactaggtattgtagaggctggaaaaagatgtgatgggattatacaggtgatgcatatttttgttttgagactcaacaatgtgctacaaatgtgatacttaaccctgaactgcatgtattggggattgttttttaaaaagaaaaaaaacaactttgaatcaataaattaacagttt

SEQ ID NO: 104350 - DNA, 3711 bp, Homo sapiens
tttttttttggcagccttgtaaggagaacttcaccatttcccagcacatccctatgtgtgcgcctattttaatgcacctctctgaaacagagacctttttgttcacaaccataactaaagctggaaagtcagtcttcaggcaaggcgagggaggaaaacatcccattagaattttttcaggaaagacttatggaaaaaaatatctctctcccacctccttttatccccatgagacacagtttcccactgtaatcagggtaatatgcatttgtaagttctgatatgtgatacatttatgtgatggcaaagataagtctgtcttgcatgcaggtactagagttgtgtgggcagggtcatctgaaactcaagcaactcagaggaatatacaaggggcttggggaagaaaatggtgctcccggagcaagtgttggatccattttgcaaaccttcatgttagcagagaaagctagagtttgtttaaacaaaaatagggctgatttcattttggggactcaggagcaacatggtttgtaggcagtcccctcaccccagctgcagggccatgccacagctgtggggacttcacacacctaggctagaactagaggtgtctaccacatcaccctttaagatttctttattaactatttaataatgccatacatttttataaggttagatgtttgtttgaaacatttgtttacattccatattccaataaaatcttattggtattggtagcagatcctactctaaatgtagattctatttttgtcgtttggtctgtgggaacttaaaatacaaatgaaactcttctcttattatagagttgagtttatagagtaaaaaataaataagatcccaaagccaaggaatgcattcagttaaggttctcataccaatgctgcctgcttgcattgcacattctgtatactaatgtaaacatttgttctacctgaaaatcaaaagcaagatgtgagctctttggctaaacctgtattgatatgtcaggcagcaaaactcagtgtttgagattatcaaaagccttctaatatgcccttataggcaatcctgaagcattggttatcatcagggagatgtgccactgcgtgtctttcctgctccccctccaatctcctttatcaccccaccccactcctcagccctccctttttttttttaagttgcctgtctggaccaggcaagaggtgcctactggagggtcttggtgaagcggtaactccattcctttcccttgggtcccccaaaggtaataaaagtacctggaggagaatagtcaggtgattgacctctgcctgtctctctgacggtgatgtaggtgcagacaccgcctgcctgccttgtcctggggttttgtaactgcagctttgacacaggcattcttcctttgaagcacacagcttgcttttccagcacctagacttttacctctcttcatgccttagacttagaccataactgggcttgaaatgctcaccccttcctgggtctggtcttggcacctaggctattcctttccaaactgaagtgagtccagtttcagaccatctcttttcctgtctccaaaaaccatttttgtttccaaacctagctcccccgaaattttaagactatttacctagattcggagatggtcttggagagttccaaaaggggtgtgtgtgtgtctgtgtgtgtgtctgtgtgtgtgtctgtgtgtgtgtctgtgtgtgtgtctgtgtgtctaatatttagactaaaccatggtaaatgtacgcacccagtatccttttcagttagcatattctttcttaaactcatctcagtacttttcatttgtttgcttcattatcttaaacaggttaaaagtgcctatgataaggacttaattatttcctaaagaaaagcaaaaaatgtggggaacagggtagtgttatactatcatctcaggtactgcctatgttcaagaacatagacctggtatggtgagaacaaaaggttcctatgccaaatccagatggctatatcatttgttggctacaagtgagcctgactgcaaggtttgcttctgctgagaaatcccatggtgagagtagaactcatgaagtgctgagtcacatttgcacctctggtgtggtggcagttcactctcccctggatgctgtcagctggccttgctttcatcctatccctgtaggcagggtaggtggctgggtaggagaagctattgagtgtatgacgcagaccaagctttcctgggccttctcaccaactagagaagcgctgatgtcgttcattgaggcacttaaacaccagtcactcagccaggcctcctcccagacattctgtaacatgtcagcactcacaaggtttaaagcaaatgtgttcccttgcagagaggaaggtgctctcagactgatagattagaggagacagacaaactcgtaatccttggggacttgaagagagtggctaggggaagggctgttaaaagaaaagggaccaataagaaaatccatctaaaggtagctcttgaggaggaaattaacttcttgaggggataaattagagggtaccaagtttatgttctggaatgtaccctggggagggcgctgcccactggattggtcccagtggactgaaaggtggtgctctcgagtcaggcgcttagtcccagagagagctgggtgccgcggggctcgtggtctgtgcctactcagggaaatgacttaggttctcccaggtgctctgttgataaggatggaagcagaactactttgagacacaagcaacaattggaagagtttttttatatgaactgaaatagatctaagagagcctggttaacagtttcctttaataccagttcagattaaatggttactttaggaacctgtgttactgtgtgagcacccacagaaacaagcaaacttatttcctacaaaaaatgaggggataataaccgatcagagtcacagtcgtttcaatataaacccttccgaaagcaaaagcagggaccacatgagcacacaagaagccaaagtttgtcagtgatcttaataaattaagactgagtaacatcctgcctttagaaaaaaataaccccgaggtggagaccagggcaggggaggtggcggagaagcatcgggccagatcaaccgttaataacatgcttctgagctatgtggatgtataaatgaaaacacccccaactaggtattgtagaggctggaaaaagatgtgatgggattatacaggtgatgcatatttttgttttgagactcaacaatgtgctacaaatgtgatacttaaccctgaactgcatgtattggggattgttttttaaaaagaaaaaaaacaactttgaatcaataaattaacagtttttcacttgctggctcttcttgctgtaaatggtgactaagaggttgggacagaaatcttgacaactagtggaaaacttggataatcttcaaggaccatggagccttctgtttccttctgtttgcagaaaagcaacactgcctgggttgtgatcctttacaagtgactacttcagacacaattggccacctctttgtatcactggatgactgatgtatgatttatgtgctgctgcccttagagggaagaaaaatgccatgttaaatcctgttttcttaaataaaaatgttgacaataaccagccttcccaagtgggagacaaaccat

SEQ ID NO: 104351 - DNA, 908 bp, Homo sapiens
  misc_feature (826)..(826): n is a, c, g, or t
gtgatttggtcagtttgttttgtgtttcagcttgttcgcattgccaaggttctgggtacagaagaactgtatgggtatctgaagaagtatcacatagacctagatccacacttcaacgatatcctgggacaacattcacggaaacgctgggaaaactttatccatagtgagaacagacaccttgtcagccctgaggccctagatcttctggacaaacttctgcgatacgaccatcaacagagactgactgccaaagaggccatggagcacccatacttctaccctgtggtgaaggagcagtcccagccttgtgcagacaatgctgtgctttccagtggtctcacggcagcacgatgaagactggaaagcgacgggtctgttgcggttctcccacttttccataagcagaacaagaaccaaatcaaacgtcttaacgcgtatagagagatcacgttccgtgagcagacacaaaacggtggcaggtttggcgagcacgaactagaccaagcgaagggcagcccaccaccgtatatcaaacctcacttccgaatgtaaaaggctcacttgcctttggcttcctgttgacttcttcccgacccagaaagcatggggaatgtgaagggtatgcagaatgttgttggttactgttgctccccgagcccctcaactcgtcccgtggccgcctgtttttccagcaaaccacgctaactagctgaccacagactccacagtggggggacgggcgcagtatgtggcatggcggcagttacatattattattttaaaagtatatattattgaataaaaggttttaaaagatataaanatattaaaaataaaaactcaagggggggcccggtaccaatttcgcccttagtgagtcgttttacgcgcgctaattggccgct

SEQ ID NO: 104352 - DNA, 3655 bp, Homo sapiens
tttttttttggcagccttgtaaggagaacttcaccatttcccagcacatccctatgtgtgcgcctattttaatgcacctctctgaaacagagacctttttgttcacaaccataactaaagctggaaagtcagtcttcaggcaaggcgagggaggaaaacatcccattagaattttttcaggaaagacttatggaaaaaaatatctctctcccacctccttttatccccatgagacacagtttcccactgtaatcagggtaatatgcatttgtaagttctgatatgtgatacatttatgtgatggcaaagataagtctgtcttgcatgcaggtactagagttgtgtgggcagggtcatctgaaactcaagcaactcagaggaatatacaaggggcttggggaagaaaatggtgctcccggagcaagtgttggatccattttgcaaaccttcatgttagcagagaaagctagagtttgtttaaacaaaaatagggctgatttcattttggggactcaggagcaacatggtttgtaggcagtcccctcaccccagctgcagggccatgccacagctgtggggacttcacacacctaggctagaactagaggtgtctaccacatcaccctttaagatttctttattaactatttaataatgccatacatttttataaggttagatgtttgtttgaaacatttgtttacattccatattccaataaaatcttattggtattggtagcagatcctactctaaatgtagattctatttttgtcgtttggtctgtgggaacttaaaatacaaatgaaactcttctcttattatagagttgagtttatagagtaaaaaataaataagatcccaaagccaaggaatgcattcagttaaggttctcataccaatgctgcctgcttgcattgcacattctgtatactaatgtaaacatttgttctacctgaaaatcaaaagcaagatgtgagctctttggctaaacctgtattgatatgtcaggcagcaaaactcagtgtttgagattatcaaaagccttctaatatgcccttataggcaatcctgaagcattggttatcatcagggagatgtgccactgcgtgtctttcctgctccccctccaatctcctttatcaccccaccccactcctcagccctccctttttttttttaagttgcctgtctggaccaggcaagaggtgcctactggagggtcttggtgaagcggtaactccattcctttcccttgggtcccccaaaggtaataaaagtacctggaggagaatagtcaggtgattgacctctgcctgtctctctgacggtgatgtaggtgcagacaccgcctgcctgccttgtcctggggttttgtaactgcagctttgacacaggcattcttcctttgaagcacacagcttgcttttccagcacctagacttttacctctcttcatgccttagacttagaccataactgggcttgaaatgctcaccccttcctgggtctggtcttggcacctaggctattcctttccaaactgaagtgagtccagtttcagaccatctcttttcctgtctccaaaaaccatttttgtttccaaacctagctcccccgaaattttaagactatttacctagattcggagatggtcttggagagttccaaaaggggtgtgtgtgtgtctgtgtgtgtgtctgtgtgtgtgtctgtgtgtgtgtctgtgtgtgtgtctgtgtgtctaatatttagactaaaccatggtaaatgtacgcacccagtatccttttcagttagcatattctttcttaaactcatctcagtacttttcatttgtttgcttcattatcttaaacaggttaaaagtgcctatgataaggacttaattatttcctaaagaaaagcaaaaaatgtggggaacagggtagtgttatactatcatctcaggtactgcctatgttcaagaacatagacctggtatggtgagaacaaaaggttcctatgccaaatccagatggctatatcatttgttggctacaagtgagcctgactgcaaggtttgcttctgctgagaaatcccatggtgagagtagaactcatgaagtgctgagtcacatttgcacctctggtgtggtggcagttcactctcccctggatgctgtcagctggccttgctttcatcctatccctgtaggcagggtaggtggctgggtaggagaagctattgagtgtatgacgcagaccaagctttcctgggccttctcaccaactagagaagcgctgatgtcgttcattgaggcacttaaacaccagtcactcagccaggcctcctcccagacattctgtaacatgtcagcactcacaaggtttaaagcaaatgtgttcccttgcagagaggaaggtgctctcagactgatagattagaggagacagacaaactcgtaatccttggggacttgaagagagtggctaggggaagggctgttaaaagaaaagggaccaataagaaaatccatctaaaggtagctcttgaggaggaaattaacttcttgaggggataaattagagggtaccaagtttatgttctggaatgtaccctggggagggcgctgcccactggattggtcccagtggactgaaaggtggtgctctcgagtcaggcgcttagtcccagagagagctgggtgccgcggggctcgtggtctgtgcctactcagggaaatgacttaggttctcccaggtgctctgttgataaggatggaagcagaactactttgagacacaagcaacaattggaagagtttttttatatgaactgaaatagatctaagagagcctggttaacagtttcctttaataccagttcagattaaatggttactttaggaacctgtgttactgtgtgagcacccacagaaacaagcaaacttatttcctacaaaaaatgaggggataataaccgatcagagtcacagtcgtttcaatataaacccttccgaaagcaaaagcagggaccacatgagcacacaagaagccaaagtttgtcagtgatcttaataaattaagactgagtggcggagaagcatcgggccagatcaaccgttaataacatgcttctgagctatgtggatgtataaatgaaaacacccccaactaggtattgtagaggctggaaaaagatgtgatgggattatacaggtgatgcatatttttgttttgagactcaacaatgtgctacaaatgtgatacttaaccctgaactgcatgtattggggattgttttttaaaaagaaaaaaaacaactttgaatcaataaattaacagtttttcacttgctggctcttcttgctgtaaatggtgactaagaggttgggacagaaatcttgacaactagtggaaaacttggataatcttcaaggaccatggagccttctgtttccttctgtttgcagaaaagcaacactgcctgggttgtgatcctttacaagtgactacttcagacacaattggccacctctttgtatcactggatgactgatgtatgatttatgtgctgctgcccttagagggaagaaaaatgccatgttaaatcctgttttcttaaataaaaatgttgacaataaccagccttcccaagtgggagacaaaccat

SEQ ID NO: 104353 - DNA, 927 bp, Homo sapiens
gattttcaggattcccgcgagaggcgcttaaaacgaactggcaccatttgcaaaatccatctaaaggtagctcttgaggaggaaattaacttcttgaggggataaattagagggtaccaagtttatgttctggaatgtaccctggggagggcgctgcccactggattggtcccagtggactgaaaggtggtgctctcgagtcaggcgcttagtcccagagagagctgggtgccgcggggctcgtggtctgtgcctactcagggaaatgacttaggttctcccaggtgctctgttgataaggatggaagcagaactactttgagacacaagcaacaattggaagagtttttttatatgaactgaaatagatctaagagagcctggttaacagtttcctttaataccagttcagattaaatggttactttaggaacctgtgttactgtgtgagcacccacagaaacaagcaaacttatttcctacaaaaaatgaggggataataaccgatcagagtcacagtcgtttcaatataaacccttccgaaagcaaaagcagggaccacatgagcacacaagaagccaaagtttgtcagtgatcttaataaattaagactgagtaacatcctgcctttagaaaaaaataaccccgaggtggagaccagggcaggggaggtggcggagaagcatcgggccagatcaaccgttaataacatgcttctgagctatgtggatgtataaatgaaaacacccccaactaggtattgtagaggctggaaaaagatgtgatgggattatacaggtgatgcatatttttgttttgagactcaacaatgtgctacaaatgtgatacttaaccctgaactgcatgtattggggattgttttttaaaaagaaaaaaaacaactttgaatcaataaattaacagttt

SEQ ID NO: 104354 - DNA, 2281 bp, Homo sapiens
tttttttttggcagccttgtaaggagaacttcaccatttcccagcacatccctatgtgtgcgcctattttaatgcacctctctgaaacagagacctttttgttcacaaccataactaaagctggaaagtcagtcttcaggcaaggcgagggaggaaaacatcccattagaattttttcaggaaagacttatggaaaaaaatatctctctcccacctccttttatccccatgagacacagtttcccactgtaatcagggtaatatgcatttgtaagttctgatatgtgatacatttatgtgatggcaaagataagtctgtcttgcatgcaggtactagagttgtgtgggcagggtcatctgaaactcaagcaactcagaggaatatacaaggggcttggggaagaaaatggtgctcccggagcaagtgttggatccattttgcaaaccttcatgttagcagagaaagctagagtttgtttaaacaaaaatagggctgatttcattttggggactcaggagcaacatggtttgtaggcagtcccctcaccccagctgcagggccatgccacagctgtggggacttcacacacctaggctagaactagaggtgtctaccacatcaccctttaagatttctttattaactatttaataatgccatacatttttataaggttagatgtttgtttgaaacatttgtttacattccatattccaataaaatcttattggtattggtagcagatcctactctaaatgtagattctatttttgtcgtttggtctgtgggaacttaaaatacaaatgaaactcttctcttattatagagttgagtttatagagtaaaaaataaataagatcccaaagccaaggaatgcattcagttaaggttctcataccaatgctgcctgcttgcattgcacattctgtatactaatgtaaacatttgttctacctgaaaatcaaaagcaagatgtgagctctttggctaaacctgtattgatatgtcaggcagcaaaactcagtgtttgagattatcaaaagccttctaatatgcccttataggcaatcctgaagcattggttatcatcagggagatgtgccactgcgtgtctttcctgctccccctccaatctcctttatcaccccaccccactcctcagccctccctttttttttttaagttgcctgtctggaccaggcaagaggtgcctactggagggtcttggtgaagcggtaactccattcctttcccttgggtcccccaaaggtaataaaagtacctggaggagaatagtcaggtgattgacctctgcctgtctctctgacggtgatgtaggtgcagacaccgcctgcctgccttgtcctggggttttgtaactgcagctttgacacaggcattcttcctttgaagcacacagcttgcttttccagcacctagacttttacctctcttcatgccttagacttagaccataactgggcttgaaatgctcaccccttcctgggtctggtcttggcacctaggctattcctttccaaactgaagtgagtccagtttcagaccatctcttttcctgtctccaaaaaccatttttgtttccaaacctagctcccccgaaattttaagactatttacctagattcggagatggtcttggagagttccaaaaggggtgtgtgtgtgtctgtgtgtgtgtctgtgtgtgtgtctgtgtgtgtgtctgtgtgtgtgtctgtgtgtctaatatttagactaaaccatggtaaatgtacgcacccagtatccttttcagttagcatattctttcttaaactcatctcagtacttttcatttgtttgcttcattatcttaaacaggttaaaagtgcctatgataaggacttaattatttcctaaagaaaagcaaaaaatgtggggaacaggagtcagagctgacaggaaaacgttagagtggctataacatttttaaaataatctttgagtcgtaaaatagtaagtcacacattccaagttttccatagaaaggccaacatgtaaaccggttacgaactaagtattcttgaattgaactgacccagtcatctgtagtacatcttaagaattaatgcgagatgtggcgcacttgacgcgagtcactggcgtgctttttaacgaactgctgtccatttccaacgccccccaacccactcgccccctgcccagaccacccgacacccccacccgccgcaagcacacgcccgcgccgcgccaatagcacctccgggggccccccacccg

SEQ ID NO: 104355 - DNA, 615 bp, Homo sapiens
tgtgtcagtgaacagcccttcccctagccactctcttcaagtcccgcaaggataacgagttggtctgtctcctctaatctatcagtctgagagcaccttcctctcggcaagggaacacatttgctcgtgactgtgtgagcacccacagaaacaagcaaacttatttcctacaaaaaatgaggggataataaccgatcagagtcacagtcgtttcaatataaacccttccgaaagcaaaagcagggaccacatgagcacacaagaagccaaagtttgtcagtgatcttaataaattaagactgagtaacatcctgcctttagaaaaaaataaccccgaggtggagaccagggcaggggaggtggcggagaagcatcgggccagatcaaccgttaataacatgcttctgagctatgtggatgtataaatgaaaacacccccaactaggtattgtagaggctggaaaaagatgtgatgggattatacaggtgatgcatatttttgttttgagactcaacaatgtgctacaaatgtgatacttaaccctgaactgcatgtattggggattgttttttaaaaagaaaaaaaacaactttgaatcaataaattaacagttt

SEQ ID NO: 104356 - DNA, 1014 bp, Homo sapiens
cgcgggcagcagggcccgggtctacgccgaggtgaacagtctgaggagccgcgagtactgggactacgaggctcacgtcccgagctggggtaatcaagatgattaccaactggttcgaaaacttggtcggggaaaatatagtgaagtatttgaggccattaatatcaccaacaatgagagagtggttgtaaaaatcctgaagccagtgaagaaaaagaagataaaacgagaggttaagattctggagaaccttcgtggtggaacaaatatcattaagctgattgacactgtaaaggaccccgtgagtcaaagacaccagctttggtatttgaatatatcaataatacagattttaagcaactctaccagatcctgacagactttgatatccggttttatatgtatgaactacttaaagctctggattactgccacagcaagggaatcatgcacagggatgtgaaacctcacaatgtcatgatagatcaccaacagaaaaagctgcgactgatagattggggtctggcagaattctatcatcctgctcaggagtacaatgttcgtgtagcctcaaggtacttcaagggaccagagctcctcgtggactatcagatgtatgattatagcttggacatgtggagtttgggctgtatgttagcaagcatgatctttcgaagggaaccattcttccatggacaggacaactatgaccagcttgttcgcattgccaaggttctgggtacagaagaactgtatgggtatctgaagaagtatcacatagacctagatccacacttcaacgatatcctgggacaacattcacggaaacgctgggaaaactttatccatagtgagaacagacaccttgtcagccctgaggccctagatcttctggacaaacttctgcgatacgaccatcaacagagactgactgccaaagaggccatggagcacccatacttctaccctgtggtgaacggactctggcctcgtgaccggggatcctctacgagt

SEQ ID NO: 104357 - DNA, 323 bp, Homo sapiens
ggggttagagatgatattaatattgaaagaaaataaatgtagaaatttgaacagtgggaaattagagtttctatgcctcttagcattgagtctgtactccgaggaagggtaagagttgactgcaataacaatttccctgatcatttttcagtgtttggtttttatatggctggaattccgtgatttccgtctctcctgttgcccccctgaccctggcttgcccatcagtctgtctctctttccgttgaaagggtgggtttgccatgggcttctctcagcactcaccaccctgattgcctgactttcctcctgctttcttgcag

SEQ ID NO: 104358 - DNA, 1592 bp, Homo sapiens
  misc_feature (1510)..(1510): n is a, c, g, or t
cgcgggcagcagggcccgggtctacgccgaggtgaacagtctgaggagccgcgagtactgggactacgaggctcacgtcccgagctggggtaatcaagatgattaccaactggttcgaaaacttggtcggggaaaatatagtgaagtatttgaggccattaatatcaccaacaatgagagagtggttgtaaaaatcctgaagccagtgaagaaaaagaagataaaacgagaggttaagattctggagaaccttcgtggtggaacaaatatcattaagctgattgacactgtaaaggaccccgtgagtcaaagacaccagctttggtatttgaatatatcaataatacagattttaagcaactctaccagatcctgacagactttgatatccggttttatatgtatgaactacttaaagctctggattactgccacagcaagggaatcatgcacagggatgtgaaacctcacaatgtcatgatagatcaccaacagaaaaagctgcgactgatagattggggtctggcagaattctatcatcctgctcaggagtacaatgttcgtgtagcctcaaggtacttcaagggaccagagctcctcgtggactatcagatgtatgattatagcttggacatgtggagtttgggctgtatgttagcaagcatgatctttcgaagggaaccattcttccatggacaggacaactatgaccagcttgttcgcattgccaaggttctgggtacagaagaactgtatgggtatctgaagaagtatcacatagacctagatccacacttcaacgatatcctgggacaacattcacggaaacgctgggaaaactttatccatagtgagaacagacaccttgtcagccctgaggccctagatcttctggacaaacttctgcgatacgaccatcaacagagactgactgccaaagaggccatggagcacccatacttctaccctgtggtgaaggagcagtcccagccttgtgcagacaatgctgtgctttccagtggtctcacggcagcacgatgaagactggaaagcgacgggtctgttgcggttctcccacttttccataagcagaacaagaaccaaatcaaacgtcttaacgcgtatagagagatcacgttccgtgagcagacacaaaacggtggcaggtttggcgagcacgaactagaccaagcgaagggcagcccaccaccgtatatcaaacctcacttccgaatgtaaaaggctcacttgcctttggcttcctgttgacttcttcccgacccagaaagcatggggaatgtgaagggtatgcagaatgttgttggttactgttgctccccgagcccctcaactcgtcccgtggccgcctgtttttccagcaaaccacgctaactagctgaccacagactccacagtggggggacgggcgcagtatgtggcatggcggcagttacatattattattttaaaagtatatattattgaataaaaggttttaaaagatataaanatattaaaaataaaaactcaagggggggcccggtaccaatttcgcccttagtgagtcgttttacgcgcgctaattggccgct

SEQ ID NO: 104359 - DNA, 1559 bp, Homo sapiens
cgcgggcagcagggcccgggtctacgccgaggtgaacagtctgaggagccgcgagtactgggactacgaggctcacgtcccgagctggggtaatcaagatgattaccaactggttcgaaaacttggtcggggaaaatatagtgaagtatttgaggccattaatatcaccaacaatgagagagtggttgtaaaaatcctgaagccagtgaagaaaaagaagataaaacgagaggttaagattctggagaaccttcgtggtggaacaaatatcattaagctgattgacactgtaaaggaccccgtgagtcaaagacaccagctttggtatttgaatatatcaataatacagattttaagcaactctaccagatcctgacagactttgatatccggttttatatgtatgaactacttaaagctctggattactgccacagcaagggaatcatgcacagggatgtgaaacctcacaatgtcatgatagatcaccaacagaaaaagctgcgactgatagattggggtctggcagaattctatcatcctgctcaggagtacaatgttcgtgtagcctcaaggtacttcaagggaccagagctcctcgtggactatcagatgtatgattatagcttggacatgtggagtttgggctgtatgttagcaagcatgatctttcgaagggaaccattcttccatggacaggacaactatgaccagcttgttcgcattgccaaggttctgggtacagaagaactgtatgggtatctgaagaagtatcacatagacctagatccacacttcaacgatatcctgggacaacattcacggaaacgctgggaaaactttatccatagtgagaacagacaccttgtcagccctgaggccctagatcttctggacaaacttctgcgatacgaccatcaacagagactgactgccaaagaggccatggagcacccatacttctaccctgtggtgaaggagcagtcccagccttgtgcagacaatgctgtgctttccagtggtctcacggcagcacgatgaagactggaaagcgacgggtaatgcggcattgatgcttgccaataaaaccaaccaaccaaacacaaaccttgaaggaaaactacagtgtgataaaaagaaattcttatcattccttctaaatgcacagaagagtaaagacctaaaagtctgtcaaaaagcaagaaagaaactccccagtgctagtctccagggagctgtcactgtggcagcatggggatgcacctagttcaggatctgaaggagctctgcctttggaatgcatgggagatagagactcggagttgttgtacatttacctttgtttaacagggcaccactgttgaattaacccattcagtcaacaagctctgaatgtctgacttcctatctattccattgtggtctgggtttcctttggtgaaattcaggctcaagtcttagcgaaatgtcagcagtctatactgacacaccagcctcatttacaaaaaggagatattaaaacagtgacagtattttttttttaagctctttacaaatcc

SEQ ID NO: 104360 - DNA, 1795 bp, Homo sapiens
  misc_feature (1124)..(1124): n is a, c, g, or t
atttttgtgaaggtaccgtggaaaatatttcatttttcttctcaccggagcaattgtaaatgctatgcggtaagaggagttacctgtggaaaggtggttaagagattaggtaaagaaaaggaaaggacaccaaaataaagtgctgcggaagaatttttgtccagctgtgagacgacgagtgcgtgaagtgaaggcgattgagaggggctgagggaattgtcctctgtggaagggactttcttttggccctaggccccttcctgcccctgtcgtcagcagagagatggaaaacttgatgactagctccaccctaccgcccctttttgcagatgaagacggttccaaggagagtaatgatctggctaccactgggttaaatcacccagaggttccatacagtagtggcgccacatcatccaccaacaatccagaatttgtggaggatctctctcaaggtcagttgcttcagagtgagtcttcaaatgcagcagaaggcaatgaacagaggcatgaagatgaggtaagctgaagtatctccttctgttcctatcatctgaaacttctgaagaagcagtcacaaggaaggtgtgttgatcaaggtgttcatatgaccttcttatattcttaggctgatacctgcaaaattttgttttctatttcttgttttatacggaaccatattaataattttaatgacatagacaggtagactcttttttccctgttccctaagaaatgtatacttacctcatattagatgttgaacaaatacttgttgaatgagtgaatgatttaatcattaataagtaactaatgagaagtgtacatgcccttgctcaaggctctgctcagcaagccctgctgcatggagccctatgtgcccaaaggattcatactacttaccaaatctttcaccctcccatagggggtaactttccttaactcacacaaaggcgtatgagcctgggcagtcatgcccttgttggactttcagtgtttcttacaaataactgattacattgtcagtgttttaaggcactcttttttttttttaagccaataaagagtgccaccattgatttttgtcttttttcttattttaaaaaagctggccgggcatggtngctcatgcctgtaatcctagcacttggccctccaaagtgctgggattacaggtgtgaaccaccgtgccagcccacagtagctttaatgtaactaggtttaaaaaaagaaaaacctaataccaaatacataatttgcccagtggtgaattataccattttatatatatttggaggagtagagtactacaattagtatttagatatttttgtccttgtttatttatatttctcttgtctgaaataagaattcttgtatccatgaaatattaactgatacggctgtatttgtaaaattatgaagtaaaaatattatgtaccttacatcttatttaaagggccaagaagaaaggctgtggtgaaacatcagtggtacctcagtccttttcatttctttagtttttttcagaggtgattcaatcttttgatttacctggtaactcaacatataaagacctctgactataaaatgtacatctaggccgggagccaccgtgcccggccacaaactctatttttaaaagagaagaaacaattgggaatttgaatgcagactgaatatttgatattaaggaattactattttttacatgtgatagtggtgtggtggttttattttttacaaaagaggcttttcttttcaaaacatactgaaatatttactgacaaaaacc

SEQ ID NO: 104361 - DNA, 4193 bp, Homo sapiens
atttttgtgaaggtaccgtggaaaatatttcatttttcttctcaccggagcaattgtaaatgctatgcggtaagaggagttacctgtggaaaggtggttaagagattaggtaaagaaaaggaaaggacaccaaaataaagtgctgcggaagaatttttgtccagctgtgagacgacgagtgcgtgaagtgaaggcgattgagaggggctgagggaattgtcctctgtggaagggactttcttttggccctaggccccttcctgcccctgtcgtcagcagagagatggaaaacttgatgactagctccaccctaccgcccctttttgcagatgaagacggttccaaggagagtaatgatctggctaccactgggttaaatcacccagaggttccatacagtagtggcgccacatcatccaccaacaatccagaatttgtggaggatctctctcaaggtcagttgcttcagagtgagtcttcaaatgcagcagaaggcaatgaacagaggcatgaagatgagcaacgaagtaaacgaggaggttggtccaaaggaagaaagaggaagaaacctcttcgagacagcaatgcacccaaatccccccttacaggatatgttcggttcatgaatgagcgtcgagaacaacttcgagcaaagagaccagaagtcccatttccagaaatcacaaggatgttaggcaatgaatggagtaaactgcctcctgaggaaaaacagcgctaccttgatgaagcagacagagataaggagcgttacatgaaggaactggaacagtatcagaaaacagaggcctacaaggtcttcagtaggaaaacccaggaccgtcagaaaggcaaatctcataggcaagatgcagcccggcaggccactcatgatcatgagaaagaaacagaggtaaaggaacggtctgtttttgacatccctatatttacagaggaattcttgaaccatagcaaagctcgggaagcagagctccgccagcttcgcaaatccaacatggagtttgaggagaggaatgcagccctgcaaaagcacgtggagagcatgcgcacagcagtggagaagctggaggtggatgtgatccaggagcggagccgcaacacagtcttacagcagcacctggagaccctgcggcaggtgctgaccagcagctttgccagcatgcccttgcctggaagtggagagacacctacagtggacaccattgactcatatatgaacagactgcacagtattattttagctaatccccaagacaatgaaaacttcatagctacagttcgagaagttgtgaacagactcgatcgttagggaatggtcttagaactccaagatgttccataagtgtttttacttgtgaggaatgagaagccatccatggaaatttgaactgagtgggggcagagaaagagtgcagatccctttgcttgtgaaagaattatcagtgagtgaaaggccatcaccccaggaagccaaatgagggagcagcaacatgtatatgagcttcctatggaattgtccttatgtgaagctttgaaggtgtacagccactctcccgggtcttcaggttcctaccatttccatttctgttaaagtggatctgcatatcttcagcttactaggtgacccggatgctgacatctgctgctgcagaaaggaagacttttcattgtaatttcgcttagacccttttatcagtggagctccagttttcttacctagctgtcacttttttaaatgcctctgggggttatttttgctttccttggcccccaccaatttatacatctccattttctgacctctggactaactggttgctcagcaaggttctgaaggagagtttcttgcattggacaggcccagtcttctcccatcattgccctgctgtgactccaaagaaaggagcttcttgctgacagtgccctgtggagcaaggctgtgtttcctaccccacacggtgctcagtgggtgccagccctcagtgtggctttgtgattgctgccctaaaggagaatgctctttccttcctcactggtactgcctgctgttttctaagcattgctcctgcacagacatggagtcccagccccagcaaggctcttctgttcccatctgttgacaatgtcttgtggagcatttttgctgaggaaaaggtcacttgtaaacagaggagaaagggaaagagtacaaagccctaagtttattgtaagtgaaaactgagggaattcctgtcttctttaggagtaatgattcatagatctagataggtggaaatatcattcaaaatagtcacttgagctcacaaaaaaagcaaggaagaattctcatgtcctttgtcttccttctgtagccattaactgctgaatccatgtgaggaagacaggcttcccttccttccccctccttagtgattttttctttaacagcataagtaaagaggactttctggttcatttttgtttgttttgttttgttttgttttgtttacagatgaggtcttgctgtgttgcccaggctggagtgcggtggctattcacagatgctatcatagcacactacagcctccaactcttgggctcaagcatcacgcctagcagtttctggttcctttaacagcaaaaggaaagagaggttctgattcttacctcagggttttttggttgttcattgtttttgtttttgtttttgttttgacactgcagagcacaaggctaaaggttacagctgagatctttggaaccaaaggcagagcaagcagagcccgttgtctgggccccacaccactgcaggcaggtggatagaagtgcggcccctctcatagtatgcccataagtcagggcatagggcagaactacctgtcatgttgctacaccatcctgtcttctcagcatctccttgcctgttttctttattagtccaaaggaaaacaacagcaacaaaatctgtttttaaaatgtcttatatgaacatatatcaaatatccatgcgctgaaacccacataccatcacttggcaattttttagaataagaccccattattatctattgctataaacctagccagttctcttgctcttctgtattttcctatttccctgccatcatctgctatttctgccacttctcttagactccttgtctgcaaagcccaagctagaactcactgtctatggcagaaggacatccagagcccattctggagttttgttttttccttctgccagatgctttgtgtcctgtcttccttcctcctcatatttctgtttctcatttgtgttcagttttgtgcagcattgctagcactgcttttgtgaccagaaaaggccataacatggtccaggatcatcattcttctgactctagatgggacacttgacagtgacttgaaacatttgcatattcaggaatgcatgagatttcaagagagcctacagtatgaaatcattttcacaaaataagcagcttgcttctgaaatgctgtctttcccagtagctactcacctgcctctggtggctgggattcagatgccacaaaactgtcagtatctatagaccaggtctgtgccacctcctctctcctctgtgctcagtgaggaggcagtaaatgaagttacaggctagcacaatacctaattcatgtttcccagtacacctgtagatattactgtacttttatgttctcaagaaataagttgttgcctattcagtgttacagatttctttgtttctttttaattaaaatacaagaagcagctgaggaaagggagacaaggtattttatttctgactgattttagaaaaaacttgtgtacatgtgtttggaactgttgaaatgccaagttttctgtataagtgtttttgtaattaaactttcagattttctttgttttttaagaagttgatgtgcttgtttgacatttgtctcattaaaacttttctacgttggaaaaaacacaccccacacacgaagaccaacaaacaacgcaacacacgacaaaaacacagagagacaacaacaacacgctaagcaaaaaaagacggcgaaccaagggccgccgcggcaaccgcggcagcgcgctactcgcacctataagggcacgagataaacaagcggggcggacccggaaaagcgcgaatgcgctcgtggacaaccacacaaacaaagcagcggag

SEQ ID NO: 104362 - DNA, 4065 bp, Homo sapiens
atttttgtgaaggtaccgtggaaaatatttcatttttcttctcaccggagcaattgtaaatgctatgcggtaagaggagttacctgtggaaaggtggttaagagattaggtaaagaaaaggaaaggacaccaaaataaagtgctgcggaagaatttttgtccagctgtgagacgacgagtgcgtgaagtgaaggcgattgagaggggctgagggaattgtcctctgtggaagggactttcttttggccctaggccccttcctgcccctgtcgtcagcagagagatggaaaacttgatgactagctccaccctaccgcccctttttgcagatgaagacggttccaaggagagtaatgatctggctaccactgggttaaatcacccagaggttccatacagtagtggcgccacatcatccaccaacaatccagaatttgtggaggatctctctcaaggtcagttgcttcagagtgagtcttcaaatgcagcagaaggcaatgaacagaggcatgaagatgagcaacgaagtaaacgaggaggttggtccaaaggaagaaagaggaagaaacctcttcgagacagcaatgcacccaaatccccccttacaggatatgttcggttcatgaatgagcgtcgagaacaacttcgagcaaagagaccagaagtcccatttccagaaatcacaaggatgttaggcaatgaatggagtaaactgcctcctgaggaaaaacagcgctaccttgatgaagcagacagagataaggagcgttacatgaaggaactggaacagtatcagaaaacagaggcctacaaggtcttcagtaggaaaacccaggaccgtcagaaaggcaaatctcataggcaagatgcagcccggcaggccactcatgatcatgagaaagaaacagaggtaaaggaacggtctgtttttgacatccctatatttacagaggaattcttgaaccatagcaaagctcgggaagcagagctccgccagcttcgcaaatccaacatggagtttgaggagaggaatgcagccctgcaaaagcacgtggagagcatgcgcacagcagtggagaagctggaggtggatgtgatccaggagcggagccgcaacacagtcttacagcagcacctggagaccctgcggcaggtgctgaccagcagctttgccagcatgcccttgcctggaagtggagagacacctacagtggacaccattgactcatatatgaacagactgcacagtattattttagctaatccccaagacaatgaaaacttcatagctacagttcgagaagttgtgaacagactcgatcgttagggaatggtcttagaactccaagatgttccataagtgtttttacttgtgaggaatgagaagccatccatggaaatttgaactgagtgggggcagagaaagagtgcagatccctttgcttgtgaaagaattatcagtgagtgaaaggccatcaccccaggaagccaaatgagggagcagcaacatgtatatgagcttcctatggaattgtccttatgtgaagctttgaaggtgtacagccactctcccgggtcttcaggttcctaccatttccatttctgttaaagtggatctgcatatcttcagcttactaggtgacccggatgctgacatctgctgctgcagaaaggaagacttttcattgtaatttcgcttagacccttttatcagtggagctccagttttcttacctagctgtcacttttttaaatgcctctgggggttatttttgctttccttggcccccaccaatttatacatctccattttctgacctctggactaactggttgctcagcaaggttctgaaggagagtttcttgcattggacaggcccagtcttctcccatcattgccctgctgtgactccaaagaaaggagcttcttgctgacagtgccctgtggagcaaggctgtgtttcctaccccacacggtgctcagtgggtgccagccctcagtgtggctttgtgattgctgccctaaaggagaatgctctttccttcctcactggtactgcctgctgttttctaagcattgctcctgcacagacatggagtcccagccccagcaaggctcttctgttcccatctgttgacaatgtcttgtggagcatttttgctgaggaaaaggtcacttgtaaacagaggagaaagggaaagagtacaaagccctaagtttattgtaagtgaaaactgagggaattcctgtcttctttaggagtaatgattcatagatctagataggtggaaatatcattcaaaatagtcacttgagctcacaaaaaaagcaaggaagaattctcatgtcctttgtcttccttctgtagccattaactgctgaatccatgtgaggaagacaggcttcccttccttccccctccttagtgattttttctttaacagcataagtaaagaggactttctggttcatttttgtttgttttgttttgttttgttttgtttacagatgaggtcttgctgtgttgcccaggctggagtgcggtggctattcacagatgctatcatagcacactacagcctccaactcttgggctcaagcatcacgcctagcagtttctggttcctttaacagcaaaaggaaagagaggttctgattcttacctcagggttttttggttgttcattgtttttgtttttgtttttgttttgacactgcagagcacaaggctaaaggttacagctgagatctttggaaccaaaggcagagcaagcagagcccgttgtctgggccccacaccactgcaggcaggtggatagaagtgcggcccctctcatagtatgcccataagtcagggcatagggcagaactacctgtcatgttgctacaccatcctgtcttctcagcatctccttgcctgttttctttattagtccaaaggaaaacaacagcaacaaaatctgtttttaaaatgtcttatatgaacatatatcaaatatccatgcgctgaaacccacataccatcacttggcaattttttagaataagaccccattattatctattgctataaacctagccagttctcttgctcttctgtattttcctatttccctgccatcatctgctatttctgccacttctcttagactccttgtctgcaaagcccaagctagaactcactgtctatggcagaaggacatccagagcccattctggagttttgttttttccttctgccagatgctttgtgtcctgtcttccttcctcctcatatttctgtttctcatttgtgttcagttttgtgcagcattgctagcactgcttttgtgaccagaaaaggccataacatggtccaggatcatcattcttctgactctagatgggacacttgacagtgacttgaaacatttgcatattcaggaatgcatgagatttcaagagagcctacagtatgaaatcattttcacaaaataagcagcttgcttctgaaatgctgtctttcccagtagctactcacctgcctctggtggctgggattcagatgccacaaaactgtcagtatctatagaccaggtctgtgccacctcctctctcctctgtgctcagtgaggaggcagtaaatgaagttacaggctagcacaatacctaattcatgtttcccagtacacctgtagatattactgtacttttatgttctcaagaaataagttgttgcctattcagtgttacagatttctttgtttctttttaattaaaatacaagaagcagctgaggaaagggagacaaggtattttatttctgactgattttagaaaaaacttgtgtacatgtgtttggaactgttgaaatgccaagttttctgtataagtgtttttgtaattaaactttcagattttctttgttttttaagaagttgatgtgcttgtttgacatttgtctcattaaaacttttctacgttgcctcgggccccaatttcacctcaccttcccccatctcccccctatatcgtcccattcccacatctccctggcccctcctcttcccctctctctcccctgg

SEQ ID NO: 104363 - DNA, 3776 bp, Homo sapiens
  misc_feature (3774)..(3774): n is a, c, g, or t
atttttgtgaaggtaccgtggaaaatatttcatttttcttctcaccggagcaattgtaaatgctatgcggtaagaggagttacctgtggaaaggtggttaagagattaggtaaagaaaaggaaaggacaccaaaataaagtgctgcggaagaatttttgtccagctgtgagacgacgagtgcgtgaagtgaaggcgattgagaggggctgagggaattgtcctctgtggaagggactttcttttggccctaggccccttcctgcccctgtcgtcagcagagagatggaaaacttgatgactagctccaccctaccgcccctttttgcagatgaagacggttccaaggagagtaatgatctggctaccactgggttaaatcacccagaggttccatacagtagtggcgccacatcatccaccaacaatccagaatttgtggaggatctctctcaaggtcagttgcttcagagtgagtcttcaaatgcagcagaaggcaatgaacagaggcatgaagatgagcaacgaagtaaacgaggaggttggtccaaaggaagaaagaggaagaaacctcttcgagacagcaatgcacccaaatccccccttacaggatatgttcggttcatgaatgagcgtcgagaacaacttcgagcaaagagaccagaagtcccatttccagaaatcacaaggatgttaggcaatgaatggagtaaactgcctcctgaggaaaaacagcgctaccttgatgaagcagacagagataaggagcgttacatgaaggaactggaacagtatcagaaaacagaggcctacaaggtcttcagtaggaaaacccaggaccgtcagaaaggcaaatctcataggcaagatgcagcccggcaggccactcatgatcatgagaaagaaacagaggtaaaggaacggtctgtttttgacatccctatatttacagaggaattcttgaaccatagcaaagctcgggaagcagagctccgccagcttcgcaaatccaacatggagtttgaggagaggaatgcagccctgcaaaagcacgtggagagcatgcgcacagcagtggagaagctggaggtggatgtgatccaggagcggagccgcaacacagtcttacagcagcacctggagaccctgcggcaggtgctgaccagcagctttgccagcatgcccttgcctggaagtggagagacacctacagtggacaccattgactcatatatgaacagactgcacagtattattttagctaatccccaagacaatgaaaacttcatagctacagttcgagaagttgtgaacagactcgatcgttagggaatggtcttagaactccaagatgttccataagtgtttttacttgtgaggaatgagaagccatccatggaaatttgaactgagtgggggcagagaaagagtgcagatccctttgcttgtgaaagaattatcagtgagtgaaaggccatcaccccaggaagccaaatgagggagcagcaacatgtatatgagcttcctatggaattgtccttatgtgaagctttgaaggtgtacagccactctcccgggtcttcaggttcctaccatttccatttctgttaaagtggatctgcatatcttcagcttactaggtgacccggatgctgacatctgctgctgcagaaaggaagacttttcattgtaatttcgcttagacccttttatcagtggagctccagttttcttacctagctgtcacttttttaaatgcctctgggggttatttttgctttccttggcccccaccaatttatacatctccattttctgacctctggactaactggttgctcagcaaggttctgaaggagagtttcttgcattggacaggcccagtcttctcccatcattgccctgctgtgactccaaagaaaggagcttcttgctgacagtgccctgtggagcaaggctgtgtttcctaccccacacggtgctcagtgggtgccagccctcagtgtggctttgtgattgctgccctaaaggagaatgctctttccttcctcactggtactgcctgctgttttctaagcattgctcctgcacagacatggagtcccagccccagcaaggctcttctgttcccatctgttgacaatgtcttgtggagcatttttgctgaggaaaaggtcacttgtaaacagaggagaaagggaaagagtacaaagccctaagtttattgtaagtgaaaactgagggaattcctgtcttctttaggagtaatgattcatagatctagataggtggaaatatcattcaaaatagtcacttgagctcacaaaaaaagcaaggaagaattctcatgtcctttgtcttccttctgtagccattaactgctgaatccatgtgaggaagacaggcttcccttccttccccctccttagtgattttttctttaacagcataagtaaagaggactttctggttcatttttgtttgttttgttttgttttgttttgtttacagatgaggtcttgctgtgttgcccaggctggagtgcggtggctattcacagatgctatcatagcacactacagcctccaactcttgggctcaagcatcacgcctagcagtttctggttcctttaacagcaaaaggaaagagaggttctgattcttacctcagggttttttggttgttcattgtttttgtttttgtttttgttttgacactgcagagcacaaggctaaaggttacagctgagatctttggaaccaaaggcagagcaagcagagcccgttgtctgggccccacaccactgcaggcaggtggatagaagtgcggcccctctcatagtatgcccataagtcagggcatagggcagaactacctgtcatgttgctacaccatcctgtcttctcagcatctccttgcctgttttctttattagtccaaaggaaaacaacagcaacaaaatctgtttttaaaatgtcttatatgaacatatatcaaatatccatgcgctgaaacccacataccatcacttggcaattttttagaataagaccccattattatctattgctataaacctagccagttctcttgctcttctgtattttcctatttccctgccatcatctgctatttctgccacttctcttagactccttgtctgcaaagcccaagctagaactcactgtctatggcagaaggacatccagagcccattctggagttttgttttttccttctgccagatgctttgtgtcctgtcttccttcctcctcatatttctgtttctcatttgtgttcagttttgtgcagcattgctagcactgcttttgtgaccagaaaaggccataacatggtccaggatcatcattcttctgactctagatgggacacttgacagtgacttgaaacatttgcatattcaggaatgcatgagatttcaagagagcctacagtatgaaatcattttcacaaaataagcagcttgcttctgaaatgctgtctttcccagtagctactcacctgcctctggtggctgggattcagatgccacaaaactgtcagtatctatagaccaggtctgtgccacctcctctctcctctgtgctcagtgaggaggcagtaaatgaagttacaggctagcacaatacctaattcatgtttcccagtacacctgtagatattactgtacttttatgttctcaagaaataagttgttgcctattcagtgttatattacggcccggccgcgcgccacccccatacaagaagcatntg

SEQ ID NO: 104364 - DNA, 395 bp, Homo sapiens
ggactaatttcatttctttgagatctaaaagtctctcctctaaaattaaaagcatgtctgtggagcagaccacattagaatcactgtttctttgaaattgtgttttatggtacaactgaatagggaggattttcttactttcttcttatctcacttcaggaagtggagagacacctacagtggacaccattgactcatatatgaacagactgcacagtattattttagctaatccccaagacaatgaaaacttcatagctacagttcgagaagttgtgaacagactcgatcgttagggaatggtgagtgctcactgataaatatttatatgccagcacatcatcaaaaataagatgtcatcagactttatcaatactactaaaaccctgggatta

SEQ ID NO: 104365 - DNA, 3965 bp, Homo sapiens
atttttgtgaaggtaccgtggaaaatatttcatttttcttctcaccggagcaattgtaaatgctatgcggtaagaggagttacctgtggaaaggtggttaagagattaggtaaagaaaaggaaaggacaccaaaataaagtgctgcggaagaatttttgtccagctgtgagacgacgagtgcgtgaagtgaaggcgattgagaggggctgagggaattgtcctctgtggaagggactttcttttggccctaggccccttcctgcccctgtcgtcagcagagagatggaaaacttgatgactagctccaccctaccgcccctttttgcagatgaagacggttccaaggagagtaatgatctggctaccactgggttaaatcacccagaggttccatacagtagtggcgccacatcatccaccaacaatccagaatttgtggaggatctctctcaaggtcagttgcttcagagtgagtcttcaaatgcagcagaaggcaatgaacagaggcatgaagatgagcaacgaagtaaacgaggaggttggtccaaaggaagaaagaggaagaaacctcttcgagacagcaatgcacccaaatccccccttacaggatatgttcggttcatgaatgagcgtcgagaacaacttcgagcaaagagaccagaagtcccatttccagaaatcacaaggatgttaggcaatgaatggagtaaactgcctcctgaggaaaaacagcgctaccttgatgaagcagacagagataaggagcgttacatgaaggaactggaacagtatcagaaaacagaggcctacaaggtcttcagtaggaaaacccaggaccgtcagaaaggcaaatctcataggcaagatgcagcccggcaggccactcatgatcatgagaaagaaacagaggtaaaggaacggtctgtttttgacatccctatatttacagaggaattcttgaaccatagcaaagctcgggaagcagagctccgccagcttcgcaaatccaacatggagtttgaggagaggaatgcagccctgcaaaagcacgtggagagcatgcgcacagcagtggagaagctggaggtggatgtgatccaggagcggagccgcaacacagtcttacagcagcacctggagaccctgcggcaggtgctgaccagcagctttgccagcatgcccttgcctggaagtggagagacacctacagtggacaccattgactcatatatgaacagactgcacagtattattttagctaatccccaagacaatgaaaacttcatagctacagttcgagaagttgtgaacagactcgatcgttagggaatggtcttagaactccaagatgttccataagtgtttttacttgtgaggaatgagaagccatccatggaaatttgaactgagtgggggcagagaaagagtgcagatccctttgcttgtgaaagaattatcagtgagtgaaaggccatcaccccaggaagccaaatgagggagcagcaacatgtatatgagcttcctatggaattgtccttatgtgaagctttgaaggtgtacagccactctcccgggtcttcaggttcctaccatttccatttctgttaaagtggatctgcatatcttcagcttactaggtgacccggatgctgacatctgctgctgcagaaaggaagacttttcattgtaatttcgcttagacccttttatcagtggagctccagttttcttacctagctgtcacttttttaaatgcctctgggggttatttttgctttccttggcccccaccaatttatacatctccattttctgacctctggactaactggttgctcagcaaggttctgaaggagagtttcttgcattggacaggcccagtcttctcccatcattgccctgctgtgactccaaagaaaggagcttcttgctgacagtgccctgtggagcaaggctgtgtttcctaccccacacggtgctcagtgggtgccagccctcagtgtggctttgtgattgctgccctaaaggagaatgctctttccttcctcactggtactgcctgctgttttctaagcattgctcctgcacagacatggagtcccagccccagcaaggctcttctgttcccatctgttgacaatgtcttgtggagcatttttgctgaggaaaaggtcacttgtaaacagaggagaaagggaaagagtacaaagccctaagtttattgtaagtgaaaactgagggaattcctgtcttctttaggagtaatgattcatagatctagataggtggaaatatcattcaaaatagtcacttgagctcacaaaaaaagcaaggaagaattctcatgtcctttgtcttccttctgtagccattaactgctgaatccatgtgaggaagacaggcttcccttccttccccctccttagtgattttttctttaacagcataagtaaagaggactttctggttcatttttgtttgttttgttttgttttgttttgtttacagatgaggtcttgctgtgttgcccaggctggagtgcggtggctattcacagatgctatcatagcacactacagcctccaactcttgggctcaagcatcacgcctagcagtttctggttcctttaacagcaaaaggaaagagaggttctgattcttacctcagggttttttggttgttcattgtttttgtttttgtttttgttttgacactgcagagcacaaggctaaaggttacagctgagatctttggaaccaaaggcagagcaagcagagcccgttgtctgggccccacaccactgcaggcaggtggatagaagtgcggcccctctcatagtatgcccataagtcagggcatagggcagaactacctgtcatgttgctacaccatcctgtcttctcagcatctccttgcctgttttctttattagtccaaaggaaaacaacagcaacaaaatctgtttttaaaatgtcttatatgaacatatatcaaatatccatgcgctgaaacccacataccatcacttggcaattttttagaataagaccccattattatctattgctataaacctagccagttctcttgctcttctgtattttcctatttccctgccatcatctgctatttctgccacttctcttagactccttgtctgcaaagcccaagctagaactcactgtctatggcagaaggacatccagagcccattctggagttttgttttttccttctgccagatgctttgtgtcctgtcttccttcctcctcatatttctgtttctcatttgtgttcagttttgtgcagcattgctagcactgcttttgtgaccagaaaaggccataacatggtccaggatcatcattcttctgactctagatgggacacttgacagtgacttgaaacatttgcatattcaggaatgcatgagatttcaagagagcctacagtatgaaatcattttcacaaaataagcagcttgcttctgaaatgctgtctttcccagtagctactcacctgcctctggtggctgggattcagatgccacaaaactgtcagtatctatagaccaggtctgtgccacctcctctctcctctgtgctcagtgaggaggcagtaaatgaagttacaggctagcacaatacctaattcatgtttcccagtacacctgtagatattactgtacttttatgttctcaagaaataagttgttgcctattcagtgttacagatttctttgtttctttttaattaaaatacaagaagcagctgaggaaagggagacaaggtattttatttctgactgattttagaaaaaacttgtgtacatgtgtttggaactgttgaaatgccaagttttctgtataagtgtttttgtaattaaactttcagattttctttgttttttaagaagttgatgtgcttgtttgacatttgtctcattaaaacttttctacgttg

SEQ ID NO: 104366 - DNA, 4058 bp, Homo sapiens
atttttgtgaaggtaccgtggaaaatatttcatttttcttctcaccggagcaattgtaaatgctatgcggtaagaggagttacctgtggaaaggtggttaagagattaggtaaagaaaaggaaaggacaccaaaataaagtgctgcggaagaatttttgtccagctgtgagacgacgagtgcgtgaagtgaaggcgattgagaggggctgagggaattgtcctctgtggaagggactttcttttggccctaggccccttcctgcccctgtcgtcagcagagtctctacaaggaagataacggactgtaaaattctataaagcaaagctacacatcacttgacaccatacaccatcttggttacataatgaagagagatggaaaacttgatgactagctccaccctaccgcccctttttgcagatgaagacggttccaaggagagtaatgatctggctaccactgggttaaatcacccagaggttccatacagtagtggcgccacatcatccaccaacaatccagaatttgtggaggatctctctcaaggtcagttgcttcagagtgagtcttcaaatgcagcagaaggcaatgaacagaggcatgaagatgagcaacgaagtaaacgaggaggttggtccaaaggaagaaagaggaagaaacctcttcgagacagcaatgcacccaaatccccccttacaggatatgttcggttcatgaatgagcgtcgagaacaacttcgagcaaagagaccagaagtcccatttccagaaatcacaaggatgttaggcaatgaatggagtaaactgcctcctgaggaaaaacagcgctaccttgatgaagcagacagagataaggagcgttacatgaaggaactggaacagtatcagaaaacagaggcctacaaggtcttcagtaggaaaacccaggaccgtcagaaaggcaaatctcataggcaagatgcagcccggcaggccactcatgatcatgagaaagaaacagaggtaaaggaacggtctgtttttgacatccctatatttacagaggaattcttgaaccatagcaaagctcgggaagcagagctccgccagcttcgcaaatccaacatggagtttgaggagaggaatgcagccctgcaaaagcacgtggagagcatgcgcacagcagtggagaagctggaggtggatgtgatccaggagcggagccgcaacacagtcttacagcagcacctggagaccctgcggcaggtgctgaccagcagctttgccagcatgcccttgcctggaagtggagagacacctacagtggacaccattgactcatatatgaacagactgcacagtattattttagctaatccccaagacaatgaaaacttcatagctacagttcgagaagttgtgaacagactcgatcgttagggaatggtcttagaactccaagatgttccataagtgtttttacttgtgaggaatgagaagccatccatggaaatttgaactgagtgggggcagagaaagagtgcagatccctttgcttgtgaaagaattatcagtgagtgaaaggccatcaccccaggaagccaaatgagggagcagcaacatgtatatgagcttcctatggaattgtccttatgtgaagctttgaaggtgtacagccactctcccgggtcttcaggttcctaccatttccatttctgttaaagtggatctgcatatcttcagcttactaggtgacccggatgctgacatctgctgctgcagaaaggaagacttttcattgtaatttcgcttagacccttttatcagtggagctccagttttcttacctagctgtcacttttttaaatgcctctgggggttatttttgctttccttggcccccaccaatttatacatctccattttctgacctctggactaactggttgctcagcaaggttctgaaggagagtttcttgcattggacaggcccagtcttctcccatcattgccctgctgtgactccaaagaaaggagcttcttgctgacagtgccctgtggagcaaggctgtgtttcctaccccacacggtgctcagtgggtgccagccctcagtgtggctttgtgattgctgccctaaaggagaatgctctttccttcctcactggtactgcctgctgttttctaagcattgctcctgcacagacatggagtcccagccccagcaaggctcttctgttcccatctgttgacaatgtcttgtggagcatttttgctgaggaaaaggtcacttgtaaacagaggagaaagggaaagagtacaaagccctaagtttattgtaagtgaaaactgagggaattcctgtcttctttaggagtaatgattcatagatctagataggtggaaatatcattcaaaatagtcacttgagctcacaaaaaaagcaaggaagaattctcatgtcctttgtcttccttctgtagccattaactgctgaatccatgtgaggaagacaggcttcccttccttccccctccttagtgattttttctttaacagcataagtaaagaggactttctggttcatttttgtttgttttgttttgttttgttttgtttacagatgaggtcttgctgtgttgcccaggctggagtgcggtggctattcacagatgctatcatagcacactacagcctccaactcttgggctcaagcatcacgcctagcagtttctggttcctttaacagcaaaaggaaagagaggttctgattcttacctcagggttttttggttgttcattgtttttgtttttgtttttgttttgacactgcagagcacaaggctaaaggttacagctgagatctttggaaccaaaggcagagcaagcagagcccgttgtctgggccccacaccactgcaggcaggtggatagaagtgcggcccctctcatagtatgcccataagtcagggcatagggcagaactacctgtcatgttgctacaccatcctgtcttctcagcatctccttgcctgttttctttattagtccaaaggaaaacaacagcaacaaaatctgtttttaaaatgtcttatatgaacatatatcaaatatccatgcgctgaaacccacataccatcacttggcaattttttagaataagaccccattattatctattgctataaacctagccagttctcttgctcttctgtattttcctatttccctgccatcatctgctatttctgccacttctcttagactccttgtctgcaaagcccaagctagaactcactgtctatggcagaaggacatccagagcccattctggagttttgttttttccttctgccagatgctttgtgtcctgtcttccttcctcctcatatttctgtttctcatttgtgttcagttttgtgcagcattgctagcactgcttttgtgaccagaaaaggccataacatggtccaggatcatcattcttctgactctagatgggacacttgacagtgacttgaaacatttgcatattcaggaatgcatgagatttcaagagagcctacagtatgaaatcattttcacaaaataagcagcttgcttctgaaatgctgtctttcccagtagctactcacctgcctctggtggctgggattcagatgccacaaaactgtcagtatctatagaccaggtctgtgccacctcctctctcctctgtgctcagtgaggaggcagtaaatgaagttacaggctagcacaatacctaattcatgtttcccagtacacctgtagatattactgtacttttatgttctcaagaaataagttgttgcctattcagtgttacagatttctttgtttctttttaattaaaatacaagaagcagctgaggaaagggagacaaggtattttatttctgactgattttagaaaaaacttgtgtacatgtgtttggaactgttgaaatgccaagttttctgtataagtgtttttgtaattaaactttcagattttctttgttttttaagaagttgatgtgcttgtttgacatttgtctcattaaaacttttctacgttg

SEQ ID NO: 104367 - DNA, 3912 bp, Homo sapiens
atttttgtgaaggtaccgtggaaaatatttcatttttcttctcaccggagcaattgtaaatgctatgcggtaagaggagttacctgtggaaaggtggttaagagattaggtaaagaaaaggaaaggacaccaaaataaagtgctgcggaagaatttttgtccagctgtgagacgacgagtgcgtgaagtgaaggcgattgagaggggctgagggaattgtcctctgtggaagggactttcttttggccctaggccccttcctgcccctgtcgtcagcagagagatggaaaacttgatgactagctccaccctaccgcccctttttgcagatgaagacggttccaaggagagtaatgatctggctaccactgggttaaatcacccagaggttccatacagtagtggcgccacatcatccaccaacaatccagaatttgtggaggatctctctcaaggtcagttgcttcagagtgagtcttcaaatgcagcagaaggcaatgaacagaggcatgaagatgagcaacgaagtaaacgaggaggttggtccaaaggaagaaagaggaagaaacctcttcgagacagcaatgcacccaaatccccccttacaggatatgttcggttcatgaatgagcgtcgagaacaacttcgagcaaagagaccagaagtcccatttccagaaatcacaaggatgttaggcaatgaatggagtaaactgcctcctgaggaaaaacagcgctaccttgatgaagcagacagagataaggagcgttacatgaaggaactggaacagtatcagaaaacagaggcctacaaggtcttcagtaggaaaacccaggaccgtcagaaaggcaaatctcataggcaagatgcagcccggcaggccactcatgatcatgagaaagaaacagaggtaaaggaacggtctgtttttgacatccctatatttacagaggaattcttgaaccatagcaaagctcgggaagcagagctccgccagcttcgcaaatccaacatggagtttgaggagaggaatgcagccctgcaaaagcacgtggagagcatgcgcacagcagtggagaagctggaggtggatgtgatccaggagcggagccgcaacacagtcttacagcagcacctggagaccctgcggcaggtgctgaccagcagctttgccagcatgcccttgcctggaagtggagagacacctacagtggacaccattgactcatatatgaacagactgcacagtattattttagctaatccccaagacaatgaaaacttcatagctacagttcgagaagttgtgaacagactcgatcgttagggaatggtcttagaactccaagatgttccataagtgtttttacttgtgaggaatgagaagccatccatggaaatttgaactgagtgggggcagagaaagagtgcagatccctttgcttgtgaaagaattatcagtgagtgaaaggccatcaccccaggaagccaaatgagggagcagcaacatgtatatgagcttcctatggaattgtccttatgtgaagctttgaaggtgtacagccactctcccgggtcttcaggttcctaccatttccatttctgttaaagtggatctgcatatcttcagcttactaggtgacccggatgctgacatctgctgctgcagaaaggaagacttttcattgtaatttcgcttagacccttttatcagtggagctccagttttcttacctagctgtcacttttttaaatgcctctgggggttatttttgctttccttggcccccaccaatttatacatctccattttctgacctctggactaactggttgctcagcaaggttctgaaggagagtttcttgcattggacaggcccagtcttctcccatcattgccctgctgtgactccaaagaaaggagcttcttgctgacagtgccctgtggagcaaggctgtgtttcctaccccacacggtgctcagtgggtgccagccctcagtgtggctttgtgattgctgccctaaaggagaatgctctttccttcctcactggtactgcctgctgttttctaagcattgctcctgcacagacatggagtcccagccccagcaaggctcttctgttcccatctgttgacaatgtcttgtggagcatttttgctgaggaaaaggtcacttgtaaacagaggagaaagggaaagagtacaaagccctaagtttattgtaagtgaaaactgagggaattcctgtcttctttaggagtaatgattcatagatctagataggtggaaatatcattcaaaatagtcacttgagctcacaaaaaaagcaaggaagaattctcatgtcctttgtcttccttctgtagccattaactgctgaatccatgtgaggaagacaggcttcccttccttccccctccttagtgattttttctttaacagcataagtaaagaggactttctggttcatttttgtttgttttgttttgttttgttttgtttacagatgaggtcttgctgtgttgcccaggctggagtgcggtggctattcacagatgctatcatagcacactacagcctccaactcttgggctcaagcatcacgcctagcagtttctggttcctttaacagcaaaaggaaagagaggttctgattcttacctcagggttttttggttgttcattgtttttgtttttgtttttgttttgacactgcagagcacaaggctaaaggttacagctgagatctttggaaccaaaggcagagcaagcagagcccgttgtctgggccccacaccactgcaggcaggtggatagaagtgcggcccctctcatagtatgcccataagtcagggcatagggcagaactacctgtcatgttgctacaccatcctgtcttctcagcatctccttgcctgttttctttattagtccaaaggaaaacaacagcaacaaaatctgtttttaaaatgtcttatatgaacatatatcaaatatccatgcgctgaaacccacataccatcacttggcaattttttagaataagaccccattattatctattgctataaacctagccagttctcttgctcttctgtattttcctatttccctgccatcatctgctatttctgccacttctcttagactccttgtctgcaaagcccaagctagaactcactgtctatggcagaaggacatccagagcccattctggagttttgttttttccttctgccagatgctttgtgtcctgtcttccttcctcctcatatttctgtttctcatttgtgttcagttttgtgcagcattgctagcactgcttttgtgaccagaaaaggccataacatggtccaggatcatcattcttctgactctagatgggacacttgacagtgacttgaaacatttgcatattcaggaatgcatgagatttcaagagagcctacagtatgaaatcattttcacaaaataagcagcttgcttctgaaatgctgtctttcccagtagctactcacctgcctctggtggctgggattcagatgccacaaaactgtcagtatctatagaccaggtctgtgccacctcctctctcctctgtgctcagtgaggaggcagtaaatgaagttacaggctagcacaatacctaattcatgtttcccagtacacctgtagatattactgtacttttatgttctcaagaaataagttgttgcctattcagtgttacagatttctttgtttctttttaattaaaatacaagaagcagctgaggaaagggagacaaggtattttatttctgactgattttagaaaaaacttgtgtacatgtgtttggaactgttgaaatgccaagttttctgtataagtgtttttgtaattaaactttcagattttctttgtttttt

SEQ ID NO: 104368 - DNA, 3580 bp, Homo sapiens
atttttgtgaaggtaccgtggaaaatatttcatttttcttctcaccggagcaattgtaaatgctatgcggtaagaggagttacctgtggaaaggtggttaagagattaggtaaagaaaaggaaaggacaccaaaataaagtgctgcggaagaatttttgtccagctgtgagacgacgagtgcgtgaagtgaaggcgattgagaggggctgagggaattgtcctctgtggaagggactttcttttggccctaggccccttcctgcccctgtcgtcagcagagagatggaaaacttgatgactagctccaccctaccgcccctttttgcagatgaagacggttccaaggagagtaatgatctggctaccactgggttaaatcacccagaggttccatacagtagtggcgccacatcatccaccaacaatccagaatttgtggaggatctctctcaaggtcagttgcttcagagtgagtcttcaaatgcagcagaaggcaatgaacagaggcatgaagatgagcaacgaagtaaacgaggaggttggtccaaaggaagaaagaggaagaaacctcttcgagacagcaatgcacccaaatccccccttacaggatatgttcggttcatgaatgagcgtcgagaacaacttcgagcaaagagaccagaagtcccatttccagaaatcacaaggatgttaggcaatgaatggagtaaactgcctcctgaggaaaaacagcgctaccttgatgaagcagacagagataaggagcgttacatgaaggaactggaacagtatcagaaaacagaggcctacaaggtcttcagtaggaaaacccaggaccgtcagaaaggcaaatctcataggcaagatgcagcccggcaggccactcatgatcatgagaaagaaacagaggtaaaggaacggtctgtttttgacatccctatatttacagaggaattcttgaaccatagcaaagctcgggaagcagagctccgccagcttcgcaaatccaacatggagtttgaggagaggaatgcagccctgcaaaagcacgtggagagcatgcgcacagcagtggagaagctggaggtggatgtgatccaggagcggagccgcaacacagtcttacagcagcacctggagaccctgcggcaggtgctgaccagcagctttgccagcatgcccttgcctggaagtggagagacacctacagtggacaccattgactcatatatgaacagactgcacagtattattttagctaatccccaagacaatgaaaacttcatagctacagttcgagaagttgtgaacagactcgatcgttagggaatggtcttagaactccaagatgttccataagtgtttttacttgtgaggaatgagaagccatccatggaaatttgaactgagtgggggcagagaaagagtgcagatccctttgcttgtgaaagaattatcagtgagtgaaaggccatcaccccaggaagccaaatgagggagcagcaacatgtatatgagcttcctatggaattgtccttatgtgaagctttgaaggtgtacagccactctcccgggtcttcaggttcctaccatttccatttctgttaaagtggatctgcatatcttcagcttactaggtgacccggatgctgacatctgctgctgcagaaaggaagacttttcattgtaatttcgcttagacccttttatcagtggagctccagttttcttacctagctgtcacttttttaaatgcctctgggggttatttttgctttccttggcccccaccaatttatacatctccattttctgacctctggactaactggttgctcagcaaggttctgaaggagagtttcttgcattggacaggcccagtcttctcccatcattgccctgctgtgactccaaagaaaggagcttcttgctgacagtgccctgtggagcaaggctgtgtttcctaccccacacggtgctcagtgggtgccagccctcagtgtggctttgtgattgctgccctaaaggagaatgctctttccttcctcactggtactgcctgctgttttctaagcattgctcctgcacagacatggagtcccagccccagcaaggctcttctgttcccatctgttgacaatgtcttgtggagcatttttgctgaggaaaaggtcacttgtaaacagaggagaaagggaaagagtacaaagccctaagtttattgtaagtgaaaactgagggaattcctgtcttctttaggagtaatgattcatagatctagataggtggaaatatcattcaaaatagtcacttgagctcacaaaaaaagcaaggaagaattctcatgtcctttgtcttccttctgtagccattaactgctgaatccatgtgaggaagacaggcttcccttccttccccctccttagtgattttttctttaacagcataagtaaagaggactttctggttcatttttgtttgttttgttttgttttgttttgtttacagatgaggtcttgctgtgttgcccaggctggagtgcggtggctattcacagatgctatcatagcacactacagcctccaactcttgggctcaagcatcacgcctagcagtttctggttcctttaacagcaaaaggaaagagaggttctgattcttacctcagggttttttggttgttcattgtttttgtttttgtttttgttttgacactgcagagcacaaggctaaaggttacagctgagatctttggaaccaaaggcagagcaagcagagcccgttgtctgggccccacaccactgcaggcaggtggatagaagtgcggcccctctcatagtatgcccataagtcagggcatagggcagaactacctgtcatgttgctacaccatcctgtcttctcagcatctccttgcctgttttctttattagtccaaaggaaaacaacagcaacaaaatctgtttttaaaatgtcttatatgaacatatatcaaatatccatgcgctgaaacccacataccatcacttggcaattttttagaataagaccccattattatctattgctataaacctagccagttctcttgctcttctgtattttcctatttccctgccatcatctgctatttctgccacttctcttagactccttgtctgcaaagcccaagctagaactcactgtctatggcagaaggacatccagagcccattctggagttttgttttttccttctgccagatgctttgtgtcctgtcttccttcctcctcatatttctgtttctcatttgtgttcagttttgtgcagcattgctagcactgcttttgtgaccagaaaaggccataacatggtccaggatcatcattcttctgactctagatgggacacttgacagtgacttgaaacatttgcatattcaggaatgcatgagatttcaagagagcctacagtatgaaatcattttcacaaaataagcagcttgcttctgaaatgctgtctttcccagtagctactcacctgcctctggtggctcgagcgccgccggtttaccctcaggaatcagctgatgaccatgg

SEQ ID NO: 104369 - DNA, 1615 bp, Homo sapiens
tctcattgtttatatttttattttcagaaaaacagagttcacttgaatacaattctcactagttaaatcacaattagagcatcggccggcgaccgttccggcggccattgcgaaaacttccccacggctactgcgtccacgtggcggtggcgtggggactccctgaaagcagagcggcagggcgcccggaagtcgtgagtcgagtcttcccgggctaatccatgccgggttggaggctgctgacgcaggtcggcgcccaggtgctgggtcgactcggggacggcctgggtgctgccctgggcccggggaacagaacacacatctggctttttgttagaggtcttcatggaaagagtggtacatggtgggatgagcatctttctgaagaaaatgtcccattcattaagcagttggtctctgatgaagataaagcccaattagcaagtaaactgtgtcctctgaaagatgaaccatggcctatacatccttgggaaccaggttcctttagagttggtcttattgccttgaagctgggcatgatgcctttatggaccaaggatggtcaaaagcatgtggtcacattacttcaggtacaagactgtcatgtcttaaaatatacgtcaaaggaaaactgtaatggaaaaatggcaaccctgtctgtaggaggaaaaactgtatcacgttttcgtaaagctacatccatattggaattttaccgggaacttggattgccgccgaaacagacagttaaaatctttaatataacagataatgctgcaattaaaccaggcactcctctttatgctgctcactttcgtccaggacagtatgtggatgtcacagccaaaactattggtaaaggttttcaaggtgtcatgaaaagatggggatttaaaggccagcctgctacgcatggtcaaacgaaaacccacaggagacctggagctgttgcaactggtgatattggcagagtctggcctggaactaaaatgcctggaaaaatgggaaacatatacaggacagaatatggactgaaagtgtggagaataaacacaaagcacaacataatctatgtaaatggctctgtacctggacataaaaattgcttagtaaaggtcaaagattctaaactgcctgcatataaggatctcggtaaaaatctaccattccctacatattttcctgatggagatgaagaggaactgccagaagatttgtatgatgaaaacgtgtgtcagcccggtgcgccttctattacatttgcctaacatctttggacgtggcagaaccttacatattctgtgagcttcgatgagccagagtgatatcataaccaccagaaatcatactctcctttcttagtcacaacaaaatcacacatgtcatctttgtcaagggcataaatatatcattcatacccccattaaattttgttagaaaaattaccacattaaatatatgagttaagtagattggatttgctgaaattggtgttgggcatattagcaaaatattcttaatttgtggactcgattcttttttactacatatttcccaagttatcttaagatgtctgtaaatttaacttttattaaagttttgtcaatctttgtga

SEQ ID NO: 104370 - DNA, 916 bp, Homo sapiens
  misc_feature (843)..(843): n is a, c, g, or t
  misc_feature (850)..(850): n is a, c, g, or t
  misc_feature (879)..(879): n is a, c, g, or t
gtaaaacgcaccggaagtgggtccggcggctttctttccgtcgcagagaagagcatcggccggcgaccgttccggcggccattgcgaaaacttccccacggctactgcgtccacgtggcggtggcgtggggactccctgaaagcagagcggcagggcgcccggaagtcgtgagtcgagtcttcccgggctaatccatgccgggttggaggctgctgacgcaggtcggcgcccaggtgctgggtcgactcggggacggcctgggtgctgccctgggcccggggaacagaacacacatctggctttttgttagaggtcttcatggaaagagtggtacatggtgggatgagcatctttctgaagaaaatgtcccattcattaagcagttggtctctgatgaagataaagcccaattagcaagtaaactgtgtcctctgaaagatgaaccatggcctatacatccttgggaaccaggttcctttagagttggtcttattgccttgaagctgggcatgatgcctttatggaccaaggatggtcaaaagcatgtggtcacattacttcaggtacaagactgtcatgtcttaaaatatacgtcaaaggaaaactgtaatggaaaaatggcaaccctgtctgtaggaggaaaaactgtatcacgttttcgtaaagctacatccatattggaattttaccgggaacttggattgccgccgaaacagacagttaaaatctttaatataacagataatgctgcaattaaaccagcactccctctttattgctgctcactttccgtccaaggacaattataatgggatgtcacaagcccaaaaacctatttgggnaaaaggnttttcaaaggggggtccattgaaaaaagnattgggggaattttaaaaggggccaaacccttgctta

SEQ ID NO: 104371 - DNA, 815 bp, Homo sapiens
ctaggtcgaggctggtgttaatcggacgagggtcacgtggcggtggcgtggggactccctgaaagcagagcggcagggcgcccggaagtcgtgagtcgagtcttcccgggctaatccatgccgggttggaggctgctgacgcaggtcggcgcccaggtgctgggtcgactcggggacggcctgggtgctgccctgggcccggggaacagaacacacatctggctttttgttagaggtcttcatggaaagagtggtacatggtgggatgagcatctttctgaagaaaatgtcccattcattaagcagttggtctctgatgaagataaagcccaattagcaagtaaactgtgtcctctgaaagatgaaccatggcctatacatccttgggaaccaggttcctttagagttggtcttattgccttgaagctgggcatgatgcctttatggaccaaggatggtcaaaagcatgtggtcacattacttcaggtacaagactgtcatgtcttaaaatatacgtcaaaggaaaactgtaatggaaaaatggcaaccctgtctgtaggaggaaaaactgtatcacgttttcgtaaagctacatccatattggaattttaccgggaacttggattgccgccgaaacagacagttaaaatctttaatataacagataatgctgcaattaaaccaggtttttctctgcctatataaatccaggttgggttataacttaaaggaagttccccccctgcaatcttacagcactttgctgcttgtattaaataaactataactataaataaactttcagttacattctc

SEQ ID NO: 104372 - DNA, 336 bp, Homo sapiens
  misc_feature (9)..(9): n is a, c, g, or t
attcctctncactgtttgcctaccggtcagagagcatcggccggcgaccgttccggcggccattgcgaaaacttccccacggctactgcgtccacgtggcggtggcgtggggactccctgaaagcagagcggcagggcgcccggaagtcgtgagtcgagtcttcccgggctaatccatgccgggttggaggctgctgacgcaggtcggcgcccaggtgctgggtcgactcggggacggcctgggtgctgccctgggcccggggaacagggtaacgactaacagtttaaatgtgagccttatccgaaggaatgtggggagtgaggaaaaggttggag

SEQ ID NO: 104373 - DNA, 1744 bp, Homo sapiens
gacccccactaggctaggacaggctgggtgaatcggacgaagagcatcggccggcgaccgttccggcggccattgcgaaaacttccccacggctactgcgtccacgtggcggtggcgtggggactccctgaaagcagagcggcagggcgcccggaagtcgtgagtcgagtcttcccgggctaatccatgccgggttggaggctgctgacgcaggtcggcgcccaggtgctgggtcgactcggggacggcctgggtgctgccctgggcccggggaacagaacacacatctggctttttgttagaggtcttcatggaaagagtggtacatggtgggatgagcatctttctgaagaaaatgtcccattcattaagcagttggtctctgatgaagataaagcccaattagcaagtaaactgtgtcctctgaaagatgaaccatggcctatacatccttgggaaccaggttcctttagagttggtcttattgccttgaagctgggcatgatgcctttatggaccaaggatggtcaaaagcatgtggtcacattacttcaggtacaagactgtcatgtcttaaaatatacgtcaaaggaaaactgtaatggaaaaatggcaaccctgtctgtaggaggaaaaactgtatcacgttttcgtaaagctacatccatattggaattttaccgggaacttggattgccgccgaaacagacagttaaaatctttaatataacagataatgctgcaattaaaccaggcactcctctttatgctgctcactttcgtccaggacagtatgtggatgtcacagccaaaactattggtaaaggttttcaaggtgtcatgaaaagatggggatttaaaggccagcctgctacgcatggtcaaacgaaaacccacaggagacctggagctgttgcaactggtgatattggcagagtctggcctggaactaaaatgcctggaaaaatgggaaacatatacaggacagaatatggactgaaagtgtggagaataaacacaaagcacaacataatctatgtaaatggctctgtacctggacataaaaattgcttagtaaaggtcaaagattctaaactgcctgcatataaggatctcggtaaaaatctaccattccctacatattttcctgatggagatgaagaggaactgccagaagatttgtatgatgaaaacgtgtgtcagcccggtgcgccttctattacatttgcctaacatctttggacgtggcagaaccttacatattctgtgagcttcgatgagccagagtgatatcataaccaccagaaatcatactctcctttcttagtcacaacaaaatcacacatgtcatctttgtcaagggcataaatatatcattcatacccccattaaattttgttagaaaaattaccacattaaatatatgagttaagtagattggatttgctgaaattggtgttgggcatattagcaaaatattcttaatttgtggactcgattcttttttactacatatttcccaagttatcttaagatgtctgtaaatttaacttttattaaagttttgtcaatctttgtgaaatagtggttgtggaacagtagaaaaccatatggggactatagtgcaacctatttgggtaaagaaaccatttgctaaaatggagaaagtaaatagatttttatttaaattacagaaacatgttaaaggccggacaaaggaaagacaataaaatcataaattatc

SEQ ID NO: 104374 - DNA, 1585 bp, Homo sapiens
  misc_feature (14)..(14): n is a, c, g, or t
  misc_feature (17)..(17): n is a, c, g, or t
  misc_feature (19)..(19): n is a, c, g, or t
  misc_feature (21)..(21): n is a, c, g, or t
  misc_feature (38)..(38): n is a, c, g, or t
aagtgtcttgagtntancncngccccctcccgggttancgggatgagagcatcggccggcgaccgttccggcggccattgcgaaaacttccccacggctactgcgtccacgtggcggtggcgtggggactccctgaaagcagagcggcagggcgcccggaagtcgtgagtcgagtcttcccgggctaatccatgccgggttggaggctgctgacgcaggtcggcgcccaggtgctgggtcgactcggggacggcctgggtgctgccctgggcccggggaacagaacacacatctggctttttgttagaggtcttcatggaaagagtggtacatggtgggatgagcatctttctgaagaaaatgtcccattcattaagcagttggtctctgatgaagataaagcccaattagcaagtaaactgtgtcctctgaaagatgaaccatggcctatacatccttgggaaccaggttcctttagagttggtcttattgccttgaagctgggcatgatgcctttatggaccaaggatggtcaaaagcatgtggtcacattacttcaggtacaagactgtcatgtcttaaaatatacgtcaaaggaaaactgtaatggaaaaatggcaaccctgtctgtaggaggaaaaactgtatcacgttttcgtaaagctacatccatattggaattttaccgggaacttggattgccgccgaaacagacagttaaaatctttaatataacagataatgctgcaattaaaccaggcactcctctttatgctgctcactttcgtccaggacagtatgtggatgtcacagccaaaactattggtaaaggttttcaaggtgtcatgaaaagatggggatttaaaggccagcctgctacgcatggtcaaacgaaaacccacaggagacctggagctgttgcaactggtgatattggcagagtctggcctggaactaaaatgcctggaaaaatgggaaacatatacaggacagaatatggactgaaagtgtggagaataaacacaaagcacaacataatctatgtaaatggctctgtacctggacataaaaattgcttagtaaaggtcaaagattctaaactgcctgcatataaggatctcggtaaaaatctaccattccctacatattttcctgatggagatgaagaggaactgccagaagatttgtatgatgaaaacgtgtgtcagcccggtgcgccttctattacatttgcctaacatctttggacgtggcagaaccttacatattctgtgagcttcgatgagccagagtgatatcataaccaccagaaatcatactctcctttcttagtcacaacaaaatcacacatgtcatctttgtcaagggcataaatatatcattcatacccccattaaattttgttagaaaaattaccacattaaatatatgagttaagtagattggatttgctgaaattggtgttgggcatattagcaaaatattcttaatttgtggactcgattcttttttactacatatttcccaagttatcttaagatgtctgtaaatttaacttttattaaagttttgtcaatctttgtga

SEQ ID NO: 104375 - DNA, 1771 bp, Homo sapiens
  misc_feature (14)..(14): n is a, c, g, or t
  misc_feature (17)..(17): n is a, c, g, or t
  misc_feature (19)..(19): n is a, c, g, or t
  misc_feature (21)..(21): n is a, c, g, or t
  misc_feature (38)..(38): n is a, c, g, or t
aagtgtcttgagtntancncngccccctcccgggttancgggatgagagcatcggccggcgaccgttccggcggccattgcgaaaacttccccacggctactgcgtccacgtggcggtggcgtggggactccctgaaagcagagcggcagggcgcccggaagtcgtgagtcgagtcttcccgggctaatccatgccgggttggaggctgctgacgcaggtcggcgcccaggtgctgggtcgactcggggacggcctgggtgctgccctgggcccggggaacagaacacacatctggctttttgttagaggtcttcatggaaagagtggtacatggtgggatgagcatctttctgaagaaaatgtcccattcattaagcagttggtctctgatgaagataaagcccaattagcaagtaaactgtgtcctctgaaagatgaaccatggcctatacatccttgggaaccaggttcctttagagttggtcttattgccttgaagctgggcatgatgcctttatggaccaaggatggtcaaaagcatgtggtcacattacttcaggtacaagactgtcatgtcttaaaatatacgtcaaaggaaaactgtaatggaaaaatggcaaccctgtctgtaggaggaaaaactgtatcacgttttcgtaaagctacatccatattggaattttaccgggaacttggattgccgccgaaacagacagttaaaatctttaatataacagataatgctgcaattaaaccaggcactcctctttatgctgctcactttcgtccaggacagtatgtggatgtcacagccaaaactattggtaaaggttttcaaggtgtcatgaaaagatggggatttaaaggccagcctgctacgcatggtcaaacgaaaacccacaggagacctggagctgttgcaactggtgatattggcagagtctggcctggaactaaaatgcctggaaaaatgggaaacatatacaggacagaatatggactgaaagtgtggagaataaacacaaagcacaacataatctatgtaaatggctctgtacctggacataaaaattgcttagtaaaggtcaaagattctaaactgcctgcatataaggatctcggtaaaaatctaccattccctacatattttcctgatggagatgaagaggaactgccagaagatttgtatgatgaaaacgtgtgtcagcccggtgcgccttctattacatttgcctaacatctttggacgtggcagaaccttacatattctgtgagcttcgatgagccagagtgatatcataaccaccagaaatcatactctcctttcttagtcacaacaaaatcacacatgtcatctttgtcaagggcataaatatatcattcatacccccattaaattttgttagaaaaattaccacattaaatatatgagttaagtagattggatttgctgaaattggtgttgggcatattagcaaaatattcttaatttgtggactcgattcttttttactacatatttcccaagttatcttaagatgtctgtaaatttaacttttattaaagttttgtcaatctttgtgaaatagtggttgtggaacagtagaaaaccatatggggactatagtgcaacctatttgggtaaagaaaccatttgctaaaatggagaaagtaaatagatttttatttaaattacagaaacatgttaaaggccggacaaaggaaagacaataaaatcataaattatcaagtgagaaaatgaacacaatg

SEQ ID NO: 104376 - DNA, 1364 bp, Homo sapiens
  misc_feature (14)..(14): n is a, c, g, or t
  misc_feature (17)..(17): n is a, c, g, or t
  misc_feature (19)..(19): n is a, c, g, or t
  misc_feature (21)..(21): n is a, c, g, or t
  misc_feature (38)..(38): n is a, c, g, or t
  misc_feature (1330)..(1330): n is a, c, g, or t
aagtgtcttgagtntancncngccccctcccgggttancgggatgagagcatcggccggcgaccgttccggcggccattgcgaaaacttccccacggctactgcgtccacgtggcggtggcgtggggactccctgaaagcagagcggcagggcgcccggaagtcgtgagtcgagtcttcccgggctaatccatgccgggttggaggctgctgacgcaggtcggcgcccaggtgctgggtcgactcggggacggcctgggtgctgccctgggcccggggaacagaacacacatctggctttttgttagaggtcttcatggaaagagtggtacatggtgggatgagcatctttctgaagaaaatgtcccattcattaagcagttggtctctgatgaagataaagcccaattagcaagtaaactgtgtcctctgaaagatgaaccatggcctatacatccttgggaaccaggttcctttagagttggtcttattgccttgaagctgggcatgatgcctttatggaccaaggatggtcaaaagcatgtggtcacattacttcaggtacaagactgtcatgtcttaaaatatacgtcaaaggaaaactgtaatggaaaaatggcaaccctgtctgtaggaggaaaaactgtatcacgttttcgtaaagctacatccatattggaattttaccgggaacttggattgccgccgaaacagacagttaaaatctttaatataacagataatgctgcaattaaaccaggcactcctctttatgctgctcactttcgtccaggacagtatgtggatgtcacagccaaaactattggtaaaggttttcaaggtgtcatgaaaagatggggatttaaaggccagcctgctacgcatggtcaaacgaaaacccacaggagacctggagctgttgcaactggtgatattggcagagtctggcctggaactaaaatgcctggaaaaatgggaaacatatacaggacagaatatggactgaaagtgtggagaataaacacaaagcacaacataatctatgtaaatggctctgtacctggacataaaaattgcttagtaaaggtcaaagattctaaactgcctgcatataaggatctcggtaaaaatctaccattccctacatattttcctgatggagatgaagaggaactgccagaagatttgtatgatgaaaacgtgtgtcagcccggtgcgccttctattacatttgcctaacatctttggacgtggcagaaccttacatattctgtgagcttcgatgagccagagtgatatcataaccaccagaaatcatactctcctttcanaaatcccttctccggccggtaaattttttaccaa

SEQ ID NO: 104377 - DNA, 1630 bp, Homo sapiens
  misc_feature (14)..(14): n is a, c, g, or t
  misc_feature (17)..(17): n is a, c, g, or t
  misc_feature (19)..(19): n is a, c, g, or t
  misc_feature (21)..(21): n is a, c, g, or t
  misc_feature (38)..(38): n is a, c, g, or t
aagtgtcttgagtntancncngccccctcccgggttancgggatgagagcatcggccggcgaccgttccggcggccattgcgaaaacttccccacggctactgcgtccacgtggcggtggcgtggggactccctgaaagcagagcggcagggcgcccggaagtcaacacacatctggctttttgttagaggtcttcatggaaagagtggtacatggtgggatgagcatctttctgaagaaaatgtcccattcattaagcagttggtctctgatgaagataaagcccaattagcaagtaaactgtgtcctctgaaagatgaaccatggcctatacatccttgggaaccaggttcctttagagttggtcttattgccttgaagctgggcatgatgcctttatggaccaaggatggtcaaaagcatgtggtcacattacttcaggtacaagactgtcatgtcttaaaatatacgtcaaaggaaaactgtaatggaaaaatggcaaccctgtctgtaggaggaaaaactgtatcacgttttcgtaaagctacatccatattggaattttaccgggaacttggattgccgccgaaacagacagttaaaatctttaatataacagataatgctgcaattaaaccaggcactcctctttatgctgctcactttcgtccaggacagtatgtggatgtcacagccaaaactattggtaaaggttttcaaggtgtcatgaaaagatggggatttaaaggccagcctgctacgcatggtcaaacgaaaacccacaggagacctggagctgttgcaactggtgatattggcagagtctggcctggaactaaaatgcctggaaaaatgggaaacatatacaggacagaatatggactgaaagtgtggagaataaacacaaagcacaacataatctatgtaaatggctctgtacctggacataaaaattgcttagtaaaggtcaaagattctaaactgcctgcatataaggatctcggtaaaaatctaccattccctacatattttcctgatggagatgaagaggaactgccagaagatttgtatgatgaaaacgtgtgtcagcccggtgcgccttctattacatttgcctaacatctttggacgtggcagaaccttacatattctgtgagcttcgatgagccagagtgatatcataaccaccagaaatcatactctcctttcttagtcacaacaaaatcacacatgtcatctttgtcaagggcataaatatatcattcatacccccattaaattttgttagaaaaattaccacattaaatatatgagttaagtagattggatttgctgaaattggtgttgggcatattagcaaaatattcttaatttgtggactcgattcttttttactacatatttcccaagttatcttaagatgtctgtaaatttaacttttattaaagttttgtcaatctttgtgaaatagtggttgtggaacagtagaaaaccatatggggactatagtgcaacctatttgggtaaagaaaccatttgctaaaatggagaaagtaaatagatttttatttaaattacagaaacatgttaaaggccggacaaaggaaagacaataaaatcataaattatc

SEQ ID NO: 104378 - DNA, 1160 bp, Homo sapiens
  misc_feature (14)..(14): n is a, c, g, or t
  misc_feature (17)..(17): n is a, c, g, or t
  misc_feature (19)..(19): n is a, c, g, or t
  misc_feature (21)..(21): n is a, c, g, or t
  misc_feature (38)..(38): n is a, c, g, or t
aagtgtcttgagtntancncngccccctcccgggttancgggatgagagcatcggccggcgaccgttccggcggccattgcgaaaacttccccacggctactgcgtccacgtggcggtggcgtggggactccctgaaagcagagcggcagggcgcccggaagtcgtgagtcgagtcttcccgggctaatccatgccgggttggaggctgctgacgcaggtcggcgcccaggtgctgggtcgactcggggacggcctgggtgctgccctgggcccggggaacagaacacacatctggctttttgttagaggtcttcatggaaagagtggtacatggtgggatgagcatctttctgaagaaaatgtcccattcattaagcagttggtctctgatgaagataaagcccaattagcaagtaaactgtgtcctctgaaagatgaaccatggcctatacatccttgggaaccaggttcctttagagttggtcttattgccttgaagctgggcatgatgcctttatggaccaaggatggtcaaaagcatgtggtcacattacttcaggtacaagactgtcatgtcttaaaatatacgtcaaaggaaaactgtaatggaaaaatggcaaccctgtctgtaggaggaaaaactgtatcacgttttcgtaaagctacatccatattggaattttaccgggaacttggattgccgccgaaacagacagttaaaatctttaatataacagataatgctgcaattaaaccaggcactcctctttatgctgctcactttcgtccaggacagtatgtggatgtcacagccaaaactattggtaaaggttttcaaggtgtcatgaaaagatggggatttaaaggccagcctgctacgcatggtcaaacgaaaacccacaggagacctggagctgttgcaactggtgatattggcagagtctggcctggaactaaaatgcctggaaaaatgggaaacatatacaggacagaatatggactgaaatgtgggattacacccaaggccactatctatgtaatggtcgtgctggctaaatggtcggcaggtcaggatttacggcgctttagtccggaaaattacattccaattttcggtgggtcaaggcgcgcacatttttaggcggttccggggcttaag

SEQ ID NO: 104379 - DNA, 1012 bp, Homo sapiens
  misc_feature (14)..(14): n is a, c, g, or t
  misc_feature (17)..(17): n is a, c, g, or t
  misc_feature (19)..(19): n is a, c, g, or t
  misc_feature (21)..(21): n is a, c, g, or t
  misc_feature (38)..(38): n is a, c, g, or t
aagtgtcttgagtntancncngccccctcccgggttancgggatgagagcatcggccggcgaccgttccggcggccattgcgaaaacttccccacggctactgcgtccacgtggcggtggcgtggggactccctgaaagcagagcggcagggcgcccggaagtcgtgagtcgagtcttcccgggctaatccatgccgggttggaggctgctgacgcaggtcggcgcccaggtgctgggtcgactcggggacggcctgggtgctgccctgggcccggggaacagaacacacatctggctttttgttagaggtcttcatggaaagagtggtacatggtgggatgagcatctttctgaagaaaatgtcccattcattaagcagttggtctctgatgaagataaagcccaattagcaagtaaactgtgtcctctgaaagatgaaccatggcctatacatccttgggaaccaggttcctttagagttggtcttattgccttgaagctgggcatgatgcctttatggaccaaggatggtcaaaagcatgtggtcacattacttcaggtacaagactgtcatgtcttaaaatatacgtcaaaggaaaactgtaatggaaaaatggcaaccctgtctgtaggaggaaaaactgtatcacgttttcgtaaagctacatccatattggaattttaccgggaacttggattgccgccgaaacagacagttaaaatctttaatataacagataatgctgcaattaaaccaggcactcctctttatgctgctcactttcgtccaggacagtatgtggatgtcacagccaaaactattggtaaaggttttcaaggtgtcatgaaaagatggggatttaaaggccagcctgctacgcatggtcaaacgaaaacccacaggagacctggagctgttgcaactggtgattttggcggagtctggcctggacctaattgcctggaaattgggaacttttccgggcgttttggctgaagtgtggagattac

SEQ ID NO: 104380 - DNA, 984 bp, Homo sapiens
tgggaatggtctatgctcttttcattatgtaaattctaacgtttgttttgttcagtattggtaaaggttttcaaggtgtcatgaaaagatggggatttaaaggccagcctgctacgcatggtcaaacgaaaacccacaggagacctggagctgttgcaactggtgatattggcagagtctggcctggaactaaaatgcctggaaaaatgggaaacatatacaggacagaatatggactgaaagtgtggagaataaacacaaagcacaacataatctatgtaaatggctctgtacctggacataaaaattgcttagtaaaggtcaaagattctaaactgcctgcatataaggatctcggtaaaaatctaccattccctacatattttcctgatggagatgaagaggaactgccagaagatttgtatgatgaaaacgtgtgtcagcccggtgcgccttctattacatttgcctaacatctttggacgtggcagaaccttacatattctgtgagcttcgatgagccagagtgatatcataaccaccagaaatcatactctcctttcttagtcacaacaaaatcacacatgtcatctttgtcaagggcataaatatatcattcatacccccattaaattttgttagaaaaattaccacattaaatatatgagttaagtagattggatttgctgaaattggtgttgggcatattagcaaaatattcttaatttgtggactcgattcttttttactacatatttcccaagttatcttaagatgtctgtaaatttaacttttattaaagttttgtcaatctttgtgaaatagtggttgtggaacagtagaaaaccatatggggactatagtgcaacctatttgggtaaagaaaccatttgctaaaatggagaaagtaaatagatttttatttaaattacagaaacatgttaaaggccggacaaaggaaagacaataaaatcataaattatc

SEQ ID NO: 104381 - DNA, 982 bp, Homo sapiens
ggggagagagtggtgcatgtgtaaacataatcttccacacccacacacaaccttgtggtgacaaggttttcattagtggtggaaacatggggatttaaaggccagcctgctacgcatggtcaaacgaaaacccacaggagacctggagctgttgcaactggtgatattggcagagtctggcctggaactaaaatgcctggaaaaatgggaaacatatacaggacagaatatggactgaaagtgtggagaataaacacaaagcacaacataatctatgtaaatggctctgtacctggacataaaaattgcttagtaaaggtcaaagattctaaactgcctgcatataaggatctcggtaaaaatctaccattccctacatattttcctgatggagatgaagaggaactgccagaagatttgtatgatgaaaacgtgtgtcagcccggtgcgccttctattacatttgcctaacatctttggacgtggcagaaccttacatattctgtgagcttcgatgagccagagtgatatcataaccaccagaaatcatactctcctttcttagtcacaacaaaatcacacatgtcatctttgtcaagggcataaatatatcattcatacccccattaaattttgttagaaaaattaccacattaaatatatgagttaagtagattggatttgctgaaattggtgttgggcatattagcaaaatattcttaatttgtggactcgattcttttttactacatatttcccaagttatcttaagatgtctgtaaatttaacttttattaaagttttgtcaatctttgtgaaatagtggttgtggaacagtagaaaaccatatggggactatagtgcaacctatttgggtaaagaaaccatttgctaaaatggagaaagtaaatagatttttatttaaattacagaaacatgttaaaggccggacaaaggaaagacaataaaatcataaattatc

SEQ ID NO: 104382 - DNA, 912 bp, Homo sapiens
  misc_feature (14)..(14): n is a, c, g, or t
  misc_feature (17)..(17): n is a, c, g, or t
  misc_feature (19)..(19): n is a, c, g, or t
  misc_feature (21)..(21): n is a, c, g, or t
  misc_feature (38)..(38): n is a, c, g, or t
  misc_feature (839)..(839): n is a, c, g, or t
  misc_feature (846)..(846): n is a, c, g, or t
  misc_feature (875)..(875): n is a, c, g, or t
aagtgtcttgagtntancncngccccctcccgggttancgggatgagagcatcggccggcgaccgttccggcggccattgcgaaaacttccccacggctactgcgtccacgtggcggtggcgtggggactccctgaaagcagagcggcagggcgcccggaagtcgtgagtcgagtcttcccgggctaatccatgccgggttggaggctgctgacgcaggtcggcgcccaggtgctgggtcgactcggggacggcctgggtgctgccctgggcccggggaacagaacacacatctggctttttgttagaggtcttcatggaaagagtggtacatggtgggatgagcatctttctgaagaaaatgtcccattcattaagcagttggtctctgatgaagataaagcccaattagcaagtaaactgtgtcctctgaaagatgaaccatggcctatacatccttgggaaccaggttcctttagagttggtcttattgccttgaagctgggcatgatgcctttatggaccaaggatggtcaaaagcatgtggtcacattacttcaggtacaagactgtcatgtcttaaaatatacgtcaaaggaaaactgtaatggaaaaatggcaaccctgtctgtaggaggaaaaactgtatcacgttttcgtaaagctacatccatattggaattttaccgggaacttggattgccgccgaaacagacagttaaaatctttaatataacagataatgctgcaattaaaccagcactccctctttattgctgctcactttccgtccaaggacaattataatgggatgtcacaagcccaaaaacctatttgggnaaaaggnttttcaaaggggggtccattgaaaaaagnattgggggaattttaaaaggggccaaacccttgctta

SEQ ID NO: 104383 - DNA, 776 bp, Homo sapiens
ctcgcttcccctcccacaccaacacaagggcctgtggggacagacataaaccttgcacaacataatctatgtaaatggctctgtacctggacataaaaattgcttagtaaaggtcaaagattctaaactgcctgcatataaggatctcggtaaaaatctaccattccctacatattttcctgatggagatgaagaggaactgccagaagatttgtatgatgaaaacgtgtgtcagcccggtgcgccttctattacatttgcctaacatctttggacgtggcagaaccttacatattctgtgagcttcgatgagccagagtgatatcataaccaccagaaatcatactctcctttcttagtcacaacaaaatcacacatgtcatctttgtcaagggcataaatatatcattcatacccccattaaattttgttagaaaaattaccacattaaatatatgagttaagtagattggatttgctgaaattggtgttgggcatattagcaaaatattcttaatttgtggactcgattcttttttactacatatttcccaagttatcttaagatgtctgtaaatttaacttttattaaagttttgtcaatctttgtgaaatagtggttgtggaacagtagaaaaccatatggggactatagtgcaacctatttgggtaaagaaaccatttgctaaaatggagaaagtaaatagatttttatttaaattacagaaacatgttaaaggccggacaaaggaaagacaataaaatcataaattatc

SEQ ID NO: 104384 - DNA, 723 bp, Homo sapiens
agagagagagagagagagagagagagagagagagtggacataaaaatggcttagtaaaggtcaaagattctaaactgcctgcatataaggatctcggtaaaaatctaccattccctacatattttcctgatggagatgaagaggaactgccagaagatttgtatgatgaaaacgtgtgtcagcccggtgcgccttctattacatttgcctaacatctttggacgtggcagaaccttacatattctgtgagcttcgatgagccagagtgatatcataaccaccagaaatcatactctcctttcttagtcacaacaaaatcacacatgtcatctttgtcaagggcataaatatatcattcatacccccattaaattttgttagaaaaattaccacattaaatatatgagttaagtagattggatttgctgaaattggtgttgggcatattagcaaaatattcttaatttgtggactcgattcttttttactacatatttcccaagttatcttaagatgtctgtaaatttaacttttattaaagttttgtcaatctttgtgaaatagtggttgtggaacagtagaaaaccatatggggactatagtgcaacctatttgggtaaagaaaccatttgctaaaatggagaaagtaaatagatttttatttaaattacagaaacatgttaaaggccggacaaaggaaagacaataaaatcataaattatc

SEQ ID NO: 104385 - DNA, 384 bp, Homo sapiens
  misc_feature (14)..(14): n is a, c, g, or t
  misc_feature (17)..(17): n is a, c, g, or t
  misc_feature (19)..(19): n is a, c, g, or t
  misc_feature (21)..(21): n is a, c, g, or t
  misc_feature (38)..(38): n is a, c, g, or t
aagtgtcttgagtntancncngccccctcccgggttancgggatgagagcatcggccggcgaccgttccggcggccattgcgaaaacttccccacggctactgcgtccacgtggcggtggcgtggggactccctgaaagcagagcggcagggcgcccggaagtcgtgagtcgagtcttcccgggctaatccatgccgggttggaggctgctgacgcaggtcggcgcccaggtgctgggtcgactcggggacggcctgggtgctgccctgggcccggggaacagaacacacatctggctttttgttagaggtcttcatggaaagagtggtacatggtgggatgagcatctttctgaagacctctaaaaaaaaaccggcgcggccg

SEQ ID NO: 104386 - DNA, 745 bp, Homo sapiens
agagagagagagagagagagagagagagagagagtggacataaaaatggcttagtaaaggtcaaagattctaaactgcctgcatataaggatctcggtaaaaatctaccattccctacatattttcctgatggagatgaagaggaactgccagaagatttgtatgatgaaaacgtgtgtcagcccggtgcgccttctattacatttgcctaacatctttggacgtggcagaaccttacatattctgtgagcttcgatgagccagagtgatatcataaccaccagaaatcatactctcctttcttagtcacaacaaaatcacacatgtcatctttgtcaagggcataaatatatcattcatacccccattaaattttgttagaaaaattaccacattaaatatatgagttaagtagattggatttgctgaaattggtgttgggcatattagcaaaatattcttaatttgtggactcgattcttttttactacatatttcccaagttatcttaagatgtctgtaaatttaacttttattaaagttttgtcaatctttgtgaaatagtggttgtggaacagtagaaaaccatatggggactatagtgcaacctatttgggtaaagaaaccatttgctaaaatggagaaagtaaatagatttttatttaaattacagaaacatgttaaaggccggacaaaggaaagacaataaaatcataaattatcaagtgagaaaatgaacacaatg

SEQ ID NO: 104387 - DNA, 1749 bp, Homo sapiens
  misc_feature (14)..(14): n is a, c, g, or t
  misc_feature (17)..(17): n is a, c, g, or t
  misc_feature (19)..(19): n is a, c, g, or t
  misc_feature (21)..(21): n is a, c, g, or t
  misc_feature (38)..(38): n is a, c, g, or t
aagtgtcttgagtntancncngccccctcccgggttancgggatgagagcatcggccggcgaccgttccggcggccattgcgaaaacttccccacggctactgcgtccacgtggcggtggcgtggggactccctgaaagcagagcggcagggcgcccggaagtcgtgagtcgagtcttcccgggctaatccatgccgggttggaggctgctgacgcaggtcggcgcccaggtgctgggtcgactcggggacggcctgggtgctgccctgggcccggggaacagaacacacatctggctttttgttagaggtcttcatggaaagagtggtacatggtgggatgagcatctttctgaagaaaatgtcccattcattaagcagttggtctctgatgaagataaagcccaattagcaagtaaactgtgtcctctgaaagatgaaccatggcctatacatccttgggaaccaggttcctttagagttggtcttattgccttgaagctgggcatgatgcctttatggaccaaggatggtcaaaagcatgtggtcacattacttcaggtacaagactgtcatgtcttaaaatatacgtcaaaggaaaactgtaatggaaaaatggcaaccctgtctgtaggaggaaaaactgtatcacgttttcgtaaagctacatccatattggaattttaccgggaacttggattgccgccgaaacagacagttaaaatctttaatataacagataatgctgcaattaaaccaggcactcctctttatgctgctcactttcgtccaggacagtatgtggatgtcacagccaaaactattggtaaaggttttcaaggtgtcatgaaaagatggggatttaaaggccagcctgctacgcatggtcaaacgaaaacccacaggagacctggagctgttgcaactggtgatattggcagagtctggcctggaactaaaatgcctggaaaaatgggaaacatatacaggacagaatatggactgaaagtgtggagaataaacacaaagcacaacataatctatgtaaatggctctgtacctggacataaaaattgcttagtaaaggtcaaagattctaaactgcctgcatataaggatctcggtaaaaatctaccattccctacatattttcctgatggagatgaagaggaactgccagaagatttgtatgatgaaaacgtgtgtcagcccggtgcgccttctattacatttgcctaacatctttggacgtggcagaaccttacatattctgtgagcttcgatgagccagagtgatatcataaccaccagaaatcatactctcctttcttagtcacaacaaaatcacacatgtcatctttgtcaagggcataaatatatcattcatacccccattaaattttgttagaaaaattaccacattaaatatatgagttaagtagattggatttgctgaaattggtgttgggcatattagcaaaatattcttaatttgtggactcgattcttttttactacatatttcccaagttatcttaagatgtctgtaaatttaacttttattaaagttttgtcaatctttgtgaaatagtggttgtggaacagtagaaaaccatatggggactatagtgcaacctatttgggtaaagaaaccatttgctaaaatggagaaagtaaatagatttttatttaaattacagaaacatgttaaaggccggacaaaggaaagacaataaaatcataaattatc

SEQ ID NO: 104388 - DNA, 2122 bp, Homo sapiens
  misc_feature (14)..(14): n is a, c, g, or t
  misc_feature (17)..(17): n is a, c, g, or t
  misc_feature (19)..(19): n is a, c, g, or t
  misc_feature (21)..(21): n is a, c, g, or t
  misc_feature (38)..(38): n is a, c, g, or t
aagtgtcttgagtntancncngccccctcccgggttancgggatgagagcatcggccggcgaccgttccggcggccattgcgaaaacttccccacggctactgcgtccacgtggcggtggcgtggggactccctgaaagcagagcggcagggcgcccggaagtcgtgagtcgagtcttcccgggctaatccatgccgggttggaggctgctgacgcaggtcggcgcccaggtgctgggtcgactcggggacggcctgggtgctgccctgggcccggggaacagaacacacatctggctttttgttagaggtcttcatggaaagagtggtacatggtgggatgagcatctttctgaagaaaatgtcccattcattaagcagttggtctctgatgaagataaagcccaattagcaagtaaactgtgtcctctgaaagatgaaccatggcctatacatccttgggaaccaggttcctttagagttggtcttattgccttgaagctgggcatgatgcctttatggaccaaggatggtcaaaagcatgtggtcacattacttcaggtacaagactgtcatgtcttaaaatatacgtcaaaggaaaactgtaatggaaaaatggcaaccctgtctgtaggaggaaaaactgtatcacgttttcgtaaagctacatccatattggaattttaccgggaacttggattgccgccgaaacagacagttaaaatctttaatataacagataatgctgcaattaaaccaggcactcctctttatgctgctcactttcgtccaggacagtatgtggatgtcacagccaaaactattggtaaaggttttcaaggtgtcatgaaaagatggggatttaaaggccagcctgctacgcatggtcaaacgaaaacccacaggagacctggagctgttgcaactggtgatattggcagagtctggcctggaactaaaatgcctggaaaaatgggaaacatatacaggacagaatatggactgaaagtgtggagaataaacacaaagcacaacataatctatgtaaatggctctgtacctggacataaaaattgcttagtaaaggtcaaagattctaaactgcctgcatataaggatctcggtaaaaatctaccattccctacatattttcctgatggagatgaagaggaactgccagaagatttgtatgatgaaaacgtgtgtcagcccggtgcgccttctattacatttgcctaacatctttggacgtggcagaaccttacatattctgtgagcttcgatgagccagagtgatatcataaccaccagaaatcatactctcctttcttagtcacaacaaaatcacacatgtcatctttgtcaagggcataaatatatcattcatacccccattaaattttgttagaaaaattaccacattaaatatatgagttaagtagattggatttgctgaaattggtgttgggcatattagcaaaatattcttaatttgtggactcgattcttttttactacatatttcccaagttatcttaagatgtctgtaaatttaacttttattaaagttttgtcaatctttgtgaaatagtggttgtggaacagtagaaaaccatatggggactatagtgcaacctatttgggtaaagaaaccatttgctaaaatggagaaagtaaatagatttttatttaaattacagaaacatgttaaaggccggacaaaggaaagacaataaaatcataaattatcggtcctgtttacatttttgttgggagaggtgattactttttagttttatcactcaattataagatcagtgtgttttggttttgttttgttttgttctgtttaggcagggttttgctgtgttgcccaggctggagtgcagtgcagtggtgcgatcttggctcactgcagccacgaccttctgagctcaagtgatccttccacctcagcctcccatgtatctgggactataggtgcccaccaccatgcctggctaatatttgtatttttttgtaaaaatagaatcccactatgttgcccagggtggtcttgaacttctgagttcaagctttttaccttccatggcctcccaaagtgtcaggattacaggcgtgag

SEQ ID NO: 104389 - DNA, 1440 bp, Homo sapiens
  misc_feature (14)..(14): n is a, c, g, or t
  misc_feature (17)..(17): n is a, c, g, or t
  misc_feature (19)..(19): n is a, c, g, or t
  misc_feature (21)..(21): n is a, c, g, or t
  misc_feature (38)..(38): n is a, c, g, or t
aagtgtcttgagtntancncngccccctcccgggttancgggatgagagcatcggccggcgaccgttccggcggccattgcgaaaacttccccacggctactgcgtccacgtggcggtggcgtggggactccctgaaagcagagcggcagggcgcccggaagtcgtgagtcgagtcttcccgggctaatccatgccgggttggaggctgctgacgcaggtcggcgcccaggtgctgggtcgactcggggacggcctgggtgctgccctgggcccggggaacagaacacacatctggctttttgttagaggtcttcatggaaagagtggtacatggtgggatgagcatctttctgaagaaaatgtcccattcattaagcagttggtctctgatgaagataaagcccaattagcaagtaaactgtgtcctctgaaagatgaaccatggcctatacatccttgggaaccaggttcctttagagttggtcttattgccttgaagctgggcatgatgcctttatggaccaaggatggtcaaaagcatgtggtcacattacttcaggtacaagactgtcatgtcttaaaatatacgtcaaaggaaaactgtaatggaaaaatggcaaccctgtctgtaggaggaaaaactgtatcacgttttcgtaaagctacatccatattggaattttaccgggaacttggattgccgccgaaacagacagttaaaatctttaatataacagataatgctgcaattaaaccaggcactcctctttatgctgctcactttcgtccaggacagtatgtggatgtcacagccaaaactattggtaaaggttttcaaggtgtcatgaaaagatggggatttaaaggccagcctgctacgcatggtcaaacgaaaacccacaggagacctggagctgttgcaactggtgatattggcagagtctggcctggaactaaaatgcctggaaaaatgggaaacatatacaggacagaatatggactgaaagtgtggagaataaacacaaagcacaacataatctatgtaaatggctctgtacctggacataaaaattgcttagtaaaggtcaaagattctaaactgcctgcatataaggatctcggtaaaaatctaccattccctacatattttcctgatggagatgaagaggaactgccagaagatttgtatgatgaaaacgtgtgtcagcccggtgcgccttctattacatttgcctaacatctttggacgtggcagaaccttacatattctgtgagcttcgatgagccagagtgatatcataaccaccagaaatcatactctcctttcttagtcacaacaaaatcacacatgtcatctttgtcaagggcataaatatatcattcatacccccattaaattttgttagaaaaattaccacattaaatatatgagttaagta

SEQ ID NO: 104390 - DNA, 1696 bp, Homo sapiens
  misc_feature (14)..(14): n is a, c, g, or t
  misc_feature (17)..(17): n is a, c, g, or t
  misc_feature (19)..(19): n is a, c, g, or t
  misc_feature (21)..(21): n is a, c, g, or t
  misc_feature (38)..(38): n is a, c, g, or t
aagtgtcttgagtntancncngccccctcccgggttancgggatgagagcatcggccggcgaccgttccggcggccattgcgaaaacttccccacggctactgcgtccacgtggcggtggcgtggggactccctgaaagcagagcggcagggcgcccggaagtcgtgagtcgagtcttcccgggctaatccatgccgggttggaggctgctgacgcaggtcggcgcccagaacacacatctggctttttgttagaggtcttcatggaaagagtggtacatggtgggatgagcatctttctgaagaaaatgtcccattcattaagcagttggtctctgatgaagataaagcccaattagcaagtaaactgtgtcctctgaaagatgaaccatggcctatacatccttgggaaccaggttcctttagagttggtcttattgccttgaagctgggcatgatgcctttatggaccaaggatggtcaaaagcatgtggtcacattacttcaggtacaagactgtcatgtcttaaaatatacgtcaaaggaaaactgtaatggaaaaatggcaaccctgtctgtaggaggaaaaactgtatcacgttttcgtaaagctacatccatattggaattttaccgggaacttggattgccgccgaaacagacagttaaaatctttaatataacagataatgctgcaattaaaccaggcactcctctttatgctgctcactttcgtccaggacagtatgtggatgtcacagccaaaactattggtaaaggttttcaaggtgtcatgaaaagatggggatttaaaggccagcctgctacgcatggtcaaacgaaaacccacaggagacctggagctgttgcaactggtgatattggcagagtctggcctggaactaaaatgcctggaaaaatgggaaacatatacaggacagaatatggactgaaagtgtggagaataaacacaaagcacaacataatctatgtaaatggctctgtacctggacataaaaattgcttagtaaaggtcaaagattctaaactgcctgcatataaggatctcggtaaaaatctaccattccctacatattttcctgatggagatgaagaggaactgccagaagatttgtatgatgaaaacgtgtgtcagcccggtgcgccttctattacatttgcctaacatctttggacgtggcagaaccttacatattctgtgagcttcgatgagccagagtgatatcataaccaccagaaatcatactctcctttcttagtcacaacaaaatcacacatgtcatctttgtcaagggcataaatatatcattcatacccccattaaattttgttagaaaaattaccacattaaatatatgagttaagtagattggatttgctgaaattggtgttgggcatattagcaaaatattcttaatttgtggactcgattcttttttactacatatttcccaagttatcttaagatgtctgtaaatttaacttttattaaagttttgtcaatctttgtgaaatagtggttgtggaacagtagaaaaccatatggggactatagtgcaacctatttgggtaaagaaaccatttgctaaaatggagaaagtaaatagatttttatttaaattacagaaacatgttaaaggccggacaaaggaaagacaataaaatcataaattatc

SEQ ID NO: 104391 - DNA, 1695 bp, Homo sapiens
  misc_feature (14)..(14): n is a, c, g, or t
  misc_feature (17)..(17): n is a, c, g, or t
  misc_feature (19)..(19): n is a, c, g, or t
  misc_feature (21)..(21): n is a, c, g, or t
  misc_feature (38)..(38): n is a, c, g, or t
aagtgtcttgagtntancncngccccctcccgggttancgggatgagagcatcggccggcgaccgttccggcggccattgcgaaaacttccccacggctactgcgtccacgtggcggtggcgtggggactccctgaaagcagagcggcagggcgcccggaagtcgtgagtcgagtcttcccgggctaatccatgccgggttggaggctgctgacgcaggtcggcgcccaggtgctgggtcgactcggggacggcctgggtgctgccctgggcccggggaacagaacacacatctggctttttgttagaggtcttcatggaaagagtggtacatggtgggatgagcatctttctgaagcaagtaaactgtgtcctctgaaagatgaaccatggcctatacatccttgggaaccaggttcctttagagttggtcttattgccttgaagctgggcatgatgcctttatggaccaaggatggtcaaaagcatgtggtcacattacttcaggtacaagactgtcatgtcttaaaatatacgtcaaaggaaaactgtaatggaaaaatggcaaccctgtctgtaggaggaaaaactgtatcacgttttcgtaaagctacatccatattggaattttaccgggaacttggattgccgccgaaacagacagttaaaatctttaatataacagataatgctgcaattaaaccaggcactcctctttatgctgctcactttcgtccaggacagtatgtggatgtcacagccaaaactattggtaaaggttttcaaggtgtcatgaaaagatggggatttaaaggccagcctgctacgcatggtcaaacgaaaacccacaggagacctggagctgttgcaactggtgatattggcagagtctggcctggaactaaaatgcctggaaaaatgggaaacatatacaggacagaatatggactgaaagtgtggagaataaacacaaagcacaacataatctatgtaaatggctctgtacctggacataaaaattgcttagtaaaggtcaaagattctaaactgcctgcatataaggatctcggtaaaaatctaccattccctacatattttcctgatggagatgaagaggaactgccagaagatttgtatgatgaaaacgtgtgtcagcccggtgcgccttctattacatttgcctaacatctttggacgtggcagaaccttacatattctgtgagcttcgatgagccagagtgatatcataaccaccagaaatcatactctcctttcttagtcacaacaaaatcacacatgtcatctttgtcaagggcataaatatatcattcatacccccattaaattttgttagaaaaattaccacattaaatatatgagttaagtagattggatttgctgaaattggtgttgggcatattagcaaaatattcttaatttgtggactcgattcttttttactacatatttcccaagttatcttaagatgtctgtaaatttaacttttattaaagttttgtcaatctttgtgaaatagtggttgtggaacagtagaaaaccatatggggactatagtgcaacctatttgggtaaagaaaccatttgctaaaatggagaaagtaaatagatttttatttaaattacagaaacatgttaaaggccggacaaaggaaagacaataaaatcataaattatc

SEQ ID NO: 104392 - DNA, 1650 bp, Homo sapiens
  misc_feature (14)..(14): n is a, c, g, or t
  misc_feature (17)..(17): n is a, c, g, or t
  misc_feature (19)..(19): n is a, c, g, or t
  misc_feature (21)..(21): n is a, c, g, or t
  misc_feature (38)..(38): n is a, c, g, or t
aagtgtcttgagtntancncngccccctcccgggttancgggatgagagcatcggccggcgaccgttccggcggccattgcgaaaacttccccacggctactgcgtccacgtggcggtggcgtggggactccctgaaagcagagcggcagggcgcccggaagtcgtgagtcgagtcttcccgggctaatccatgccgggttggaggctgctgacgcaggtcggcgcccaggtgctgggtcgactcggggacggcctgggtgctgccctgggcccggggaacagaacacacatctggctttttgttagaggtcttcatggaaagagtggtacatggtgggatgagcatctttctgaagaaaatgtcccattcattaagcagttggtctctgatgaagataaagcccaattagcaagtaaactgtgtcctctgaaagatgaaccatggcctatacatccttgggaaccaggttcctttagagttggtcttattgccttgaagctgggcatgatgcctttatggaccaaggatggtcaaaagcatgtggtcacattacttcagaaagctacatccatattggaattttaccgggaacttggattgccgccgaaacagacagttaaaatctttaatataacagataatgctgcaattaaaccaggcactcctctttatgctgctcactttcgtccaggacagtatgtggatgtcacagccaaaactattggtaaaggttttcaaggtgtcatgaaaagatggggatttaaaggccagcctgctacgcatggtcaaacgaaaacccacaggagacctggagctgttgcaactggtgatattggcagagtctggcctggaactaaaatgcctggaaaaatgggaaacatatacaggacagaatatggactgaaagtgtggagaataaacacaaagcacaacataatctatgtaaatggctctgtacctggacataaaaattgcttagtaaaggtcaaagattctaaactgcctgcatataaggatctcggtaaaaatctaccattccctacatattttcctgatggagatgaagaggaactgccagaagatttgtatgatgaaaacgtgtgtcagcccggtgcgccttctattacatttgcctaacatctttggacgtggcagaaccttacatattctgtgagcttcgatgagccagagtgatatcataaccaccagaaatcatactctcctttcttagtcacaacaaaatcacacatgtcatctttgtcaagggcataaatatatcattcatacccccattaaattttgttagaaaaattaccacattaaatatatgagttaagtagattggatttgctgaaattggtgttgggcatattagcaaaatattcttaatttgtggactcgattcttttttactacatatttcccaagttatcttaagatgtctgtaaatttaacttttattaaagttttgtcaatctttgtgaaatagtggttgtggaacagtagaaaaccatatggggactatagtgcaacctatttgggtaaagaaaccatttgctaaaatggagaaagtaaatagatttttatttaaattacagaaacatgttaaaggccggacaaaggaaagacaataaaatcataaattatc

SEQ ID NO: 104393 - DNA, 889 bp, Homo sapiens
  misc_feature (14)..(14): n is a, c, g, or t
  misc_feature (17)..(17): n is a, c, g, or t
  misc_feature (19)..(19): n is a, c, g, or t
  misc_feature (21)..(21): n is a, c, g, or t
  misc_feature (38)..(38): n is a, c, g, or t
aagtgtcttgagtntancncngccccctcccgggttancgggatgagagcatcggccggcgaccgttccggcggccattgcgaaaacttccccacggctactgcgtccacgtggcggtggcgtggggactccctgaaagcagagcggcagggcgcccggaagtcgtgagtcgagtcttcccgggctaatccatgccgggttggaggctgctgacgcaggtcggcgcccaggtgctgggtcgactcggggacggcctgggtgctgccctgggcccggggaacagaacacacatctggctttttgttagaggtcttcatggaaagagtggtacatggtgggatgagcatctttctgaagaaaatgtcccattcattaagcagttggtctctgatgaagataaagcccaattagcaagtaaactgtgtcctctgaaagatgaaccatggcctatacatccttgggaaccaggttcctttagagttggtcttattgccttgaagctgggcatgatgcctttatggaccaaggatggtcaaaagcatgtggtcacattacttcaggtacaagactgtcatgtcttaaaatatacgtcaaaggaaaactgtaatggaaaaatggcaaccctgtctgtaggaggaaaaactgtatcacgttttcgtaaagctacatccatattggaattttaccgggaacttggattgccgccgaaacagacagttaaaatctttaatataacagataatgctgcaattaaaccaggtttttctctgcctatataaatccaggttgggttataacttaaaggaagttccccccctgcaatcttacagcactttgctgcttgtattaaataaactataactataaataaactttcagttacattctc

SEQ ID NO: 104394 - DNA, 1199 bp, Homo sapiens
  misc_feature (14)..(14): n is a, c, g, or t
  misc_feature (17)..(17): n is a, c, g, or t
  misc_feature (19)..(19): n is a, c, g, or t
  misc_feature (21)..(21): n is a, c, g, or t
  misc_feature (38)..(38): n is a, c, g, or t
aagtgtcttgagtntancncngccccctcccgggttancgggatgagagcatcggccggcgaccgttccggcggccattgcgaaaacttccccacggctactgcgtccacgtggcggtggcgtggggactccctgaaagcagagcggcagggcgcccggaagtcgtgagtcgagtcttcccgggctaatccatgccgggttggaggctgctgacgcaggtcggcgcccaggtgctgggtcgactcggggacggcctgggtgctgccctgggcccggggaacagaacacacatctggctttttgttagaggtcttcatggaaagagtggtacatggtgggatgagcatctttctgaagaaaatgtcccattcattaagcagttggtctctgatgaagataaagcccaattagcaagtaaactgtgtcctctgaaagatgaaccatggcctatacatccttgggaaccaggttcctttagagttggtcttattgccttgaagctgggcatgatgcctttatggaccaaggatggtcaaaagcatgtggtcacattacttcaggtacaagactgtcatgtcttaaaatatacgtcaaaggaaaactgtaatggaaaaatggcaaccctgtctgtaggaggaaaaactgtatcacgttttcgtgtaaggatgtattttcatagctagaatactgcatttttcatcagtttcaaatctggatgagtttatgttttgagattgttccacagccacaaacttgcatttgtttgtgaggtaaattgtgtatttgggggaggcagtctggcacagccattttgcccaggagtcttggagactcttgagtttgttctaatacctctccctgtatctggaacaagtaattttacctctctaagctgtagtgcttgtatatctgtacaatgggaacaaaaatactacatacctaatagatttatcacaaggattaaattaggtttttcagatgtgcttggaatataacagacactcagtagatttggttattttgttattgttttatgtttcatttcactttcttcctatggaaaattgtcttaactcttgacaccaagagcatgtggaaattaattttgtgtattctggaaggagctttcagtgtttgggagaaagctgtataagaatccaaatcagattttttttaataaagcatttttttttaagtag

SEQ ID NO: 104395 - DNA, 2807 bp, Homo sapiens
cccacgcgtgagaactggaaagccgagggtagccgagcggggcgggcgctctggagcggcgggtgctcgggctgccgtccgctccgccagaagcaccgagcagccgagccggggcccgccgccctcctcctccatgaggcccgagtgaggcgcggcggctatagccgacccgcggcgccttccccccgcgtcctatcgcgagcgcagcggcagcggcccctggaggaggaggcggaggaggaggagcatgtcggacggtttcgatcgggccccaggtgctggtcggggccggagccggggcctgggccgcggagggggcgggcctgagggcggcggtttcccgaacggagcggggcctgctgagcgggcgcggcaccagccgccgcaacccaaagccccgggcttcctgcagccaccgccgctgcgccagcccaggacgaccccgccgccaggggcccagtgcgaggtccccgccagcccccagcggccttcccggcccggggcgctcccagagcaaacgaggcccctgagagctccacctagttcacaggataaaatcccacagcagaactcggagtcagcaatggctaagccccaggtggttgtagctcctgtattaatgtctaagctgtctgtgaatgcccctgaattttacccttcaggttattcttccagttacacagaatcctatgaggatggttgtgaggattatcctactctatcagaatatgttcaggattttttgaatcatcttacagagcagcctggcagttttgaaactgaaattgaacagtttgcagagaccctgaatggttgtgttacaacagatgatgctttgcaagaacttgtggaactcatctatcaacaggccacatctatcccaaatttctcttatatgggagctcgcctgtgtaattacctgtcccatcatctgacaattagcccacagagtggcaacttccgccaattgctacttcaaagatgtcggactgaatatgaagttaaagatcaagctgcaaaaggggatgaagttactcgaaaacgatttcatgcatttgtactctttctgggagaactttatcttaacctggagatcaagggaacaaatggacaggttacaagagcagatattcttcaggttggtcttcgagaattgctgaatgccctgttttctaatcctatggatgacaatttaatttgtgcagtaaaattgttaaagttgacaggatcagttttggaagatgcttggaaggaaaaaggaaagatggatatggaagaaattattcagagaattgaaaacgttgtcctagatgcaaactgcagtagagatgtaaaacagatgctcttgaagcttgtagaactccggtcaagtaactggggcagagtccatgcaacttcaacatatagagaagcaacaccagaaaatgatcctaactactttatgaatgaaccaacattttatacatctgatggtgttcctttcactgcagctgatccagattaccaagagaaataccaagaattacttgaaagagaggacttttttccagattatgaagaaaatggaacagatttatccggggctggtgatccatacttggatgatattgatgatgagatggacccagagatagaagaagcttatgaaaagttttgtttggaatcagagcgtaagcgaaaacagtaaagttaaatttcagcatatcagttttataaagcagtttaggtatggtgatttagcagaacacaagagagcaagaaaatgtgtcacatctataccaaattaaggatgttgagttatgttactaatgtatgcaactttaattttgtttaacactatctgccaaaataaactttattccctataacttaaaatgtgtatatatatataatagtttattatgtacagttaattctactgttttggctgcaataaaatcgattttgaaataaatgaaatgttgaaaattttgctagttggttagatgcttatcctttaaattctacttttcttgaggggaaaaagtcttcgtctggaaatacatattactgcaaaaatgtagcatccttttttaggtaggagtattatagctttcattttagtttgacatttagtgtcccaatgaattgaatttcaaatatgaatcataatcttgaaaatctttagcactaaagtcttggaatatatcaacaactgatttacatatgcagatgctatttgataccaagggctttttaaatgtcatgggggggaaaaacccaacttggtgaactcccagctaaacaaccaagacttcactgaagatttattccaattctagaattgttcttttttatttttattttttcaactgactaacttcattaccttaaagcctagaacattattctgctttatttatatggctttctcacttttattttgtagcatgggttgcatcgacttttttactagagaattttactagatatttgtcattcaagttttcatctgctttataattgatacaccttgagggtcacttttctaatacttttactataatgtggtaccacctcagccctaataaataatatttttacctaatgtcaaatctttttccagctaactaaaaactgtgtacaaaaggattgcttgtaaatatgcatgtaaatagttctgttaataacccactgttttacatttggtacatctgtgtctgctaatacagttagctttctcacttttctgcttgtttgttcagtctgaattaaaattagactttgaaaataaagcttaaatagttgtttcctctaaaaaaaatatt

SEQ ID NO: 104396 - DNA, 1714 bp, Homo sapiens
cccacgcgtgagaactggaaagccgagggtagccgagcggggcgggcgctctggagcggcgggtgctcgggctgccgtccgctccgccagaagcaccgagcagccgagccggggcccgccgccctcctcctccatgaggcccgagtgaggcgcggcggctatagccgacccgcggcgccttccccccgcgtcctatcgcgagcgcagcggcagcggcccctggaggaggaggcggaggaggaggagcatgtcggacggtttcgatcggccagagcaaacgaggcccctgagagctccacctagttcacaggataaaatcccacagcagaactcggagtcagcaatggctaagccccaggtggttgtagctcctgtattaatgtctaagctgtctgtgaatgcccctgaattttacccttcaggttattcttccagttacacagaatcctatgaggatggttgtgaggattatcctactctatcagaatatgttcaggattttttgaatcatcttacagagcagcctggcagttttgaaactgaaattgaacagtttgcagagaccctgaatggttgtgttacaacagatgatgctttgcaagaacttgtggaactcatctatcaacaggccacatctatcccaaatttctcttatatgggagctcgcctgtgtaattacctgtcccatcatctgacaattagcccacagagtggcaacttccgccaattgctacttcaaagatgtcggactgaatatgaagttaaagatcaagctgcaaaaggggatgaagttactcgaaaacgatttcatgcatttgtactctttctgggagaactttatcttaacctggagatcaagggaacaaatggacaggttacaagagcagatattcttcaggttggtcttcgagaattgctgaatgccctgttttctaatcctatggatgacaatttaatttgtgcagtaaaattgttaaagttgacaggatcagttttggaagatgcttggaaggaaaaaggaaagatggatatggaagaaattattcagagaattgaaaacgttgtcctagatgcaaactgcagtagagatgtaaaacagatgctcttgaagcttgtagaactccggtcaagtaactggggcagagtccatgcaacttcaacatatagagaagcaacaccagaaaatgatcctaactactttatgaatgaaccaacattttatacatctgatggtgttcctttcactgcagctgatccagattaccaagagaaataccaagaattacttgaaagagaggacttttttccagattatgaagaaaatggaacagatttatccggggctggtgatccatacttggatgatattgatgatgagatggacccagagatagaagaagcttatgaaaagttttgtttggaatcagagcgtaagcgaaaacagtaaagttaaatttcagcatatcagttttataaagcagtttaggtatggtgatttagcagaacacaagagagcaagaaaatgtgtcacatctataccaaattaaggatgttgagttatgttactaatgtatgcaactttaattttgtttaacactatctgccaaaataaactttattccctataacttaaaatgtgtatatatatataatagtttattatgtacagttaattctactgttttggctgcaataaaatcgattttgaaataaa

SEQ ID NO: 104397 - DNA, 2521 bp, Homo sapiens
ccaggctgttacggtccgagttctttgctcgtccgctccgccagaagcaccgagcagccgagccggggcccgccgccctcctcctccatgaggcccgagtgaggcgcggcggctatagccgacccgcggcgccttccccccgcgtcctatcgcgagcgcagcggcagcggcccctggaggaggaggcggaggaggaggagcatgtcggacggtttcgatcggccagagcaaacgaggcccctgagagctccacctagttcacaggataaaatcccacagcagaactcggagtcagcaatggctaagccccaggtggttgtagctcctgtattaatgtctaagctgtctgtgaatgcccctgaattttacccttcaggttattcttccagttacacagaatcctatgaggatggttgtgaggattatcctactctatcagaatatgttcaggattttttgaatcatcttacagagcagcctggcagttttgaaactgaaattgaacagtttgcagagaccctgaatggttgtgttacaacagatgatgctttgcaagaacttgtggaactcatctatcaacaggccacatctatcccaaatttctcttatatgggagctcgcctgtgtaattacctgtcccatcatctgacaattagcccacagagtggcaacttccgccaattgctacttcaaagatgtcggactgaatatgaagttaaagatcaagctgcaaaaggggatgaagttactcgaaaacgatttcatgcatttgtactctttctgggagaactttatcttaacctggagatcaagggaacaaatggacaggttacaagagcagatattcttcaggttggtcttcgagaattgctgaatgccctgttttctaatcctatggatgacaatttaatttgtgcagtaaaattgttaaagttgacaggatcagttttggaagatgcttggaaggaaaaaggaaagatggatatggaagaaattattcagagaattgaaaacgttgtcctagatgcaaactgcagtagagatgtaaaacagatgctcttgaagcttgtagaactccggtcaagtaactggggcagagtccatgcaacttcaacatatagagaagcaacaccagaaaatgatcctaactactttatgaatgaaccaacattttatacatctgatggtgttcctttcactgcagctgatccagattaccaagagaaataccaagaattacttgaaagagaggacttttttccagattatgaagaaaatggaacagatttatccggggctggtgatccatacttggatgatattgatgatgagatggacccagagatagaagaagcttatgaaaagttttgtttggaatcagagcgtaagcgaaaacagtaaagttaaatttcagcatatcagttttataaagcagtttaggtatggtgatttagcagaacacaagagagcaagaaaatgtgtcacatctataccaaattaaggatgttgagttatgttactaatgtatgcaactttaattttgtttaacactatctgccaaaataaactttattccctataacttaaaatgtgtatatatatataatagtttattatgtacagttaattctactgttttggctgcaataaaatcgattttgaaataaatgaaatgttgaaaattttgctagttggttagatgcttatcctttaaattctacttttcttgaggggaaaaagtcttcgtctggaaatacatattactgcaaaaatgtagcatccttttttaggtaggagtattatagctttcattttagtttgacatttagtgtcccaatgaattgaatttcaaatatgaatcataatcttgaaaatctttagcactaaagtcttggaatatatcaacaactgatttacatatgcagatgctatttgataccaagggctttttaaatgtcatgggggggaaaaacccaacttggtgaactcccagctaaacaaccaagacttcactgaagatttattccaattctagaattgttcttttttatttttattttttcaactgactaacttcattaccttaaagcctagaacattattctgctttatttatatggctttctcacttttattttgtagcatgggttgcatcgacttttttactagagaattttactagatatttgtcattcaagttttcatctgctttataattgatacaccttgagggtcacttttctaatacttttactataatgtggtaccacctcagccctaataaataatatttttacctaatgtcaaatctttttccagctaactaaaaactgtgtacaaaaggattgcttgtaaatatgcatgtaaatagttctgttaataacccactgttttacatttggtacatctgtgtctgctaatacagttagctttctcacttttctgcttgtttgttcagtctgaattaaaattagactttgaaaataaagcttaaatagttgtttcctctaaaaaaaatatt

SEQ ID NO: 104398 - DNA, 2351 bp, Homo sapiens
  misc_feature (26)..(26): n is a, c, g, or t
agcggacgcacgtctctcctgagaantaccgagtaggtcgggcctgcctgtgccagagcaaacgaggcccctgagagctccacctagttcacaggataaaatcccacagcagaactcggagtcagcaatggctaagccccaggtggttgtagctcctgtattaatgtctaagctgtctgtgaatgcccctgaattttacccttcaggttattcttccagttacacagaatcctatgaggatggttgtgaggattatcctactctatcagaatatgttcaggattttttgaatcatcttacagagcagcctggcagttttgaaactgaaattgaacagtttgcagagaccctgaatggttgtgttacaacagatgatgctttgcaagaacttgtggaactcatctatcaacaggccacatctatcccaaatttctcttatatgggagctcgcctgtgtaattacctgtcccatcatctgacaattagcccacagagtggcaacttccgccaattgctacttcaaagatgtcggactgaatatgaagttaaagatcaagctgcaaaaggggatgaagttactcgaaaacgatttcatgcatttgtactctttctgggagaactttatcttaacctggagatcaagggaacaaatggacaggttacaagagcagatattcttcaggttggtcttcgagaattgctgaatgccctgttttctaatcctatggatgacaatttaatttgtgcagtaaaattgttaaagttgacaggatcagttttggaagatgcttggaaggaaaaaggaaagatggatatggaagaaattattcagagaattgaaaacgttgtcctagatgcaaactgcagtagagatgtaaaacagatgctcttgaagcttgtagaactccggtcaagtaactggggcagagtccatgcaacttcaacatatagagaagcaacaccagaaaatgatcctaactactttatgaatgaaccaacattttatacatctgatggtgttcctttcactgcagctgatccagattaccaagagaaataccaagaattacttgaaagagaggacttttttccagattatgaagaaaatggaacagatttatccggggctggtgatccatacttggatgatattgatgatgagatggacccagagatagaagaagcttatgaaaagttttgtttggaatcagagcgtaagcgaaaacagtaaagttaaatttcagcatatcagttttataaagcagtttaggtatggtgatttagcagaacacaagagagcaagaaaatgtgtcacatctataccaaattaaggatgttgagttatgttactaatgtatgcaactttaattttgtttaacactatctgccaaaataaactttattccctataacttaaaatgtgtatatatatataatagtttattatgtacagttaattctactgttttggctgcaataaaatcgattttgaaataaatgaaatgttgaaaattttgctagttggttagatgcttatcctttaaattctacttttcttgaggggaaaaagtcttcgtctggaaatacatattactgcaaaaatgtagcatccttttttaggtaggagtattatagctttcattttagtttgacatttagtgtcccaatgaattgaatttcaaatatgaatcataatcttgaaaatctttagcactaaagtcttggaatatatcaacaactgatttacatatgcagatgctatttgataccaagggctttttaaatgtcatgggggggaaaaacccaacttggtgaactcccagctaaacaaccaagacttcactgaagatttattccaattctagaattgttcttttttatttttattttttcaactgactaacttcattaccttaaagcctagaacattattctgctttatttatatggctttctcacttttattttgtagcatgggttgcatcgacttttttactagagaattttactagatatttgtcattcaagttttcatctgctttataattgatacaccttgagggtcacttttctaatacttttactataatgtggtaccacctcagccctaataaataatatttttacctaatgtcaaatctttttccagctaactaaaaactgtgtacaaaaggattgcttgtaaatatgcatgtaaatagttctgttaataacccactgttttacatttggtacatctgtgtctgctaatacagttagctttctcacttttctgcttgtttgttcagtctgaattaaaattagactttgaaaataaagcttaaatagttgtttcctctaaaaaaaatatt

SEQ ID NO: 104399 - DNA, 2762 bp, Homo sapiens
cccacgcgtgagaactggaaagccgagggtagccgagcggggcgggcgctctggagcggcgggtgctcgggctgccgtccgctccgccagaagcaccgagcagccgagccggggcccgccgccctcctcctccatgaggcccgagtgaggcgcggcggctatagccgacccgcggcgccttccccccgcgtcctatcgcgagcgcagcggcagcggcccctggaggaggaggcggaggaggaggagcatgtcggacggtttcgatcgggccccaggtgctggtcggggccggagccggggcctgggccgcggagggggcgggcctgagggcggcggtttcccgaacggagcggggcctgctgagcgggcgcggcaccagccgccgcaacccaaagccccgggcttcctgcagccaccgccgctgcgccagcccaggacgaccccgccgccaggggcccagtgcgaggtccccgccagcccccagcggccttcccggcccggggcgctcccagagcaaacgaggcccctgagagctccacctagttcacaggatatggttgtagctcctgtattaatgtctaagctgtctgtgaatgcccctgaattttacccttcaggttattcttccagttacacagaatcctatgaggatggttgtgaggattatcctactctatcagaatatgttcaggattttttgaatcatcttacagagcagcctggcagttttgaaactgaaattgaacagtttgcagagaccctgaatggttgtgttacaacagatgatgctttgcaagaacttgtggaactcatctatcaacaggccacatctatcccaaatttctcttatatgggagctcgcctgtgtaattacctgtcccatcatctgacaattagcccacagagtggcaacttccgccaattgctacttcaaagatgtcggactgaatatgaagttaaagatcaagctgcaaaaggggatgaagttactcgaaaacgatttcatgcatttgtactctttctgggagaactttatcttaacctggagatcaagggaacaaatggacaggttacaagagcagatattcttcaggttggtcttcgagaattgctgaatgccctgttttctaatcctatggatgacaatttaatttgtgcagtaaaattgttaaagttgacaggatcagttttggaagatgcttggaaggaaaaaggaaagatggatatggaagaaattattcagagaattgaaaacgttgtcctagatgcaaactgcagtagagatgtaaaacagatgctcttgaagcttgtagaactccggtcaagtaactggggcagagtccatgcaacttcaacatatagagaagcaacaccagaaaatgatcctaactactttatgaatgaaccaacattttatacatctgatggtgttcctttcactgcagctgatccagattaccaagagaaataccaagaattacttgaaagagaggacttttttccagattatgaagaaaatggaacagatttatccggggctggtgatccatacttggatgatattgatgatgagatggacccagagatagaagaagcttatgaaaagttttgtttggaatcagagcgtaagcgaaaacagtaaagttaaatttcagcatatcagttttataaagcagtttaggtatggtgatttagcagaacacaagagagcaagaaaatgtgtcacatctataccaaattaaggatgttgagttatgttactaatgtatgcaactttaattttgtttaacactatctgccaaaataaactttattccctataacttaaaatgtgtatatatatataatagtttattatgtacagttaattctactgttttggctgcaataaaatcgattttgaaataaatgaaatgttgaaaattttgctagttggttagatgcttatcctttaaattctacttttcttgaggggaaaaagtcttcgtctggaaatacatattactgcaaaaatgtagcatccttttttaggtaggagtattatagctttcattttagtttgacatttagtgtcccaatgaattgaatttcaaatatgaatcataatcttgaaaatctttagcactaaagtcttggaatatatcaacaactgatttacatatgcagatgctatttgataccaagggctttttaaatgtcatgggggggaaaaacccaacttggtgaactcccagctaaacaaccaagacttcactgaagatttattccaattctagaattgttcttttttatttttattttttcaactgactaacttcattaccttaaagcctagaacattattctgctttatttatatggctttctcacttttattttgtagcatgggttgcatcgacttttttactagagaattttactagatatttgtcattcaagttttcatctgctttataattgatacaccttgagggtcacttttctaatacttttactataatgtggtaccacctcagccctaataaataatatttttacctaatgtcaaatctttttccagctaactaaaaactgtgtacaaaaggattgcttgtaaatatgcatgtaaatagttctgttaataacccactgttttacatttggtacatctgtgtctgctaatacagttagctttctcacttttctgcttgtttgttcagtctgaattaaaattagactttgaaaataaagcttaaatagttgtttcctctaaaaaaaatatt

SEQ ID NO: 104400 - DNA, 2478 bp, Homo sapiens
cccacgcgtgagaactggaaagccgagggtagccgagcggggcgggcgctctggagcggcgggtgctcgggctgccgtccgctccgccagaagcaccgagcagccgagccggggcccgccgccctcctcctccatgaggcccgagtgaggcgcggcggctatagccgacccgcggcgccttccccccgcgtcctatcgcgagcgcagcggcagcggcccctggaggaggaggcggaggaggaggagcatgtcggacggtttcgatcggccagagcaaacgaggcccctgagagctccacctagttcacaggataaaatcccacagcagaactcggagtcagcaatggctaagccccaggtggttgtagctcctgtattaatgtctaagctgtctgtgaatgcccctgaattttacccttcaggttattcttccagttacacagaatcctatgaggatggttgtgaggattatcctactctatcagaatatgttcaggattttttgaatcatcttacagagcagcctggcagttttgaaactgaaattgaacagtttgcagagaccctgaatggttgtgttacaacagatgatgctttgcaagaacttgtggaactcatctatcaacaggccacatctatcccaaatttctcttatatgggagctcgcctgtgtaattacctgtcccatcatctgacaattagcccacagagtggcaacttccgccaattgctacttcaaagatgtcggactgaatatgaagttaaagatcaagctgcaaaaggggatgaagttactcgaaaacgatttcatgcatttgtactctttctgggagaactttatcttaacctggagatcaagggaacaaatggacaggttacaagagcagatattcttcaggttggtcttcgagaattgctgaatgccctgttttctaatcctatggatgacaatttaatttgtgcagtaaaattgttaaagttgacaggatcagttttggaagatgcttggaaggaaaaaggaaagatggatatggaagaaattattcagagaattgaaaacgttgtcctagatgcaaactgcagtagagatgtaaaacagatgctcttgaagcttgtagaactccggtcaagtaactggggcagagtccatgcaacttcaacatatagagaagcaacaccagaaaatgatcctaactactttatgaatgaaccaacattttatacatctgatggtgttcctttcactgcagctgatccagattaccaagagaaataccaagaattacttgaaagagaggacttttttccagattatgaagaaaatggaacagatttatccggggctggtgatccatacttggatgatattgatgatgagatggacccagagatagaagaagcttatgaaaagttttgtttggaatcagagcgtaagcgaaaacagtaaagttaaatttcagcatatcagttttataaagcagtttaggtatggtgatttagcagaacacaagagagcaagaaaatgtgtcacatctataccaaattaaggatgttgagttatgttactaatgtatgcaactttaattttgtttaacactatctgccaaaataaactttattccctataacttaaaatgtgtatatatatataatagtttattatgtacagttaattctactgttttggctgcaataaaatcgattttgaaataaaacaaaaacaacacaaaaaaaaaaaaaaacaaaaaaaaaaaaaaaaaaaaaaaaaaaacaacaaccacaaaacaaaaaaaaacaacaaaaaaaacaaaaaaaaaaacaaaaagaaaaacaacaaccaccacacaaaaaaaacaaacaagcaaacagaaacaaccaagaaaaaacgaaaaaaagaaaaaacaaagacaaaaagaaacacaaaaaagaaaaaagaagaaaagtagagccgcgacgaagagcgaaaaaaagtagaaacaacgaaagagagacagcacgagacgaagaagacaagaaaatagaaaaacagaccaagagacgagaagaatgcaaacgaagccacaaccaggagaacaaagagagagataaagaaaaacagaagagccaagacagagcgaccagaacccggaagacagacagaggaagagcagagagaggagagagcgcagagagtcaataaagagaacaagagaggagacacagaaacaaaaaacaaaagaatcaaagaagaaaacgaaagaaacgaaaggcgaggcagggaacggaaaacccaacactatctcaccgaagggtagcagaaagcgagaagaggaaaacaaagcaaaacagaaggcaaccgacgagggagaagaaggagaagagcaaaacaaagaacgaaaagaaaaaaaaaagaagagagaagaggacagaacataacaagaagagacagactgactaagaaaacaaaaagcacaaaaaaaacaagagcagacacaaaat

SEQ ID NO: 104401 - DNA, 1637 bp, Homo sapiens
cccacgcgtgagaactggaaagccgagggtagccgagcggggcgggcgctctggagcggcgggtgctcgggctgccgtccgctccgccagaagcaccgagcagccgagccggggcccgccgccctcctcctccatgaggcccgagtgaggcgcggcggctatagccgacccgcggcgccttccccccgcgtcctatcgcgagcgcagcggcagcggcccctggaggaggaggcggaggaggaggagcatgtcggacggtttcgatcggccagagcaaacgaggcccctgagagctccacctagttcacaggataaaatcccacagcagaactcggagtcagcaatggctaagccccaggtggttgtagctcctgtattaatgtctaagctgtctgtgaatgcccctgaattttacccttcaggttattcttccagttacacagaatcctatgaggatggttgtgaggattatcctactctatcagaatatgttcaggattttttgaatcatcttacagagcagcctggcagttttgaaactgaaattgaacagtttgcagagaccctgaatggttgtgttacaacagatgatgctttgcaagaacttgtggaactcatctatcaacaggccacatctatcccaaatttctcttatatgggagctcgcctgtgtaattacctgtcccatcatctgacaattagcccacagagtggcaacttccgccaattgctacttcaaagatgtcggactgaatatgaagttaaagatcaagctgcaaaaggggatgaagttactcgaaaacgatttcatgcatttgtactctttctgggagaactttatcttaacctggagatcaagggaacaaatggacaggttacaagagcagatattcttcaggttggtcttcgagaattgctgaatgccctgttttctaatcctatggatgacaatttaatttgtgcagtaaaattgttaaagttgacaggatcagttttggaagatgcttggaaggaaaaaggaaagatggatatggaagaaattattcagagaattgaaaacgttgtcctagatgcaaactgcagtagagatgtaaaacagatgctcttgaagcttgtagaactccggtcaagtaactggggcagagtccatgcaacttcaacatatagagaagcaacaccagaaaatgatcctaactactttatgaatgaaccaacattttatacatctgatggtgttcctttcactgcagctgatccagattaccaagagaaataccaagaattacttgaaagagaggacttttttccagattatgaagaaaatggaacagatttatccggggctggtgatccatacttggatgatattgatgatgagatggacccagagatagaagaagcttatgaaaagttttgtttggaatcagagcgtaagcgaaaacagtaaagttaaatttcagcatatcagttttataaagcagtttaggtatggtgatttagcagaacacaagagagcaagaaaatgtgtcacatctataccaaattaaggatgttgagttatgttactaatgtatgcaactttaattttgtttaacactatctgccaaaataaactttattccctataacttaaaatg

SEQ ID NO: 104402 - DNA, 2036 bp, Homo sapiens
cccacgcgtgagaactggaaagccgagggtagccgagcggggcgggcgctctggagcggcgggtgctcgggctgccgtccgctccgccagaagcaccgagcagccgagccggggcccgccgccctcctcctccatgaggcccgagtgaggcgcggcggctatagccgacccgcggcgccttccccccgcgtcctatcgcgagcgcagcggcagcggcccctggaggaggaggcggaggaggaggagcatgtcggacggtttcgatcggccagagcaaacgaggcccctgagagctccacctagttcacaggataaaatcccacagcagaactcggagtcagcaatggctaagccccaggtggttgtagctcctgtattaatgtctaagctgtctgtgaatgcccctgaattttacccttcaggttattcttccagttacacagaatcctatgaggatggttgtgaggattatcctactctatcagaatatgttcaggattttttgaatcatcttacagagcagcctggcagttttgaaactgaaattgaacagtttgcagagaccctgaatggttgtgttacaacagatgatgctttgcaagaacttgtggaactcatctatcaacaggccacatctatcccaaatttctcttatatgggagctcgcctgtgtaattacctgtcccatcatctgacaattagcccacagagtggcaacttccgccaattgctacttcaaagatgtcggactgaatatgaagttaaagatcaagctgcaaaaggggatgaagttactcgaaaacgatttcatgcatttgtactctttctgggagaactttatcttaacctggagatcaagggaacaaatggacaggttacaagagcagatattcttcaggttggtcttcgagaattgctgaatgccctgttttctaatcctatggatgacaatttaatttgtgcagtaaaattgttaaagttgacaggatcagttttggaagatgcttggaaggaaaaaggaaagatggatatggaagaaattattcagagaattgaaaacgttgtcctagatgcaaactgcagtagagatgtaaaacagatgctcttgaagcttgtagaactccggtcaagtaactggggcagagtccatgcaacttcaacatatagagaagcaacaccagaaaatgatcctaactactttatgaatgaaccaacattttatacatctgatggtgttcctttcactgcagctgatccagattaccaagagaaataccaagaattacttgaaagagaggacttttttccagattatgaagaaaatggaacagatttatccggggctggtgatccatacttggatgatattgatgatgagatggacccagagatagaagaagcttatgaaaagttttgtttggaatcagagcgtaagcgaaaacagtaaagttaaatttcagcatatcagttttataaagcagtttaggtatggtgatttagcagaacacaagagagcaagaaaatgtgtcacatctataccaaattaaggatgttgagttatgttactaatgtatgcaactttaattttgtttaacactatctgccaaaataaactttattccctataacttaaaatgaaaaaaaaaaaaaaaaaaaaaacaacgtgttgtggggcgcgcgcctgtgggccctctggaaaaacattttctacaacaccaatccgggtggggcgcgcgggggccccatgttgggtctaggggacacggggccaaaaacgcggtcccaaaggaaacccggggccatgagaaaagggcggggggggttcttctccacaattaataaaaaagaggcgccggggggggagcaaccccagagggtgtttctgtgagaacaaatttctccagagatggggggtcttcaaggaggggccaatatagacgggggagtcttttattcaaccaggggagggtcctccaaagcgagaagagccccggattttctaaaaattatcgccccgcggggctcgttgtggtggt

SEQ ID NO: 104403 - DNA, 1723 bp, Homo sapiens
gagctcggtacccgagattagaagtgatacgaggatctattatacgagtagggctagggatgaatagctgaaagctgggcgtcgtaattccatatgtcgtgacagggtttaatttgtgcagtaaaattgttaaagttgacaggatcagttttggaagatgcttggaaggaaaaaggaaagatggatatggaagaaattattcagagaattgaaaacgttgtcctagatgcaaactgcagtagagatgtaaaacagatgctcttgaagcttgtagaactccggtcaagtaactggggcagagtccatgcaacttcaacatatagagaagcaacaccagaaaatgatcctaactactttatgaatgaaccaacattttatacatctgatggtgttcctttcactgcagctgatccagattaccaagagaaataccaagaattacttgaaagagaggacttttttccagattatgaagaaaatggaacagatttatccggggctggtgatccatacttggatgatattgatgatgagatggacccagagatagaagaagcttatgaaaagttttgtttggaatcagagcgtaagcgaaaacagtaaagttaaatttcagcatatcagttttataaagcagtttaggtatggtgatttagcagaacacaagagagcaagaaaatgtgtcacatctataccaaattaaggatgttgagttatgttactaatgtatgcaactttaattttgtttaacactatctgccaaaataaactttattccctataacttaaaatgtgtatatatatataatagtttattatgtacagttaattctactgttttggctgcaataaaatcgattttgaaataaatgaaatgttgaaaattttgctagttggttagatgcttatcctttaaattctacttttcttgaggggaaaaagtcttcgtctggaaatacatattactgcaaaaatgtagcatccttttttaggtaggagtattatagctttcattttagtttgacatttagtgtcccaatgaattgaatttcaaatatgaatcataatcttgaaaatctttagcactaaagtcttggaatatatcaacaactgatttacatatgcagatgctatttgataccaagggctttttaaatgtcatgggggggaaaaacccaacttggtgaactcccagctaaacaaccaagacttcactgaagatttattccaattctagaattgttcttttttatttttattttttcaactgactaacttcattaccttaaagcctagaacattattctgctttatttatatggctttctcacttttattttgtagcatgggttgcatcgacttttttactagagaattttactagatatttgtcattcaagttttcatctgctttataattgatacaccttgagggtcacttttctaatacttttactataatgtggtaccacctcagccctaataaataatatttttacctaatgtcaaatctttttccagctaactaaaaactgtgtacaaaaggattgcttgtaaatatgcatgtaaatagttctgttaataacccactgttttacatttggtacatctgtgtctgctaatacagttagctttctcacttttctgcttgtttgttcagtctgaattaaaattagactttgaaaataaagcttaaatagttgtttcctctaaaaaaaatatt

SEQ ID NO: 104404 - DNA, 1347 bp, Homo sapiens
cccctccccgccccttccccccagcgctcagggatccagattaccaagagaaataccaagaattacttgaaagagaggacttttttccagattatgaagaaaatggaacagatttatccggggctggtgatccatacttggatgatattgatgatgagatggacccagagatagaagaagcttatgaaaagttttgtttggaatcagagcgtaagcgaaaacagtaaagttaaatttcagcatatcagttttataaagcagtttaggtatggtgatttagcagaacacaagagagcaagaaaatgtgtcacatctataccaaattaaggatgttgagttatgttactaatgtatgcaactttaattttgtttaacactatctgccaaaataaactttattccctataacttaaaatgtgtatatatatataatagtttattatgtacagttaattctactgttttggctgcaataaaatcgattttgaaataaatgaaatgttgaaaattttgctagttggttagatgcttatcctttaaattctacttttcttgaggggaaaaagtcttcgtctggaaatacatattactgcaaaaatgtagcatccttttttaggtaggagtattatagctttcattttagtttgacatttagtgtcccaatgaattgaatttcaaatatgaatcataatcttgaaaatctttagcactaaagtcttggaatatatcaacaactgatttacatatgcagatgctatttgataccaagggctttttaaatgtcatgggggggaaaaacccaacttggtgaactcccagctaaacaaccaagacttcactgaagatttattccaattctagaattgttcttttttatttttattttttcaactgactaacttcattaccttaaagcctagaacattattctgctttatttatatggctttctcacttttattttgtagcatgggttgcatcgacttttttactagagaattttactagatatttgtcattcaagttttcatctgctttataattgatacaccttgagggtcacttttctaatacttttactataatgtggtaccacctcagccctaataaataatatttttacctaatgtcaaatctttttccagctaactaaaaactgtgtacaaaaggattgcttgtaaatatgcatgtaaatagttctgttaataacccactgttttacatttggtacatctgtgtctgctaatacagttagctttctcacttttctgcttgtttgttcagtctgaattaaaattagactttgaaaataaagcttaaatagttgtttcctctaaaaaaaatatt

SEQ ID NO: 104405 - DNA, 1441 bp, Homo sapiens
  misc_feature (27)..(27): n is a, c, g, or t
  misc_feature (51)..(51): n is a, c, g, or t
  misc_feature (69)..(69): n is a, c, g, or t
  misc_feature (116)..(116): n is a, c, g, or t
ggggcccccagaacccggaaaaatttncccctcccccaaataaagccattngggtggccccgaagaccngcccataatggaaatccccaaaggtagggcctgtggtcccataatanccccagcccaggaaaggtgtattaccattatttttttccatgatttagcaccctacctttcctgagttgaaaaacccctacacctatgaatccatcctttgcttttacagataccttggatgatattgatgatgagatggacccagagatagaagaagcttatgaaaagttttgtttggaatcagagcgtaagcgaaaacagtaaagttaaatttcagcatatcagttttataaagcagtttaggtatggtgatttagcagaacacaagagagcaagaaaatgtgtcacatctataccaaattaaggatgttgagttatgttactaatgtatgcaactttaattttgtttaacactatctgccaaaataaactttattccctataacttaaaatgtgtatatatatataatagtttattatgtacagttaattctactgttttggctgcaataaaatcgattttgaaataaatgaaatgttgaaaattttgctagttggttagatgcttatcctttaaattctacttttcttgaggggaaaaagtcttcgtctggaaatacatattactgcaaaaatgtagcatccttttttaggtaggagtattatagctttcattttagtttgacatttagtgtcccaatgaattgaatttcaaatatgaatcataatcttgaaaatctttagcactaaagtcttggaatatatcaacaactgatttacatatgcagatgctatttgataccaagggctttttaaatgtcatgggggggaaaaacccaacttggtgaactcccagctaaacaaccaagacttcactgaagatttattccaattctagaattgttcttttttatttttattttttcaactgactaacttcattaccttaaagcctagaacattattctgctttatttatatggctttctcacttttattttgtagcatgggttgcatcgacttttttactagagaattttactagatatttgtcattcaagttttcatctgctttataattgatacaccttgagggtcacttttctaatacttttactataatgtggtaccacctcagccctaataaataatatttttacctaatgtcaaatctttttccagctaactaaaaactgtgtacaaaaggattgcttgtaaatatgcatgtaaatagttctgttaataacccactgttttacatttggtacatctgtgtctgctaatacagttagctttctcacttttctgcttgtttgttcagtctgaattaaaattagactttgaaaataaagcttaaatagttgtttcctctaaaaaaaatatt

SEQ ID NO: 104406 - DNA, 2659 bp, Homo sapiens
cccacgcgtgagaactggaaagccgagggtagccgagcggggcgggcgctctggagcggcgggtgctcgggctgccgtccgctccgccagaagcaccgagcagccgagccggggcccgccgccctcctcctccatgaggcccgagtgaggcgcggcggctatagccgacccgcggcgccttccccccgcgtcctatcgcgagcgcagcggcagcggcccctggaggaggaggcggaggaggaggagcatgtcggacggtttcgatcgggccccaggtgctggtcggggccggagccggggcctgggccgcggagggggcgggcctgagggcggcggtttcccgaacggagcggggcctgctgagcgggcgcggcaccagccgccgcaacccaaagccccgggcttcctgcagccaccgccgctgcgccagcccaggacgaccccgccgccaggggcccagtgcgaggtccccgccagcccccagcggccttcccggcccggggcgctcccagagcaaacgaggcccctgagagctccacctagttcacaggataaaatcccacagcagaactcggagtcagcaatggctaagccccaggtggttgtagctcctgtattaatgtctaagctgtctgtgaatgcccctgaattttacccttcaggttattcttccagttacacagaatcctatgaggatggttgtgaggattatcctactctatcagaatatgttcaggattttttgaatcatcttacagagcagcctggcagttttgaaactgaaattgaacagtttgcagagaccctgaatggttgtgttacaacagatgatgctttgcaagaacttgtggaactcatctatcaacaggccacatctatcccaaatttctcttatatgggagctcgcctgtgtaattacctgtcccatcatctgacaattagcccacagagtggcaacttccgccaattgctacttcaaagatgtcggactgaatatgaagttaaagatcaagctgcaaaaggggatgaagttactcgaaaacgatttcatgcatttgtactctttctgggagaactttatcttaacctggagatcaagggaacaaatggacaggttacaagagcagatattcttcaggttggtcttcgagaattgctgaatgccctgttttctaatcctatggatgacaatttaatttgtgcagtaaaattgttaaagttgacaggatcagttttggaagatgcttggaaggaaaaaggaaagatggatatggaagaaattattcagagaattgaaaacgttgtcctagatgcaaactgcagtagagatgtaaaacagatgctcttgaagcttgtagaactccggtcaagtaactggggcagagtccatgcaacttcaacatatagagaagcaacaccagaaaatgatcctaactactttatgaatgaaccaacattttatacatctgatggtgttcctttcactgcagctgatccagattaccaagagaaataccaagaattacttgaaagagaggacttttttccagattatgaagaaaatggaacagatttatccggggctggtgatccatacttggatgatattgatgatgagatggacccagagatagaagaagcttatgaaaagttttgtttggaatcagagcgtaagcgaaaacagtaaagttaaatttcagcatatcagttttataaagcagtttaggtatggtgatttagcagaacacaagagagcaagaaaatgtgtcacatctataccaaattaaggatgttgagttatgttactaatgtatgcaactttaattttgtttaacactatctgccaaaataaactttattccctataacttaaaatgtgtatatatatataatagtttattatgtacagttaattctactgttttggctgcaataaaatcgattttgaaataaatgaaatgttgaaaattttgctagttggttagatgcttatcctttaaattctacttttcttgaggggaaaaagtcttcgtctggaaatacatattactgcaaaaatgtagcatccttttttaggtaggagtattatagctttcattttagtttgacatttagtgtcccaatgaattgaatttcaaatatgaatcataatcttgaaaatctttagcactaaagtcttggaatatatcaacaactgatttacatatgcagatgctatttgataccaagggctttttaaatgtcatgggggggaaaaacccaacttggtgaactcccagctaaacaaccaagacttcactgaagatttattccaattctagaattgttcttttttatttttattttttcaactgactaacttcattaccttaaagcctagaacattattctgctttatttatatggctttctcacttttattttgtagcatgggttgcatcgacttttttactagagaattttactagatatttgtcattcaagttttcatctgctttataattgatacaccttgagggtcacttttctaatacttttactataatgtggtaccacctcagccctaataaataatatttttacctaatgtcaaatctttttccagctaactaaaaactgtgtacaaaaggatgctgttcactggggccgagctcgacgg

SEQ ID NO: 104407 - DNA, 2567 bp, Homo sapiens
cccacgcgtgagaactggaaagccgagggtagccgagcggggcgggcgctctggagcggcgggtgctcgggctgccgtccgctccgccagaagcaccgagcagccgagccggggcccgccgccctcctcctccatgaggcccgagtgaggcgcggcggctatagccgacccgcggcgccttccccccgcgtcctatcgcgagcgcagcggcagcggcccctggaggaggaggcggaggaggaggagcatgtcggacggtttcgatcggccagagcaaacgaggcccctgagagctccacctagttcacaggataaaatcccacagcagaactcggagtcagcaatggctaagccccaggtggttgtagctcctgtattaatgtctaagctgtctgtgaatgcccctgaattttacccttcaggttattcttccagttacacagaatcctatgaggatggttgtgaggattatcctactctatcagaatatgttcaggattttttgaatcatcttacagagcagcctggcagttttgaaactgaaattgaacagtttgcagagaccctgaatggttgtgttacaacagatgatgctttgcaagaacttgtggaactcatctatcaacaggccacatctatcccaaatttctcttatatgggagctcgcctgtgtaattacctgtcccatcatctgacaattagcccacagagtggcaacttccgccaattgctacttcaaagatgtcggactgaatatgaagttaaagatcaagctgcaaaaggggatgaagttactcgaaaacgatttcatgcatttgtactctttctgggagaactttatcttaacctggagatcaagggaacaaatggacaggttacaagagcagatattcttcaggttggtcttcgagaattgctgaatgccctgttttctaatcctatggatgacaatttaatttgtgcagtaaaattgttaaagttgacaggatcagttttggaagatgcttggaaggaaaaaggaaagatggatatggaagaaattattcagagaattgaaaacgttgtcctagatgcaaactgcagtagagatgtaaaacagatgctcttgaagcttgtagaactccggtcaagtaactggggcagagtccatgcaacttcaacatatagagaagcaacaccagaaaatgatcctaactactttatgaatgaaccaacattttatacatctgatggtgttcctttcactgcagctgatccagattaccaagagaaataccaagaattacttgaaagagaggacttttttccagattatgaagaaaatggaacagatttatccggggctggtgatccatacttggatgatattgatgatgagatggacccagagatagaagaagcttatgaaaagttttgtttggaatcagagcgtaagcgaaaacagtaaagttaaatttcagcatatcagttttataaagcagtttaggtatggtgatttagcagaacacaagagagcaagaaaatgtgtcacatctataccaaattaaggatgttgagttatgttactaatgtatgcaactttaattttgtttaacactatctgccaaaataaactttattccctataacttaaaatgtgtatatatatataatagtttattatgtacagttaattctactgttttggctgcaataaaatcgattttgaaataaatgaaatgttgaaaattttgctagttggttagatgcttatcctttaaattctacttttcttgaggggaaaaagtcttcgtctggaaatacatattactgcaaaaatgtagcatccttttttaggtaggagtattatagctttcattttagtttgacatttagtgtcccaatgaattgaatttcaaatatgaatcataatcttgaaaatctttagcactaaagtcttggaatatatcaacaactgatttacatatgcagatgctatttgataccaagggctttttaaatgtcatgggggggaaaaacccaacttggtgaactcccagctaaacaaccaagacttcactgaagatttattccaattctagaattgttcttttttatttttattttttcaactgactaacttcattaccttaaagcctagaacattattctgctttatttatatggctttctcacttttattttgtagcatgggttgcatcgacttttttactagagaattttactagatatttgtcattcaagttttcatctgctttataattgatacaccttgagggtcacttttctaatacttttactataatgtggtaccacctcagccctaataaataatatttttacctaatgtcaaatctttttccagctaactaaaaactgtgtacaaaaggattgcttgtaaatatgcatgtaaatagttctgttaataacccactgttttacatttggtacatctgtgtctgctaatacagttagctttctcacttttctgcttgtttgttcagtctgaattaaaattagactttgaaaataaagcttaaatagttgtttcctctaaaaaaaatatt

SEQ ID NO: 104408 - DNA, 2482 bp, Homo sapiens
agcgggatggggggaggggccgggtgcgcggtctcggagttcggggtcccgggaggaagtaaaaatcgcctcccctcagcagccctctaaagcgagaccctagcgagtaaccacctcttttccaccgacccctttaaaacgacagagaggaaaaaagctcgcaagcactcatttgagaggcagccagagcaaacgaggcccctgagagctccacctagttcacaggataaaatcccacagcagaactcggagtcagcaatggctaagccccaggtggttgtagctcctgtattaatgtctaagctgtctgtgaatgcccctgaattttacccttcaggttattcttccagttacacagaatcctatgaggatggttgtgaggattatcctactctatcagaatatgttcaggattttttgaatcatcttacagagcagcctggcagttttgaaactgaaattgaacagtttgcagagaccctgaatggttgtgttacaacagatgatgctttgcaagaacttgtggaactcatctatcaacaggccacatctatcccaaatttctcttatatgggagctcgcctgtgtaattacctgtcccatcatctgacaattagcccacagagtggcaacttccgccaattgctacttcaaagatgtcggactgaatatgaagttaaagatcaagctgcaaaaggggatgaagttactcgaaaacgatttcatgcatttgtactctttctgggagaactttatcttaacctggagatcaagggaacaaatggacaggttacaagagcagatattcttcaggttggtcttcgagaattgctgaatgccctgttttctaatcctatggatgacaatttaatttgtgcagtaaaattgttaaagttgacaggatcagttttggaagatgcttggaaggaaaaaggaaagatggatatggaagaaattattcagagaattgaaaacgttgtcctagatgcaaactgcagtagagatgtaaaacagatgctcttgaagcttgtagaactccggtcaagtaactggggcagagtccatgcaacttcaacatatagagaagcaacaccagaaaatgatcctaactactttatgaatgaaccaacattttatacatctgatggtgttcctttcactgcagctgatccagattaccaagagaaataccaagaattacttgaaagagaggacttttttccagattatgaagaaaatggaacagatttatccggggctggtgatccatacttggatgatattgatgatgagatggacccagagatagaagaagcttatgaaaagttttgtttggaatcagagcgtaagcgaaaacagtaaagttaaatttcagcatatcagttttataaagcagtttaggtatggtgatttagcagaacacaagagagcaagaaaatgtgtcacatctataccaaattaaggatgttgagttatgttactaatgtatgcaactttaattttgtttaacactatctgccaaaataaactttattccctataacttaaaatgtgtatatatatataatagtttattatgtacagttaattctactgttttggctgcaataaaatcgattttgaaataaatgaaatgttgaaaattttgctagttggttagatgcttatcctttaaattctacttttcttgaggggaaaaagtcttcgtctggaaatacatattactgcaaaaatgtagcatccttttttaggtaggagtattatagctttcattttagtttgacatttagtgtcccaatgaattgaatttcaaatatgaatcataatcttgaaaatctttagcactaaagtcttggaatatatcaacaactgatttacatatgcagatgctatttgataccaagggctttttaaatgtcatgggggggaaaaacccaacttggtgaactcccagctaaacaaccaagacttcactgaagatttattccaattctagaattgttcttttttatttttattttttcaactgactaacttcattaccttaaagcctagaacattattctgctttatttatatggctttctcacttttattttgtagcatgggttgcatcgacttttttactagagaattttactagatatttgtcattcaagttttcatctgctttataattgatacaccttgagggtcacttttctaatacttttactataatgtggtaccacctcagccctaataaataatatttttacctaatgtcaaatctttttccagctaactaaaaactgtgtacaaaaggattgcttgtaaatatgcatgtaaatagttctgttaataacccactgttttacatttggtacatctgtgtctgctaatacagttagctttctcacttttctgcttgtttgttcagtctgaattaaaattagactttgaaaataaagcttaaatagttgtttcctctaaaaaaaatatt

SEQ ID NO: 104409 - DNA, 2333 bp, Homo sapiens
caagatgaaaaagagggcagagttacactgaaagccagagcaaacgaggcccctgagagctccacctagttcacaggataaaatcccacagcagaactcggagtcagcaatggctaagccccaggtggttgtagctcctgtattaatgtctaagctgtctgtgaatgcccctgaattttacccttcaggttattcttccagttacacagaatcctatgaggatggttgtgaggattatcctactctatcagaatatgttcaggattttttgaatcatcttacagagcagcctggcagttttgaaactgaaattgaacagtttgcagagaccctgaatggttgtgttacaacagatgatgctttgcaagaacttgtggaactcatctatcaacaggccacatctatcccaaatttctcttatatgggagctcgcctgtgtaattacctgtcccatcatctgacaattagcccacagagtggcaacttccgccaattgctacttcaaagatgtcggactgaatatgaagttaaagatcaagctgcaaaaggggatgaagttactcgaaaacgatttcatgcatttgtactctttctgggagaactttatcttaacctggagatcaagggaacaaatggacaggttacaagagcagatattcttcaggttggtcttcgagaattgctgaatgccctgttttctaatcctatggatgacaatttaatttgtgcagtaaaattgttaaagttgacaggatcagttttggaagatgcttggaaggaaaaaggaaagatggatatggaagaaattattcagagaattgaaaacgttgtcctagatgcaaactgcagtagagatgtaaaacagatgctcttgaagcttgtagaactccggtcaagtaactggggcagagtccatgcaacttcaacatatagagaagcaacaccagaaaatgatcctaactactttatgaatgaaccaacattttatacatctgatggtgttcctttcactgcagctgatccagattaccaagagaaataccaagaattacttgaaagagaggacttttttccagattatgaagaaaatggaacagatttatccggggctggtgatccatacttggatgatattgatgatgagatggacccagagatagaagaagcttatgaaaagttttgtttggaatcagagcgtaagcgaaaacagtaaagttaaatttcagcatatcagttttataaagcagtttaggtatggtgatttagcagaacacaagagagcaagaaaatgtgtcacatctataccaaattaaggatgttgagttatgttactaatgtatgcaactttaattttgtttaacactatctgccaaaataaactttattccctataacttaaaatgtgtatatatatataatagtttattatgtacagttaattctactgttttggctgcaataaaatcgattttgaaataaatgaaatgttgaaaattttgctagttggttagatgcttatcctttaaattctacttttcttgaggggaaaaagtcttcgtctggaaatacatattactgcaaaaatgtagcatccttttttaggtaggagtattatagctttcattttagtttgacatttagtgtcccaatgaattgaatttcaaatatgaatcataatcttgaaaatctttagcactaaagtcttggaatatatcaacaactgatttacatatgcagatgctatttgataccaagggctttttaaatgtcatgggggggaaaaacccaacttggtgaactcccagctaaacaaccaagacttcactgaagatttattccaattctagaattgttcttttttatttttattttttcaactgactaacttcattaccttaaagcctagaacattattctgctttatttatatggctttctcacttttattttgtagcatgggttgcatcgacttttttactagagaattttactagatatttgtcattcaagttttcatctgctttataattgatacaccttgagggtcacttttctaatacttttactataatgtggtaccacctcagccctaataaataatatttttacctaatgtcaaatctttttccagctaactaaaaactgtgtacaaaaggattgcttgtaaatatgcatgtaaatagttctgttaataacccactgttttacatttggtacatctgtgtctgctaatacagttagctttctcacttttctgcttgtttgttcagtctgaattaaaattagactttgaaaataaagcttaaatagttgtttcctctaaaaaaaatatt

SEQ ID NO: 104410 - DNA, 2292 bp, Homo sapiens
caagatgaaaaagagggcagagttacactgaaagccagagcaaacgaggcccctgagagctccacctagttcacaggataaaatcccacagcagaactcggagtcagcaatggctaagccccagggcccctgaattttacccttcaggttattcttccagttacacagaatcctatgaggatggttgtgaggattatcctactctatcagaatatgttcaggattttttgaatcatcttacagagcagcctggcagttttgaaactgaaattgaacagtttgcagagaccctgaatggttgtgttacaacagatgatgctttgcaagaacttgtggaactcatctatcaacaggccacatctatcccaaatttctcttatatgggagctcgcctgtgtaattacctgtcccatcatctgacaattagcccacagagtggcaacttccgccaattgctacttcaaagatgtcggactgaatatgaagttaaagatcaagctgcaaaaggggatgaagttactcgaaaacgatttcatgcatttgtactctttctgggagaactttatcttaacctggagatcaagggaacaaatggacaggttacaagagcagatattcttcaggttggtcttcgagaattgctgaatgccctgttttctaatcctatggatgacaatttaatttgtgcagtaaaattgttaaagttgacaggatcagttttggaagatgcttggaaggaaaaaggaaagatggatatggaagaaattattcagagaattgaaaacgttgtcctagatgcaaactgcagtagagatgtaaaacagatgctcttgaagcttgtagaactccggtcaagtaactggggcagagtccatgcaacttcaacatatagagaagcaacaccagaaaatgatcctaactactttatgaatgaaccaacattttatacatctgatggtgttcctttcactgcagctgatccagattaccaagagaaataccaagaattacttgaaagagaggacttttttccagattatgaagaaaatggaacagatttatccggggctggtgatccatacttggatgatattgatgatgagatggacccagagatagaagaagcttatgaaaagttttgtttggaatcagagcgtaagcgaaaacagtaaagttaaatttcagcatatcagttttataaagcagtttaggtatggtgatttagcagaacacaagagagcaagaaaatgtgtcacatctataccaaattaaggatgttgagttatgttactaatgtatgcaactttaattttgtttaacactatctgccaaaataaactttattccctataacttaaaatgtgtatatatatataatagtttattatgtacagttaattctactgttttggctgcaataaaatcgattttgaaataaatgaaatgttgaaaattttgctagttggttagatgcttatcctttaaattctacttttcttgaggggaaaaagtcttcgtctggaaatacatattactgcaaaaatgtagcatccttttttaggtaggagtattatagctttcattttagtttgacatttagtgtcccaatgaattgaatttcaaatatgaatcataatcttgaaaatctttagcactaaagtcttggaatatatcaacaactgatttacatatgcagatgctatttgataccaagggctttttaaatgtcatgggggggaaaaacccaacttggtgaactcccagctaaacaaccaagacttcactgaagatttattccaattctagaattgttcttttttatttttattttttcaactgactaacttcattaccttaaagcctagaacattattctgctttatttatatggctttctcacttttattttgtagcatgggttgcatcgacttttttactagagaattttactagatatttgtcattcaagttttcatctgctttataattgatacaccttgagggtcacttttctaatacttttactataatgtggtaccacctcagccctaataaataatatttttacctaatgtcaaatctttttccagctaactaaaaactgtgtacaaaaggattgcttgtaaatatgcatgtaaatagttctgttaataacccactgttttacatttggtacatctgtgtctgctaatacagttagctttctcacttttctgcttgtttgttcagtctgaattaaaattagactttgaaaataaagcttaaatagttgtttcctctaaaaaaaatatt

SEQ ID NO: 104411 - DNA, 1980 bp, Homo sapiens
  misc_feature (1)..(1): n is a, c, g, or t
  misc_feature (25)..(25): n is a, c, g, or t
ntcgtgtcgtcactgactctcttancctaccacggctaacggccacatctatcccaaatttctcttatatgggagctcgcctgtgtaattacctgtcccatcatctgacaattagcccacagagtggcaacttccgccaattgctacttcaaagatgtcggactgaatatgaagttaaagatcaagctgcaaaaggggatgaagttactcgaaaacgatttcatgcatttgtactctttctgggagaactttatcttaacctggagatcaagggaacaaatggacaggttacaagagcagatattcttcaggttggtcttcgagaattgctgaatgccctgttttctaatcctatggatgacaatttaatttgtgcagtaaaattgttaaagttgacaggatcagttttggaagatgcttggaaggaaaaaggaaagatggatatggaagaaattattcagagaattgaaaacgttgtcctagatgcaaactgcagtagagatgtaaaacagatgctcttgaagcttgtagaactccggtcaagtaactggggcagagtccatgcaacttcaacatatagagaagcaacaccagaaaatgatcctaactactttatgaatgaaccaacattttatacatctgatggtgttcctttcactgcagctgatccagattaccaagagaaataccaagaattacttgaaagagaggacttttttccagattatgaagaaaatggaacagatttatccggggctggtgatccatacttggatgatattgatgatgagatggacccagagatagaagaagcttatgaaaagttttgtttggaatcagagcgtaagcgaaaacagtaaagttaaatttcagcatatcagttttataaagcagtttaggtatggtgatttagcagaacacaagagagcaagaaaatgtgtcacatctataccaaattaaggatgttgagttatgttactaatgtatgcaactttaattttgtttaacactatctgccaaaataaactttattccctataacttaaaatgtgtatatatatataatagtttattatgtacagttaattctactgttttggctgcaataaaatcgattttgaaataaatgaaatgttgaaaattttgctagttggttagatgcttatcctttaaattctacttttcttgaggggaaaaagtcttcgtctggaaatacatattactgcaaaaatgtagcatccttttttaggtaggagtattatagctttcattttagtttgacatttagtgtcccaatgaattgaatttcaaatatgaatcataatcttgaaaatctttagcactaaagtcttggaatatatcaacaactgatttacatatgcagatgctatttgataccaagggctttttaaatgtcatgggggggaaaaacccaacttggtgaactcccagctaaacaaccaagacttcactgaagatttattccaattctagaattgttcttttttatttttattttttcaactgactaacttcattaccttaaagcctagaacattattctgctttatttatatggctttctcacttttattttgtagcatgggttgcatcgacttttttactagagaattttactagatatttgtcattcaagttttcatctgctttataattgatacaccttgagggtcacttttctaatacttttactataatgtggtaccacctcagccctaataaataatatttttacctaatgtcaaatctttttccagctaactaaaaactgtgtacaaaaggattgcttgtaaatatgcatgtaaatagttctgttaataacccactgttttacatttggtacatctgtgtctgctaatacagttagctttctcacttttctgcttgtttgttcagtctgaattaaaattagactttgaaaataaagcttaaatagttgtttcctctaaaaaaaatatt

SEQ ID NO: 104412 - DNA, 1887 bp, Homo sapiens
tgctttgggtaacaataataatggcatggattttaacttacagaagtaacacaaaaaagaaaaaaagttaagataagggagtgttgtaaaattaaatgcctaagcagcatatttaactggtgatcaagaaagtgactaaacttgatgctaaaacataattaaaacattcctacattttcatataaaatatatgtcaaatattggcttacatttccaaatgacagcaagttaatgtagccaatgacgttatttattcaaccaagagtgtcgctttaatttgtgcagtaaaattgttaaagttgacaggatcagttttggaagatgcttggaaggaaaaaggaaagatggatatggaagaaattattcagagaattgaaaacgttgtcctagatgcaaactgcagtagagatgtaaaacagatgctcttgaagcttgtagaactccggtcaagtaactggggcagagtccatgcaacttcaacatatagagaagcaacaccagaaaatgatcctaactactttatgaatgaaccaacattttatacatctgatggtgttcctttcactgcagctgatccagattaccaagagaaataccaagaattacttgaaagagaggacttttttccagattatgaagaaaatggaacagatttatccggggctggtgatccatacttggatgatattgatgatgagatggacccagagatagaagaagcttatgaaaagttttgtttggaatcagagcgtaagcgaaaacagtaaagttaaatttcagcatatcagttttataaagcagtttaggtatggtgatttagcagaacacaagagagcaagaaaatgtgtcacatctataccaaattaaggatgttgagttatgttactaatgtatgcaactttaattttgtttaacactatctgccaaaataaactttattccctataacttaaaatgtgtatatatatataatagtttattatgtacagttaattctactgttttggctgcaataaaatcgattttgaaataaatgaaatgttgaaaattttgctagttggttagatgcttatcctttaaattctacttttcttgaggggaaaaagtcttcgtctggaaatacatattactgcaaaaatgtagcatccttttttaggtaggagtattatagctttcattttagtttgacatttagtgtcccaatgaattgaatttcaaatatgaatcataatcttgaaaatctttagcactaaagtcttggaatatatcaacaactgatttacatatgcagatgctatttgataccaagggctttttaaatgtcatgggggggaaaaacccaacttggtgaactcccagctaaacaaccaagacttcactgaagatttattccaattctagaattgttcttttttatttttattttttcaactgactaacttcattaccttaaagcctagaacattattctgctttatttatatggctttctcacttttattttgtagcatgggttgcatcgacttttttactagagaattttactagatatttgtcattcaagttttcatctgctttataattgatacaccttgagggtcacttttctaatacttttactataatgtggtaccacctcagccctaataaataatatttttacctaatgtcaaatctttttccagctaactaaaaactgtgtacaaaaggattgcttgtaaatatgcatgtaaatagttctgttaataacccactgttttacatttggtacatctgtgtctgctaatacagttagctttctcacttttctgcttgtttgttcagtctgaattaaaattagactttgaaaataaagcttaaatagttgtttcctctaaaaaaaatatt

SEQ ID NO: 104413 - DNA, 1285 bp, Homo sapiens
cccacgcgtgagaactggaaagccgagggtagccgagcggggcgggcgctctggagcggcgggtgctcgggctgccgtccgctccgccagaagcaccgagcagccgagccggggcccgccgccctcctcctccatgaggcccgagtgaggcgcggcggctatagccgacccgcggcgccttccccccgcgtcctatcgcgagcgcagcggcagcggcccctggaggaggaggcggaggaggaggagcatgtcggacggtttcgatcggccagagcaaacgaggcccctgagagctccacctagttcacaggataaaatcccacagcagaactcggagtcagcaatggctaagccccaggtggttgtagctcctgtattaatgtctaagctgtctgtgaatgcccctgaattttacccttcaggttattcttccagttacacagaatcctatgaggatggttgtgaggattatcctactctatcagaatatgttcaggattttttgaatcatcttacagagcagcctggcagttttgaaactgaaattgaacagtttgcagagaccctgaatggttgtgttacaacagatgatgctttgcaagaacttgtggaactcatctatcaacaggccacatctatcccaaatttctcttatatgggagctcgcctgtgtaattacctgtcccatcatctgacaattagcccacagagtggcaacttccgccaattgctacttcaaagatgtcggactgaatatgaagttaaagatcaagctgcaaaaggggatgaagttactcgaaaacgatttcatgcatttgtactctttctgggagaactttatcttaacctggagatcaagggaacaaatggacaggttacaagagcagatattcttcaggttggtcttcgagaattgctgaatgccctgttttctaatcctatggatgacaatttaatttgtgcagtaaaattgttaaagttgacaggatcagttttggaagatgcttggaaggaaaaaggaaagatggatatggaagaaattattcagagaattgaaaacgttgtcctagatgcaaactgcagtagagatgtaaaacagatgctcttgaagcttgtagaactccggtcaagtaactggggcagagtccatgcaacttcaacatatagagaagcaacaccagaaaatgatcctaactactttatgaatgaaccaacattttatacatctgatggtgttcctttcactgcagctatcagatacgatatgtggggatcctctaggtcc

SEQ ID NO: 104414 - DNA, 4052 bp, Homo sapiens
tagccttcctgtgtccttcccacccttagtcccaggcatctgactaccgggaacctcagccagagtccgggagccccccaccccgtccaggagccaacagagcccccgtcttgctggcgtgagaatacattgctctcctttggttgaatcagctgtccctcttcgtgggaaaatgaaccagaagacaatcctcgtgctcctcattctggccgtcatcaccatctttgccttggtttgtgtcctgctggtgggcaggggtggagatgggggtgaacccagccagcttccccattgcccctctgtatctcccagtgcccagccttggacacaccctggccagagccagctgtttgcagacctgagccgagaggagctgacggctgtgatgcgctttctgacccagcggctggggccagggctggtggatgcagcccaggcccggccctcggacaactgtgtcttctcagtggagttgcagctgcctcccaaggctgcagccctggctcacttggacagggggagccccccacctgcccgggaggcactggccatcgtcttctttggcaggcaaccccagcccaacgtgagtgagctggtggtggggccactgcctcacccctcctacatgcgggacgtgactgtggagcgtcatggaggccccctgccctatcaccgacgccccgtgctgttccaagagtacctggacatagaccagatgatcttcaacagagagctgccccaggcttctgggcttctccaccactgttgcttctacaagcaccggggacggaacctggtgacaatgaccacggctccccgtggtctgcaatcaggggaccgggccacctggtttggcctctactacaacatctcgggcgctgggttcttcctgcaccacgtgggcttggagctgctagtgaaccacaaggcccttgaccctgcccgctggactatccagaaggtgttctatcaaggccgctactacgacagcctggcccagctggaggcccagtttgaggccggcctggtgaatgtggtgctgatcccagacaatggcacaggtgggtcctggtccctgaagtcccctgtgcccccgggtccagctccccctctacagttctatccccaaggcccccgcttcagtgtccagggaagtcgagtggcctcctcactgtggactttctcctttggcctcggagcattcagtggcccaaggatctttgacgttcgcttccaaggagaaagactagtttatgagataagcctccaagaggccttggccatctatggtggaaattccccagcagcaatgacgacccgctatgtggatggaggctttggcatgggcaagtacaccacgcccctgacccgtggggtggactgcccctacttggccacctacgtggactggcacttccttttggagtcccaggcccccaagacaatacgtgatgccttttgtgtgtttgaacagaaccagggcctccccctgcggcgacaccactcagatctctactcgcactactttgggggtcttgcggaaacggtgctggtcgtcagatctatgtccaccttgctcaactatgactatgtgtgggatacggtcttccaccccagtggggccatagaaatacgattctatgccacgggctacatcagctcggcattcctctttggtgctactgggaagtacgggaaccaagtgtcagagcacaccctgggcacggtccacacccacagcgcccacttcaaggtggatctggatgtagcaggactggagaactgggtctgggccgaggatatggtctttgtccccatggctgtgccctggagccctgagcaccagctgcagaggctgcaggtgacccggaagctgctggagatggaggagcaggccgccttcctcgtgggaagcgccacccctcgctacctgtacctggccagcaaccacagcaacaagtggggtcacccccggggctaccgcatccagatgctcagctttgctggagagccgctgccccaaaacagctccatggcgagaggcttcagctgggagaggtaccagctggctgtgacccagcggaaggaggaggagcccagtagcagcagcgttttcaatcagaatgacccttgggcccccactgtggatttcagtgacttcatcaacaatgagaccattgctggaaaggatttggtggcctgggtgacagctggttttctgcatatcccacatgcagaggacattcctaacacagtgactgtggggaacggcgtgggcttcttcctccgaccctataacttctttgacgaagacccctccttctactctgccgactccatctacttccgaggggaccaggatgctggggcctgcgaggtcaaccccctagcttgcctgccccaggctgctgcctgtgcccccgacctccctgccttctcccacgggggcttctctcacaactaggcggtcctgggatggggcatgtggccaagggctccagggccagggtgtgagggatggggagcagctgggcactgggccggcagcctggttccctctttcctgtgccaggactctctttcttccactaccctccctcgcatccgcctctgagccaggagcctcctgaccctgtgatgcctgacacaggggacactgaaccttgttgatgccagctgtactgagttctcatccacagaggccaggcatggcccagcctggagccgtggccgagggcttccctagatggttccctttgttgctgtctggctttcccgaatctttttaggccacctccaaggactctaaaagggggctattccctggagaccccagagtagggttgccagtcctgcaagtccatagctgagctggaaaggatgcttctgctcacattccctctcatccaggtcctttccttctcgtcttcctctctctcacctacttcctcctcctcctcctgttcctgccttctcttctatcctgcaatttctcccgaatcctgaggggatatccctatgtcccagcccctggtactcccccagccctcagttttcagtcaagttccgtctcctctccagccctatggaagtctcaaggtcacgggacccctaatcagagtggccaatccctgtgtgtcgttcccttgtgtctgttgcttattgggagtaggagttgctcctacccctgtcctggggctgggtgtgtttcaggacagctgcttctgtgcatttgtgtctgcctgcctcatgctctctatagaggaggatggtcatcgtgacagcagcagctcaagttagcatttcaagtgatttgggggtgcaatgataatgaagaatggccattttgtaccagggctctgtattctgcaacagcctgtttgggaggctggagtggaaacaaagggtgggcatcaaagatgagaagccaaagcccctacaactccagccacccagccaggaggggctgtccaatcacattcaggcatgcgaatgagctgggccctgggtgaggtgggggtctggcctagtggggaggggcctggcctgggtggggcagggcctggcctggtccaggcttgggctccattcccatcactgctgtccctcctgaggtctggattggggatggggacaaagaaatagcaagagatgagaaacaacagaaacttttttctctaaaggactggttaaatcaattctgatacagccttacaatacaatagtatgcagctaaaaaataattgtatgtctttatatactaatatgtaataatcttcaggtgaaaaaggcaagccacagaaatgtgtatagcgcacttcccatttgtgtttcagaaaggagtagaatataaacacataattgcttatgtatgcctattcagaataaatgggtaacactgattacttttgggaggggaaccagtaggttgaggacaggagagggaagggtcttaacacttacacccttttgtacattttgaattttgaaccatgtgactgtattacctattcaaaataaacaataaatgggcccaaacaggaaaaaaaaat

SEQ ID NO: 104415 - DNA, 4092 bp, Homo sapiens
tagccttcctgtgtccttcccacccttagtcccaggcatctgactaccgggaacctcagccagagtccgggagccccccaccccgtccaggagccaacagagcccccgtcttgctggcgtgagaatacattgctctcctttggttgaatcagctgtccctcttcgtgggaaaatgaaccagaagacaatcctcgtgctcctcattctggccgtcatcaccatctttgccttggtttgtgtcctgctggtgggcaggggtggagatgggggtgaacccagccagcttccccattgcccctctgtatctcccagtgcccagccttggacacaccctggccagagccagctgtttgcagacctgagccgagaggagctgacggctgtgatgcgctttctgacccagcggctggggccagggctggtggatgcagcccaggcccggccctcggacaactgtgtcttctcagtggagttgcagctgcctcccaaggctgcagccctggctcacttggacagggggagccccccacctgcccgggaggcactggccatcgtcttctttggcaggcaaccccagcccaacgtgagtgagctggtggtggggccactgcctcacccctcctacatgcgggacgtgactgtggagcgtcatggaggccccctgccctatcaccgacgccccgtgctgttccaagagtacctggacatagaccagatgatcttcaacagagagctgccccaggcttctgggcttctccaccactgttgcttctacaagcaccggggacggaacctggtgacaatgaccacggctccccgtggtctgcaatcaggggaccgggccacctggtttggcctctactacaacatctcgggcgctgggttcttcctgcaccacgtgggcttggagctgctagtgaaccacaaggcccttgaccctgcccgctggactatccagaaggtgttctatcaaggccgctactacgacagcctggcccagctggaggcccagtttgaggccggcctggtgaatgtggtgctgatcccagacaatggcacaggtgggtcctggtccctgaagtcccctgtgcccccgggtccagctccccctctacagttctatccccaaggcccccgcttcagtgtccagggaagtcgagtggcctcctcactgtggactttctcctttggcctcggagcattcagtggcccaaggatctttgacgttcgcttccaaggagaaagactagtttatgagataagcctccaagaggccttggccatctatggtggaaattccccagcagcaatgacgacccgctatgtggatggaggctttggcatgggcaagtacaccacgcccctgacccgtggggtggactgcccctacttggccacctacgtggactggcacttccttttggagtcccaggcccccaagacaatacgtgatgccttttgtgtgtttgaacagaaccagggcctccccctgcggcgacaccactcagatctctactcgcactactttgggggtcttgcggaaacggtgctggtcgtcagatctatgtccaccttgctcaactatgactatgtgtgggatacggtcttccaccccagtggggccatagaaatacgattctatgccacgggctacatcagctcggcattcctctttggtgctactgggaagtacgggaaccaagtgtcagagcacaccctgggcacggtccacacccacagcgcccacttcaaggtggatctggatgtagcaggactggagaactgggtctgggccgaggatatggtctttgtccccatggctgtgccctggagccctgagcaccagctgcagaggctgcaggtgacccggaagctgctggagatggaggagcaggccgccttcctcgtgggaagcgccacccctcgctacctgtacctggccagcaaccacagcaacaagtggggtcacccccggggctaccgcatccagatgctcagctttgctggagagccgctgccccaaaacagctccatggcgagaggcttcagctgggagaggtaccagctggctgtgacccagcggaaggaggaggagcccagtagcagcagcgttttcaatcagaatgacccttgggcccccactgtggatttcagtgacttcatcaacaatgagaccattgctggaaaggatttggtggcctgggtgacagctggttttctgcatatcccacatgcagaggacattcctaacacagtgactgtggggaacggcgtgggcttcttcctccgaccctataacttctttgacgaagacccctccttctactctgccgactccatctacttccgaggggaccaggatgctggggcctgcgaggtcaaccccctagcttgcctgccccaggctgctgcctgtgcccccgacctccctgccttctcccacgggggcttctctcacaactaggcggtcctgggatggggcatgtggccaagggctccagggccagggtgtgagggatggggagcagctgggcactgggccggcagcctggttccctctttcctgtgccaggactctctttcttccactaccctccctcgcatccgcctctgagccaggagcctcctgaccctgtgatgcctgacacaggggacactgaaccttgttgatgccagctgtactgagttctcatccacagaggccaggcatggcccagcctggagccgtggccgagggcttccctagatggttccctttgttgctgtctggctttcccgaatctttttaggccacctccaaggactctaaaagggggctattccctggagaccccagagtagggttgccagtcctgcaagtccatagctgagctggaaaggatgcttctgctcacattccctctcatccaggtcctttccttctcgtcttcctctctctcacctacttcctcctcctcctcctgttcctgccttctcttctatcctgcaatttctcccgaatcctgaggggatatccctatgtcccagcccctggtactcccccagccctcagttttcagtcaagttccgtctcctctccagccctatggaagtctcaaggtcacgggacccctaatcagagtggccaatccctgtgtgtcgttcccttgtgtctgttgcttattgggagtaggagttgctcctacccctgtcctggggctgggtgtgtttcaggacagctgcttctgtgcatttgtgtctgcctgcctcatgctctctatagaggaggatggtcatcgtgacagcagcagctcaagttagcatttcaagtgatttgggggtgcaatgataatgaagaatggccattttgtaccagggctctgtattctgcaacagcctgtttgggaggctggagtggaaacaaagggtgggcatcaaagatgagaagccaaagcccctacaactccagccacctcaaagatgagaagccaaagcccctacaactccagccacccagccaggaggggctgtccaatcacattcaggcatgcgaatgagctgggccctgggtgaggtgggggtctggcctagtggggaggggcctggcctgggtggggcagggcctggcctggtccaggcttgggctccattcccatcactgctgtccctcctgaggtctggattggggatggggacaaagaaatagcaagagatgagaaacaacagaaacttttttctctaaaggactggttaaatcaattctgatacagccttacaatacaatagtatgcagctaaaaaataattgtatgtctttatatactaatatgtaataatcttcaggtgaaaaaggcaagccacagaaatgtgtatagcgcacttcccatttgtgtttcagaaaggagtagaatataaacacataattgcttatgtatgcctattcagaataaatgggtaacactgattacttttgggaggggaaccagtaggttgaggacaggagagggaagggtcttaacacttacacccttttgtacattttgaattttgaaccatgtgactgtattacctattcaaaataaacaataaatgggcccaaacaggaaaaaaaaat

SEQ ID NO: 104416 - DNA, 4105 bp, Homo sapiens
  misc_feature (3745)..(3746): n is a, c, g, or t
tagccttcctgtgtccttcccacccttagtcccaggcatctgactaccgggaacctcagccagagtccgggagccccccaccccgtccaggagccaacagagcccccgtcttgctggcgtgagaatacattgctctcctttggttgaatcagctgtccctcttcgtgggaaaatgaaccagaagacaatcctcgtgctcctcattctggccgtcatcaccatctttgccttggtttgtgtcctgctggtgggcaggggtggagatgggggtgaacccagccagcttccccattgcccctctgtatctcccagtgcccagccttggacacaccctggccagagccagctgtttgcagacctgagccgagaggagctgacggctgtgatgcgctttctgacccagcggctggggccagggctggtggatgcagcccaggcccggccctcggacaactgtgtcttctcagtggagttgcagctgcctcccaaggctgcagccctggctcacttggacagggggagccccccacctgcccgggaggcactggccatcgtcttctttggcaggcaaccccagcccaacgtgagtgagctggtggtggggccactgcctcacccctcctacatgcgggacgtgactgtggagcgtcatggaggccccctgccctatcaccgacgccccgtgctgttccaagagtacctggacatagaccagatgatcttcaacagagagctgccccaggcttctgggcttctccaccactgttgcttctacaagcaccggggacggaacctggtgacaatgaccacggctccccgtggtctgcaatcaggggaccgggccacctggtttggcctctactacaacatctcgggcgctgggttcttcctgcaccacgtgggcttggagctgctagtgaaccacaaggcccttgaccctgcccgctggactatccagaaggtgttctatcaaggccgctactacgacagcctggcccagctggaggcccagtttgaggccggcctggtgaatgtggtgctgatcccagacaatggcacaggtgggtcctggtccctgaagtcccctgtgcccccgggtccagctccccctctacagttctatccccaaggcccccgcttcagtgtccagggaagtcgagtggcctcctcactgtggactttctcctttggcctcggagcattcagtggcccaaggatctttgacgttcgcttccaaggagaaagactagtttatgagataagcctccaagaggccttggccatctatggtggaaattccccagcagcaatgacgacccgctatgtggatggaggctttggcatgggcaagtacaccacgcccctgacccgtggggtggactgcccctacttggccacctacgtggactggcacttccttttggagtcccaggcccccaagacaatacgtgatgccttttgtgtgtttgaacagaaccagggcctccccctgcggcgacaccactcagatctctactcgcactactttgggggtcttgcggaaacggtgctggtcgtcagatctatgtccaccttgctcaactatgactatgtgtgggatacggtcttccaccccagtggggccatagaaatacgattctatgccacgggctacatcagctcggcattcctctttggtgctactgggaagtacgggaaccaagtgtcagagcacaccctgggcacggtccacacccacagcgcccacttcaaggtggatctggatgtagcaggactggagaactgggtctgggccgaggatatggtctttgtccccatggctgtgccctggagccctgagcaccagctgcagaggctgcaggtgacccggaagctgctggagatggaggagcaggccgccttcctcgtgggaagcgccacccctcgctacctgtacctggccagcaaccacagcaacaagtggggtcacccccggggctaccgcatccagatgctcagctttgctggagagccgctgccccaaaacagctccatggcgagaggcttcagctgggagaggtaccagctggctgtgacccagcggaaggaggaggagcccagtagcagcagcgttttcaatcagaatgacccttgggcccccactgtggatttcagtgacttcatcaacaatgagaccattgctggaaaggatttggtggcctgggtgacagctggttttctgcatatcccacatgcagaggacattcctaacacagtgactgtggggaacggcgtgggcttcttcctccgaccctataacttctttgacgaagacccctccttctactctgccgactccatctacttccgaggggaccaggatgctggggcctgcgaggtcaaccccctagcttgcctgccccaggctgctgcctgtgcccccgacctccctgccttctcccacgggggcttctctcacaactaggcggtcctgggatggggcatgtggccaagggctccagggccagggtgtgagggatggggagcagctgggcactgggccggcagcctggttccctctttcctgtgccaggactctctttcttccactaccctccctcgcatccgcctctgagccaggagcctcctgaccctgtgatgcctgacacaggggacactgaaccttgttgatgccagctgtactgagttctcatccacagaggccaggcatggcccagcctggagccgtggccgagggcttccctagatggttccctttgttgctgtctggctttcccgaatctttttaggccacctccaaggactctaaaagggggctattccctggagaccccagagtagggttgccagtcctgcaagtccatagctgagctggaaaggatgcttctgctcacattccctctcatccaggtcctttccttctcgtcttcctctctctcacctacttcctcctcctcctcctgttcctgccttctcttctatcctgcaatttctcccgaatcctgaggggatatccctatgtcccagcccctggtactcccccagccctcagttttcagtcaagttccgtctcctctccagccctatggaagtctcaaggtcacgggacccctaatcagagtggccaatccctgtgtgtcgttcccttgtgtctgttgcttattgggagtaggagttgctcctacccctgtcctggggctgggtgtgtttcaggacagctgcttctgtgcatttgtgtctgcctgcctcatgctctctatagaggaggatggtcatcgtgacagcagcagctcaagttagcatttcaagtgatttgggggtgcaatgataatgaagaatggccattttgtaccagggctctgtattctgcaacagcctgtttgggaggctggagtggaaacaaagggtgggcatcaaagatgagaagccaaagcccctacaactccagccacccagccaggaggggctgtccaatcacattcaggcatgcgaatgagctgggccctgggtgaggtgggggtctggcctagtggggaggggcctggcctgggtggggcagggcctggcctggtccaggcttgggctccattcccatcactgctgtccctcctgaggtctggattggggatggggacaaagaaatagcaagagatgagaaacaacagaaacttttttctctaaaggactggttaaatcaattctgatacagccttacaatacaaccgaaggcgcccctttttaccannaattacccccaaaaaatttagaaggggggtagtatgcagctaaaaaataattgtatgtctttatatactaatatgtaataatcttcaggtgaaaaaggcaagccacagaaatgtgtatagcgcacttcccatttgtgtttcagaaaggagtagaatataaacacataattgcttatgtatgcctattcagaataaatgggtaacactgattacttttgggaggggaaccagtaggttgaggacaggagagggaagggtcttaacacttacacccttttgtacattttgaattttgaaccatgtgactgtattacctattcaaaataaacaataaatgggcccaaacaggaaaaaaaaat

SEQ ID NO: 104417 - DNA, 157 bp, Homo sapiens
atggaggcctgaccagtgcctccctaggtaccagctggctgtgacccagcggaaggaggaggagcccagtagcagcagcgttttcaatcagaatgacccttgggcccccactgtggatttcagtgacttcatcaacaatgagaccattgctggaaag

SEQ ID NO: 104418 - DNA, 2530 bp, Homo sapiens
ccggaagttgcctaggccatgctcctctcacaggacaggccagtcagtggtttgtctgtctgcgtggaaagcaagagggtcaacagctttggctaaaggattggaggtatcctggggagagggaagagaaggaggggcacactcagttctgggctgctctttggcccccactctgaagccagatgggggcagagtccagaggggccagggcagttgcctgacaggccctcccctatcccaccctgagcaggactggagaactgggtctgggccgaggatatggtctttgtccccatggctgtgccctggagccctgagcaccagctgcagaggctgcaggtgacccggaagctgctggagatggaggagcaggccgccttcctcgtgggaagcgccacccctcgctacctgtacctggccagcaaccacagcaacaagtggggtcacccccggggctaccgcatccagatgctcagctttgctggagagccgctgccccaaaacagctccatggcgagaggcttcagctgggagaggtaccagctggctgtgacccagcggaaggaggaggagcccagtagcagcagcgttttcaatcagaatgacccttgggcccccactgtggatttcagtgacttcatcaacaatgagaccattgctggaaaggatttggtggcctgggtgacagctggttttctgcatatcccacatgcagaggacattcctaacacagtgactgtggggaacggcgtgggcttcttcctccgaccctataacttctttgacgaagacccctccttctactctgccgactccatctacttccgaggggaccaggatgctggggcctgcgaggtcaaccccctagcttgcctgccccaggctgctgcctgtgcccccgacctccctgccttctcccacgggggcttctctcacaactaggcggtcctgggatggggcatgtggccaagggctccagggccagggtgtgagggatggggagcagctgggcactgggccggcagcctggttccctctttcctgtgccaggactctctttcttccactaccctccctcgcatccgcctctgagccaggagcctcctgaccctgtgatgcctgacacaggggacactgaaccttgttgatgccagctgtactgagttctcatccacagaggccaggcatggcccagcctggagccgtggccgagggcttccctagatggttccctttgttgctgtctggctttcccgaatctttttaggccacctccaaggactctaaaagggggctattccctggagaccccagagtagggttgccagtcctgcaagtccatagctgagctggaaaggatgcttctgctcacattccctctcatccaggtcctttccttctcgtcttcctctctctcacctacttcctcctcctcctcctgttcctgccttctcttctatcctgcaatttctcccgaatcctgaggggatatccctatgtcccagcccctggtactcccccagccctcagttttcagtcaagttccgtctcctctccagccctatggaagtctcaaggtcacgggacccctaatcagagtggccaatccctgtgtgtcgttcccttgtgtctgttgcttattgggagtaggagttgctcctacccctgtcctggggctgggtgtgtttcaggacagctgcttctgtgcatttgtgtctgcctgcctcatgctctctatagaggaggatggtcatcgtgacagcagcagctcaagttagcatttcaagtgatttgggggtgcaatgataatgaagaatggccattttgtaccagggctctgtattctgcaacagcctgtttgggaggctggagtggaaacaaagggtgggcatcaaagatgagaagccaaagcccctacaactccagccacccagccaggaggggctgtccaatcacattcaggcatgcgaatgagctgggccctgggtgaggtgggggtctggcctagtggggaggggcctggcctgggtggggcagggcctggcctggtccaggcttgggctccattcccatcactgctgtccctcctgaggtctggattggggatggggacaaagaaatagcaagagatgagaaacaacagaaacttttttctctaaaggactggttaaatcaattctgatacagccttacaatacaatagtatgcagctaaaaaataattgtatgtctttatatactaatatgtaataatcttcaggtgaaaaaggcaagccacagaaatgtgtatagcgcacttcccatttgtgtttcagaaaggagtagaatataaacacataattgcttatgtatgcctattcagaataaatgggtaacactgattacttttgggaggggaaccagtaggttgaggacaggagagggaagggtcttaacacttacacccttttgtacattttgaattttgaaccatgtgactgtattacctattcaaaataaacaataaatgggcccaaacaggaaaaaaaaat

SEQ ID NO: 104419 - DNA, 2396 bp, Homo sapiens
tagccttcctgtgtccttcccacccttagtcccaggcatctgactaccgggaacctcagccagagtccgggagccccccaccccgtccaggagccaacagagcccccgtcttgctggcgtgagaatacattgctctcctttggttgaatcagctgtccccatggctgtgccctggagccctgagcaccagctgcagaggctgcaggtgacccggaagctgctggagatggaggagcaggccgccttcctcgtgggaagcgccacccctcgctacctgtacctggccagcaaccacagcaacaagtggggtcacccccggggctaccgcatccagatgctcagctttgctggagagccgctgccccaaaacagctccatggcgagaggcttcagctgggagaggtaccagctggctgtgacccagcggaaggaggaggagcccagtagcagcagcgttttcaatcagaatgacccttgggcccccactgtggatttcagtgacttcatcaacaatgagaccattgctggaaaggatttggtggcctgggtgacagctggttttctgcatatcccacatgcagaggacattcctaacacagtgactgtggggaacggcgtgggcttcttcctccgaccctataacttctttgacgaagacccctccttctactctgccgactccatctacttccgaggggaccaggatgctggggcctgcgaggtcaaccccctagcttgcctgccccaggctgctgcctgtgcccccgacctccctgccttctcccacgggggcttctctcacaactaggcggtcctgggatggggcatgtggccaagggctccagggccagggtgtgagggatggggagcagctgggcactgggccggcagcctggttccctctttcctgtgccaggactctctttcttccactaccctccctcgcatccgcctctgagccaggagcctcctgaccctgtgatgcctgacacaggggacactgaaccttgttgatgccagctgtactgagttctcatccacagaggccaggcatggcccagcctggagccgtggccgagggcttccctagatggttccctttgttgctgtctggctttcccgaatctttttaggccacctccaaggactctaaaagggggctattccctggagaccccagagtagggttgccagtcctgcaagtccatagctgagctggaaaggatgcttctgctcacattccctctcatccaggtcctttccttctcgtcttcctctctctcacctacttcctcctcctcctcctgttcctgccttctcttctatcctgcaatttctcccgaatcctgaggggatatccctatgtcccagcccctggtactcccccagccctcagttttcagtcaagttccgtctcctctccagccctatggaagtctcaaggtcacgggacccctaatcagagtggccaatccctgtgtgtcgttcccttgtgtctgttgcttattgggagtaggagttgctcctacccctgtcctggggctgggtgtgtttcaggacagctgcttctgtgcatttgtgtctgcctgcctcatgctctctatagaggaggatggtcatcgtgacagcagcagctcaagttagcatttcaagtgatttgggggtgcaatgataatgaagaatggccattttgtaccagggctctgtattctgcaacagcctgtttgggaggctggagtggaaacaaagggtgggcatcaaagatgagaagccaaagcccctacaactccagccacccagccaggaggggctgtccaatcacattcaggcatgcgaatgagctgggccctgggtgaggtgggggtctggcctagtggggaggggcctggcctgggtggggcagggcctggcctggtccaggcttgggctccattcccatcactgctgtccctcctgaggtctggattggggatggggacaaagaaatagcaagagatgagaaacaacagaaacttttttctctaaaggactggttaaatcaattctgatacagccttacaatacaatagtatgcagctaaaaaataattgtatgtctttatatactaatatgtaataatcttcaggtgaaaaaggcaagccacagaaatgtgtatagcgcacttcccatttgtgtttcagaaaggagtagaatataaacacataattgcttatgtatgcctattcagaataaatgggtaacactgattacttttgggaggggaaccagtaggttgaggacaggagagggaagggtcttaacacttacacccttttgtacattttgaattttgaaccatgtgactgtattacctattcaaaataaacaataaatgggcccaaacaggaaaaaaaaat

SEQ ID NO: 104420 - DNA, 2104 bp, Homo sapiens
tagccttcctgtgtccttcccacccttagtcccaggcatctgactaccgggaacctcagccagagtccgggagccccccaccccgtccaggagccaacagagcccccgtcttgctggcgtgagaatacattgctctcctttggttgaatcagctgtccctcttcgtgggaaaatgaaccagaagacaatcctcgtgctcctcattctggccgtcatcaccatctttgccttggtttgtgtcctgctggtgggcaggggtggagatgggggtgaacccagccagcttccccattgcccctctgtatctcccagtgcccagccttggacacaccctggccagagccagctgtttgcagacctgagccgagaggagctgacggctgtgatgcgctttctgacccagcggctggggccagggctggtggatgcagcccaggcccggccctcggacaactgtgtcttctcagtggagttgcagctgcctcccaaggctgcagccctggctcacttggacagggggagccccccacctgcccgggaggcactggccatcgtcttctttggcaggcaaccccagcccaacgtgagtgagctggtggtggggccactgcctcacccctcctacatgcgggacgtgactgtggagcgtcatggaggccccctgccctatcaccgacgccccgtgctgttccaagagtacctggacatagaccagatgatcttcaacagagagctgccccaggcttctgggcttctccaccactgttgcttctacaagcaccggggacggaacctggtgacaatgaccacggctccccgtggtctgcaatcaggggaccgggccacctggtttggcctctactacaacatctcgggcgctgggttcttcctgcaccacgtgggcttggagctgctagtgaaccacaaggcccttgaccctgcccgctggactatccagaaggtgttctatcaaggccgctactacgacagcctggcccagctggaggcccagtttgaggccggcctggtgaatgtggtgctgatcccagacaatggcacaggtgggtcctggtccctgaagtcccctgtgcccccgggtccagctccccctctacagttctatccccaaggcccccgcttcagtgtccagggaagtcgagtggcctcctcactgtggactttctcctttggcctcggagcattcagtggcccaaggatctttgacgttcgcttccaaggagaaagactagtttatgagataagcctccaagaggccttggccatctatggtggaaattccccagcagcaatgacgacccgctatgtggatggaggctttggcatgggcaagtacaccacgcccctgacccgtggggtggactgcccctacttggccacctacgtggactggcacttccttttggagtcccaggcccccaagacaatacgtgatgccttttgtgtgtttgaacagaaccagggcctccccctgcggcgacaccactcagatctctactcgcactactttgggggtcttgcggaaacggtgctggtcgtcagatctatgtccaccttgctcaactatgactatgtgtgggatacggtcttccaccccagtggggccatagaaatacgattctatgccacgggctacatcagctcggcattcctctttggtgctactgggaagtacgggaaccaagtgtcagagcacaccctgggcacggtccacacccacagcgcccacttcaaggtggatctggatgtagcaggtaagacattttggtggggagaaggcttctggaagaagggctgaaaagttgtttccattagctttgggttttatgtagattatcccagaaaggaagacgtggatttttgtacttccccttttgctggatgggagagagttggctgctgagttttatttggatcttagctcactggctgggtgcaaagctgcagccttcctctacgtgacctcatccaaagatcttgggaaatggccgagctcagggaggaggcaggatttgggctaacagtgtccccattgccctcttctctcccttgtacttatatgggctctgctgctgggagcagcctt

SEQ ID NO: 104421 - DNA, 414 bp, Homo sapiens
cggaggcggcgttcagaaatagggcgctggctttgccaggagcggctcctctccaagcctggcggtcactgccctgtgtccccttttgggcctctcctggtcctcctggttggattaggaggcctctcagcccggagtctgggtcgccgaagtacaggccccttcactgaagcgacccacggcgcaggggtttctggaagccatcgccaggctccgagtgttcagatgcagctgccaggctcaggacgcagagaactggcttccagctcgcaggagcgcctgtccgtggtgggtagggtcgcaggcgtggggtgtgcaggagcagtgggacagcactgaaacgcagtcggtaaggcgtagcggctaccctctggagaggaaaaccatgacagggcggggcttggggcgcgggcg

SEQ ID NO: 104422 - DNA, 1786 bp, Homo sapiens
cggaggcggcgttcagaaatagggcgctggctttgccaggagcggctcctctccaagcctggcggtcactgccctgtgtccccttttgggcctctcctggtcctcctggttggattaggaggcctctcagcccggagtctgggtcgccgaagtacaggccccttcactgaagcgacccacggcgcaggggtttctggaagccatcgccaggctccgagtgttcagatgcagctgccaggctcaggacgcagagaactggcttccagctcgcaggagcgcctgtccgtggtgggtagggtcgcaggcgtggggtgtgcaggagcagtgggacagcactgaaacgcagtcggaagagataccacggtgtgcaggcacagggaaaagaccacgtgaggacacagagagaagacggccgtctgcaagccaaggagagaggcctcaggtgaaaccaaacctgcaggcaccttgatcttggacttccagcctccagaagcttgagaaaagaaatttctgttgtttaagacacccattctgtggtatttgttctggcagccctaacaaactaatatagggatctaaagattccttgtcttcattttgagtaagagactataaactcagaactgtggagatctagttaggtattgtacagctagcctcattctgtcttaaactccaggtaaaagagaaaaatatggagacagcccctgactttggagaacttgcagttttgtggaggtgaaaggaggcagccacaagaaaaacccctgacatcaattcaaaactataaataacaaagactaacttgttctatgcacaacaggtactacagcactgtccaacatggggacatgtgagtggcctgaagcagcacaagaactgggcaataaacttgagatgaacctcaaagcatcaatattattcatgactaaactgggttctaagaatttctatttttactctcagtgttcagtagaggtcattaaaaaaaaatctagcaatttttttttctaaaatgaatatgtaataagaatgaaaaacaaaaagcactataatgtttttaattaatgaaatgcctttacgaaccaaggtgccatcttggagaagctaggcattatgaggagctatcaggagcacatttgctaacagcttggcatgagcaggattttcttgaccaactggcaagatggggctgctcagctcctgctggcagatttttatggagcatagttttacaaattcagcctacaactctgatacgttccaatgtattttaaacatctattcagttgcaactctaatcccaggaacctgtggctaacagaaggcagatttaactgactagcagctgtgggattttcaaagtctaaactgaaatgaacatgcgaaacagttggactaccccaaaagctgaattacaattccagcactcaccagctctgaaacctcacttggttacctaacgcctctgtgcctcagttccccagctataaaatggaaaaggcaacaataccaaccttgtagattatgttttggattaaatgaggcaacacatacacagcacttagaacgtgcaaggcacaatggaagcatgcagtgaacatgacttgtaatgatgctgactgtcataactctcatccatagggatgctgcctctgcttgtcacccttgacctatatattttcaggcagtcctcacccagtccccatttgtgtgttctagatagaaaaggccccatactatgaaatgactactgtccttctgcatgaagcctggtgaacctgat

SEQ ID NO: 104423 - DNA, 212 bp, Homo sapiens
gtgatgcatgcagctggagatgttgaaggtcagatgcaggtggtcaagcattttagtttcctgtggctactgtaataactaaagtggctgaaaacaacaggaattcattatcttacagttctggagacaagaagtccaaaatcactttcactgaactagaattgaggtggtggcaggaccttggtccttctgaaggctctgggggtgaatct

SEQ ID NO: 104424 - DNA, 391 bp, Homo sapiens
atacggctaataggagtataacttagctactttggagaacaatccagcaatatcctgtgaaaagttgagcttttgctaaactatgactcagaaaatttaatactaagactattacaataaacttgcacctgtgtatgaggtggcaaatactatttatattagtagcactgttcataatagaataacaataacaaaaatattgcaaaatatgatcatcagtacattgatatgtaaattatgcaatagtcacaacaatataaatcatagactataattttggaatattcacaaaacagagtgtgatatagcagtaaatgtacatgacttgataagctgattccaaaaatttatatatgtgagaggacttcaaaaattttgtggaaaaatataa

SEQ ID NO: 104425 - DNA, 601 bp, Homo sapiens
gaaaaaggagttgtgtgattgtcttgagtttgtaagtggaactacttttttcatcgagcaccgtttttacttgaaataacaaagtatgaatatgaatgcagatttggccatttggcagatttttatttatttatttgagacaaggtcttgctgtgtcacccagactggggtgcagctcactgcagcctttacctcctgggctcaagtgatcctcctgcctcagcctccttagttgctgggaccacaggtgtgcagcaccatgctcagctaatttttaaattttttgtggagacaaggtctgaccatgttgcccaggctggtctcgaactcctgggctcaatagatcctctgtccttggtctcccaaagtgctggctcagtcattatgttctttactgccatccattgcagtataaaaagaataacagttttccctcagaatattcttggtgaaacagtaacaattattaattttattaaatcttggctcttgagcaaatgtcattttaatattctgtgtgataaaatagcaatgtcacataaagtgcttttacatacttaagtactatggttgtctgaagaaaaaggagttgtgtgattgt

SEQ ID NO: 104426 - DNA, 353 bp, Homo sapiens
ggggaatgaaaaaaagcctttcagaggcttgctgcctagtgaggagtaaagataagtcaatgattataattcagtatagactcgttacaagtagtaaaggaggcacaaaacacactggaatcaagggaacagggagagagagtaattgcaccaaagatgacacggtgtctggcaaaacctcatatgctatatctgttggagaacatgctaaggtacctggtagagggtccttgaattttggaataaggcagatactctagatttgtatcataactctgccttactaacttttccaacttgggtctagttagttaataggctcataatgtgaaacagtttcttatagggttgtt

SEQ ID NO: 104427 - DNA, 580 bp, Homo sapiens
caaaattcagttttaaaattttttataatttaaggatatagtattaatagcttcatgtcagtttaaaggaaatatattatttgcagttgttcaaaattttatctgtatttatacctatattttacttcagggttcccatcttttccacttttatttttttcccagaaaataaggtgaatttctaaaattagaaatagcagttaagtagttagtgcctgtgtcctgtagttctaggtgtttatgtgtaatagagtagaaattatggaaagatattttcaagctggtaagttggtgagcggccacagttaaaagctgaagggttgaatgtttcagcatgagaaatagtggcgggaggatttctaacttactcattgattgtgttcagttctgaaaaagttttcttgatgtcccattgcagatttgaatgtggtcttataataccccaaatgtatcatcacttttatttctctgagtaaagaaaatctggtgtcgagagtttgcttttgctgattgagcagtttatacttttttctcaagaaattgtaataccttttatcatgatgttcaggtctgaatgata

SEQ ID NO: 104428 - DNA, 388 bp, Homo sapiens
ggcttgacaaaacctaaccaatcacattgcaaggagagatagtacagaaagggaggaaggggcatgtggggggtgttgtcacaaaaattgcaggaatacaaccattattggccctattagatggacttctctcaagccacagttaggttatacaaacaggtgagccagtagtcataaagcatttacaacaaagtcaagctctactgagctttgcccatctgtttttctgtagcccattcattaatcatattccttatgagtcacccgattcctttgccagaaccacagttatgtttcaagaatattagaactcacagccaggcagacagacgctctgggcttgacattcatctttcaaagtgtcagtgtctttataaagcgaccacca

SEQ ID NO: 104429 - DNA, 104 bp, Homo sapiens
aaatctttgaagacagttccttcaaccctcccctcctcctcccacaaaattatattgaggtggaacaggaggggaaagcagtggagaagaacacagcgctaaag

SEQ ID NO: 104430 - DNA, 443 bp, Homo sapiens
ttcctctctacaaaacatctctcctgagcatcttttgttgttgttgttgttttttgacagtctcattctgtcactcaagctggagtgcagaggcaccatcttggctcactgcaaactccatctcccaggttcaaaggattctcatgcctcagcctcccaagtggctgagactacaggcatgcaccactatgcttggctaatttttgcatttttagtagagacggggtttcagcatgttggccaggctggtctcaaactcatgacctcaagtgatccacccacctaggcctcacaaagggctgggattataggtgtgagccaccatgcccggccctgaacatctttaacagatggtaaagaccttcttctgcaccttattgtgaaattggaaagagaaataggatgcctttgtcagaggatggtatgagtaataaaagccacaa

SEQ ID NO: 104431 - DNA, 150 bp, Homo sapiens
acatgtcaatatgtaccagcacttaaaagtactcaacgcatttaccaggtgaagtgtaatttacaatgagctgagaaacatcttcaagtgtcttaggagaaacaagatcaaagaattccttctcctctctttcctttcctctctcttttt

SEQ ID NO: 104432 - DNA, 390 bp, Homo sapiens
ggaaaacagcacttaactacctcacataatatagatgagctcattttcattgcttctcctttgtgtaatacctcctgtctaaattaactcctgcttatacaaaacagggcaaagcttttattacaattaaaatattttaaaaactgaacagataggaagtccataccttatataaattttgacagaaaatggaaattttcctctttccccctagtgttttttttgaatgggttgctttggagggggagaggaggaggccaaatcatcatcatcatgatattaaattgcatatgcaataggttattattaatgcagatactttatgctagatgtcttcatgcttgccaaaaccaattctgaacattttgatttatttctgaccagatataa

SEQ ID NO: 104433 - DNA, 360 bp, Homo sapiens
ttttttgagatggagtttcactcttgttgcccaagctggagtgcaatggcgcgatcttggctgaccgcaacttacacctcccaggttcaagtgattctgctgcctcagcctcctgagtaactgggatcacaggtatgtaccaccacgcccagctaattttgtatttttagtagagacggggtttctccatgttggtcaggctgatctggaactcccgacctcaggtgatctgccaacctcggcctcccaaagtgctgggattacaggcgtgagccaccgtgcctaggcgactcatttttaaaaatgagtttcattactgacaagaataaagatgaatatttttacctggaacacagacta

SEQ ID NO: 104434 - DNA, 401 bp, Homo sapiens
aaccagatggttctgatagaactgatccagagagtggcatttaaaaactgctgcctcatgggatatgtaatctcctcaatctctttttaccctttttaggagaataaaaatcaagacactttctacaatgtgtatgccaagtatggcctgaccggcacactccagaacagacccactctcctcccctacacgtgaaacctgagatgccatcccgtcaactgtaagagtggggaaaatggcgcccaagcacacagctagagattcagcgtggccactcccctcagactttgtgcctctagcttttttcccccatgctagtcttcacgtgaagtgcatctctcgaaggcaattaaaattacacagtgccctgatttcagtcttcctgtaaccatgctgaatat

SEQ ID NO: 104435 - DNA, 249 bp, Homo sapiens
ggaattgtgggagcttcaattcaagatgaaatcagagtggggacacagccaaagcatatcaaacagcttgtttgtttatagagaattaactgcatatcaaatatgtgagtcagacttaaagtcatagagaactgaccacagcaacccctgcatgaggctcagatttggaaagatctcttgttcctggcctcctcatatcatatatagttactttatcattacttttagctctgtggcttgcactaagtc

SEQ ID NO: 104436 - DNA, 1047 bp, Homo sapiens
taaactactactaactaatctacggacattcaaattttgccagttttcccgatgatgtcctttgtctggtccagggtcccatattgcattttgttgtggtgtttccttcatctctgtcagcctgtgacagtttcttggtctttatctttcatgaccttgacactttggaagagtccaggccagttattttatagaatattccccagttttagtttgtttaatgtttttacatgatatgattgaggatctgcatttttgccaagacaaccacagaagtgatactgtgctattcttagtgcctcctagcggagggtggtggtaactttttgttttggttttttttttttttttgagacggagtcccgctctgtcacccaggatggagtgcagtggcgcaatctcggctcactgcaacctctgcctcctgggttcaaagtgattctcctgcctcagcctcctgagtagctgggattgcaggtgcccaccaccacacccagctaatttttgtatttttagtagagacaggttttcgccatgttggccaggctggtcttgaactcctgacctcaggtgatccacccacctcggcctcccaaagtgctgagattacaggcatgagccaccacacctagactaggtggtggtaactttgatcacatggctaaggtggtgtgtgccaggtttctccactgtaaaattaggaattttccctttgaaattaacaagaatcttccactttgaagctgtgtgaatgtcttattcttaaaattttgcctactgattttcatttccatcatcaatgattcttgcttataacaggtattaatgttatgcttgcctaatggtgactttgtttcattattttacctgtatttattaattggtattctactataaggaagagctgtcccttttccccatttatttatttgataatttatatcagtatgaatgagtggatatctgttttattctacaggctacaatctaatgctaacagtttatttggttgctcaaattggctcagatttggccagtgagaactca

SEQ ID NO: 104437 - DNA, 616 bp, Homo sapiens
tgagcaccataagatggtgaaaaataaataaaattttatccttgtaaaagattgatggccaggcatggtggtggcccacacctgtaatcctagcactttggaaggccaaggcaggctggtcttgaactcctgacctcaggtgatccacccacctcggcctcccaaagtgctgagattacaggcatgagccaccacacctagactaggtggtggtaactttgatcacatggctaaggtggtgtgtgccaggtttctccactgtaaaattaggaattttccctttgaaattaacaagaatcttccactttgaagctgtgtgaatgtcttattcttaaaattttgcctactgattttcatttccatcatcaatgattcttgcttataacaggtattaatgttatgcttgcctaatggtgactttgtttcattattttacctgtatttattaattggtattctactataaggaagagctgtcccttttccccatttatttatttgataatttatatcagtatgaatgagtggatatctgttttattctacaggctacaatctaatgctaacagtttatttggttgctcaaattggctcagatttggccagtgagaactca

SEQ ID NO: 104438 - DNA, 349 bp, Homo sapiens
cttggctaggaattctaggcttttagattctttgggcaatggctactaaatgttcataatgttgctcagttgcaaaaacaagacattcaaactatagccagggagataagtagtcacgaactcaaggcctaaattctgctgatggagccgatgagaattgggtgctaaggcaaagagagttgccaatattatattcttcggggttttttgtttttattcgcattttggaaaaggaaaatattagcattcctctgacttaatattgagaagacattgggcactctttttcctcccacacttgtcttctttcactaggtgacaagggaagaggtagcatgaggtggtggtc

SEQ ID NO: 104439 - DNA, 348 bp, Homo sapiens
aaacatgtgacttcagagaattatcccctgtgagcctgagtttccacccctgaaaaaggaaggataggccgggtgcagtggctcaggcctgtaatcccagcactttgggaggccgaggtgggcagatcacctgaggtcaggtgttcgagaccagcctggccaacatggtgaaaccccgtctttactaaaatacaaaaattagctgggtgtggtgatgcgagcctgtaatcccagctactcaggaggctgcggcaggagaatcgcttgaacccgggaggcagaagttgcagtgagccaagattgcaccattgcactccagcctgggcgacagagcaagactccatctca

SEQ ID NO: 104440 - DNA, 724 bp, Homo sapiens
gttttttacttcttcagtttttcaagataattttgctgtttttgctttttatttatttgcaactagaaattgcatgtgccagttacttaatttaatacatctaatgggagattcaaagcaaaccattaaaactaccatataaactcaaatgaaattttatgacattctaatgtacatactcgccaagaaatgctacaaggagcctctctgcaaatgcctgatggggcactctgagaattaaacaggaaatggacaggaaaagaggcaaagcatagaatagcctctgtggtatacacacagacaatgtaaaatccaagaaatataaggtccaaggaggaattggttattgaagtagagaacctcatcatgagatttgagaatagctttagagttactcttgggatagtgtctcatggccctgtgagggaactctacaaattttatccattttgctgggcagttttaagagctactttttgtctgtactttccttaattttcatattatttctagcttttacttcatcttatgaaagattaacttagaggttagaatgcttacatttgcaaatagcctgaggaataaatatgtgctttatcaaagtggaacttctgattttctgtaatattaggatggacatgtgtctggcttatccttcctatctaggaaactggtgtcattaggaaatacgttaacataagatccctgactataaagtaagact

SEQ ID NO: 104441 - DNA, 1104 bp, Homo sapiens
ttcagcaacagagccgtgtattggaagcaaagccccaaaacacgataagagtagaggagcagacaacccagttgcagatttgaagaagcatgtggaattccttgtggcggagaaggaaagattatggaaagaaagtaaacaggtaaaggctgaaaaggccagacttctaaaaggtccagtagaaaaggagctggatgtgggtgctgattttgtggaaaagtcagagttacggagctcgcctctgcattcagaaactgctataccctcttcagccttgcagaggtttgcagcagatgccaggaaagccaagtacattccaatacccaatcttttccctcagattttccatctccagagcttccctttatggagctttctgaggatattctgaaaggatttatgagtaactaaaatggaaggccatagaagaagggagaagaggaaataatactaagtcatacagttaatccagcaacaaaaaatgaaaagggaaagccacaggcaagggtaatcctggaaatgcctcgtcatctggtgtactgtaggagaagacgcattgccaggatgtggggaacagtcgctgtgaagcgtgtcacatacctgattcactgacttgagctgatgatgccgacctggcagacactaaactcgtggagggtcagtttctcttgacaccaaccaaatggctgcctgaaagaattttttcaagcaacaattatttttcttatcttcagggttaaaatgtataaaagtatgttatgtataattaatctgttatgtcataagtgactcatcaaccctaaatttattatggcagcctgaggggctgcttcgtatttgaaacatgctttgtctcaggcgttgacgtatgtatgcatttggttactggcgttttgtataaggtgtgagacacacctttccagatgaaaccatatgtgccgcactgtgcactactcataacggtgataacctcaagaccatcaggagaaatatttaaatttccgtgttatgaagaaagaaaccaaattattagttatgctttttaacacaaattaccagtttacataataaatttagggttgatgaggatctgcagatgctccg

SEQ ID NO: 104442 - DNA, 1228 bp, Homo sapiens
ttcagcaacagagccgtgtattggaagcaaagccccaaaacacgataagagtagaggagcagacaacccagttgcagatttgaagaagcatgtggaattccttgtggcggagaaggaaagattatggaaagaaagtaaacaggtaaaggctgaaaaggccagacttctaaaaggtccagtagaaaaggagctggatgtgggtgctgattttgtggaaaagtcagagttacggagctcgcctctgcattcagaaactgctataccctcttcagccttgcagaggtttgcagcagatgccaggaaagccaagtacattccaatacccaatcttttccctcagattttccatctccagagcttccctttatggagctttctgaggatattctgaaaggatttatgagtaactaaaatggaaggccatagaagaagggagaagaggaaataatactaagtcatacagttaatccagcaacaaaaaatgaaaagggaaagccacaggcaagggtaatcctggaaatgcctcgtcatctggtgtactgtaggagaagacgcattgccaggatgtggggaacagtcgctgtgaagcgtgtcacatacctgattcactgacttgagctgatgatgccgacctggcagacactaaactcgtggagggtcagtttctcttgacaccaaccaaatggctgcctgaaagaattttttcaagcaacaattatttttcttatcttcagggttaaaatgtataaaagtatgttatgtataattaatctgttatgtcataagtgactcatcaaccctaaatttattatggcagcctgaggggctgcttcgtatttgaaacatgctttgtctcaggcgttgacgtatgtatgcatttggttactggcgttttgtataaggtgtgagacacacctttccagatgaaaccatatgtgccgcactgtgcactactcataacggtgataacctcaagaccatcaggagaaatatttaaatttccgtgttatgaagaaagaaaccaaattattagttatgctttttaacacaaattaccagtttacataataaatgagggtgcattttaagttctaactttattgtataaggcatcatttgaaagtaccaaggaagtcttctttgtttttagtgatccgtgagtggaaggaattctagttggcagtatttgattgtaagaaatcaataaagtaattgtgtttaaaaaaaa

SEQ ID NO: 104443 - DNA, 337 bp, Homo sapiens
caatcctcaggtaatctacaaattgacccttgttagagtatgtcataggatcttgctgctttaactgacctgggtttaggttcatggagacggaggagaattgttctatgatagatttgtagtggatggtggacagagggtgatggtgtgaggttgaaggtttccagaaatcaaggtgatttgagggctctatggggaccttctgcctgcatgagggggtgcagataagcacgtataacctttttcgtgtttcaggacccttcagagatcttacctccttccccaatttttcacttcaacttgttggggaagacccccaggggttggtcgtattacc

SEQ ID NO: 104444 - DNA, 427 bp, Homo sapiens
cctatctttctaataaagtacttttggttaatgtggaatatctatacccaataatgtacttcaaaaagtatgtgacatgggtaatttgttgcctataaggtctggttctgtaatagcatattgctttgatttttaagtaattaatcaatggctaggtgtggtggctcacacctgcaatcccagcactttggaaggccaaggtgggaggatcacttgagcccaggagttggagaccagtatgggcaacataatgagacctcatctctgccaaaaattaaaaaaattagctggatgtggtggtgcatccctgtagtcccagctactcaggaggctgaggtgggaaaattgcttgagcctgggatgtggaggctgcagtgagccatgatggcaccacagcactccagcctgagcaacagagagaccctgt

SEQ ID NO: 104445 - DNA, 355 bp, Homo sapiens
gttgaggaagaaagaatagtgtgtgcagaggcacagaacagaagcatgaggaacgcattctcaaaactggatttcccaaagttcaaacccttcctttgaaaaggatatgttgaaatgatcctagagatgagattcctaggggatgtgataggagatgaggctggaaaggtaggttagagttcgagttctagaaccttgaatgatacagggtatattgtgtaggtagggaggacacgagcagccaggcacagtgactcatgcttataaccacagtgctttggaaggctgaggcttgaggccaaaagtgcaagaccagcctggtcaacatagtgagaccccatcactacaaaaaaaa

SEQ ID NO: 104446 - DNA, 169 bp, Homo sapiens
cagggcccccaaattctctacaacccataccctgggccttctgttgtcatagaagtcagagttgggggactcttagagtggtacctgatctggcttcctcccatgggaagaaaaggggactgaagctcagaaatggtcagtagtgtgcccaaggtcacacagcacgcag

SEQ ID NO: 104447 - DNA, 630 bp, Homo sapiens
gttgcaacaattactgcatggtccataacgcttctttttttgtcatttccaaaaatgtttgctaacccctgatctaaggattgatgcagtatgtatttctttttacaggtaatatatattgtctttgcagtaaaatgtagtggtaacaataaagacaaaatctctttttgaactattttaaagagataagtaaagagtactgggtaagtgtaccatctttagaggatgatgacctggatttaaatttatattctgccatatcgcctgtgccaccttgggcaaattacctccatgcggagtctgtctcctcatctgtagaaaatggggatgaaagtgttatctttttcaaaatttaatgagaattaaatgagacaatatgtgcaaagcacttattataatacattaattacatcagtgaggtcatcatcatctttatcaactacccttttatccaccactaccaccgccaccaccatcattttcatttcaacaaaatattctgacctttaaatgaggaatctagagatacggagaagcaaccatgttttagctagagggttggtaactttaatagggtgcagccagggaaacagaaaccacagcaactaacaataaaaatacactacatgg

SEQ ID NO: 104448 - DNA, 381 bp, Homo sapiens
ttgtattgattctcaacatgtgtctttccacactgaagtcctaatcattttagttggttttcacgcagcttctcttcagccactgagcgatttttttgcagcttttcgtagacctctgggtcagcgatcacttttgtaggtgcattaaagttctcctgtgttgccgacgtacattccaatgggctccagtgatttgggggtcctatctccatagtattcatgatgtctgttctcctgatacccatttttgaaagggattggcttgtcctctttatggaaatggcccctcctaggaagcccacagttttggtcaagttcttctacctactttttggtttgctacgtggtcctgaaaaagtaataaattaagatgttaagatg

SEQ ID NO: 104449 - DNA, 309 bp, Homo sapiens
tcagaattatactctaagaagagataacataagcctatttccctactacacactttatcatcatcatcatagttactatttggtgtgtgtactttctttctagatattgctttaggcacttaccacacataatcctcctacaaccctcctgcaatattagtctcattttacagatgaaggagagactcaaaatgattaacttgcctacagtcctatagctaaaatgtggtagagtttgaatttgagctcaggttagctctaaaaactttgctctttccactacacacagcaagaagcctaaaagcccaa

SEQ ID NO: 104450 - DNA, 378 bp, Homo sapiens
gtaagttgaaagttttgtaattgtgacttccctagtgaaaaagatgtttattcattccagaagtttagagtttttttatgttcataatgctgaatttggcttagtatctgttttataagtaaagcaagcttgttagactgtaagattatagttaatcttctttcaaccctggccttttaattcatttagaccatttttgtccacaagttattttcctcatcatctgtcgttttacatacatgaatctgagcattgattttaaatgattttaagaacacaaaagtttgactaaccaagggcctgaggattactttcccatatatgggaaaaggacttactgtagcgatggagagagattctaccaagtgatttctcata

SEQ ID NO: 104451 - DNA, 555 bp, Homo sapiens
cgcaacgctcttcctcctgcgccacagtcccggcggcggcgctggtcgcgggtcgcaccgtgaggctcgcgtgggcggcgataggcgctgggcccgggcccggtgaggagcgcgccggcgtccccttctcctcaggagtggcgggccgggaagtgacgtggtgcacgggcaggagcgcgtttgaatcggttcccgggtgatcctcgcgcctgccgctgctcggcgccgccgctgacgaggagctgcagcgcgccgggcgaggcctcgagccgccccgggagctggagctgaaggcgccgcgcggagcgcgcacctcagccctgagcccggcggcggcaggcgtcgctgtcttttctccttttccccaatatggcagcggcggacggcggcgggcctggtggggcctctgtggggactgaggaggatggcggaggcgtcggccacaggacggtgtacttgtttgatcggcgcgaaaaggagtccgagctcggggaccggcctctgcaggtcggggagcgctcggactacgcgggatttcgcgcctgtgtgtgtcag

SEQ ID NO: 104452 - DNA, 131 bp, Homo sapiens
agacaggagcagacagtggtgggccaggcctccaagaatgacgtcagaggagacatgcgacttggctgagatgttgcagggggagcaggatgtcggcagactggaataagatggccagaccatccagggag

SEQ ID NO: 104453 - DNA, 303 bp, Homo sapiens
agtgggatgacatcaggttcatcaccattgtttcaccattgcaaccagaggcttgggttgggtaggtgatatatccagagtcttaaaattagcttgaactcatcgacaaaaaaacttagtagccgagtttgcatttcacgataacttttacttttatgagggtaaccattctgagaatagatcacagttctttcctacttaccttaactgcttctaaatgagtataatcataaataataatacagaataaggatgtctttttttttttttagactgagtctcactctgtcacccaggctggag

SEQ ID NO: 104454 - DNA, 521 bp, Homo sapiens
ctagcttctcccattttctcctagtgaatggttattctgctcttatctagcaggtgataaatctgtcaacagatagtttttcctttttgttttatgtgtaagttgttatttcttccttaaagttcataatcttttcccatttattctctaaattttagactataaccaggatgtgtttaggttgatatctttgcttatctattctgcctggaaatcaggaacctcttccaatattcagacttgtgttttcagctcagaataattattttatcatttgtttgattattcctttagttgcactggatcttagttaaaatgcccattctgattcaaagtatctggaaggcaagtatttgtcaactaagggaaaggtgaccatgcatcattggttttgctgagactacctggtttacaccttcaggctttatacttagaaaatattgcgatcatcttctggtcatgaagttacaaacttcaggacaaaggctaaccagctaagactagcagagcaaattccaaga

SEQ ID NO: 104455 - DNA, 303 bp, Homo sapiens
agccccactgtgcagtcctggccacgcaagttattcttgatcctgcaccatggcagctggggagaatccccaccccctaagcagtcacttgtctctgcttctctggggagaagacaccccttagaggagggtgaacgaagtgcacattcccagagccagcacttccagcagcctccatcctcaagtcccctgagttctggaataatcagacagagttgggagagtgagggggtacatatcaggaaatatatgctgtcccaccgaagagggaagaccgccaagtgagaggcccagtagcaaaga

SEQ ID NO: 104456 - DNA, 344 bp, Homo sapiens
acatgggctttctcattaccaacttggcaaggcagtagcacccaagctgagctgctcagcgacccttctgacaaaatgcctccagcgccagcaagtcctgcacctcagctgggaggcagaggatgaccagaagagcagcagaggaaagactgtagacatggtaccttcttggacttgttccaaaaattgtggccgggcacggtgcctcatgcctataatcccagctactcgggaggctgaggcaggagaatcacttgaacctgggaggtggaggtttcaatgagccaagattgcaccacttgactccaggctgatttcgtctcaaaaaaaacaaccaaaaaagg

SEQ ID NO: 104457 - DNA, 668 bp, Homo sapiens
agtagagacggaattttgccatgttggccaggctagtctcaaactcttgccctcaggtgatctgcccacctcggcctcccaaacagctgggattacaggcgtgagccaccacgtcaggcctattaataatagcttttatctgatctttccaaccttaaagcccactataccactaatatataatcccagctctacacaggtgaagaactgcttggtccttctcacctgtaaaaccactgcttacccatctggaatttcctcatcccctaccaaccaaaagtgcatcttcataaagccttccctaaacagatagttccatcatttggcgttctgtaccatacagacaatataaagttggactgtcagttctttcccatcatgtgtttaatttgtctcctcaacaaaacattaataaaaagtgatattattaccatatgattaccttacacaactacattagctcatgctaactagggcaatgattttttatacagtctttagtatatgccaagcatctatctaagagcttgttaactagaaatgcatttaattctcacaacaggcctatgagggaactattaatcatccctgtttttacacctgaggaaactgaggaacagactaagtaacttgctaaaagttagtcagtaagtggcagatttaatgaa

SEQ ID NO: 104458 - DNA, 184 bp, Homo sapiens
aaaaatgggcaaaaacattgaacaagaactttttaatatgtatgcccagtaaatctttgaaaatgtgttcaatctcattagttttcatggagcacaaaataatatatgaagtgagatatgaggtgaaataacagatatgaagtgagtttacaaatatggcaatgccaagtcttggtgaggatat

SEQ ID NO: 104459 - DNA, 392 bp, Homo sapiens
acaggatttcaagcacacagcttttgtctcataagaagctgattctttgtgagatagcagctcaaccttttcctttaaatatgtataaaatcattcaataattggttatcatgccataaaagacttccccgtcagtgaaactgaatagttctggagaaaaatgctttctcaactatacacccatcaaccagaagaacccatgcttggttttaaagttaaggataggtttactttttattacccttttgtttggtttgaatacttccagtgatttccagctcaaatgtttactttgttcatcaccataaaaaaatcccaaaacacatagattatattaagggcagtcttctagtctgcccttagaagaaatcaaatactgaaaccctagggaa

SEQ ID NO: 104460 - DNA, 315 bp, Homo sapiens
gaagtctgatgaaatgggataaggatgggatctgatcctgctcataggaccatgaaagtggtgtaggggaggtgggagctggtagagatgaggagaaacagcaaaaggagatgcagaacccgagtcttagtggaaaccaaacactgaaatccgaactcaggcttgcagacactgaaaactcaggcaaacagaagtagagcagcaacagatcctagacagatctgactggaggccaggtaaaagaatgcagacaataaaaggttgaacatggcacagaagaacaccaccaccaagttgttttgatgctcagctgag

SEQ ID NO: 104461 - DNA, 540 bp, Homo sapiens
gacagtttgtgaggttccaccccctgttgcctgagtcacatctcagacggaggtcaggtagctgagcgatccagcttccacttttgtccctgaaactgtcctgccagagacatttgcattataccagaactttatatgctagatataaaggccctcagaccggacactggcgtttaccgaagaagcttctgaacggggacataggtgtgcgcgcagggaatgccagacaagagtttccagataaagcgaaccccttgatgactgactctttgaggagtaaatccacagcaaaagggccctggaggcaaggccatactggatcaggagagtcagatattctccagaggacagtggcttggcatcatgctgccaggacactcagaactgtgaccccgtaggttcacagagaccaggcaatgtttacatttttaattttaagttttgttgtgggtacatagtaggtgtatatatttatgagttacatgagatattttgatgtaagcatgcaatgcctaataatcacatcatggtaaatgggga

SEQ ID NO: 104462 - DNA, 542 bp, Homo sapiens
aacttcttcctctctttaggaaatcctcttatgagatagagctcagctcctcctgtagaagctgaaattccagacactggacttcccagtctcccttgccactagatatggacacgtgatcaagattccaccaatcagatggtctttgaatctgctagtgacaaaaagaaaggaacatgccaaatccattctggcagatttaagacacaatggcagctacatccagttcccagaggcagcagggccagtggttctagcatcggcatccaagaacacttgctgatggtgcagatggtgtgagctgcagtgtccaggtgcagtatggctgctatggtgtcctcaatgaatgaatcctgcagtggaatttacagtgttgttcctggctgcacagtcttcaagcctttttctctggatactctaggaattctttgagtttcccagtgtcctttcaataaattcttcttcctaaattaagtagagcctatttctgtggcttgcaacaaagcatcccaaaagatacaatattaaattactaattaaga

SEQ ID NO: 104463 - DNA, 308 bp, Homo sapiens
aacttcttcctctctttaggaaatcctcttatgagatagagctcagctcctcctgtagaagctgaaattccagacactggacttcccagtctcccttgccactagatatggacacgtgatcaagattccaccaatcagatggtctttgaatctgctagtgacaaaaagaaaggaacatgccaaatccattctggcagatttaagacacaatggcagctacatccagttcccatctgcaccatcagcaagtgttcttggatgccgatgctagaaccactggccctgctgcctctgggaactggatgtag

SEQ ID NO: 104464 - DNA, 364 bp, Homo sapiens
gtggaggtatatctagacctgagccatttctgtgggtttaaatctcatcttccctgtcattaactgtcactgtggccttggacaaattatttgaactctgagccccccacctaccttccttatctgtaaaatgggcatagcaataatagtgcccgcctcctagagttatttttgaggatagataacaggatacacatgaagtgcttactgtggggtttggtgcttactaagtgttgagccagtgctaactactgttaccacagttgttaccattgtcatcagtatcatccttattgattcttcgtcacttccccaggtcctggttggctcccttccccctcccccgcattggggtgttattggc

SEQ ID NO: 104465 - DNA, 304 bp, Homo sapiens
atacagcctgttcccttctcaaggtacttgaaattaagtgttcaagctaaactttcttctccttgaggttcacggggggattcattactttacaaagagactgcatcaagtttacatgttaaaaagaaaacatcctggtctcagatggcttataaaatagatactagaaaacaaagatttttgcaaccaacataactctctgaaattaaaaaagtaaaaacaaatctcatctctaaattcacttaaatatccttcaaataaatcaactaatttttgtcatgttgctaattaaatattctctgag

SEQ ID NO: 104466 - DNA, 1156 bp, Homo sapiens
ccacgcctgcatcttgcggaaagcggggtggaggtttagggctggactcttgggtcctttaaaggtgagtggtctgggggcctctgggcttggggccagacccctgggtcctctatgaaagaacgtgctggggaccctgattttgggatgttagaaagttggaactcttttgttctgataggggaaggtagtggggctccggactcccgactcccggggaaagagtgggctggggtttctgcttctggatcttaggaagaggatagggtcagtctggactacttggcctccagtgggtggaagtccggttctgcgccctcacctgggtcccccgttcccagatgttcgagcctgtgagctgcaccttcacgtacctgctgggtgacagagagtcccgggaggccgttctgatcgacccagtcctggaaacagcgcctcgggatgcccagctgatcaaggagctggggctgcggctgctctatgctgtgaatacccactgccacgcggaccacattacaggctcggggctgctccgttccctcctccctggctgccagtctgtcatctcccgccttagtggggcccaggctgacttacacattgaggatggagactccatccgcttcgggcgcttcgcgttggagaccagggccagccctggccacaccccaggctgtgtcaccttcgtcctgaatgaccacagcatggccttcactggagatgccctgttgatccgtgggtgtgggcggacagacttccagcaaggctgtgccaagaccttgtaccactcggtccatgaaaagatcttcacacttccaggagactgtctgatctaccctgctcacgattaccatgggttcacagtgtccaccgtggaggaggagaggactctgaaccctcggctcaccctcagctgtgaggagtttgtcaaaatcatgggcaacctgaacttgcctaaacctcagcagatagactttgctgttccagccaacatgcgctgtggggtgcagacacccactgcctgatctcacttctgtcagatgctcccatccactattaatgcactaggtgggaggagagggcggcaatgacactgcacctctcctttcccaccgcattccctggagctccctaaataaaactttttttaacgtga

SEQ ID NO: 104467 - DNA, 965 bp, Homo sapiens
tcagtgccgtagcgcccggctcctgcaggcgctcggcctccgctcattcctgaccccgcagtgggcgcgatggcggaggctgtactgagggtcgcccggcggcagctgagccagcgcggcgggtctggagcccccatcctcctgcggcagatgttcgagcctgtgagctgcaccttcacgtacctgctgggtgacagagagtcccgggaggccgttctgatcgacccagtcctggaaacagcgcctcgggatgcccagctgatcaaggagctggggctgcggctgctctatgctgtgaatacccactgccacgcggaccacattacaggctcggggctgctccgttccctcctccctggctgccagtctgtcatctcccgccttagtggggcccaggctgacttacacattgaggatggagactccatccgcttcgggcgcttcgcgttggagaccagggccagccctggccacaccccaggctgtgtcaccttcgtcctgaatgaccacagcatggccttcactggagatgccctgttgatccgtgggtgtgggcggacagacttccagcaaggctgtgccaagaccttgtaccactcggtccatgaaaagatcttcacacttccaggagactgtctgatctaccctgctcacgattaccatgggttcacagtgtccaccgtggaggaggagaggactctgaaccctcggctcaccctcagctgtgaggagtttgtcaaaatcatgggcaacctgaacttgcctaaacctcagcagatagactttgctgttccagccaacatgcgctgtggggtgcagacacccactgcctgatctcacttctgtcagatgctcccatccactattaatgcactaggtgggaggagagggcggcaatgacactgcacctctcctttcccaccgcattccctggagctccctaaataaaactttttttaacgtga

SEQ ID NO: 104468 - DNA, 756 bp, Homo sapiens
tcagtgccgtagcgcccggctcctgcaggcgctcggcctccgctcattcctgaccccgcagtgggcgcgatggcggaggctgtactgagggtcgcccggcggcagctgagccagcgcggcgggtctggagcccccatcctcctgcggcagatgttcgagcctgtgagctgcaccttcacgtacctgctgggtgacagagagtcccgggaggccgttctgatcgacccagtcctggaaacagcgcctcgggatgcccagctgatcaaggagctggggctgcggctgctctatgctgtgaatacccactgccacgcggaccacattacaggctcggggctgctccgttccctcctccctggctgccagctgtgccaagaccttgtaccactcggtccatgaaaagatcttcacacttccaggagactgtctgatctaccctgctcacgattaccatgggttcacagtgtccaccgtggaggaggagaggactctgaaccctcggctcaccctcagctgtgaggagtttgtcaaaatcatgggcaacctgaacttgcctaaacctcagcagatagactttgctgttccagccaacatgcgctgtggggtgcagacacccactgcctgatctcacttctgtcagatgctcccatccactattaatgcactaggtgggaggagagggcggcaatgacactgcacctctcctttcccaccgcattccctggagctccctaaataaaactttttttaacgtga

SEQ ID NO: 104469 - DNA, 932 bp, Homo sapiens
tcagtgccgtagcgcccggctcctgcaggcgctcggcctccgctcattcctgaccccgcagtgggcgcgatggcggaggctgtactgagggtcgcccggcggcagctgagccagcgcggcgggtctggagcccccatcctcctgcggcagatgttcgagcctgtgagctgcaccttcacgtacctgctgggtgacagagagtcccgggaggccgttctgatcgacccagtcctggaaacagcgcctcgggatgcccagctgatcaaggagctggggctgcggctgctctatgctggctcggggctgctccgttccctcctccctggctgccagtctgtcatctcccgccttagtggggcccaggctgacttacacattgaggatggagactccatccgcttcgggcgcttcgcgttggagaccagggccagccctggccacaccccaggctgtgtcaccttcgtcctgaatgaccacagcatggccttcactggagatgccctgttgatccgtgggtgtgggcggacagacttccagcaaggctgtgccaagaccttgtaccactcggtccatgaaaagatcttcacacttccaggagactgtctgatctaccctgctcacgattaccatgggttcacagtgtccaccgtggaggaggagaggactctgaaccctcggctcaccctcagctgtgaggagtttgtcaaaatcatgggcaacctgaacttgcctaaacctcagcagatagactttgctgttccagccaacatgcgctgtggggtgcagacacccactgcctgatctcacttctgtcagatgctcccatccactattaatgcactaggtgggaggagagggcggcaatgacactgcacctctcctttcccaccgcattccctggagctccctaaataaaactttttttaacgtga

SEQ ID NO: 104470 - DNA, 321 bp, Homo sapiens
tgtgaactctccaaatattcattcatcaggaaaggtgggttttatctgggccatatttgcaattctagacaaatagctcccatctttgagattgtggtcagctcttgggctctagaacctaccagcaccagccctagaaaacacttggatcattgctacatcaagccagtagagatctggccactccaagtgagagctctccaaatcttaccttgctcatctgccccaactttttttttttttttttttaaggcagaatacttaaggaagagtatttactaaatgttcatcatttttacattacaggaaactcactttggg

SEQ ID NO: 104471 - DNA, 207 bp, Homo sapiens
gagagtttttgcctcatttacatgattaataggattcaatgttccagaaacaaaacacacacatgcttagaggtggaggggaagacagtaaacatacatactaagtgttaacagtaattatctttagatggtataaatatgggtaattacggccggacagtggcttacacctgtaaccccagcactttgagaggccaaggcaggtgg

SEQ ID NO: 104472 - DNA, 383 bp, Homo sapiens
agaaatttcaaagtggaagttcaataaaagcagtcctttaggtcctttaccttaagggtatacaaattaacattcagttcagcacagataaagaattaaagttgaagaaaaatttgttgagatcccaagtatgagccaacaaaattaacctatacatagaagcaatgtggggaagtgtctgagctttggacgcagtctggaactggaatctcaattcccccacttactagctgtgtgaccttggggaggtcatttagcctctctgagctacagcttccacatcatcatcatagtgatattaatgagactttaaaagataacaataatgacaatacctaacatttatataacaatgactacgtgacagaaactattctaagtgg

SEQ ID NO: 104473 - DNA, 686 bp, Homo sapiens
atcggtcagcgtggataaacacatctcagggagggggcccatgaaatatggttgtgggctcagactgagaaggcctcattttcaaactagagctggacgggaaactgcatctgaaagtatttcctggaatagcttgctccgtttcttgagtggcaagtttttttggtaaagatactctcccagacagtggaggtgccatggccttcgaaccagatccttccaatagtaaatcatgttgtcagttcctccttggtggatgggatccatttgtatcatgccagagagccttcaaagtagggtcaagaaacccagaaaattggcccctgcctgctcttggctggctatgggatagaaagagaagcctgagggcaatcgagcaaattaacagagtgagggaagagcaggaactccaatctgttctaacaagtttcctctggtcatagctgatcctgagaaccagcatctcagacccttcgtgtgtaagccgtagggctgttttctttttttctttctttctttcttttttttttttgagacggagtctcgctctgtcacccaggctggagtgcagtggcgcgatcttgtctcactgcaacctccgcctcccaggttcacacacaggctgctgtctcagcctccccagcagctgggactacaggcgcccgccaccatgccaggctaatttt

SEQ ID NO: 104474 - DNA, 1036 bp, Homo sapiens
ccccggatcctgggtacatgatgccaagagctggctctctagataggtttcaggttgggctggtctcgaactcctgacctcaagtgatctgcccgccttggcctcccaatatgctgggattacaggtgtcagccaccatacctggccaagacctcatttcacatggggtcatgattacagctgcaggggttcagacggggatgtgcctgtgggggacacagctcatctgaagcagcatccacttgtggagggggtggagcaggcaacgtgtgggctgggccgactgcacctgctcgccggttgcgcagttgggagctgtggggtctccaggtggcttctgcccgatgtcgtctgagaacacaacgagctccttccgcctcggggccctcacactgccgcgcccctgcctggacatgctctgccccttccccggctgttctcttccgtcaggcctcaactgacacatcccctcttgagagaccccttcctggccccttgctccccagaccccccagagttctttattgaggcacacactgctgcctggcacttcatcgccaccatgtgctgtgcacctgcggtgtgctgggcaccaccgtgagctctgggcgggcagccatggaggaggaagatgtggtcatcgttgacgcctgtggaagcggccccaggctgggttggatagaccacagagtggcccgggtgtctgggggtggtccccagccaggcagcctgtgtccctggaggcaagttctgggcggcaggggttcctggaaccccctcatggcgacggggcaccgggagcctgaggaaggtggtcgggaagtgggggctccgcgccaggctctcagacagctgctggaagaagccagctttgagggtctccaggctgggacaagcccatcagtggccacccctgtgccccgctgtgtgggcggggccccatgaccccacaggtttgctttcagagctgctgctgcccccactcactgttcctgccctgtcccacgtgcagtgggggaccctgacttgctgaggg

SEQ ID NO: 104475 - DNA, 281 bp, Homo sapiens
cacacacataccctgtagtgagaaaaaaatccgtttatatggttctataaaaatctctagctgcttcgagctttaatttcttgaatcaaaagagtattgtttttaatactgagcttctatctaaataaatgctttatttacttaaatgtgtgcttttcaaaaactagtatgattaagacattaacaggatcttagacgtaaaggaacagtcctgttgcttcttccagaagataatatgactcgtttggaattttcctatagtgtagttttttgtctagtgt

SEQ ID NO: 104476 - DNA, 398 bp, Homo sapiens
tgtggattggacatttggtgttatatctaaaaaaaaatctgcctaacccatagccttatgtgttttcttctagaagttttatagttttaggttttacatttgggtctatggtccattttgagttaatttttgtatatggtataagatgcagattgaagatttttttttaatatgtggaaaactgattgttccagcactatttattgaaaagactaatttctccattaaattgtctttgtacctttgttgtgaatcatttgcctatatatgtgtgagtctatttctgaattctcttttctgtttcagtgattcatctatgttgatgccaatgctacactgtcctgataactgtagttaataaagtcttaaagttaggtagtaaaagtctgctattttct

SEQ ID NO: 104477 - DNA, 733 bp, Homo sapiens
ctgttttcttctctcttcatattcagttttgcaacttagggtattggcctaccatataatcggtagtggttgagtcttgccaatttattcttctccgtatccattccttaatgactgtgagatatggcttcagtgtcccctataataattcaagttgtttttattgcattcttggcatgtgtagtacaacttttgtgttttcattaccaattattctggacactgattaacatgtagttgtcaatctcctatcaccttgatgtctttaaaacacacaaaccacgtcagagacctaagtactacatgggctatatctgttcttgccatcttaattggctaccaatcaaagacgtcaataaaagcataaatgtaaatgaaaactcttgagctagccctggtttttaacaccaattttttatgatggattcacaggtgaatagtttcccttctccaccaagacttacattattagaactgtaagaggcagcaaaagtgttaaacaggatggattgtacaaagcattaggctaaaactggatattcattttctgcgtaactgaacaatggcataaaaccagtgtcttgggaagtctagaagagcagtcattctgctttgatttttgaatcacgtaatttcaggatgagtcaagtacagtaatttcatagacacattcctgtaaatctgtgaccaacttctgaaaagaattgcctaatgttaaccatctttctctgga

SEQ ID NO: 104478 - DNA, 277 bp, Homo sapiens
aggaggtgaggctgggattccagactgagagggaaccagtgctaggctgtggcatcaagcagggattcccttgggttgcgggactacactgtctgctagcctgagcccccacccccttttggtgtggctccaactggctggctagctgggttgtaccatttttccttggtagcctacaggcgtgtcctgggctggggctcttgaggctgagagcagtgacaatggaggatgctaccctgcctgcagtgccacagcagctgggcctggctgtgcctgg

SEQ ID NO: 104479 - DNA, 949 bp, Homo sapiens
ggccgagtgtaaagcattgcttgaggttgcccaggtagtttcgccttacacttcttgtcccagtgcaattattagtatgagctccctttcactgtcaaatttccggttggggataaattgcattgtcgttttggtttgagataggaacgatgaggggaggaaggaggtgaggcggtaaggggcgttctctctcttgggtcccgcgcccaagcttccgctggcccaaagaacactataattttgaaccaacagacctctgctggcatctgcgattgcatttttcctgttttaacaacggctgtgctagacgaagtggtgaagcccaaagacttatttttgagctcgctgtaagactgagaaatcacgtagtccttcctgaaaccactaagaggaaaaatgtctgtgacactgcatacagatgtaggtgatattaaaattgaagtcttctgtgagaggacacccaaaacatgtgagatggagtctcgctgtgtcccccaggctggagtacaatggcgcgatctcggctcactgcaacctccgcctcctgggttcaagcaagtcttctgcctcagcctcccgagaactggaagaggaggcaacagtatttggggcaagaagtttgaggatgaatacagtgaatatcttaagcacaatgttagaggtgtgtatctatggtaataatgggccggaaaaccaatggatctcagttcttcatcacctatggcaaaacagccacatttggacctgaaatacaccgtaatttggaaaggtaatagatggtcctggaaactctagatgaggttggagaaagttggccagtaatgtggaagacttttcggactcctaatgatgttcccctttaggacttactattctgggcaaccatttgtccagtattttattgaactggccaatatattgtcaatggtggaacccttatgtggttacc

SEQ ID NO: 104480 - DNA, 351 bp, Homo sapiens
ggctcatgcctgtaatctgagaactttgggaggctgagcaggaggactgcttgaggccaggagttcaagattaacctggccaacatagtgagaccctgtctctattatttaaaaaaaagaaaagtcatggtttgggaatgaaaaaggaagtacagcttaaattacaactttccaaactcattaccctaagaacctgaaagtaacaaccacctcaaacaaagattagataaatccttggataatgcattcataatgcatcacccaagaaacatgtgttggcaatgtgttgggatataccccaaactagtttgatcaaactagtttgattttccagtagtccagtattatctg

SEQ ID NO: 104481 - DNA, 684 bp, Homo sapiens
attgtgttatttttgtaatatcaacaaatttagattcatttcatttcggaaaatttgtcataaatgccagctttctaaacaagaacatgtctagttcatgtggacgtccaaaaatccgtttgtatttttcccagatcaggaattgttttgaagcctttggctatgtttctgtaagcacatggagatttttggaaaaggtagaaatatctgggtaattaaaagttaatggctattttattttcacttaggtaactttttattactctaaaaatttagtagcaagaattagaattatctatatcagagaaaatatgttcctttaatttttttaagaaatcatctgtcttgcaaatgttttctttatgtcacaacaggaaagcttttcagtgagttgagttgtatcttaaagggtaagctgaaagctttctaggcaatgatagtggtgaggagtgggtaagtggagaaaggtgagggaatagcacatttcaagcagagtgaaaacttgtgtgggtacatgagacttggactatttgaagaatagccaggtaggtgaacattctcaaagtagtaccttcatatatattgggaatattgttttcaaattgtatcattgtactataaaatcgacttaaattacttaaaagcctattttttgttttacagttttaaaaattgtattatata

SEQ ID NO: 104482 - DNA, 354 bp, Homo sapiens
taacaaattgtcagacttttttcctgtatgtactcatgctcatagcacaataattggccagaatgaagtaaatttaatatactcatattattttggagagtgtatgctagtaaaacattttggaatcagctggcatctatcaaccttgacacatggttgacattcatcagttgatgtttttaccttaggtatgcatcctttctccccagaaaatctacatgtagatatttatcctaggctgggcgcggtggctcatgcctgtaatcccagcactttgggaggccgaggcgggcagatcacgaggtcaggagatggagaccatcctggctaacatggtgaaaccccatctctact

SEQ ID NO: 104483 - DNA, 152 bp, Homo sapiens
tttttgaatgtgtgacttagaaaagaattacgtgtgtgtgacaacttaaccttagctctgggttgaccctggcactggattagtttctggtcctgacttgtaaccatggaactgggagaaatttaggcagattcttattgagaccaggctcc

SEQ ID NO: 104484 - DNA, 217 bp, Homo sapiens
tcctctgttggcttcccgggtgaggtttggaaaggcgcaggactcaggatggccaggcaggatgatggactcccagctccagctgtcctgggaatgtcttctgtcttggaaatgacccaggagaggcccaggtgtcagggccaggcaggccagggaccacaggggcagtgacagtgcacagggccagccccaccttcctggtgcccctactcagaca

SEQ ID NO: 104485 - DNA, 309 bp, Homo sapiens
acaggcatgtgccatcacgctggctaatttttgtatttttagtagagacggggttttgccatgttgtccaggctggtcttgaattcctgacctcaggtgatctgcctgcctcagcctcccaaagtgctgggattataggcgtgaaccaccacgccgggccagaaacccccagttttgaagtgtgtgtgtcgtcacttcctgcccggtatcagtccctctggtgactgctctttgtttcttgaagaattcagcccctggctggccacggtggctcaacgcctgtaatcccagcactttgggaggccgagg

SEQ ID NO: 104486 - DNA, 418 bp, Homo sapiens
cagatgtgagccgccgtgcctggccatattttttattttattttttccagagtccagatgaggaagaacattgggatatttttaaaatcctgattatattatcctattgatgattaggcattgactatttttttattgtaattgcatattggtcccactctccccactccctgccataagattataagctccttgaaaacaagccttgtgtcttctttacccttgtatctcaagcgtatcttaaggcctggtgtgatgtcattctgtcacatagcagtcagcaagtagttcagtggcagaaagaagttagaaagatttaataagcttgcctttttagatttttaccaatgttattaataaaaatattccttgtgatggttaaaaaaaggaaatttattttgaaagaagatcaattgac

SEQ ID NO: 104487 - DNA, 411 bp, Homo sapiens
acgctccacaccctcagtcatgtggctctgcagagacgccacagctggagcagtcagagggccacacccacctgagactccccagccagcttcccctccagggtgctgggcctagttctggggctccagccagaccttacccccaaaatcactgccttgggtcaggcccagacaacaggaagctgggtgcgctcagcctccattgcctaagctttccggccaggccctgctggagaggtgaaactgcccctccgccaggccccccgcccccagcggctgaagggggtggaatacgtcattcctctcccctattgcgaaagtgagcctggattgaggaaaccaccgctgtctcatcagccgccctcccccagccctccaagggccaggacagctcctgctaccacaggggca

SEQ ID NO: 104488 - DNA, 753 bp, Homo sapiens
gaccttgtaaaagcccatattcagggggcttttacatccaaatgtcgcttttgatatcagtgaaatacaaagtaaaattcttgacttgaataagcagactcaagagtttcaaccttctttagaaacttggacagaattccagcagggtttagaaagtctcaatccttagacctacgttaaacatcaccttaatgtctcttttagacttataggaacaatgttattatgtctctgttttctgtttatagtctgtaagactgggtggaccaccaactggcaattgaaagttgcacagcctggaattacctttattcaattaatgcaaaaacataaagggggagatgttggactgaaggaatgagggttgtcaactcagtataccattggaggctgtatgagcaaacagcaaactgttcttgtgaaagcagttggcaaggtgacaactgaatctgccaccagaaggaatgctgagggcagtcacatcccaggtgccatgttccttgaaattatctacagaaacatctggagcctgttgaacaaaaaaggcaatcacttacacctgtgttaaattaaatagttgactgacagttaccccttcctctctgtttactctacccaataaatatgaagggctgtagaagctcagggctcttgttctctagaagcaaagagcccccgatcccttcttgcaaacagatacttttgtctttgactccatactccattcccgtgttcgtcctcctccattcagtc

SEQ ID NO: 104489 - DNA, 198 bp, Homo sapiens
  misc_feature (2)..(2): n is a, c, g, or t
cnaacatataactgaactcctcacacccaattggacctatctatcaccctatagaggaactaatgttagtataagtaacatgaaaacattcggctcttgttctctagaagcaaagagcccccgatcccttcttgcaaacagatacttttgtctttgactccatactccattcccgtgttcgtcctcctccattcagtc

SEQ ID NO: 104490 - DNA, 794 bp, Homo sapiens
gtgtgacttaaacatctgaatgatgtttagtttcaccattgcagtgtgtatacctttatgcatgtaaaggcagtgttgaaaaattgtgacaaccaggagactggggtttcagcacgatcaaaacagcacccatactagggtcaggctgttgggaattagatcatcactggggcctttcctattagagaggaaagaaaccctatctggagatgaattgcctttcaaatgagcaggaagtcttgtggcggttgtgtttaccaaaagactatatctggattgtaaaactgtactattgttattcctcagaaagctaaacagaattaccgtatgacccagtaattttactgctatctatgtaccctgaataattaaaaacagaggctcaaacagataacctgtatgtcagtattcatagcattattcatagtagccaaaaagtggaaaaaacccaagtgtctgtcaacagatgagtggataaacaaaatttggttaatctataaactggaatattcatctataaaaaggaatgaagttgtgatgcatggatacaacatggttgaaccttaatgttatactaagtgggctgggcgcagtggattacgcttgtaatcccagcactttgggaggctgaggcaggcggatcacgaggtcaggagatcgacaccatcgtggcgaacacagtgaaaccccgtctctactaaaaatacaaaaaaattagccgggcatggtggcgggcacctgtagtcccagctactcaggaggctgaggcaggagaatggtgtgaacccaggagg

SEQ ID NO: 104491 - DNA, 476 bp, Homo sapiens
gactctagaggacccctcgcgaacgtgttatcctgaaggtgccttagttgacaggaggtggaagtcagggggtatcttggctaagggaacaggtggctaaaagaaaccatgtaatgatattaggatgaccacctcaagatgactgcagctcctcctcagctatcactgtaccttcaatctgtgcaacagatctctatgaaaaatgcacgtctcatcttcttataccttccctgtccttgctttcatgatgcaggccaagggttctgagttccagagtggatgacctaggctggagctctggctttgttattgagctgtgtgactttgggtctgttactcaccttctctgtacctcaatctcttcatttttcaaatgtaaataatagaagtatttatcccatggggttaatagcatcaataataaattgatacatttaaccccatgggataacacgttcgcgaggggtacagagctc

SEQ ID NO: 104492 - DNA, 267 bp, Homo sapiens
atctacctctttggcctcccaaagtgctgggattacaggtgtgagccactgtgcccggccagataacctttaagaattcttagaagcccagaaataaagccaaacctatatggtcaactaatttttggcaagagtaacaagaagacacctgggaaaagaacagtatcttcaataaatggtactgagaaaacttgatttccacaggtaaaagaataaaattagactcttacaccacatgcaaaaatcaactcaaaatgcatgcaagac

SEQ ID NO: 104493 - DNA, 388 bp, Homo sapiens
ttctgcactcccagccctgcaaaagatagtgagtcaaattatatgcccaatatattggtacaacaatcagcatttgagaaagccactgcacaaaaactatctataaccaagaaactcatctagagccttagccccctgaaggcacccagaattgaagccaaatgattacacacaacatataatcacacccccaaaagagaaaagaattgaaaattgaaaatgttcttcaaatgaaagcaaatagaaaataactaagtgacagcttctataaatgagaaataatgtgagaacttcagcagtacagaaagacagagtgttttgacacccacaaaggatcacagcagttctgaagcaatggattctaacaaataaaactaaagtgacacat

SEQ ID NO: 104494 - DNA, 773 bp, Homo sapiens
cattcagtatggaaattggattataatgaagctagagtttcttcagaggttgagtaagctgcctaagaaggaacttctgaccacagacatcctgtttcctaaaaataagcagggttaaagctcagtaggaatttagctatgttgcataaacattgcattgggcaacaaaagtggggtaggggtccagctaagtcacctgggcattgcagtgggtaacagttccatctatattctgccatgaggcttatggcaagtgctctaaggaagcactaagtcccctaatggagcagtaagtaccctaaggaaggggaaaacaagactccctaatctgtcaagcatgctgttaaattttaaaaggaggaatccagtgtggttgataaaagctgaacagggtcttataggtaagttgttttgagctgggcttttctgtgtaagatattaacaaggcacacgggttgagataagggcttcttgaattaatgaataaatcccaggcagagtcctctaagacttggaggctctatttaaggacagtcagtaatctgttttgaccagggcttggaccaaatggaggacggcagtggaaaataagcttgggagagggatttgggacccattctagtggacctgggtgcttggttgtaaatagattgggttttatttggttcaatgccactgaaagcttgtggacagtgtcgtgggatggtcaggatctgtttaaggcagacatgtggtatgatcagtaaaggaaactgggagaatagttaagaaga

SEQ ID NO: 104495 - DNA, 870 bp, Homo sapiens
tgggaggccaaggcaggtggatctcttgaggtcaggaatttgagaccagcctgaccaataggccaaaaccctgtctctactaaaaatgcaaaaattagccgggcatggtggcgcacgcctgtagtcgcagctgcttgggaggctgaggcaggagaatcactggaacccgggaggtggaggttgcagtgagccgagatcgcgccactgtactccagcctgggcaatagagcaagactgtctcaaaaagtaaaataaaaataggccaggcgcgatggctcacgcctataatcccagcactttgggaggccaaggtgagcaaatcacgaagtaaggagttcgagaccagcctggccagcatattgaaaccccgtctctactaaaaatacaaaaattagctgggcgtggtggcacacgcctatagtcccagctacgcaggaggctgaggcaggagaatcacttgaacccaggaggcagagtttgcagtgagccaagatcgtgccaccgcactccagcctgggcaacagagcgaggctctatctcaaaagaaaaaaaaaagttactaaagggatacttttagacagaaaacacaggcctgagtgtggcggttgctctccttggtaagggaggtgagggagaagcagcagcccggtgccagtggagcactgggcagtggcagcacccaggaggccaaaggaagtgtctgccatgtccagtgctgttgggccgagtgaagccgtcactggtgactgtgatgggagagtgtgtgacgtgatggagcaaagctctgactggaggagttccagtgagatggaggagaggacatggagacagcgagtgtagacaactgtgacaaaacggggaaatgaagaa

SEQ ID NO: 104496 - DNA, 288 bp, Homo sapiens
atctggttggaccacagtttctggtcctgtttaaatccaagttttgttctacttgttcttctccagtgcttctttctcaaatcttggtcgtttacttcacgtacgtgtactgatgatcagaaccagctgaagactcaaggagaacacttctgagctcttatattatgtagttctctcctctgatttttaccatgtaaattctgatgccttcacctcccagatcttcatactgtttgctcaactcaaagaggtggtcaacatctgtttgggttgctcctccctgtgctg

SEQ ID NO: 104497 - DNA, 135 bp, Homo sapiens
gagatttgtcctttcacctcctgcccttgattctcagaggctcttactgagcctcctcagttttcatggcaacgtaggtatttgcatggtgtcttgtgggcggaggattacctaggtgccgaggcaagagactga

SEQ ID NO: 104498 - DNA, 469 bp, Homo sapiens
gtaatctatagattcactctgcaagaccagttgctttctcagatacagcactctgtctgtggcccacagagtctttctactgtatctaagacctaaacatttggagaagtcagtttttgagccaggtgcggtggcacgcacctatagtcccagctactcgggaggctgagaagggaggatcacttgaatccaggaattggaggctgcagtgagcaatgattgtgtcagtgcattccacagcctgagagacagagcaagaccccatctctttaaaaaaaaaaaaaaaaaaagcaggctgggcacaatggctcgtgcctgtaatctcagcattttgggtggctgaggtgggaggatcttgagtcaggagtttgagaccagcctggacaatatagtgatactccatctcgaaaaagaaaaaatatattggaaaaagaaaaaaaacagtttttgaagtgtttttttttttttt

SEQ ID NO: 104499 - DNA, 757 bp, Homo sapiens
tttggctcaggaaactaggccaacaatggaattcaaagacaatcccaccaaagagaaaaccagcagggtgggcgacgcctgggctccaagaaccggtggggagctccatttccctcagatggagcgtttcctaaccccggggcaactttcccgaaacatggcaggcttgcctgacccaaatagcccctcattcttggctgcacttgtgaccaccgggccgagctcctcggaggcgtggacaaaggaggccttggcgagaacagggttcggtggccagtgggtggagaagtcggtgctggctgcgccgtggagcccgtggatcaacatttgctgaggacctcagtgcggaaagtcgtggtcgcacttccttccgggtctgctgagctgccactcacggcgggagagttgggacgtcctggaattctggaaagcctcctgctctgaaggagttcaaggttttcctgtccggtctgacatccccagacgtttgccctgctagggctggagaaaggtgtccaggcattgaaggaacaatttgagggacaatctggcttttttttttttaacagttcttttctaaacacctcagaatgaatgaaacaaagtcctatttatcactagagatgaagacacatccctgatttacgttgccacgtggggagaagtgctttgtttctactcagcagaaggagacaggggcaggcgggaggagctgtctcaggaacaccagcctgggtttcccaccctccctgctgtg

SEQ ID NO: 104500 - DNA, 328 bp, Homo sapiens
tctaatataaaatatttaattttgaatggttctccattaaggcaacaaattgccagaggatagggagtgcctgggaaaggtgacagatgccaagtcacattctgtttgagttgcaccctgaaacccatgccaggaaaatgaaatgtggagttctgtttgactgcttccactcaacagctccctctcctcaggagaatgcatgttcccaaaacaatactgagagggaggttcaatgtttaattcatcttaaaaattattttttatatttggaagcatgcaaaacacagtaaaatttacaataaaaagcatcctgacaaaatgcagagaa

SEQ ID NO: 104501 - DNA, 506 bp, Homo sapiens
aaaggaaaaagtaatattgtgaaaatctcaaattatcccaggtggaaggagaaggaattttgtttttcatgttttcatggcttatcttatgtttataagagcaacacacctaccttcaagaaaaaatacagacttttgtacgcaacttactaggggaagtaaaaaatgtaggttgaggaaaatcttataaataatgctttaaaagaacatttcatttagactccgattctcatcttaaattccatattttataagaaatcaggaggagcggatatttagaagtgttatgagagagtaagttgggcataaaggctgctttaagtataattcagatcacctgcattttataattttatttccaaggtaggccatgtaaaattaaaatgcacacactccactgggttttttatatacctctataattgacactttcttctttaaaattatgttcaaataaatatactgaatcatccaaaactctttttaccctactttaaaagctgatc

SEQ ID NO: 104502 - DNA, 433 bp, Homo sapiens
aatgacacaatttcacttgactcttgaccaataggaatgaaaacaggaagcattctggaaacatctgttatttcaatgatacccacccaaatccttccctcctaggacttagtagtatcattgaaatgacagatgtcttcagatgtttcatctagttaaatattttccttctatatctgaaatttttaaaattaaaacattccacctgccaagctctcactaccctctctactaatgaggtagagacatatgaagtatttctctgaattaaccaatttatttttttttgcaatcaaaataaaaccgtgtttccagaggtcaaagactaactaacttaaatctccattagcattttatattaatgtatattctccagacatctatagaaataacacacctatgctacattttggaggtaatgctttggtgatag

SEQ ID NO: 104503 - DNA, 209 bp, Homo sapiens
tgggggagggcagaataggattacaaattgagttgtattgattctaaatggtatttgaggataaaaaagatgtttccagccaagcgtggtggctcacacctgtaatcccagcattttgggaggtcaaggtggatggatcacctgaggtcaggagttcgagaccagcctggccaacatggtgaaaccccatctgtatgaaaaacacaatg

SEQ ID NO: 104504 - DNA, 202 bp, Homo sapiens
ctccaatgtcccctggggccaggtaggtacataaaggagtgagggaggttaggaggggtctgtggtgtgtgaggaagcacacagccactgctcaaatcctgcatagttgctctatggtggtgtgggcccagtgtggcctgatttgatgaaattttttttttttttgaggcgaagtcttgctctgtagttaccaggctggagt

SEQ ID NO: 104505 - DNA, 275 bp, Homo sapiens
aggccacgtgatttgtatctgtctactctccccatggaactgaaactctccaggggcccttaggagggtaaaggtaagaaaagcaaggacttctgagggtcatttcctccaagaagccaagccaagctgcaagaaggcgacgtctcaaactgtggctgtgataagacaaatccatcttcactctgggagaagcacctgttccctggctctcaatgggagatgcaaatggccctgtgatttaacctgtctggctcagccacagctgtgcatgcctc

SEQ ID NO: 104506 - DNA, 434 bp, Homo sapiens
ggagccctgtgggtccaggggaggggactggacgcagccccatgacaatgctcagacctgggctaggaactggaagcctgtggttcctctgggctgtaggggttggggccccacagtgatggcagagccaggacctcatacacagcagcatggactccagacccgagcgggacctccgttctggtcccagggtgacctgggctgagtggcccagcaatcagggaccacttcagggtccctctgcactggtctgtccctctcacccagtctggacccctgtggggcacttgccctgtccccagttttccttacaggggacctgggcaaagcccagggaagcttgcacctgttaaggaggccattctcctgcctcccccttggggatccagtttctttctctcgccttggaccttccccaggatcctatggaaact

SEQ ID NO: 104507 - DNA, 190 bp, Homo sapiens
ccctccattggctcagtccctaagactcagcatcctgtgagtaaccctgtggctctcacccagggtcgagctggaagggagaaatgggagcagcttggagaaaataaactagacatggttgcctatctttcagccaaacctctgtcctataaacaagtctctcattgccatcccagggacagagccacaa

SEQ ID NO: 104508 - DNA, 635 bp, Homo sapiens
tgttgtgagagaaaaggagcaggtagaggaatagtcaatgatatatttgtctcacgcccagtaaatcagctctttatataagataaggtgagcatagagtagctacctgtagagatatttaaccttttatctgtagctttctgcttaggaacaaaaggaagggtatcttcttgcatgaaagcatccagcttattttttttcctttggcatagtaaattgaggcaccaagtttttattttccgttcacatttcttcccctccccttttaaaaaaagtcttcagaaaatgcattttagaagaaaatgcgtctctagtcttgggggttttgtctggtctcttgtgactaagacagtttatttctagacaggtcccacgtggttaggaaagctcatttttagcaggttgtaaagtctcatgacccatgaaggaaaaaaataggtggaggaagagagagagaaacaaacaaacaaacaaacaaaaataaagggagaacaatcctggaaaactgacataaaccgtattactctgaagtccctatgtcagtaggcaggtatgaaagtgatttacgtatataaataggttcctgttattttcttccaaagttgacgttgtctagcttcagtttacagggcttt

SEQ ID NO: 104509 - DNA, 604 bp, Homo sapiens
gggaaatacagaaatttataaatggaaattaaaagtattcattatcccgcttccgagaagcaaccagtgttaacattttggtgtgtttctttccattcaatgttactcattaacaactgtacataacttttcatttaactccctttctcaacaaccctgataggattgattttaaagctggggcaagtgaggcacaaaaggtaaggtaataaccttccccagaccagcatagtgatttgtagtatacacacacacccgcccgaagagcctcagtgcttacactaaggagtcgtcttctatgcaatagtgtgagttcatggagtaggaggaagcaatacaaccaaaggttggacagtggaaagctttttagacatcaaccctggccctgtagtcattagcctgtgctttacatagtaactggctaaatataatgaaactcccatcatgactaggatttggcagaagagaatcaatagaaccagtgtcagatgctctgtggttatcctgcaagtcagtggttccaatgtgttttgagaacaagctgttctgttgaaggggtcataccaaggtatggtctggtaattaatgcagtttcctgagacaa

SEQ ID NO: 104510 - DNA, 543 bp, Homo sapiens
agctcagcaggtttaattacaagggacccctcagggtactctgtgagcatagaggagtgtggccctggtggggacacaggcatgcatggatgacagtgctgtcagcctcatcttattctgacctgggctcagccaggagtcacattaaaggtatcatcatggagtcctcccacctcagttcatgacatttcctccaggaaatgtgggatctgggactgatttggttaccatgatctctataacttgggccagccatataaaactgccatggacctcagtttttgtttatatatatttttcctttcaaatttgtcttgtgccccagggggcaacaggaccagtttctcagggttttggtgaagatcagatggaattagggatgtgaaaagatcttgaacagtttaaagcatagagaaagtgcatggagtatcattcgtccatccatccagtcatccatctactcaatgaacatttattattattattttattttttgagatggagtttcgctcttattgcccaagctggagcgcaatggtgtga

SEQ ID NO: 104511 - DNA, 2754 bp, Homo sapiens
ggtgtccggagccgcggacctagagatcccagaagccacagcgcagcggcccggcccgccactatttccaggctctgcggggcaggggccgccgcccaccgcccgccgccatggggctgaaggccgcccagaagacgctgttcccgctgcgctccatcgacgacgtggtgcgcctgtttgctgccgagctgggccgagaggagccggacctggtgctcctttccttggtgctgggcttcgtggagcattttctggctgtcaaccgcgtcatccctaccaacgttcccgagctcaccttccagcccagccccgcccccgacccgcctggcggcctcacctactttcccgtggccgacctgtctatcatcgccgccctctatgcccgcttcaccgcccagatccgaggcgccgtcgacctgtccctctatcctcgagaagggggtgtctccagccgtgagctggtgaagaaggtctccgatgtcatatggaacagcctcagccgctcctacttcaaggatcgggcccacatccagtccctcttcagcttcatcacaggcaccaaattggacagctccggtgtggcctttgctgtggttggggcctgccaggccctgggtctccgggatgtccacctcgccctgtctgaggatcatgcctgggtagtgtttgggcccaatggggagcagacagctgaggtcacctggcacggcaagggcaacgaggaccgcaggggccagacagtcaatgccggtgtggctgagcggagctggctgtacctgaaaggatcatacatgcgctgtgaccgcaagatggaggtggcgttcatggtgtgtgccatcaacccttccattgacctgcacaccgactcgctggagcttctgcagctgcagcagaagctgctctggctgctctatgacctgggacatctggaaaggtaccccatggccttagggaacctggcagatctagaggagctggagcccacccctggccggccagacccactcaccctctaccacaagggcattgcctcagccaagacctactatcgggatgaacacatctacccctacatgtacctggctggctaccactgtcgcaaccgcaatgtgcgggaagccctgcaggcctgggcggacacggccactgtcatccaggactacaactactgccgggaagacgaggagatctacaaggagttctttgaagtagccaatgatgtcatccccaacctgctgaaggaggcagccagcttgctggaggcgggcgaggagcggccgggggagcaaagccagggcacccagagccaaggttccgccctccaggaccctgagtgcttcgcccacctgctgcgattctacgacggcatctgcaaatgggaggagggcagtcccacgcctgtgctgcacgtgggctgggccacctttcttgtgcagtccctaggccgttttgagggacaggtgcggcagaaggtgcgcatagtgagccgagaggccgaggcggccgaggccgaggagccgtggggcgaggaagcccgggaaggccggcggcggggcccacggcgggagtccaagccagaggagcccccgccgcccaagaagccagcactggacaagggcctgggcaccggccagggtgcagtgtcaggacccccccggaagcctcctgggactgtcgctggcacagcccgaggccctgaaggtggcagcacggctcaggtgccagcacccgcagcatcaccaccgccggagggtccagtgctcactttccagagtgagaagatgaagggcatgaaggagctgctggtggccaccaagatcaactcgagcgccatcaagctgcaactcacggcacagtcgcaagtgcagatgaagaagcagaaagtgtccacccctagtgactacactctgtctttcctcaagcggcagcgcaaaggcctctgaactactggggacttcggaccgcttgtggggacccaggctccgcccttagtcccccaactctgagcccatgttctgcccccagcccaaaggggacaggcctcacctctacccaaaccctaggttcccggtcccgagtacagtctgtatcaaacccacgattttctccagctcagaacccagggctctgccccagtcgttagaatataggtctcttctcccagaatcccagccggccaatggaaacctcacgctgggtcctaattaccagtctttaaaggcccagcccctagaaacccaagctcctcctcggaaccgctcacctagagccagaccaacgttactcagggctcctcccagcttgtaggagctgaggtttcacccttaacccaaggagcacaggtcccacctccagcccgggagcctaggaccactcagcccctaggagtatatttccgcacttcagaattccatatcttgcgaatccaagctccctgccccaaataacttcagtcctgcttcagaatttggaaatcctagtttcctctccttcgtatcccgagtctgggacacaaaactccgcccccagcctatgagcatcctgagccccgccctcttcctgacgaaactggccccggatcagagcaggacctcccttccgaccctctgggaacctcccagaggtccagcccatctcggagcatcccggaggaaatctgcagaggggttaggagtgggtgacaagagcctgatctcttcctgttttgtacatagatttatttttcagttccaagaaagatgaatacattttgtt

SEQ ID NO: 104512 - DNA, 2385 bp, Homo sapiens
ctaagatcccggacgagcatccttatacggccctgggtctccgggatgtccacctcgccctgtctgaggatcatgcctgggtagtgtttgggcccaatggggagcagacagctgaggtcacctggcacggcaagggcaacgaggaccgcaggggccagacagtcaatgccggtgtggctgagcgggtattgttccctccccccagccttgtccccttcatactgtagtagcccaagccacccaagggactccattttcttgggccacacccctttcttcccatcaccacccacataggaagggaagacagaagagccccttttcctggctgtcattccctgaagcaggcacagggtgggccatcatgagacataatgatctcatccccccctaagagctggctgtacctgaaaggatcatacatgcgctgtgaccgcaagatggaggtggcgttcatggtgtgtgccatcaacccttccattgacctgcacaccgactcgctggagcttctgcagctgcagcagaagctgctctggctgctctatgacctgggacatctggaaaggtaccccatggccttagggaacctggcagatctagaggagctggagcccacccctggccggccagacccactcaccctctaccacaagggcattgcctcagccaagacctactatcgggatgaacacatctacccctacatgtacctggctggctaccactgtcgcaaccgcaatgtgcgggaagccctgcaggcctgggcggacacggccactgtcatccaggactacaactactgccgggaagacgaggagatctacaaggagttctttgaagtagccaatgatgtcatccccaacctgctgaaggaggcagccagcttgctggaggcgggcgaggagcggccgggggagcaaagccagggcacccagagccaaggttccgccctccaggaccctgagtgcttcgcccacctgctgcgattctacgacggcatctgcaaatgggaggagggcagtcccacgcctgtgctgcacgtgggctgggccacctttcttgtgcagtccctaggccgttttgagggacaggtgcggcagaaggtgcgcatagtgagccgagaggccgaggcggccgaggccgaggagccgtggggcgaggaagcccgggaaggccggcggcggggcccacggcgggagtccaagccagaggagcccccgccgcccaagaagccagcactggacaagggcctgggcaccggccagggtgcagtgtcaggacccccccggaagcctcctgggactgtcgctggcacagcccgaggccctgaaggtggcagcacggctcaggtgccagcacccgcagcatcaccaccgccggagggtccagtgctcactttccagagtgagaagatgaagggcatgaaggagctgctggtggccaccaagatcaactcgagcgccatcaagctgcaactcacggcacagtcgcaagtgcagatgaagaagcagaaagtgtccacccctagtgactacactctgtctttcctcaagcggcagcgcaaaggcctctgaactactggggacttcggaccgcttgtggggacccaggctccgcccttagtcccccaactctgagcccatgttctgcccccagcccaaaggggacaggcctcacctctacccaaaccctaggttcccggtcccgagtacagtctgtatcaaacccacgattttctccagctcagaacccagggctctgccccagtcgttagaatataggtctcttctcccagaatcccagccggccaatggaaacctcacgctgggtcctaattaccagtctttaaaggcccagcccctagaaacccaagctcctcctcggaaccgctcacctagagccagaccaacgttactcagggctcctcccagcttgtaggagctgaggtttcacccttaacccaaggagcacaggtcccacctccagcccgggagcctaggaccactcagcccctaggagtatatttccgcacttcagaattccatatcttgcgaatccaagctccctgccccaaataacttcagtcctgcttcagaatttggaaatcctagtttcctctccttcgtatcccgagtctgggacacaaaactccgcccccagcctatgagcatcctgagccccgccctcttcctgacgaaactggccccggatcagagcaggacctcccttccgaccctctgggaacctcccagaggtccagcccatctcggagcatcccggaggaaatctgcagaggggttaggagtgggtgacaagagcctgatctcttcctgttttgtacatagatttatttttcagttccaagaaagatgaatacattttgtt

SEQ ID NO: 104513 - DNA, 2616 bp, Homo sapiens
ggcacgagggggcggcgtgcgccgcggtgcctagtgtgggatgtaagcgcggaggccgccgcccaccgcccgccgccatggggctgaaggccgcccagaagacgctgttcccgctgcgctccatcgacgacgtggtgcgcctgtttgctgccgagctgggccgagaggagccggacctggtgctcctttccttggtgctgggcttcgtggagcattttctggctgtcaaccgcgtcatccctaccaacgttcccgagctcaccttccagcccagccccgcccccgacccgcctggcggcctcacctactttcccgtggccgacctgtctatcatcgccgccctctatgcccgcttcaccgcccagatccgaggcgccgtcgacctgtccctctatcctcgagaagggggtgtctccagccgtgagctggtgaagaaggtctccgatgtcatatggaacagcctcagccgctcctacttcaaggatcgggcccacatccagtccctcttcagcttcatcacaggcaccaaattggacagctccggtgtggcctttgctgtggttggggcctgccaggccctgggtctccgggatgtccacctcgccctgtctgaggatcatgcctggagctggctgtacctgaaaggatcatacatgcgctgtgaccgcaagatggaggtggcgttcatggtgtgtgccatcaacccttccattgacctgcacaccgactcgctggagcttctgcagctgcagcagaagctgctctggctgctctatgacctgggacatctggaaaggtaccccatggccttagggaacctggcagatctagaggagctggagcccacccctggccggccagacccactcaccctctaccacaagggcattgcctcagccaagacctactatcgggatgaacacatctacccctacatgtacctggctggctaccactgtcgcaaccgcaatgtgcgggaagccctgcaggcctgggcggacacggccactgtcatccaggactacaactactgccgggaagacgaggagatctacaaggagttctttgaagtagccaatgatgtcatccccaacctgctgaaggaggcagccagcttgctggaggcgggcgaggagcggccgggggagcaaagccagggcacccagagccaaggttccgccctccaggaccctgagtgcttcgcccacctgctgcgattctacgacggcatctgcaaatgggaggagggcagtcccacgcctgtgctgcacgtgggctgggccacctttcttgtgcagtccctaggccgttttgagggacaggtgcggcagaaggtgcgcatagtgagccgagaggccgaggcggccgaggccgaggagccgtggggcgaggaagcccgggaaggccggcggcggggcccacggcgggagtccaagccagaggagcccccgccgcccaagaagccagcactggacaagggcctgggcaccggccagggtgcagtgtcaggacccccccggaagcctcctgggactgtcgctggcacagcccgaggccctgaaggtggcagcacggctcaggtgccagcacccgcagcatcaccaccgccggagggtccagtgctcactttccagagtgagaagatgaagggcatgaaggagctgctggtggccaccaagatcaactcgagcgccatcaagctgcaactcacggcacagtcgcaagtgcagatgaagaagcagaaagtgtccacccctagtgactacactctgtctttcctcaagcggcagcgcaaaggcctctgaactactggggacttcggaccgcttgtggggacccaggctccgcccttagtcccccaactctgagcccatgttctgcccccagcccaaaggggacaggcctcacctctacccaaaccctaggttcccggtcccgagtacagtctgtatcaaacccacgattttctccagctcagaacccagggctctgccccagtcgttagaatataggtctcttctcccagaatcccagccggccaatggaaacctcacgctgggtcctaattaccagtctttaaaggcccagcccctagaaacccaagctcctcctcggaaccgctcacctagagccagaccaacgttactcagggctcctcccagcttgtaggagctgaggtttcacccttaacccaaggagcacaggtcccacctccagcccgggagcctaggaccactcagcccctaggagtatatttccgcacttcagaattccatatcttgcgaatccaagctccctgccccaaataacttcagtcctgcttcagaatttggaaatcctagtttcctctccttcgtatcccgagtctgggacacaaaactccgcccccagcctatgagcatcctgagccccgccctcttcctgacgaaactggccccggatcagagcaggacctcccttccgaccctctgggaacctcccagaggtccagcccatctcggagcatcccggaggaaatctgcagaggggttaggagtgggtgacaagagcctgatctcttcctgttttgtacatagatttatttttcagttccaagaaagatgaatacattttgtt

SEQ ID NO: 104514 - DNA, 2195 bp, Homo sapiens
ctaagatcccggacgagcatccttatacggccctgggtctccgggatgtccacctcgccctgtctgaggatcatgcctgggtagtgtttgggcccaatggggagcagacagctgaggtcacctggcacggcaagggcaacgaggaccgcaggggccagacagtcaatgccggtgtggctgagcgggtattgttccctccccccagccttgtccccttcatactgtagtagcccaagccacccaagggactccattttcttgggccacacccctttcttcccatcaccacccacataggaagggaagacagaagagccccttttcctggctgtcattccctgaagcaggcacagggtgggccatcatgagacataatgatctcatccccccctaagagctggctgtacctgaaaggatcatacatgcgctgtgaccgcaagatggaggtggcgttcatggtgtgtgccatcaacccttccattgacctgcacaccgactcgctggagcttctgcagctgcagcagaagctgctctggctgctctatgacctgggacatctggaaaggtaccccatggccttagggaacctggcagatctagaggagctggagcccacccctggccggccagacccactcaccctctaccacaagggcattgcctcagccaagacctactatcgggatgaacacatctacccctacatgtacctggctggctaccactgtcgcaaccgcaatgtgcgggaagccctgcaggcctgggcggacacggccactgtcatccaggactacaactactgccgggaagacgaggagatctacaaggagttctttgaagtagccaatgatgtcatccccaacctgctgaaggaggcagccagcttgctggaggcgggcgaggagcggccgggggagcaaagccagggcacccagagccaaggttccgccctccaggaccctgagtgcttcgcccacctgctgcgattctacgacggcatctgcaaatgggaggagggcagtcccacgcctgtgctgcacgtgggctgggccacctttcttgtgcagtccctaggccgttttgagggacaggtgcggcagaaggtgcgcatagtgagccgagaggccgaggcggccgaggccgaggagccgtggggcgaggaagcccgggaaggccggcggcggggcccacggcgggagtccaagccagaggagcccccgccgcccaagaagccagcactggacaagggcctgggcaccggccagggtgcagtgtcaggacccccccggaagcctcctgggactgtcgctggcacagcccgaggccctgaaggtggcagcacggctcaggtgccagcacccgcagcatcaccaccgccggagggtccagtgctcactttccagagtgagaagatgaagggcatgaaggagctgctggtggccaccaagatcaactcgagcgccatcaagctgcaactcacggcacagtcgcaagtgcagatgaagaagcagaaagtgtccacccctagtgactacactctgtctttcctcaagcggcagcgcaaaggcctctgaactactggggacttcggaccgcttgtggggacccaggctccgcccttagtcccccaactctgagcccatgttctgcccccagcccaaaggggacaggcctcacctctacccaaaccctaggttcccggtcccgagtacagtctgtatcaaacccacgattttctccagctcagaacccagggctctgccccagtcgttagaatataggtctcttctcccagaatcccagccggccaatggaaacctcacgctgggtcctaattaccagtctttaaaggcccagcccctagaaacccaagctcctcctcggaaccgctcacctagagccagaccaacgttactcagggctcctcccagcttgtaggagctgaggtttcacccttaacccaaggagcacaggtcccacctccagcccgggagcctaggaccactcagcccctaggagtatatttccgcacttcagaattccatatcttgcgaatccaagctccctgccccaaataacttcagtcctgcttcagaatttggaaatcctagtttcctctccttcgtatcccgagtctgggacacaaaactccgccccaccccgcccgtcagatcctcaagtcacctagcctccgc

SEQ ID NO: 104515 - DNA, 243 bp, Homo sapiens
tatttgtagtagagacagggtttcaccatgttggccaggctggtctcgaactcctgatctcaggtgatccacccgccttggcctcccaaagtgctgggattacagtgtgagccaccgcaccccggcctggggatggctttaaggcaaggaatgagtgaggtagtgaggcagtctctgaccccttgtctattcagggtccagcatacattctgtcacaggggtagtttcatttgttggatgagg

SEQ ID NO: 104516 - DNA, 757 bp, Homo sapiens
gagtagctgggactacaggcacctgccgccacgcctggctaattttttgtatttttagtagagacagggtttcaccatgttagccaggatggtctcgatctcctgacgtcgtgatccgcctgcctcgacctctcaaagtgctaggattacaggcgtgagccaccgtgcccggccgcctagttgatcttaattctggtaggaaatttggaaatcatctagtgcagcccctcctttttctcaatcatgacatttgagactcgggcacagtggtttataccttaatctcagcactttgggaggaccggggtgggaggattacttgagccctggaggctgaggctgcagtgagccatgatcatgccactgcactccagcctgggtgacagagtaaaacactgtctaaaaagaaagatattgagacccaaattacttaagtgatttacccagttaccttccttcatggaatttgagtgaaactttctttccgttttacatggatttattgttcaggataacctagattggtggtttccaagctttttaatagaactttttttttccttaaaaaaaaaaaaaatctcacctagtccgggtgcggtgactcacgcctgtaattccagcactttgggaggccaaggcggggggattgcttgagcccaggagttcgaaccagcctaggcaacatgatgaaaccccgcctctgtaaaaaataccgaaattagccaggtatggtggcgtgcgcctgcagtcccagctg

SEQ ID NO: 104517 - DNA, 5762 bp, Homo sapiens
cggtcccccgagatcagcaggagattactgcttactctgggtccgcgccacctttaaagctcacggccgcggtctgcgtcttcgttcttgaagtcagcaagaccgcaagcccaccgggaggagcagacgactccggacgcgccatctttaagagctgtaacactcaccgcgaggtccgtggttttattcttaaagtcggcgagaccaacaacccagcagaaggaataaattccgcacacagggaaaagatgccgttccaccatgtgaccgccggcttgttgtacaaggggaattacctcaaccgatcgctctctgctggcagtgacagcgaacagctggctaatatctccgtggaggagctcgatgaaatccgagaggcctttcgggttctggaccgggatgggaacggcttcatctccaagcaggagctgggcatggccatgcgctctttggggtacatgccaagcgaggtggagctggccatcatcatgcagcgcttggacatggacggggatggccaggtggattttgatgaattcatgaccattcttggccccaaactggtgtcttcagaaggtcgcgatggttttcttgggaacacgatagacagcatattctggcagtttgacatgcaaaggataactctggaagagttgaagcacattctctatcatgccttccgagaccacctaacgatgaaggacattgagaacatcattatcaatgaggaagagagcctgaatgagacctcggggaactgccaaacagagtttgaaggagtgcattcccagaagcagaacagacagacctgcgtccggaagagcctcatatgcgcctttgctatggccttcatcatcagtgtcatgctgattgcagccaaccagatactccggagcggcatggagtagcagcctcccgccagccacactgtgttgcagctcaccgcgcatgtgcatgccgtgcgggcagactcttcctccacacagcagacacggacctatggactatggatggatgcggacgatggaaccgttcagtaaagaacccaaggttgagtgcaactggggttgcacttcagcttcatctccttggcagggacactaaagggctgtcttcagtgctttaatggttttgttttctaatgcaataaatcgccaggatttccaaattattgcttcaaccatcagtcataactctagagaaaaacttcatcttcatctcggaattccagcagccatccaggtataatggtgagagagcaagagagaggcatgaacacacagtcacctccactccccattctttcaacccaagggtcaacaggagactctctgctgaggtcaaccctcagttccaagaggctgacttcagggttgccacagaagagggggctttccatcccaccctggcttccttcctccacccagtggagacccccccaaggcatgaggggaaagccattaagtggggtgcagcccctggcggtcttcagctgcacccctcaccgcttccgttcttactgccttttctagaggactgccattggtagagctggggtgctctcagtttccgtcggcacttggctttctgttcctagagcccatcccgcaccagcattttggaacctgcagagagcctttctcccagctttgccgcctgtgctgccattagagaaaaaaagaagcataatcgtgggcatctctataacatagacagatatatatatttggcttcttcgtgtgtgatgtcattcttccctaatcgcttacacctaatataagcttgtcctccctcccacactcatccctgcttctttggggcaggggtgaggcaggttgaggggggaggggactgggactggcggtgaggttttgatacccacacccagccatctggagtcatggagacccaccacgtctctatgccggatgacctttgtaagttaaggtccttgtgcatcttacctttcccttaccttggagtttgctttgttagtcttccccagctaaaaagagaaatgcaatccaaaatggaaagatggagagatcaaacgactgtattttcacataagatcttctggccttcagattctgcaactgactcattttcaggaggttgggggaaaagatgtttatgagtttagccaacagaacaggtaatttactcctgcctgcagaatacttttcgttggggaagagaactgaatccaaggatctgttttcaacaccattccaagtctgtaatttcctgacttttcctagatgtcagccactactatgaattcaagcttgtgtagtcagattagccagtaatctctagatgtaatagttccctttgtacttttccaagctcaggtctttattttgtaatggaattaccttgctcctacttcttttgattacatcctaaaactacatgcttccccccttccagtagcgagccaccagaagctttcttgtctctatgcagtgggtaggattttttggtgcgttgtgtgttcctgatctccctccctgtcttcctgctcagctttctccctactgccttttcagacttggagcacccaaggtctccaatgaaagttttctcattcacctctgcaagtgctactggcaacagcctgagggcagctgtagaaactttccctctgtgggagactatgaatattcctgatgagcacaagtaaaactaaggcttcagccataatatggaggagggagcagatgtaagctcccaagagcctgggggatcacaggtccctctgcaaaacttcctggagttcagcccagcaaggccagaccaaggaggcagcaacctgcctttcccccttacctgccctgctgcctgcacactgcatgcctgccccttctgctgctcctgttggctgactcaccactgtccccttaggattggaattctcaactagaaccggtccaaatgcagaatattaatacatcgaacaacttcatccttaatctctgccctgggcagtttgccctctcccatctggacttagatgggagggcatagcagatcttgaagggatatactttcctgtttttccctgacccccgaaccacccaaccacatccataggggtgcaggaccctaagtagactgggtagaaaccccagggatgattcttcaaagccccctcctccatgagaggggactgaaatgctgcagctgaggctggtcttcagggcagaaaatgagtacttctttgaaggtggcttttctgcgagttcttctgcctcctgctggagaacagagacccttcaagaggtgagggttagatttcattggcagagagattagccactgtgcaggagtagggaggaaaaggagttctggagaggcgccgccatcctgttttctggaaaggctgcaggattcctttcctaacggtgaccttcttcttgctcccagtgacctggaagcaagcccaccctccccaggggaaaatctaggagaatgcattcctctgcagactgctagagagagatggcaagaaggaagacacagaattctttctgacagcctaggagttatcttcccactgtggtaaccccccatgtggcacccagggactgaaggacacagtgcgtggagacggccctgagctagcggcattccttagacttcaggagctcagagtttgtcccggtgacttgcaccctggctgctttgcttggacagtttgtcttgggtatagggaagccttccttgtcaggcagccaactcccagccctgttcacacaaattttatgctagggccccatgccagtcagtgtccccatcatggtggctatgaagctcacggctgaagattccagaaggtcctggtctcccatgcccaagggatgccatgtagccccagctggaagtgacttccgcaggaattgagagggaatagctcacccctcattctgtcctccggacttaggaaccagtgaccttggctgcccaactgtgtggaggctgagtgattgacaaacacaggttggctcattcttgctgcaagagcaggtaccccccgccgcccccctggaaagcacaagtgatgagcaagaaggcattttccttgggagagaaggggaaatggaccctgacccccttgatccccaaagaagctgcgccccacctttccagatacccacaaagcccccagacagaatctagcatcgggactattagcaatggcttccagaatgtgcttgggtcccacgtgactgatctgacaaaaaaaaaagagggatattaccatggcaacccttgcattccaccctgagtttgccaaggcacacaaaaatagggaacattttcttaaagaacactccaattcagcctgagtgcaacctgactctctgcatctgtatcctgctgggagaggcaattacccttaaagaatctgggtggtatctctgcctttttgtctggcatttgaacttgtccttctatttactcaggagagcaggagctacctgtaagccctggtatctccccatccctactcccagccccttctcccagggtccagagccaggaccccttaatctaggtaaattgacagaaatatcatcttggaaggcaaacaagatattaagcctccaatctttaaaagtatcggtttgcctgttgagcacactcctgcaagccaaacacgtgaactttggtgaactgaggtttaggtgtggtcttaggcaaacccagtggtttcagaaatgtctgggtgttttatttgcagagaacaagatgtgtcttatgagtcttctttctcaatacctgccctgtctcaaatctcacttgacaaatggtctacgatcttgcagttatccaaaagagcctatgaaaaatggacagctgcttttgacaataatgcccctcccaacttcccattcatagaatcataaagcgatatgtttcagaactgagagagaaaagtttaccttttattccaaatgcctcgtactcggtttaagtccagactcaggtcataaatcaaagacagttttgcacgttgctcttcacctaaatctagcagtttccctgaggccctatgagggcatggacagaaaatgaaggatgcaaccacccaggacagctccctggtttgggctggcctggccacgtgtggtcacatgtcctgggatctgtgtttactgtgtccttgctctccttccttgcagaagctgctaagctctgctcctcctaactgcaggtctcaaaccctattgggtcattttgccacactatttctccaaaggcccatagtcattacattttttaccatttcaccaagataacagggggggtctggaattcccctgctaggaagggccccttttcctatatcaccgtgatggtacagatgaactgagatgaaacttttagacttcagcacgtcacacatcctggttgtataaccaggaggtctgcagagctgcaacccctgaagaacatctgtcttaaaagacctcaaatcagaacattctcattggcctcttcagtgatccccatggagctaagagtccgtaacctaaaggccttaccatagccatcttccctccacacctgattgctcaactgccccagaaggggagaatctatctgaaatagaaaagaagcattaaggaccaggtgcggtggctcacacctataatcccagcactttgggaggccaaggcaggtggatcacttaagatcaggagttcaagaccagcctggccaacgtggtgaaaccccatctctactaaaaaaaa

SEQ ID NO: 104518 - DNA, 5793 bp, Homo sapiens
cgcccagatcgcgctccgagtcgacgagggggctcgtgcaggtcccggcgcgcgcgtggggagcggcccgggggcgccgagggagccggcggcagcgaggatgccggcacggggacgcggctgcctgctgggggtgtgagcgagaggctgagcgctgcccgctcggcgcatccattccgcaccgccccctccctgcgggcctcggaggaagccccccgcgctgtgcggaggcgcctcggctgccgggctgcggagccccggcccagcaagagggaaaagatgccgttccaccatgtgaccgccggcttgttgtacaaggggaattacctcaaccgatcgctctctgctggcagtgacagcgaacagctggctaatatctccgtggaggagctcgatgaaatccgagaggcctttcgggttctggaccgggatgggaacggcttcatctccaagcaggagctgggcatggccatgcgctctttggggtacatgccaagcgaggtggagctggccatcatcatgcagcgcttggacatggacggggatggccaggtggattttgatgaattcatgaccattcttggccccaaactggtgtcttcagaaggtcgcgatggttttcttgggaacacgatagacagcatattctggcagtttgacatgcaaaggataactctggaagagttgaagcacattctctatcatgccttccgagaccacctaacgatgaaggacattgagaacatcattatcaatgaggaagagagcctgaatgagacctcggggaactgccaaacagagtttgaaggagtgcattcccagaagcagaacagacagacctgcgtccggaagagcctcatatgcgcctttgctatggccttcatcatcagtgtcatgctgattgcagccaaccagatactccggagcggcatggagtagcagcctcccgccagccacactgtgttgcagctcaccgcgcatgtgcatgccgtgcgggcagactcttcctccacacagcagacacggacctatggactatggatggatgcggacgatggaaccgttcagtaaagaacccaaggttgagtgcaactggggttgcacttcagcttcatctccttggcagggacactaaagggctgtcttcagtgctttaatggttttgttttctaatgcaataaatcgccaggatttccaaattattgcttcaaccatcagtcataactctagagaaaaacttcatcttcatctcggaattccagcagccatccaggtataatggtgagagagcaagagagaggcatgaacacacagtcacctccactccccattctttcaacccaagggtcaacaggagactctctgctgaggtcaaccctcagttccaagaggctgacttcagggttgccacagaagagggggctttccatcccaccctggcttccttcctccacccagtggagacccccccaaggcatgaggggaaagccattaagtggggtgcagcccctggcggtcttcagctgcacccctcaccgcttccgttcttactgccttttctagaggactgccattggtagagctggggtgctctcagtttccgtcggcacttggctttctgttcctagagcccatcccgcaccagcattttggaacctgcagagagcctttctcccagctttgccgcctgtgctgccattagagaaaaaaagaagcataatcgtgggcatctctataacatagacagatatatatatttggcttcttcgtgtgtgatgtcattcttccctaatcgcttacacctaatataagcttgtcctccctcccacactcatccctgcttctttggggcaggggtgaggcaggttgaggggggaggggactgggactggcggtgaggttttgatacccacacccagccatctggagtcatggagacccaccacgtctctatgccggatgacctttgtaagttaaggtccttgtgcatcttacctttcccttaccttggagtttgctttgttagtcttccccagctaaaaagagaaatgcaatccaaaatggaaagatggagagatcaaacgactgtattttcacataagatcttctggccttcagattctgcaactgactcattttcaggaggttgggggaaaagatgtttatgagtttagccaacagaacaggtaatttactcctgcctgcagaatacttttcgttggggaagagaactgaatccaaggatctgttttcaacaccattccaagtctgtaatttcctgacttttcctagatgtcagccactactatgaattcaagcttgtgtagtcagattagccagtaatctctagatgtaatagttccctttgtacttttccaagctcaggtctttattttgtaatggaattaccttgctcctacttcttttgattacatcctaaaactacatgcttccccccttccagtagcgagccaccagaagctttcttgtctctatgcagtgggtaggattttttggtgcgttgtgtgttcctgatctccctccctgtcttcctgctcagctttctccctactgccttttcagacttggagcacccaaggtctccaatgaaagttttctcattcacctctgcaagtgctactggcaacagcctgagggcagctgtagaaactttccctctgtgggagactatgaatattcctgatgagcacaagtaaaactaaggcttcagccataatatggaggagggagcagatgtaagctcccaagagcctgggggatcacaggtccctctgcaaaacttcctggagttcagcccagcaaggccagaccaaggaggcagcaacctgcctttcccccttacctgccctgctgcctgcacactgcatgcctgccccttctgctgctcctgttggctgactcaccactgtccccttaggattggaattctcaactagaaccggtccaaatgcagaatattaatacatcgaacaacttcatccttaatctctgccctgggcagtttgccctctcccatctggacttagatgggagggcatagcagatcttgaagggatatactttcctgtttttccctgacccccgaaccacccaaccacatccataggggtgcaggaccctaagtagactgggtagaaaccccagggatgattcttcaaagccccctcctccatgagaggggactgaaatgctgcagctgaggctggtcttcagggcagaaaatgagtacttctttgaaggtggcttttctgcgagttcttctgcctcctgctggagaacagagacccttcaagaggtgagggttagatttcattggcagagagattagccactgtgcaggagtagggaggaaaaggagttctggagaggcgccgccatcctgttttctggaaaggctgcaggattcctttcctaacggtgaccttcttcttgctcccagtgacctggaagcaagcccaccctccccaggggaaaatctaggagaatgcattcctctgcagactgctagagagagatggcaagaaggaagacacagaattctttctgacagcctaggagttatcttcccactgtggtaaccccccatgtggcacccagggactgaaggacacagtgcgtggagacggccctgagctagcggcattccttagacttcaggagctcagagtttgtcccggtgacttgcaccctggctgctttgcttggacagtttgtcttgggtatagggaagccttccttgtcaggcagccaactcccagccctgttcacacaaattttatgctagggccccatgccagtcagtgtccccatcatggtggctatgaagctcacggctgaagattccagaaggtcctggtctcccatgcccaagggatgccatgtagccccagctggaagtgacttccgcaggaattgagagggaatagctcacccctcattctgtcctccggacttaggaaccagtgaccttggctgcccaactgtgtggaggctgagtgattgacaaacacaggttggctcattcttgctgcaagagcaggtaccccccgccgcccccctggaaagcacaagtgatgagcaagaaggcattttccttgggagagaaggggaaatggaccctgacccccttgatccccaaagaagctgcgccccacctttccagatacccacaaagcccccagacagaatctagcatcgggactattagcaatggcttccagaatgtgcttgggtcccacgtgactgatctgacaaaaaaaaaagagggatattaccatggcaacccttgcattccaccctgagtttgccaaggcacacaaaaatagggaacattttcttaaagaacactccaattcagcctgagtgcaacctgactctctgcatctgtatcctgctgggagaggcaattacccttaaagaatctgggtggtatctctgcctttttgtctggcatttgaacttgtccttctatttactcaggagagcaggagctacctgtaagccctggtatctccccatccctactcccagccccttctcccagggtccagagccaggaccccttaatctaggtaaattgacagaaatatcatcttggaaggcaaacaagatattaagcctccaatctttaaaagtatcggtttgcctgttgagcacactcctgcaagccaaacacgtgaactttggtgaactgaggtttaggtgtggtcttaggcaaacccagtggtttcagaaatgtctgggtgttttatttgcagagaacaagatgtgtcttatgagtcttctttctcaatacctgccctgtctcaaatctcacttgacaaatggtctacgatcttgcagttatccaaaagagcctatgaaaaatggacagctgcttttgacaataatgcccctcccaacttcccattcatagaatcataaagcgatatgtttcagaactgagagagaaaagtttaccttttattccaaatgcctcgtactcggtttaagtccagactcaggtcataaatcaaagacagttttgcacgttgctcttcacctaaatctagcagtttccctgaggccctatgagggcatggacagaaaatgaaggatgcaaccacccaggacagctccctggtttgggctggcctggccacgtgtggtcacatgtcctgggatctgtgtttactgtgtccttgctctccttccttgcagaagctgctaagctctgctcctcctaactgcaggtctcaaaccctattgggtcattttgccacactatttctccaaaggcccatagtcattacattttttaccatttcaccaagataacagggggggtctggaattcccctgctaggaagggccccttttcctatatcaccgtgatggtacagatgaactgagatgaaacttttagacttcagcacgtcacacatcctggttgtataaccaggaggtctgcagagctgcaacccctgaagaacatctgtcttaaaagacctcaaatcagaacattctcattggcctcttcagtgatccccatggagctaagagtccgtaacctaaaggccttaccatagccatcttccctccacacctgattgctcaactgccccagaaggggagaatctatctgaaatagaaaagaagcattaaggaccaggtgcggtggctcacacctataatcccagcactttgggaggccaaggcaggtggatcacttaagatcaggagttcaagaccagcctggccaacgtggtgaaaccccatctctactaaaaaaaa

SEQ ID NO: 104519 - DNA, 6037 bp, Homo sapiens
ggctgaataagagaataaaagctggctccccgagcccgctggggaagctcgctggggtgctatccgcttgagtttgtgtttttttctttcctgcttcttaataaagcttactgcttactctgggtccgcgccacctttaaagctcacggccgcggtctgcgtcttcgttcttgaagtcagcaagaccgcaagcccaccgggaggagcagacgactccggacgcgccatctttaagagctgtaacactcaccgcgaggtccgtggttttattcttaaagtcggcgagaccaacaacccagcagaaggaataaattccgcacacagagtctcagtgccttcgctgacgttcctttgatgagcttctaactctctctgagaacatcgccctggacccccgatgcggctgccagagcaacccggagaggggaagcccgagaatgagaaaaagggggacggaggagccctcggagggggagaggagccgccgaggagccaggcccccgacttccccacctgggaaaagatgccgttccaccatgtgaccgccggcttgttgtacaaggggaattacctcaaccgatcgctctctgctggcagtgacagcgaacagctggctaatatctccgtggaggagctcgatgaaatccgagaggcctttcgggttctggaccgggatgggaacggcttcatctccaagcaggagctgggcatggccatgcgctctttggggtacatgccaagcgaggtggagctggccatcatcatgcagcgcttggacatggacggggatggccaggtggattttgatgaattcatgaccattcttggccccaaactggtgtcttcagaaggtcgcgatggttttcttgggaacacgatagacagcatattctggcagtttgacatgcaaaggataactctggaagagttgaagcacattctctatcatgccttccgagaccacctaacgatgaaggacattgagaacatcattatcaatgaggaagagagcctgaatgagacctcggggaactgccaaacagagtttgaaggagtgcattcccagaagcagaacagacagacctgcgtccggaagagcctcatatgcgcctttgctatggccttcatcatcagtgtcatgctgattgcagccaaccagatactccggagcggcatggagtagcagcctcccgccagccacactgtgttgcagctcaccgcgcatgtgcatgccgtgcgggcagactcttcctccacacagcagacacggacctatggactatggatggatgcggacgatggaaccgttcagtaaagaacccaaggttgagtgcaactggggttgcacttcagcttcatctccttggcagggacactaaagggctgtcttcagtgctttaatggttttgttttctaatgcaataaatcgccaggatttccaaattattgcttcaaccatcagtcataactctagagaaaaacttcatcttcatctcggaattccagcagccatccaggtataatggtgagagagcaagagagaggcatgaacacacagtcacctccactccccattctttcaacccaagggtcaacaggagactctctgctgaggtcaaccctcagttccaagaggctgacttcagggttgccacagaagagggggctttccatcccaccctggcttccttcctccacccagtggagacccccccaaggcatgaggggaaagccattaagtggggtgcagcccctggcggtcttcagctgcacccctcaccgcttccgttcttactgccttttctagaggactgccattggtagagctggggtgctctcagtttccgtcggcacttggctttctgttcctagagcccatcccgcaccagcattttggaacctgcagagagcctttctcccagctttgccgcctgtgctgccattagagaaaaaaagaagcataatcgtgggcatctctataacatagacagatatatatatttggcttcttcgtgtgtgatgtcattcttccctaatcgcttacacctaatataagcttgtcctccctcccacactcatccctgcttctttggggcaggggtgaggcaggttgaggggggaggggactgggactggcggtgaggttttgatacccacacccagccatctggagtcatggagacccaccacgtctctatgccggatgacctttgtaagttaaggtccttgtgcatcttacctttcccttaccttggagtttgctttgttagtcttccccagctaaaaagagaaatgcaatccaaaatggaaagatggagagatcaaacgactgtattttcacataagatcttctggccttcagattctgcaactgactcattttcaggaggttgggggaaaagatgtttatgagtttagccaacagaacaggtaatttactcctgcctgcagaatacttttcgttggggaagagaactgaatccaaggatctgttttcaacaccattccaagtctgtaatttcctgacttttcctagatgtcagccactactatgaattcaagcttgtgtagtcagattagccagtaatctctagatgtaatagttccctttgtacttttccaagctcaggtctttattttgtaatggaattaccttgctcctacttcttttgattacatcctaaaactacatgcttccccccttccagtagcgagccaccagaagctttcttgtctctatgcagtgggtaggattttttggtgcgttgtgtgttcctgatctccctccctgtcttcctgctcagctttctccctactgccttttcagacttggagcacccaaggtctccaatgaaagttttctcattcacctctgcaagtgctactggcaacagcctgagggcagctgtagaaactttccctctgtgggagactatgaatattcctgatgagcacaagtaaaactaaggcttcagccataatatggaggagggagcagatgtaagctcccaagagcctgggggatcacaggtccctctgcaaaacttcctggagttcagcccagcaaggccagaccaaggaggcagcaacctgcctttcccccttacctgccctgctgcctgcacactgcatgcctgccccttctgctgctcctgttggctgactcaccactgtccccttaggattggaattctcaactagaaccggtccaaatgcagaatattaatacatcgaacaacttcatccttaatctctgccctgggcagtttgccctctcccatctggacttagatgggagggcatagcagatcttgaagggatatactttcctgtttttccctgacccccgaaccacccaaccacatccataggggtgcaggaccctaagtagactgggtagaaaccccagggatgattcttcaaagccccctcctccatgagaggggactgaaatgctgcagctgaggctggtcttcagggcagaaaatgagtacttctttgaaggtggcttttctgcgagttcttctgcctcctgctggagaacagagacccttcaagaggtgagggttagatttcattggcagagagattagccactgtgcaggagtagggaggaaaaggagttctggagaggcgccgccatcctgttttctggaaaggctgcaggattcctttcctaacggtgaccttcttcttgctcccagtgacctggaagcaagcccaccctccccaggggaaaatctaggagaatgcattcctctgcagactgctagagagagatggcaagaaggaagacacagaattctttctgacagcctaggagttatcttcccactgtggtaaccccccatgtggcacccagggactgaaggacacagtgcgtggagacggccctgagctagcggcattccttagacttcaggagctcagagtttgtcccggtgacttgcaccctggctgctttgcttggacagtttgtcttgggtatagggaagccttccttgtcaggcagccaactcccagccctgttcacacaaattttatgctagggccccatgccagtcagtgtccccatcatggtggctatgaagctcacggctgaagattccagaaggtcctggtctcccatgcccaagggatgccatgtagccccagctggaagtgacttccgcaggaattgagagggaatagctcacccctcattctgtcctccggacttaggaaccagtgaccttggctgcccaactgtgtggaggctgagtgattgacaaacacaggttggctcattcttgctgcaagagcaggtaccccccgccgcccccctggaaagcacaagtgatgagcaagaaggcattttccttgggagagaaggggaaatggaccctgacccccttgatccccaaagaagctgcgccccacctttccagatacccacaaagcccccagacagaatctagcatcgggactattagcaatggcttccagaatgtgcttgggtcccacgtgactgatctgacaaaaaaaaaagagggatattaccatggcaacccttgcattccaccctgagtttgccaaggcacacaaaaatagggaacattttcttaaagaacactccaattcagcctgagtgcaacctgactctctgcatctgtatcctgctgggagaggcaattacccttaaagaatctgggtggtatctctgcctttttgtctggcatttgaacttgtccttctatttactcaggagagcaggagctacctgtaagccctggtatctccccatccctactcccagccccttctcccagggtccagagccaggaccccttaatctaggtaaattgacagaaatatcatcttggaaggcaaacaagatattaagcctccaatctttaaaagtatcggtttgcctgttgagcacactcctgcaagccaaacacgtgaactttggtgaactgaggtttaggtgtggtcttaggcaaacccagtggtttcagaaatgtctgggtgttttatttgcagagaacaagatgtgtcttatgagtcttctttctcaatacctgccctgtctcaaatctcacttgacaaatggtctacgatcttgcagttatccaaaagagcctatgaaaaatggacagctgcttttgacaataatgcccctcccaacttcccattcatagaatcataaagcgatatgtttcagaactgagagagaaaagtttaccttttattccaaatgcctcgtactcggtttaagtccagactcaggtcataaatcaaagacagttttgcacgttgctcttcacctaaatctagcagtttccctgaggccctatgagggcatggacagaaaatgaaggatgcaaccacccaggacagctccctggtttgggctggcctggccacgtgtggtcacatgtcctgggatctgtgtttactgtgtccttgctctccttccttgcagaagctgctaagctctgctcctcctaactgcaggtctcaaaccctattgggtcattttgccacactatttctccaaaggcccatagtcattacattttttaccatttcaccaagataacagggggggtctggaattcccctgctaggaagggccccttttcctatatcaccgtgatggtacagatgaactgagatgaaacttttagacttcagcacgtcacacatcctggttgtataaccaggaggtctgcagagctgcaacccctgaagaacatctgtcttaaaagacctcaaatcagaacattctcattggcctcttcagtgatccccatggagctaagagtccgtaacctaaaggccttaccatagccatcttccctccacacctgattgctcaactgccccagaaggggagaatctatctgaaatagaaaagaagcattaaggaccaggtgcggtggctcacacctataatcccagcactttgggaggccaaggcaggtggatcacttaagatcaggagttcaagaccagcctggccaacgtggtgaaaccccatctctactaaaaaaaa

SEQ ID NO: 104520 - DNA, 5504 bp, Homo sapiens
ttgctggagtcaggaactggaagaaattttagcagcagaagtcaaaattgcaaaattatggaaccaacctaaaagcccatcaaccaatgagtggataaagaaaatgtgaaatccgagaggcctttcgggttctggaccgggatgggaacggcttcatctccaagcaggagctgggcatggccatgcgctctttggggtacatgccaagcgaggtggagctggccatcatcatgcagcgcttggacatggacggggatggccaggtggattttgatgaattcatgaccattcttggccccaaactggtgtcttcagaaggtcgcgatggttttcttgggaacacgatagacagcatattctggcagtttgacatgcaaaggataactctggaagagttgaagcacattctctatcatgccttccgagaccacctaacgatgaaggacattgagaacatcattatcaatgaggaagagagcctgaatgagacctcggggaactgccaaacagagtttgaaggagtgcattcccagaagcagaacagacagacctgcgtccggaagagcctcatatgcgcctttgctatggccttcatcatcagtgtcatgctgattgcagccaaccagatactccggagcggcatggagtagcagcctcccgccagccacactgtgttgcagctcaccgcgcatgtgcatgccgtgcgggcagactcttcctccacacagcagacacggacctatggactatggatggatgcggacgatggaaccgttcagtaaagaacccaaggttgagtgcaactggggttgcacttcagcttcatctccttggcagggacactaaagggctgtcttcagtgctttaatggttttgttttctaatgcaataaatcgccaggatttccaaattattgcttcaaccatcagtcataactctagagaaaaacttcatcttcatctcggaattccagcagccatccaggtataatggtgagagagcaagagagaggcatgaacacacagtcacctccactccccattctttcaacccaagggtcaacaggagactctctgctgaggtcaaccctcagttccaagaggctgacttcagggttgccacagaagagggggctttccatcccaccctggcttccttcctccacccagtggagacccccccaaggcatgaggggaaagccattaagtggggtgcagcccctggcggtcttcagctgcacccctcaccgcttccgttcttactgccttttctagaggactgccattggtagagctggggtgctctcagtttccgtcggcacttggctttctgttcctagagcccatcccgcaccagcattttggaacctgcagagagcctttctcccagctttgccgcctgtgctgccattagagaaaaaaagaagcataatcgtgggcatctctataacatagacagatatatatatttggcttcttcgtgtgtgatgtcattcttccctaatcgcttacacctaatataagcttgtcctccctcccacactcatccctgcttctttggggcaggggtgaggcaggttgaggggggaggggactgggactggcggtgaggttttgatacccacacccagccatctggagtcatggagacccaccacgtctctatgccggatgacctttgtaagttaaggtccttgtgcatcttacctttcccttaccttggagtttgctttgttagtcttccccagctaaaaagagaaatgcaatccaaaatggaaagatggagagatcaaacgactgtattttcacataagatcttctggccttcagattctgcaactgactcattttcaggaggttgggggaaaagatgtttatgagtttagccaacagaacaggtaatttactcctgcctgcagaatacttttcgttggggaagagaactgaatccaaggatctgttttcaacaccattccaagtctgtaatttcctgacttttcctagatgtcagccactactatgaattcaagcttgtgtagtcagattagccagtaatctctagatgtaatagttccctttgtacttttccaagctcaggtctttattttgtaatggaattaccttgctcctacttcttttgattacatcctaaaactacatgcttccccccttccagtagcgagccaccagaagctttcttgtctctatgcagtgggtaggattttttggtgcgttgtgtgttcctgatctccctccctgtcttcctgctcagctttctccctactgccttttcagacttggagcacccaaggtctccaatgaaagttttctcattcacctctgcaagtgctactggcaacagcctgagggcagctgtagaaactttccctctgtgggagactatgaatattcctgatgagcacaagtaaaactaaggcttcagccataatatggaggagggagcagatgtaagctcccaagagcctgggggatcacaggtccctctgcaaaacttcctggagttcagcccagcaaggccagaccaaggaggcagcaacctgcctttcccccttacctgccctgctgcctgcacactgcatgcctgccccttctgctgctcctgttggctgactcaccactgtccccttaggattggaattctcaactagaaccggtccaaatgcagaatattaatacatcgaacaacttcatccttaatctctgccctgggcagtttgccctctcccatctggacttagatgggagggcatagcagatcttgaagggatatactttcctgtttttccctgacccccgaaccacccaaccacatccataggggtgcaggaccctaagtagactgggtagaaaccccagggatgattcttcaaagccccctcctccatgagaggggactgaaatgctgcagctgaggctggtcttcagggcagaaaatgagtacttctttgaaggtggcttttctgcgagttcttctgcctcctgctggagaacagagacccttcaagaggtgagggttagatttcattggcagagagattagccactgtgcaggagtagggaggaaaaggagttctggagaggcgccgccatcctgttttctggaaaggctgcaggattcctttcctaacggtgaccttcttcttgctcccagtgacctggaagcaagcccaccctccccaggggaaaatctaggagaatgcattcctctgcagactgctagagagagatggcaagaaggaagacacagaattctttctgacagcctaggagttatcttcccactgtggtaaccccccatgtggcacccagggactgaaggacacagtgcgtggagacggccctgagctagcggcattccttagacttcaggagctcagagtttgtcccggtgacttgcaccctggctgctttgcttggacagtttgtcttgggtatagggaagccttccttgtcaggcagccaactcccagccctgttcacacaaattttatgctagggccccatgccagtcagtgtccccatcatggtggctatgaagctcacggctgaagattccagaaggtcctggtctcccatgcccaagggatgccatgtagccccagctggaagtgacttccgcaggaattgagagggaatagctcacccctcattctgtcctccggacttaggaaccagtgaccttggctgcccaactgtgtggaggctgagtgattgacaaacacaggttggctcattcttgctgcaagagcaggtaccccccgccgcccccctggaaagcacaagtgatgagcaagaaggcattttccttgggagagaaggggaaatggaccctgacccccttgatccccaaagaagctgcgccccacctttccagatacccacaaagcccccagacagaatctagcatcgggactattagcaatggcttccagaatgtgcttgggtcccacgtgactgatctgacaaaaaaaaaagagggatattaccatggcaacccttgcattccaccctgagtttgccaaggcacacaaaaatagggaacattttcttaaagaacactccaattcagcctgagtgcaacctgactctctgcatctgtatcctgctgggagaggcaattacccttaaagaatctgggtggtatctctgcctttttgtctggcatttgaacttgtccttctatttactcaggagagcaggagctacctgtaagccctggtatctccccatccctactcccagccccttctcccagggtccagagccaggaccccttaatctaggtaaattgacagaaatatcatcttggaaggcaaacaagatattaagcctccaatctttaaaagtatcggtttgcctgttgagcacactcctgcaagccaaacacgtgaactttggtgaactgaggtttaggtgtggtcttaggcaaacccagtggtttcagaaatgtctgggtgttttatttgcagagaacaagatgtgtcttatgagtcttctttctcaatacctgccctgtctcaaatctcacttgacaaatggtctacgatcttgcagttatccaaaagagcctatgaaaaatggacagctgcttttgacaataatgcccctcccaacttcccattcatagaatcataaagcgatatgtttcagaactgagagagaaaagtttaccttttattccaaatgcctcgtactcggtttaagtccagactcaggtcataaatcaaagacagttttgcacgttgctcttcacctaaatctagcagtttccctgaggccctatgagggcatggacagaaaatgaaggatgcaaccacccaggacagctccctggtttgggctggcctggccacgtgtggtcacatgtcctgggatctgtgtttactgtgtccttgctctccttccttgcagaagctgctaagctctgctcctcctaactgcaggtctcaaaccctattgggtcattttgccacactatttctccaaaggcccatagtcattacattttttaccatttcaccaagataacagggggggtctggaattcccctgctaggaagggccccttttcctatatcaccgtgatggtacagatgaactgagatgaaacttttagacttcagcacgtcacacatcctggttgtataaccaggaggtctgcagagctgcaacccctgaagaacatctgtcttaaaagacctcaaatcagaacattctcattggcctcttcagtgatccccatggagctaagagtccgtaacctaaaggccttaccatagccatcttccctccacacctgattgctcaactgccccagaaggggagaatctatctgaaatagaaaagaagcattaaggaccaggtgcggtggctcacacctataatcccagcactttgggaggccaaggcaggtggatcacttaagatcaggagttcaagaccagcctggccaacgtggtgaaaccccatctctactaaaaaaaa

SEQ ID NO: 104521 - DNA, 443 bp, Homo sapiens
gcttgcaggctttacaaaaacatactgtgggatggattaggtttgcaggcagttggcctggattttccagagtgcctactaaattaatttacctaccaccagcctgcagttaggaaaaaatggctctggtttgaactctgaatgttaatgagaaaaaccagtttacccttctccacactcccttcctcttaaggcagtagttactaaacctggcaaaattacctagagaacctttttaaaaaccagattcacagaactgctactgaatcactttctgggcccaagaaccagttttgaaaaccttaatatttggtaatgccctctaaaccttccacaaatgattggtagtttctccccgcaagacgcagccctagtaagaaagcaaaaagcttaactgtatacttttggggaaataaagagcagtggtcttttaattgggtgac

SEQ ID NO: 104522 - DNA, 256 bp, Homo sapiens
tctctttaaatgcctgttaacctgattttaagaatatctttattgtatacatcttattctttaaatgtaccccataactaatagtaccaattttatgttttcaacatttaagttatgatattatacatttcctttaacttgctttttctattcaaactggttgatagctgtagatctgattttgttttctatatttaattcccttgaagtcacataccacggtttatccaatccctgatttttttttttttttttt

SEQ ID NO: 104523 - DNA, 332 bp, Homo sapiens
caacaagtgcttgtatttgttcagtaaggatatattgagtacggtactaggctgcaggaatatgttggtgaagaaaaccaacatgttctctattgtacactcaccgcccttgtgagcttacaatctaggtgaggggtggtgataaacagatctgtgactaagcgctgtgaaggaaggcagcagggttcagtggcttcctacgcattttccctaagtcaagggtcaggcactttgtatcagtctcttttttatgtagatattttatcagcccccttcttctgtgtagatattatatatagatttgtaaaaatctcccccaccttcatcttaaa

SEQ ID NO: 104524 - DNA, 513 bp, Homo sapiens
atgcatagatgtcatctttttctttcatacactctttcttctggatttctcatcaaaagcctgctccgccgcctcctccctgcggcgctccggggctgtagacggctactttattgtctcggctgcgcaccgcgcgggacctggggacccggctctgagccagtcctgcaagtccactctgcgctgtgccttccccggcggcggctgccttcctcttcttcctcttcctctctgtccaagctccagctcagcacgtgagctacgcagcccgactcccgggctctctgggcagccagcgcctgccgcatcccccggcccgggtctgcaggtcgcccccgccaccgccgctcgccgtgcgtcctcgctttgctccacacttacagctgtgccccgggccgcctttctcgcgtccttccgtcctgcctgcctcctctcgctgtcagccggggctttcggctccctctctccccagcagcccccgcccgccgcctctccgggggctggggcggccgc

SEQ ID NO: 104525 - DNA, 444 bp, Homo sapiens
aggcgtggtggcgggcgcctgtggtcccagctactcaggaggctgaggcaggagaatggtgtgaacctgggagcttgagcttgcagtgagccgagatcgagccactgcactccagcctgggcgacagagccagactccatctcaaaaaaaagaactttgagtccagggccaaaaccacatttttatgcaaaacacctttgcaacttcttctttcaaagtgtccagaaaagggggtgggggactgaaggaagtcgttcaatttattcagccctgtgagatgtggatataaaattctttctgcatttttaccattactgtcatcataaatggttatttagaactgcacattgattgtgtctcaggggttctcagaaccggcgttcagcagaacagaacttaataaatgctgattcagggatgcagaatcgaacacactcatgctgt

SEQ ID NO: 104526 - DNA, 466 bp, Homo sapiens
atgcagatatgttgtggaaaaggtaagcgtatacacatttggttatcttcactactacttaattaggctgatcaagaattaccaattgctcctttttggaaagttcactttccctgctttataatttttttcctaactaaaccaagagttgcaattgtgtatctttatttttacttattaagaaatgtttgaaaactaagatgtctcttttcgtttacacgtttcttatgtcaggtccccagtagcatgcagtgactgtatagtggttagcactctgtgttgtggccacagcaaccatggttcaaatctgagtcatgacattgtgggaacatgttccttatttcagccacaaatcaatgaggtctgagtttgtgtagtataaacatttaatgtacagtaaatattttatgacatgaatttgtataatataaatatttaatatacaataaagaataagtaatcattc

SEQ ID NO: 104527 - DNA, 123 bp, Homo sapiens
cttgaatttgtgaacactttcccctccctaccaaaatttcttgagttttatgctcctcaaatgcgaagcatatattattattgatttctgaatactttcaataagtttgtttatttatttatt

SEQ ID NO: 104528 - DNA, 425 bp, Homo sapiens
ttatcaaaacagtcctgggaggtggtttatctctgttttcagacatagggtctacaaagcagaaaagaaggtgatgcacagcagaaatgaaagaggagtttgctttacactctgtggtacgtagcattgatcagggagccaccatggctggcatgcagtgggcatttgatatgtgtttgtccaataaatgaatagcaggcactcaacaaatcatccttgatttgaaataaaagtttttctggattttgcttccagctcactctggtcttctttactctctggctgtttcttctcttccctgttgggttagctcctctccctggcccttgcacttgtcccaggcctgcgaggggagattgacacccagaggttgctggatcgtggtgatgcagaggcatcttgcggtgactcctgggagccagcag

SEQ ID NO: 104529 - DNA, 426 bp, Homo sapiens
tgagacggagtttcactgttgttgcccagtctggagtgcaatggagtgatctcggctcactgcaacctccccctcccaggttcaagcgattctcccacttcagcctcccaagtagctgggattacaggcatgtgctaccatgcccagctgattttttatttttagtagagacagggtttcaccatgttggtcaggttggtcttgaactccagacctcaggtgatgctcccacctcagcctcccaaagtgctgggattacaggtgtgaaccaccacacctggcccctctttccctttcaagcatcataggaaattaagattatttaaggagaagggtagataataatgatccaaacacgagtgtgtttgggggttcatctcaagcaatcaattacagagtaaatacacataatacacacaacttgta

SEQ ID NO: 104530 - DNA, 689 bp, Homo sapiens
ttgggagcactggcgggagcccatggtccggggccgaaccagcccccttctgtttccctgaagaagggtgaggctgagggccctcggaacagagcccctgtgtcattctgtgcagggccgggatagccactagtcactgtgggcagaagcaagaagcagaggctcaggctccatcccaagcctgtgctcctgctgggctgtgggaggtgtgacccttccactgtttcgtagactgagaacatggagggactggcatttgctgtgttaccctgtggtgccatcagcgtgttgtgacaggggcaggaggagtgtgctagaacccacccactctggtactgcccatctctgtggccttgggccagccaccaaaccgtaccatgccttagttcccctatgattcatagctgcttcatgggctgatgtgaggattaaacagcttactatgtgttgggtctggttttgtttggctttgttttgttttttgagacaaggtctcactctgctgctcaggctggagtgcagtggtgcaatcacagctcacagcaggctccacctctcaggctcaagcgatcctcccatctcagcctccctggtaggtgggactataggcacatgcccccatacctggctaattttaaattttttgtagagatagggtctcactatgttgcccaggctggggcttacag

SEQ ID NO: 104531 - DNA, 863 bp, Homo sapiens
  misc_feature (541)..(541): n is a, c, g, or t
gatgtagcagaagcgacgctgtgtgagttcccaggctgaggctgcagagatttgaggcatcttctctcacccagcttgaagtccttccccttggaagccagtcaccgtgaaaaaactcaccatgctgtgaggaagcccaagagagctgcatggagagaagggcctgtggaagagctctgaggtgccactcacatgaagtgagcctttgtggaccttccagcccagccaccagcaaacacaacccagtaagtgtccccagtcaatgcttctctccataggagacctgtaaatgggcggtggggggaggaattttctggtctcacacactattatgggttgaattttccccctcccgaattcttgtgttgaagctcccacctccagtactttacaaagtaacatatttggagataagatcttttttttttttttttggagacggagtctggcggtgtcctcaggctggagtgcctggtgcaatctcggctcatggaacctctgtctcccgggtccagggatcctggggcctaagctcccaagngttgattgagtcctgcttgtgcggacacccacgaggatcagactgtcggcgtctatctaggaagggacgacttagagcccccttttggaaagcctgtgcttaaattatggtggcggagatgtgtcattggtgtttgccccggcctttgccctcctccttgcccacgcggggtctcaaagctggttgttgaccccggtcagggactagggcgcagggcgctgtacacagtgttccgcgtttggggagactccctcttgttccaaccgggcagcttgaacgggcctcctaagggttcacgtcccaatgaatgtgcgtgagagcc

SEQ ID NO: 104532 - DNA, 1902 bp, Homo sapiens
agtagagatgggtttctccgtgttggtcaggctggtcttgaattccccacctcaggtgatctgcctgcctcagcctcccaaagtgctgggattacaggtgtgagccaccacgcctggtcttctacaaaaaaattttaaaaaattagctgggggtggggagggtggggtggtgctgcatgcctgtagtcccagctatttgggaggctgagatgggaggattgcttgagcccatgagattgaggctgtagtgagccatgattgtgccactgcactctaggctgggcaacagaacaagcacctgtatcaaaacaaacaaaaaagtgcaagattggaagcttcgaggcttcttgaggcctagtctcagaactggcacaatatcacttcataaggctatctcagattcaagggagtaagaggagagatgctacctattaaaaggagaagcagcaaatactatggccattctcttcacaatagttgtcaccaaaacgtaatcgatttgtttatgggtttacattgtcatgtctccacaggacaatgcacatggtatgtttgtcagaacccagttggagttttgtttcccagcatccaaaggaaatccctaactttcattttttcttcccgtaagcagccccgaacacttacttataagccatctctacctgaattagcaatcatggataagctcaataactgatcatttccttatcagtttaaaccatatatattttaacactgtctctttttcacacacactagttagctaagaatgagctggggggctgggcgtggtggttcacgcctgtaatcccagcactttgggaggcggaggtgggcggatcacttgaggtcaggagtttgagaccagcctggctaacatggtgaaaccccgtctctactgaaaatgcaaaaattagctgggtgtggtggcaggcatctgtaatcctagctactcaggaggctgaggcaggagaatcccttgaacccaggaggcagaggttgcagtgggccaagatcacaccactgcactccagtctgggtgataaaacgagattccgtctcaaaaaaaaaaaaaaaactgccaaaacgctttttgcaaagtggttgtaccattttatattctcaccaccatgaatgaaagttccaattgctatattcttgccctcatttgataatatttttagttttagccattctaatggatatatagtaataatttgatggttttaatttgcatttctctgatgatcaataacattaagttttgattcaggtacttgttgggcactcatatctttggtgaaatatctgttcaaatcatttgctcttttttttttcttagcacttaaaaaagactttttgccaggcacagtggcacatgcctgtagacctagctactcaggaggctaagacaggaggatcacttgagtccagaagttctgggttgtagtgagctatgtcaatcaggtgtttgcactaagttcagcataaatgtagtgacctcctgggtcactgggacccagagttgcctaaggagcgtcagaagtggagcaggtcaaaactcctgtgctgatcagtagtgggatcacacctgtgaatagccactgcactgcagcctgggcaacatagtgagatcctcatctcctgaaaaaaaaaaaaaaactttagtttttaaaagtagttttaggttctgagcaaaattgagaggagggtacagaaataacttatatatcctcagtgctcccctcccccatgcctccctcatcaccatcccccagcagagtggcacattggttacaattgataaacctacactgacacatcattatcacccaaagcctattgtttccattagggttcactcttggtgctgtacaatctatgggtttgaacaaaggtaca

SEQ ID NO: 104533 - DNA, 439 bp, Homo sapiens
agtcacactctccacctgagggcagaaagggtggggcaggcatgtgagatcctggctcccctccctcttccactctttcccattcactgactccggggttgggtgccctgtccttccctggggctcatgtcttggggcccaattcccctgtctcaaggaaagggcagaaatagcaccatgaggtccgtcaccaccccaaatactttaccccctaccttcccctccagctgtgggaacagtttcaggaccactgacatagaggcttccacaaagaagtttttgaaggtctcatagtcactgccctactttcccttcagttccacctgccactcctcaaaccactcgtaggtgctgggtatgagcatgatcatggtggaccggcctggggatcagagctgatattactactgcccggcccctccctccaccccctcaccca

SEQ ID NO: 104534 - DNA, 1375 bp, Homo sapiens
agaccaaagccatgaagtcaccccaagttcaaacccaaaatgcaatttgcagtggttagaaatgacaaaggatgggtggtaggatccagagaaaaaacagtgaaacccgatggaccttaaatagatctgagggcactgatttgattattttgggtgaaatcttttaagaaaatcttgtcagattcttcacagaaaatttggtaaagcctatatttcatcgccagcctagcaaaggcaagctggcaaacagggaaacaaggagaactgtgtgctcagccctccagagtggcacggattatgaggaggtgatggtccttccccgccaagatcctgagacactgtcactccggaatccaaaaagagattcagataccatgaaaggatttgagcgtttttttatgtgaatccaaagatgacatttacaaaaggtggagaagcagttccctactgagggacgtggatacaaaaagcagatgacacaacacatcccatagagttcccagggaagaatgaacccagattcttgacctgcagaggtggcgtactggctggagaaatctctggctggcgaccgtgctattctgtctgtccacctaactgtgggctcccagatcaccactgccatgggcagggggccgtggggtgggcctgcttggggtgacaggctagctgtgctcccatagcagaggtgggagaagggaatcacatctggtgagcagctatgtcgtgccaggcactgtgctgtgtattgcacacatctcaaaccttgtgacaaatgtgtaagatattttttatgtattacaaatgaaggaactgggctcagaaaagctccattatttgcccaaattgcagcagtaatgcaggaatttgaatccacattaatctgactccacaacccatgttctttcactgaattcccatatccttgttccccctactgtcctcactggtcaaggtgagcttggtcttccacaaacaggctagaaaagtatgcttacttatctttagctttatgcttttaaactaattcttaaaaatcttctctggataagtcaaagacaatgggaatgtgtatttctaatacattaattataatacattaccggtttacacaatgccatcaccttgtcattttctttgacacaacgtccccctcccctctagtttataaatgaggacattgaggcacaaagtgggtaagtgacttgcccaagggggagatttgtccaatcataaagatgggcctgaactttttctactttgcattcttacttgaaaggcaggaaacatatgctcaagagggagatctcacgaaatttcatgtcatatagtgctctcgctaatttaatcctgtcattcctggttatatcccttt

SEQ ID NO: 104535 - DNA, 839 bp, Homo sapiens
agaccaaagccatgaagtcaccccaagttcaaacccaaaatgcaatttgcagtggttagaaatgacaaaggatgggtggtaggatccagagaaaaaacagtgaaacccgatggaccttaaatagatctgagggcactgatttgattattttgggtgaaatcttttaagaaaatcttgtcagattcttcacagaaaatttggtaaagcctatatttcatcgccagcctagcaaagttcaccttgtgcccaaccttctgtctccctgagtcagacctgcagacgattgcatgccaccagctgtcttcactcctgagaacatgacacaaaggaatgctccctgtcaagttcttcattatccttctgatgaatttcccctggtttaaacaagttggtggtagacagacctttctcgcattttcacagacgtgccaggaggaaacccagcgtctctcagtttcctttaaatatatgagataccatgaaaggatttgagcgtttttttatgtgaatccaaagatgacatttacaaaaggtggagaagcagttccctactgagggacgtggatacaaaaagcagatgacacaacacatcccatagagttcccagggaagaatgaacccagattcttgacctgcagaggttatcgcagtcgacttcaggctggaacgggcattgctcttgcactgaagaaagtctgtcctgactccctcagagtgcctcaacatcaaccaagagccaccgtgaacctctggggcactgagcctggccaccagcacccccaccccagcccatatggcctgggcctctcccttggtaagcctcttccaacagggtatca

SEQ ID NO: 104536 - DNA, 650 bp, Homo sapiens
gatcaaatgctaaacgaggggtggattattcatgagttttctgggaaaggggcagggaattcctggaactgaggattcccctttcacaccatgtagggtaacttccacatattgccatgacatttgtaaactgtcttggtgctggcgggagtttcctatagcatgccaatgtattataattagcatacgatgagcagccaggagacctgagactgctttcattgccttgttgattttggcgggttttggctggctttgccacagactgttgtattaggggttctttgtgacctgtatcttgtgaaaccagtcctgctgaattcctgtatcagcaggggctcctcctgcaaatgcagaggctccccaagagagcacaagggggctcaatcagtacttgtgggatgaaggcatggtggtgctccaagagggacgacggatgattcctcggaagccttctctgctgctgatccatagtaaagccccttgagtgccttccttatctccttcaccatcatcttggtaaccaccaaggtgttgactggagtgagttcctggaaagagctccagagctaaggtctgctgcactagggagggaggtgcaccctctcattaagaatgggcaggcgtggtggctcatgcctgtaatccca

SEQ ID NO: 104537 - DNA, 492 bp, Homo sapiens
tatatatatctttctccacctttattaacctataacagacttgaatccatgctctctttaaggcaaagtagaatgtttaaaacgatatactttataaactcaaaaaagtgctttggcattttttttttctttttttttctttttggtacagggtctcactctgtcgctgggctggagtgcgatgtaggctctctgcaacctctccctccttggttcaagcaatcctcccacctcagcctctcaagtagctggggctacagatgtgtgcgaccatgcctacctaatttttgtattttttgtagagaccacgtttcgtcatgttgcccaggctagtcttgaactcctgggttcgagtgatctgcctccctcagtctcccaaagtgctgtgattacaggcatgaaccattgcaccgggctgaaacggcttttaataaagggtgggatcataactaaaaggtcattttgagttcaaatcaccaatccaaaaatggc

SEQ ID NO: 104538 - DNA, 534 bp, Homo sapiens
caggctgatccctgtgtccagattttaattcaggaaacgggagagcacgttttagtcacagcaggagaagtccaccttcagcgatgcctggatgacttaaaagaaaggttaggtgaaaatgatagcgatggagaaatgatagctctcaatcaatgggatgttttagtgtttcctaaaccagttgaacttagactgcggcttatttttggagaaaaatgaaatgccctcaattcagacatgaacagttattcgattgtagacttattttttaataactgaaaaatggcattcactgcctacacttgaataattttgcatttttagcttaagtcataaaatgtttttctgtgtatgtattttactttaagcatgtacacaaaacacacaaaataccaggacaacaaaacaagatattattttgtaaatgttggctatgtaattaggatagacttcttctcttattgatgtggtctttacaatgtaaaccttctggaaatctttatgtttttctataaagatgatatgtattataaa

SEQ ID NO: 104539 - DNA, 355 bp, Homo sapiens
aaaaacgaagaattcaaataggaaattaggaaaacaactctgtttatgattacataaagcagaataaactaggaataaacttaaccaaggaggtgaaagacttgcacactgaaactacaaaattttgctaaaataaattaaagaagagataaatgtaaagacattcaatgctcatggagtctcactctgtcgcccaggctgggctggagtgcaatggcgcgatctcagctcactgcaacctctgcctcccgggttcaagcaattctcctgcctcagcttcctgagtagctgggattagaggcgcacgccaccacgcccagcttatttttgtatttagtagaggcggaggtcgacg

SEQ ID NO: 104540 - DNA, 308 bp, Homo sapiens
attctccagaaaacccctctggtcatcagatgtccaccatgctctgagagggaagagtaatttggtcctagtctgctctctcattttttattagttagaaccaagttattttccagtcttgggattaggcaggttcaagattgactaaggctaacagtagactatgtttagactgatttataaacttcctcaaaatttaggccatgatgaaaggaccagaaatagaccttttccagttatagcctaggatatgatacactggtaaatctaaattccattctgttaattgactttaaaatttaatgctc

SEQ ID NO: 104541 - DNA, 512 bp, Homo sapiens
gtggtacatctacacaatggagtactactcagctattaaaaagaatgaatttatgaaattcctaggcaaatggatggacctggagggcatcatcctgagtgaggtaacacattcacaaaggaactcacacaatatgtactcactgataagtggatattagcccaaaacctaggatacccaagataaaagatacaatttcctaaacacatgaaactcaagaaaaatgaagactgaagtgtggacactatgcccctccttagaagtgggaacaaaacacccttggaaggagttacagagacaaagtttggagctgagatgaaaggatggaccatgtagagactgccatatccagggatccaccccataatcagcatccaaacgctgacaccattgcatacactagcaagattttatcgaaaggacccagatatagctgtctcttgtgagactatgccggggcctagcaaacacagaagtggatgctcacagtcagctaatggatggatcacagg

SEQ ID NO: 104542 - DNA, 409 bp, Homo sapiens
agaatacaacattgagtcttcccatccaagacaattgtaaagcctcttcctgtctcaggctctgttttggtgacatgctcaagtcttatagtagattttaagacactcatgaatgggatgtgtatgtaccttgatttagtagtgcttaaatacttgttgaaggaatgatagctttaggctgagctagctctacttttgtgatgttatttgtacttacttgatgttcaatccctacactcttgttttttctgtcagaaaatatggtctactttgccgggcgtggtggctcacgcttgtaattctagcactttgggaggctgaggcaggagaatcgcttgaacctgggaggtggaggttgcgatgagccaagatctcaccattgcactccagcctgagcaacaagagtgaa

SEQ ID NO: 104543 - DNA, 634 bp, Homo sapiens
acacccagcctggcctccatggcccctgtgcccttaggggtcctgcaggtgtgtcaggagcctcccagagtgctatgagcagattatgggaagtacccagctgggctccaggcctagctccaccccagtctcagcgggtccctgcccggggttgagtgccttggcatcttcgaagccgagtttcctcctcctcctcgcagctctgacagtgctctgtgtgcctctgagatagacccacgcagggtgtccccagggcaggtttcccaacctcgaatgagaaggttgggggcgggcactgcatcagcctaggatgaggcggcctgagcattctcctgtcccccacagttctgacctgtggtccagaggggccatgccgtcccctgctctacccaggcctggtccttgacagcccctgcaggcgctgaggttgggacagccagggtccacatccctcctggctttgtgatgagctcgtggcgaggccatgcggctctttaagcagcctctctagggctgcagtcaaggctggggtgtgctgggaaagcaaccctgaaagcccagcctgtgcaggtggaggacaggcccaagaggggctgaggaagctggagggaggagagagctggggggagcgagg

SEQ ID NO: 104544 - DNA, 320 bp, Homo sapiens
agctcggtacccctccttccctctctcacgcactgaatacattttccgtgtgaggtggggagaggaatagtcacttatgccttgagctcagggaatctatattgtcacaaatgataaacatagagcaagggaagaaatcagatatgcatttgttgcaggcaagcagagggataactttgatttctgtcctttgttccatgcctgtgaagataagctattaacttacattgtcagggtgaaattcaacagaactggttcacgggaaagatcttagggctcacaaggaatttccttgtcggcaaattgtgagggagatatgt

SEQ ID NO: 104545 - DNA, 494 bp, Homo sapiens
tgattcttaactgctgttttctttgacctcctccacttctaccacctaaaaaccttcttcctcaccaccacccccacttctctgaagctccctctttctcccccatccactcttcagctgaccacaggtggcttctttgtagttgcttgagcatatgtgagccatgaaagggtttcgtttccccttctgttctcagcccagctgtgccagcctctgtgatccttgtgagctttaaatgaggcactccagacccttcttacgcaggccatggcatttctggaactgccacacctaaaatccaggtatgaggaaggaaggagacaactatttgaacacctacattgtaccaggccccgtgcttgacatagagacactgagcccaacctttaaaggcctcagcttccaggtccttccaggcatcttactgatgggcacctggaggctctgagatgattggtctgattccatctgcagtctgtctgtctgtctgtggg

SEQ ID NO: 104546 - DNA, 367 bp, Homo sapiens
accacctcggcctcccaaagtgctgggattacatgtgccaccatgccttgcctaaaatcccatttgattgttcccaggtattataggaaatggcctgcctcatgtcaattgaaacaatgacctattagctcgtcttactctccttctagatgagtacaagatacaggcctcttccttccccaggtactttctataggccatatatgtgtttctgtccagagcacaggcccacctctcaaggttctctacctcccataactgcacttggcttcccctcaagaggggagtaagagggtggtgacaatgagacccccttcccctttagagagggacatgacttgtctcatcctgactgctcttccatggc

SEQ ID NO: 104547 - DNA, 505 bp, Homo sapiens
ggggactggaggcacagcatgggggaggaaatggggcaaaggtgagttaaaaagccatgaaatttcctatggctttgaatgtgtctttttcttggttgggtgggcttggttgctgtagatctttgacttccaaagcttgtcaaaagaagttattttagccacttcctagttggttatttaacatttctgtaggaaaatgagggcctggagctttctagtccaccatcttgctgacattcctctccactgcctaaatcttagacccaaagggtataacccaaggagatagtatggagcctcagtggtcagagcagagccaaggctgagaggtaacaagagacaagttaaataggaaaaggtggggagcggaggtctggaaattggaaactgaagacttagacttaattctgtgaaattaacaagcaactataacaatgcctggcaaggcaacaaagccaaggcatgcgctgggtgatagctcatgcctgtaatcccagccctgtgg

SEQ ID NO: 104548 - DNA, 187 bp, Homo sapiens
gctttaaatgctttgtaaatcatagcaaaaaataatggccttctaacagagagtcatataccgtaatcaactggaagaaagtcagcattgtaatttaaaataaaaaaaaatccttatgtgagtctctcgtttaaattaagagacaggacgtgattcaaataataaggcccaagtgaggctggttttt

SEQ ID NO: 104549 - DNA, 330 bp, Homo sapiens
caattctcctgtctcagcctccctaatagctgggattacaggcatccaccaccacacccggctaatttttgtatttttagttagagacagggtttcatcatattggacaggctggtctcaaactcttgacctcaggtgatcctcaggcctcagcctcccaaagtgctgggattacaggtgtgagccactactcccagcccattttgtttttaattgggattatattatagatcttttaaaagctgctatataacctgatatattgagaacattttacttcaaatagttaaaaacacacaatcacccattatcctaccagctagagagaac

SEQ ID NO: 104550 - DNA, 472 bp, Homo sapiens
gtacttggctatgggggaagataactccgacattttaatatcttgatcaatttgtgacattcaaaataattccatttaagaaacattaatcaaaacttaaagagacataccactaagtatcccacacagtatactgaaaataaatatagaaatacaaccagaagtctacagatcaccacagtagacagactggtgaagccccagctatcatgagctgttgagttacaacagctgatgactatcatttcagccacttttcctacagagtaggatggactttagttagaagcctccctaagataaattcagttgttgcaagacctgatgttagtaatgcgataatttgtaagtcgatgctgaatcagtttctgctccagagagatttaactttagggatgactgattgttgttgaaagttttgttttcaaaccagtttttgtaattacgtacttttctgggtcctttttgtagt

SEQ ID NO: 104551 - DNA, 395 bp, Homo sapiens
cagatgaggaaatgaagaccgacggaagctatctcttgagctcgtcatgcagctggcgaagggtggagcagggcttcaaatgcagacctttccaactccattgtccctgctctcctgcgtgccctttcctgccttttctcaagggagaccatgagatcaagaaaaaagattttcttctccacggcaactgaagtgttgactttgacagtgaaagctacagagtgtatgatgtttccctttttgccgtgcttgccaggaagcttgtgctttttgtcaaactgcttacttcccctttccatggttttggtcttctacctttgacagacttttattcacaagtcttactgtaagctgttctactcatagaataagctgaataaatagaaattgaattg

SEQ ID NO: 104552 - DNA, 232 bp, Homo sapiens
aaggacttgcttgtgctaccccctttatagttgcttcctacttccaatgtccgtataccctggatatcactattccattctccatttctaaaactgtcacttcaaaaatgttacaaaattaaagtattttttttttgagactggcctttttcatttagcataatgctcctaagatgcacccggttgttgtgtaccaatagttcatttctttccattgccaaacagtattcta

SEQ ID NO: 104553 - DNA, 559 bp, Homo sapiens
tatagtacacagggcagtagcacaagtttagagttaggcagacctgggttcaaaattcaggttatcataaccaaggccattttttatttaaactttttattttgaaataatgatagaaaagacaaaaataacacagagtcctatgaaccctgtgtaaacttctcccaatggtggctttgtatatagctatagtacaatatcaaaagcagattttaaaaaataatttattttagtttcagggagtgcttgtatacttgttacatggtatattgcataatgctgaagtttggggtatgactgatcctgtcacctaggtaatgagcatagtactcaatggttactttttcaaccttgccctttcttttccttcccccttattagtgttgccatttttatgtccatgtttacccaatgtcaaaaaccgaaaattgatattgttacattactgttgtctagactacagactttattcagttttaacaatttttaaacttgcattcatgtgaatgtgtgtatatatgtgtgtagttctttgtagttgtatttaatgaatagattc

SEQ ID NO: 104554 - DNA, 2250 bp, Homo sapiens
ttgcatggagttagtcattgtgattgtagctttatttcataatatattaagacttgcactgctatttactagcagtgagaagaaacctcaggaaaggatatgaaaaagcaagtggccagtgtctgggatactgggccttggtaaagcagaggagggcacacccacagtcctcttattctctgttttactgcttgttttgaggttctggggtctggcaaagaggatgcagtttgacacctgcagccctttctcaatcccactaatgtcttactaatgtggaacagtccatattagctccagagagtgtcaaacccagagaaatgtgtgcaaaaatgatactcttttctgcattagccccaccattgtgttcaccaatgcttggaacactgcctgaaggcactcattttttaatttttattttatttttaattttttatatctttatgagacgatctcactctgtcaccaggttggagtacagtggtacaatcacaactcaccgtagcctcaaactcctgggctcaagtgattctcccacctcaggcacccaaatagctggaactacaggcatataccgccacacccagctaattttattttttgaaaagacaaggttccctatgttgcccagctggtcttaaactcctgggctccagcaattatcccagcttgggctccaaaagtgctgggattacaggcatgagtcaccatgcctggcctcattttttaaaacaaatgaataaatggacaaatgagtaaatgagaaagtctcacaccatgaaagatgctagtccaatgagctgaatacagaggtaatataaatgtcttccagctgttgcttttctgttctcaagctgcccctcctggggtaggagcataatctacatcactgggcagtcacaggacactctatagcaaggttgtagcgtcctctccagtggggggagaaaaggaactgtgcctaccaaaggtactctcttgtcagcaatttccatttctatactttatgggacactagaaactaaaagcaacaaataatctgatataagtccttgtatagtcatccttcaattcagtagcaatattttctggtcactactaacctgtattgtattaaaatgagactattggaaggaaatggtgctaaaactaataacatctcttaccaacctttacccaactcctgggttggcaaacagctgaccaaactgccatcacctcccacttggaagtgtatggccgacagcatgaaatagctgagcccagatgttccttctgcatcctccgaatcccagggctgggtgtaggtagccgttggaggccatcgctacagggcacctatctgttatcgctgctgtcctcccaacagctgtctccagttctagttccttggttttcaggcacagtgggggatgttctgcacccagtggacttcaaaagagttttgaagacttaattttttgtaaaacaagtacttgagattttggtttatccataatagaatgtatttcattagattctctgattctatataagaatgtgaaaagattgatatattgttgttagaaataatgttatttctttccaattttttttttttttttttttgagatggagtctcgctctgtcacccaggctggagtcagtggtgtgatctcggctcactgcagcctctaactcccaggttcaagctattctcctgcctcagcctcccaagtagctggattacaggcatacaccaccacgcctggctatgttttgtatttttcgtagagatagggtttcaccatgttggccaggctggtctcaaactcctgacctcaagtgatccacccacttcagcttcccaaagcactgggattacaggtgtgagccactgtgcccggcaaatttttttacctttacagaaggttttgcttatttaattgtgagctcatttttctttgttacttttgtccccccagatttgggggacaaaataaaattaatcttttaaaatgtgtcagccatatgtatggggcttccatttggggtgatgagaaagttctggaactagatagtggtcatggttatacaacatcataaatgcaattactgccactgaattgtatgttttaaagtggttaaaatgttaagttttatgttttattacaatttttaaatgtgtcaaccaactttatagtacataaattatatctcagtaaagctgttaaataaataaatatagtaaaaattttagaactaaaaaaa

SEQ ID NO: 104555 - DNA, 358 bp, Homo sapiens
gtccggaatccgcggccaggacccgcgcaggcccctccttagctgaggggcggccgggtactcgggtcccgacccgcgaccaccgcacccatcaccaccacagcgggaactgcccggcggcccccagaagccccggcccggccgcagaggtgggcccccgagcacagaggccccgaaactcggctcgcagccctcagccccaatgtcggggggcgcggtggccccgggcgaccccccaccccgctcctggagcccacaggtggccccacaacttcgcggcccgcgctgcgcccgcggggcctagcacgctgccgcgggacctgcccaacgtggagtgtgtgcctgccccctcccgccc

SEQ ID NO: 104556 - DNA, 566 bp, Homo sapiens
cacccggcagagagcaggggcagcagggatgggttatcaagaccagcgaggagctggacctctgggagaagaagggagggtcaggatctgagtgaacacgggggaaggggacagaagctggggcgcagggctgagatgagagggccctggggctggtggcggtgggggtgcggggaatcactgagggacaagaatggggatcactatggtcaagggctgttggggagcacttggcaatagaaagttatcgggagaaggccgggcacggtgactcatgcctgtaatccccaccgcctgtaatcccagcactttgggaggccgaggcgggcagatcacgaggtcaggagatcaagaccatcctggctaacacagtgaaacccagtctctactaaaaaatacaaaaaattagccgggcatggtggcaagtgcctgtagtcccagcctcccgagcagctgggattacaggcgcccactaatttttgtattcttagtagaaacgaggtttcaacatgttggccaggatggtctcaatctcttgacctcttgatccacccgacttggcctcc

SEQ ID NO: 104557 - DNA, 383 bp, Homo sapiens
cattgattgggaaaatggcagaactactctgaggccagtaatacgttaaaattttttaaaatgtatttatacataatctatatagttttaacataattataatgggtcaaacatcaatgcttgatgtgcttatagacttcaagatttttccaataactgaaactttgcagagatccactgccctgggaaagtggctagaaccagtcctctagggcagtaaaattcccccaaaattttatttgatgaaactctgtagcattagcacttgttacctaaattagtctttcatctttctggctgggcatggtactcatgcctgtaatccaagcactttgagaggccaaggcagcccaggagttttgggaccagcctgggcaacgtag

SEQ ID NO: 104558 - DNA, 560 bp, Homo sapiens
aaggaattgaccacagctgctgcaaggacaggctgagtgtggagattcacagctggagaacaatttgcctcaggaagaatcacaccttgagtctcactcatatttgatttacctgagacttttgattttagacttttgagttgattccggaaggagttaagacttttggggctattggaatgaaatgaatgcattttgtatgtgagaaggacataagttttggggagggtatggagcagaacgctatggtttggatgtatcctctccaaaattcagatgttaccagtgtgctgacattaagagatgggacctttaagaggtgattacgccatgagggctccttcctaataaggaatgaatacataaatgggataaataaattaatgagattaaggctcttaaaaaagagccttcatgctgcacttggctagcttgctgtcttgcctttctgccttctgccatgagatgacacagcagagggccctcacccgatggtggcaacttgatcttggacttcccagtcttcagaactgtgacaaataaatttcttttctttataa

SEQ ID NO: 104559 - DNA, 861 bp, Homo sapiens
gtgaaatgatcctttccaggtaacagccgagaataggggactgcgggacatctccgcctcttccttggctctgggccttcgatgtaaggcgttagaggacaatctttgttggctggatttctgttcttcccctagagatatctggttctttggaggccacttgggcaattgggttaacaatcacttacctgatacctgctcccaaaacgaatcctattgatgaaggatcttctttctgagcagtaaacctgtgtttaattaaccttatgcaaatgagcttaattgcttatcagtggctgttgtccagaagcacctagggattccttccctcagacattttcagcacctagatgaaccgcaaagttggaagcctttcatctacacatgtgttgtgtgcctgtggagccctgggccctgtgttgaagattgcaaggaaaagcaaggtgtgacccctgctgtggacttactttcagtcttagggcaacagacacttacaaccaagaataacaaagggagccgtcggaacatcctgggactccaaggctccgacccccagcgcaaaggactctagggactggcttcctggctgtaccgcgcagcgggactcctcgtctgcacagcttcggggaggcccagagcacgcccctactagccggctccgtccaaggcccaccaagacaacccgccacgaaacttcccggccccctcagcccagggctcccggtcccgagctgctggccggtggcgcggggcctgccgcccgccttctacgagccgcatggacggaggcctgcgtgttatttcatagaggccgaaacggagacccaggaaagataaaagaagggctcaacccgggacccc

SEQ ID NO: 104560 - DNA, 604 bp, Homo sapiens
aatccatgaatcaatagagataatcaaggaaaagtcatcagaacaaaatctatcaccaaccactgaaaaactcctttgtcacctatggaagtgaccaacttttccgaaaattagaagttataaggaaagaagtaagtacttttccttcctctttcagagatactgtagttcatcccgttgatgaaatatagcacttcttaggctgggcgtggtggctcaggcctgtaatcccagcactttgggaggcggaggcgggtggattacctgaggtcaggagttcaagaccagcctgatgaacatggtgaatccctgtctctactaaaattacaaaattagcccggtgtggtggcatgcttctgtaattccagctccttgggagactgaggcaaaagaatcgcttgaacccaggagacggaagttgcaatgagccaagattgtgccactgcactccagcctgggcgacaagagcgaaactccatctcaaaaaaaaaaaaaaatacagctcttcttgagctatgctacatagtaaatgtattattcttccagagaatgtattcttcaaaagtacactattatagttaataaagtaatgataaagctgata

SEQ ID NO: 104561 - DNA, 437 bp, Homo sapiens
gtcgaccccccacccccaatccgtggaaaaactgtcttccacgaaaccagtccctggtgccaaaaaggtgggggatggttttgggatgacactgttccacctcaaatcatcaggcgttagagtctcataaggagaccgtaacctagatcccttgcacgtgcagttcaccataggagttgtgctcctgtgagaatctaattctgctgctgatctgacaggaggagttcaggaggtaatgagagcaatggagagtggctgcaaatacagatgaagctttgctcactcacccgccactcacctcctgctgtgtggcccagttcctaacaggccacagaccagtaagtcttgggggcctgctgggggttgggggcccctgcttgaggagacatccctgtcaaaatctctagtgacacaggaatccatttggacaaattata

SEQ ID NO: 104562 - DNA, 273 bp, Homo sapiens
acctaataaatacagagggctgtgtaaagctcacggcccttgtccactagaggcaagatgccccttgacctcttcttccaaatatactcttttgtgtcttgtcttttattcccacattcgcccccctttgttcagtcccccgaggtccatgcaggttacaagtggcaccccaaacagcaacaggatcgggtgctctgcatagtggcatccgaacacaggacttcgaggacatgaatgaagaaagtccgctggagcagaggaactgaaattgac

SEQ ID NO: 104563 - DNA, 350 bp, Homo sapiens
actactaaaactataaatgtgttaggaagggaaaagcaataacagctaagcctatggtaaacataatcaaagggaaaacacaaaccagaaggaaagaagatgacatagagctagcgtctgaagaaaattttaatgtgttaagttctttggacaatggtgcacttgctaaatttgaaagtttcagtaaggtgggaaaatttaacttgtctaaatggattcaaaaagaagcagaaaaattaagtggttatgaaccttggaaaaagatatgtgtcaaataatttcctcaaaaaagtcccttggcccagagagttttatagacacgttctttcaaatcgtgagagaggaaggat

SEQ ID NO: 104564 - DNA, 83 bp, Homo sapiens
aaggtgatgaggggcctctccatctgcaccacctgcctcctgagcatgttccaggccattaccatcagccccagcacctcctg

SEQ ID NO: 104565 - DNA, 305 bp, Homo sapiens
agtacacctagtatctttacagtgactattaagtatttttgaactcaaagtatatattcatcttaaactcctggaactatgaaccctcccatgtaattttctgatgaatgaaaaggaaaactttctttcaaataagtgtcatctgttgcaaaagtatgtgatttaaaaacacatgtaaatataatcttagctctaatgttttcctttgggagtttgggaaaaagcagttacatttctctgttgtctggtttttatcatttgaaaattggaagattcattctgattgctgagctgcatcagtaggg

SEQ ID NO: 104566 - DNA, 382 bp, Homo sapiens
ggttagagggcctgatgtataaaccggacaccagttgattcattttttaaggagtggtttcactgccaggctgagtggatattgcctcatctgggctaggacaccctctccctgcaggccacccagataaacagccacaggtgagaaggctgctgagtgcccctggaaggtgagctagaggagccagaaggtggttagggtgttgaagagggtcagatgctgacagtgtgctgggccagccccagcccaggcaagcatccctggcctcactgggtccctttcccccagacagagtaagtacaggcgctgtcagcatttacttctctggctgacctttctcttttctaatcctgtgcattaggcctttcatatgttagtgtca

SEQ ID NO: 104567 - DNA, 419 bp, Homo sapiens
cccggaggcaacacaagggagaagaggcctttttatgttgggaggtcagagactcaggagagcaactatagccaggaaagtcacatcgcctgaaagatcaaaacaagaaggcaagaaaacaggccacaggaaaatgatacttcagagggaaattcctctctgaggtaggctcttctaggtagatatgtctatgcagaatagaacaaatctagaggtagaattgttggcaggatggttataattagataataaaggtagattcttagatagctatggtacgatatgaaaatcaaagtaaatattattttcaccaaatcataaagtacttctgtaacacataaaaatgtgccaatgaaattactcagaaatgtgaaagtagttatatataaaatgtggatatctgaataaattcacttgga

SEQ ID NO: 104568 - DNA, 537 bp, Homo sapiens
ggagggtcctggctgtcacagttggacgcgcgaacggcagcgtctgggcgacaggcgatgtcccagccactgaaaccgtatttgggggcactttcaaaatagatcaggagaaaataaaaacaatttgatttttgatttttagagataccaaaatcacaacttgatttttggaggaattaaagcaacctgcgatgtcaaggctacgtaggttgaactttgcaggttgaccgtgtgtgacttggctaacgcaagagtgagtgacagatgtaagcatcggaaagggcatcatttctttgactgcttgttctcaagtctggaagagatcggcgtcgtaatcacagaagccagacctccactttcctgtgacagagggagattaccgaggcattttagagccaaggcgggtcaaatgataattgcttctaattggcatccccagaagcaccttaattatttatctgcagctgtcactcaaagagggaaattcttcctacctttggaaaactggttttctttcatattgttattctaatacat

SEQ ID NO: 104569 - DNA, 411 bp, Homo sapiens
tcagacggagtcttgctcattgtccaggctggagtgcagtgatgcacgatctcggctcactgcaacctccgcctcctgggttcaagccattctcctgcctcagcctccctagtagctgggactacaggcatgtgccaccacacccaactaattttttctatttttagtagagatggggttttgccgtgttagccaggatggtcttgatctcatgacttcgtgatccacccacctcggcctcccaaagtgctgggattacaggcatgagccaccatgcctggcctcaagtccagaatctttaatatacgttcaaagatgattggagaccaggctcttgatttaccttccagcctctttccccctcagcctataactcccaaactcaggctgcgctgtgctgtctttaacaaa

SEQ ID NO: 104570 - DNA, 689 bp, Homo sapiens
actttccttcttactggtcactatgtagtataggttgagtatcccttatctgaaacacctgggacccgttttaaccaaagggaaatgacagaagtaatgttgctccagttccaggtgtaggccttaagagtctagcagttcaactttggctctctggagaaacctagttgtcatgtgagaagtccaagtaccctgagaccaccatgttttgaagaggcccaagctggccacatgtagagcatcaaagagcccggacaagtgagaatcaaggtcacagacacaggcctggtgaggtgttctatccccaagctattcgagccatcccagcagattccatagagccaagatgagctgaacctgctaagtcctgacaagctgcagaattatgagcaaataataaaactgttattggtttaagccagcaaatttaggggtttgtcatataagagataaaccaaaatgccaattcatttgcttttctgcttaagccagcttgagctgggcatttgtcattttaacaaaaaatgttctagctgacagctttggtcttgacgggcaatcagggcggaacattcccctccccttggagtgcttttcagttccataagtctgtgagacattgtattacatcagtcccctcaagaagcacaccagaaacccttacctgcaagtcacagttcccctgacta

SEQ ID NO: 104571 - DNA, 409 bp, Homo sapiens
aacctgcaggggaagaaagtcagataggccagtgagaattccagcaggcctggtttccgtcctcacacacttggctcctgtttgtgtccagggacgttacttgcacacaggggagaatagattgaggcgttactcgtgggtctttgtagagagaatgtgctcttccacttagcattagtgtagagcgtagaccaaagatttgccagtgaacattccttgttgtgagatcataagaggtacctgtctgcagatcttgcaaaccatctctatgctcctgaatattgtccactgtcccggagactcttggctgatggggtgtgagatatatgtgtggcatttctatttctgaatgccttttttgctattgctctctccaataccatatttaaaaggctcctggagcaattcc

SEQ ID NO: 104572 - DNA, 488 bp, Homo sapiens
attagagtgagaggatggacctcagccttggggtcagaactcccgtgcttgggatgggggttggcaaaaataaagtagaattaataagacatgggctgaaggtccagatgaagacagaagccctgttatcagaaccaaagcccagtgctagatatgtgtgcatccaggagggctgggttctaaatcctggaggatggggatgcttaggctccctacattcctcccactaataatggtcagtatgaatcatgtggctggctgaggtgaggtttaacttagccatatagtcttctccctgacccccaggttttcttttaaagcaaaatacctgcttcatcatggaaacagagtctttgacttaacaatggactattacaattccacatgagagcattagagacctaatacaaggaagcaaggaagtgaattcagcttctggctccagacaccggctgggtggtcctggacatgaacccttaccatgctgg

SEQ ID NO: 104573 - DNA, 159 bp, Homo sapiens
tgctggtcagggggcgctggtgcgcaggcgcgcggggccgccgtcgcagctaccttcctgcgccgattcggagagggccccctaatctctactcggcccgcaccagcagcgctggcgtcagggcgcggtgggggcaagacgggtgactggcagcagggc

SEQ ID NO: 104574 - DNA, 417 bp, Homo sapiens
ctctactaaaaatacaaaaattagctgggcatggtgacacgcgcctgtagtcctggctacttgggaggctgagggaggagaattgcttgaatctggcaggtggaggctgcaatgagccaagatcgtgccactacactccagcctggcaacagagtgacactgtctcaaaacaaaaagaaaaaaaaaagaaaaaagaaaaactcacctaaatatgggatgatcatattgtttgtagtccagactgggaaacttgagagtgaaagtgacacagaggcagcaggtgtatcctgagatagcccaggcaagcgaacaaggtttccctatctaaatcctattactagcaaagcatccattaaggatgaggaaattggctgggcatggtggctcacgcctgtaaccccagcactttgggaggct

SEQ ID NO: 104575 - DNA, 230 bp, Homo sapiens
gcgtgatgagctagcgggagccggagccccagccaggggagaggatcttgcagccagcaaccctggggcagccataccagagaagtggcaaaggggcaggagaaatgcccgatttttctctcatttcacttccagtttcctgcctttggccaaacacacaggaagccagtgggcaaagtcagcatcctgagcacagggcaggtcagagaagggtggagaatagaaagtgg

SEQ ID NO: 104576 - DNA, 205 bp, Homo sapiens
cgcagggagaaacgacaacgcatattaatcacttgattatgatgtgtaatcatttttgtcatttttagaatgtcaaaaaaatctgttgcaaaaaaaaatctccttattgagttttaaaacgtctgtaggtttctcccagtaccctggggcaatagagacccatcataacatcaaccagtgatgagccctgctaatgtgctgggtg

SEQ ID NO: 104577 - DNA, 415 bp, Homo sapiens
tctaatgattaaaatcagtaatttcattcaaagaacaattctaacaatttggtaatgtggatttcccattcacagttacttagcacatttgtagtaatagggactactattgctaggaccaaccacatcaatgagttagtgggcaaaacacatgtgcacccacaaggaaaagataaaactggctattaaaaagctactatataattacattaaacggcccctgaatggtttggctgtgtcccacccaaatctcattttgaattgtagctgccaaaattcctacgtgttgtgggagggacccacattgtatcatggggcacatctttcccatactgttcttatgatagtgaataagtcttatgagatctgatggttttataagggggagtttccctgcacaagctctctctttgcc

SEQ ID NO: 104578 - DNA, 696 bp, Homo sapiens
tcaaaatagggtgtaaaatataaaactataaaacttttaggaaaacacagaagaaaatatttgggatctatgatggacagagttcctaaataccaaaagcatgatccacaaaaagagaggaaagtccaaaagcatgatttataaattggaccgcatcaaagttccaaatgtttgccctgtgaaagcccatgtgaagaggatgaaaagacaagctacagactggaagaaaatatctgtaaaccacatatccaacaaaggactagaattttattttattgtattgagatagagtctcactgtcgcccaggctggagtgatcacagctcactgcagcctcaacctccctggcctcagctgatcctcccatctcagtctctcagatagctgaaactacaggtgcacaccaccacatccagctaatttttttcttttttgtagagatagggtttcgccatgttgcccaagctagtctcaaacaactcacccacctaagcctcccaaagtgctgggattacaggtgtgagccactgcacctggtcaagactagaattttaaatgtacaaagaattctctaaactcaacagttaaaaaacaatccaattagaaaattggcaaccacatgaacagacatttttccaaagatggcaaataagcacataaaaggacttttcaacacctttggcaatcaggaaaatg

SEQ ID NO: 104579 - DNA, 714 bp, Homo sapiens
cttcccaggttcaagcagttctcctgcctcagcctcctgagtagctgggattacaggcatgcaccaccacgcccagctaatttttgtatttttagtagagacgcggtttctccatgttggccaggctggtctcgaactcccgacctcaggtgatccacctgcctccgcctcccaaagtgctgggattacaggcgtgagccaccgcacccagccgttgttttgttctttatttactttattcgaccctgaagtgtggtactactatctgttctgttgataaggaaacagagacaaaagttgaaggcactgcaggggcagagctcttaagccactgcctagaactggccatgtacaatagtcctcccttatctgtgcggcgatatcttccaagacccccagtgggtgcctgaaagtaccagaccctatatgtacaaatgcccctcggtatccgtagggggttggttccaggactccctgaggatactgaaatttgtggaatatataaaattgcatggtatttgcatataaaccattaatacgtacattctcctgtatacgttaaatcatctctagattacttataatacctcatacaacgtagatattatgtaagtagttgttatgctatattgtttagggaataatgacaagaaaaaaagtgtacacattcagtacaggcacaaccatcgtaggcctactaactacatttttgat

SEQ ID NO: 104580 - DNA, 451 bp, Homo sapiens
taaggagtatacacgtttaagggagtgggggtggaggatgcagctatgaagttagaccacttgagtttgaatctaggctttgtcacgttaaaactgtggtcttaggcaagttacttaacctacctaaaccttagtttcctggtttgtaaagtggaggcagtaacagtatcaacctcaaagggttattttgagataatccgtgtagaaactagcgctctgcctgtcactagcaattaatacatgctactattgttatcgttatcaactgcaacactaacagaaatagcaatgctattaacctctttgcttagaggtgatagccacaagcatcaggaaggtaaatccacagacagaagatgataaaacgttttgtaagaaagcacgtgttaatttgatcacgcttctcaccacaagcaacgtaaattttctagaattatctctggaaccaaaa

SEQ ID NO: 104581 - DNA, 172 bp, Homo sapiens
agcagaggctttcctatattattgaaaacttcagaatgatttttaagttaccatgaaaagcttcaaatgacattctccttattgtgtctttattcagtcatctgatgttgactatactagatgaaatgcattcctgtaaatgctgatgtgtgtatagaaatgagcttcttgc

SEQ ID NO: 104582 - DNA, 177 bp, Homo sapiens
gctttcttggctttgcctgcccagttgtttcatgccaggaggaggagccgcctgctggaggctggagcttgtggcaccaccgctcgcctcgctgtggttggtggcggccatggagactaaagactcagcgctggagtggtaggagggcggcaatgaaaactgaagagcaccagagcg

SEQ ID NO: 104583 - DNA, 408 bp, Homo sapiens
aaaaaaaaaaaaaagacaaaaattagccaggcgtggtggcctgcgcctgtaatcccagctactcagtaggctgaggcaggagaatcgcttgaacctgggaggcggaggttgcagtgagccgagatggcaccactgcactccagcctgggcgacaagagcaaggctccgtctcaaaaaaacaaaaacaaacaaaaaaacagactgagctagcaaatagtatacccagcatagtgcctcatcgttggctgactgcatagtagctcttattacagctaccttccctacagaatttaggcatgctgtgggccagactcccaattttataagtgcttacaatggaaagagcactggattgggagtcaggacaacttgagttgagtcttggctctattactagctgttgatgga

SEQ ID NO: 104584 - DNA, 703 bp, Homo sapiens
ttcctctcagtcaaaacaagtgatcatatcaaaaaaaaaaaaaaatggagtttgttatgctacattccagtcacatttattctcttatttcagggaagcctacaaatgactaataagttaagaaactacactaaatatgtatgtaaatattctttagaatttttttctgaaaccatgtattcgttatcactagcaggtattttacatatagctttctaaatataaaacatgcatggtttcctattctgcattagtatgtttgaatagataaattttttaatgctcagaagatgttgtcagcattttgtttctttttaatttgagaattactttacagctttatatagtgagggcaatgtgtacaaaggttaagagtgatggtgacacattaaagcgaattctttaacttgctgactttggagtattcaagatcatcatctcattggtgatcatgcttgggtaatgcatttgaaaagctatctttttttttaactttaaagagttactttctgcttcattgttttgcttatgtaaatataattaattcattaactgttgccataaagcaatgcaactgatattaagtgatttttctacatggaatttcagaaattatttttttaatttcccaattaagggccgatttactgctaatcatagagccatctgtgtgaaactcagtgcccttcagtctgaaaaatga

SEQ ID NO: 104585 - DNA, 367 bp, Homo sapiens
attgtatgcagctgcaggtgtatcctttttatgaaaaagaagggaaaaaaaaacagttttttgtccctatctttcagcattctcaaaaggatgagtgacccaaaaatcattacagattcctgtctcagagtaatgagttccacatggttattgcctatgcaacgtcattgcctattgacatttgtcctgaaggctttcacaagtaacaaagggtgtctccttattttctatgtttggggatctgtgaatgagcctctgttcccttcagccttgcatttgtgctttcttaagaacctgtgagtgagcaaatatgtaaactaagtaacaccctgcccttgtagccttcctgaagtgccttccatacgtg

SEQ ID NO: 104586 - DNA, 169 bp, Homo sapiens
tctccacacagctaccacagtgtgcaagtagaagtctcagccatatcaccacactcctgctttaatgtccctactccattgcttcttttctccttcagaagagtttaagcttaatgaagctgggcaacttcacatatttttccacgagctggagatcacttggtttaag

SEQ ID NO: 104587 - DNA, 112 bp, Homo sapiens
atactgcatagtggatggattagtttgtggttcctgggatcttctgtgttttgtgttgaagctcaacaaccacattactgcagacctccaaaattttacaaaagactgcata

SEQ ID NO: 104588 - DNA, 417 bp, Homo sapiens
taaagtaagatatcattctctcattcctttcacatacctgcctaaagatctctgataaaagaggccttcattttcttccataccccatcaccctttatcctctactatacattattttgttttacttattatcatcttatatattttgttcatgctttgttgtctgtctcctcacttaagaactaaatttcatgacagcagagattttgttttgtcactgctgttttctctgcacttaaaaagagttgttggcacatagtattatagattaatagaaacttaaatatttgccaaggaatgtcatttatataagcacaacaacatggaaaacaatcttgtattttgtttagaaacatatggatattcctaatgttgtgcctaggcatgataactaccaaatgcaggagaatggttacc

SEQ ID NO: 104589 - DNA, 643 bp, Homo sapiens
ttaaatgagataagacaaacacagagcaactccttgctaacagccatgcagtaccaagcaaggcacagcaaagggaaagagaaatccagtggcaccagtgggctgagaaactgtcgggtttggctgctgctgttgtctgcatctcccgccttcctcctgagccgtgcttccagggcagccccggcccttcatgtcagctggtgacatttctgcaattgttcctaaagaggggcctgtgggtcgagtgagctaagcagggcttggcaaggtggtgtcccccggtcagtgccagagtctccctaatgtggcctgtgagacagagctgatgctgaacaaaggaacagggtgatctgggagcagcagcagccgctgtcctgagcatctgggtcaggacgacacggatgccaccccaggacccctggcatagggagccgagcagggcagccgggcagaggcaggaatgaatcctactcagctgcagaatagtcacagacacctctccaccagcaacgtccctgaaacagtctttcttattaaaaaatattgagtgtcagttatgtgtcaggcactgttctggacacgaggtctcaggaacaaacaaaatatacagaaacttggcccttgtgttgctcaggatgaagag

SEQ ID NO: 104590 - DNA, 525 bp, Homo sapiens
tgccaatattctgttcttctgataatggttttaccatgacattgaggagtatactgcttgaagattttgaagtttttcacaactgaaattaaaaatgtcgtaattttatgttatttccccttttgtctttttttggtgaaatctagaaaaggagactttctttcatctcatttttaaatttttagaataaggtattctgccagtggccaacattaactttataataggcctgagcaaataaacccatttctttcacatattgtgtctagtgaacatccaatcagggattctcctagctttatcagctcacaactctgcctctgtaaagctttgctgccttttatttttgtggttgctataaagctagaagtcacgagcttttatcattattgcacagtctgttgttgataaccctaatttctcaataaaattggaaggcaagatatctgagttgatttttcctgttctttcaaaatattgctaaagaaatttgtcttaaacttttttgggtaaacaaatgggaat

SEQ ID NO: 104591 - DNA, 1824 bp, Homo sapiens
  misc_feature (1)..(3): n is a, c, g, or t
  misc_feature (72)..(72): n is a, c, g, or t
  misc_feature (202)..(202): n is a, c, g, or t
  misc_feature (362)..(362): n is a, c, g, or t
  misc_feature (643)..(643): n is a, c, g, or t
  misc_feature (919)..(919): n is a, c, g, or t
nnnattgcctatacagaacaggcaacccttgggctaaatctgttcagtgagaagaatggatcacagggaagnttattaagaaaggattcaccctggctactgactgacagactgcgcatgtgtgtgttcagtgcatgtatgtgtacccatgcctttcctcacgttgccgtgatacggaagcgcaggttggctcctgtcgatngggatgggtaagatccgaattcgaggtcacacccccgccatggggctgtcttcagctgtaggtgtgggcctcgttgaaccgcatttcctcctgggtgaaatgtggatggcatctcccatgcagggtgttacgcaaatggcacagtgtctggaaggggctnagtatactgcgctgcgcagagaaagcggggaagctgatcattttttaaaaattaactttttatttggaaataattccagagaaaagttgccaagacaatagtgtttctgtatggtctgcacccatcctcttcccgttaacatcttatgtcaccataggagagtcggcaaaactaagaaaacaacgttggtatgttacattaactaaagtccagattttattccatggtaatattttcaatgattatcattaatggaaagagatctaaagtataatatgcancaaaagttccccagaatttggtatataagtgatctagtgagtgtgaccttcccttcgcagtcctgcatgagactgcaatatacttccatcaacagtggggaaattacagggcagagaaagtctcaggaagttttccggaatgattaggctgaagctcagttcagcaaacacacctgcccctatccaaatgtcaccttctcctgagtaaacacacctgagaaggagatggacgcccaaggcctgcttcttgctggcaaagccacattacctgctttnttcaaaaacaaggaaactggtttggtgagttctaataacttcaggagttcttttccttgtgaaagcaagaacagtttactcagctgttcaaatgagttcagagaaagccacttaacaacctttggcgtgcagtcaggactcccaaatgccagccctgaggtgactggcagaggctgagtgcaaggtggccagctgggttccccgagacaggtggaaggcctgctttgctacagagtgccttggtagattctgcagggtacaaaactccacttacgagccagctgggagctgggagacagcaagcagtcagtcgtacaaagaggccctcggaattggctatggggtgcacgcagttttcatggaggatcagctgcatgttttaggagaaactttggccagagtcacgtggaaagcatgcgggagactggctgggaggaccagactgactgaatgtcgagatatcactgagcagccaaggctctgtgagacagtgaggaaggagaggggaggccacctagagttttgaacacagtcagctcagaggatggtcatgaaaatgggagggaagtcaaagaagccaggaagaaagaagcatacaagtacgataagggaagatgagcttgctttgggaatgataattttgagggccctgtgataaagtgctccaaacagttggaaatgtgggtcccaggctttggaaagaaatgaggcagaaaggtgtaggtttggaagttatccacaagaagaatcagatcttcaaggaagagaacattaagaggaaaagagagctgagggcagaatcttctcgactatacctttatggcagcttgctttccataaacgtagatcatggcagcataaaaaccagcaaaggaaacagaggccaccagaggtttgaaaaaaaa

SEQ ID NO: 104592 - DNA, 974 bp, Homo sapiens
ccttggagaaaaattgagtttggttccaagggctgtctgtgctcttttgggaatctaagggtaggagtcttacagatctgggtcagttaatgtgcacaaaacgttgtggcatatttactccctttgatacctaaccctggaacttttaggctttcaaagaaagtcaccactgtagtcctagctcatccctggggcatgatggttctgtgaggaccagtccagtcatcctcttgctcctgcaggcttagtcctgcagtctaggaagccatgcaaagaaggtgagagggtcccttctttccattgttcatggcacctgagggattcttcactttgagagcagcttccattcccttagaactcatgggaccaggacttatgcagagaacagtagtgagaaaatacttgtggtcattttcttgattccaggatcttccaaagattatgcaatcagtctttaaaaaaacagaataattaattttaataaaaaatgtttcttgattttaaatgttttaaaagataggacccaaaattccacttcatctggcctggcatcatccttgcaggctttggatatgtctcccgtgtgcggacctgggaggcagtgagaactaattatttctttgttgcttaacaaaaggcggtgctgtttggcactttcacagactggcttatctccagcaaccactgcagaagacagtgttatcaccattttatagaggagaaaactgagacttagagaggtaaagtaatttgcccaaagttacatatctaggaagcctcagcacaagaattcaaatcctggccatctgattccagagcctgggctcttggccagcacagcctgactgtcactggttgggggaaggggcggtgatgcttttagaaacaggcttcttgagacaccaggcagctttccagttccctgcaaacatgggggaatgccctgatcagtcctaaaggtgtgacatagtcta

SEQ ID NO: 104593 - DNA, 362 bp, Homo sapiens
gcccaggagagttgctcacttcccagagaggaaacttcctgtattgatgtgtgggaggcaccagtggttaaacagtgcttgatttatacctcttggcgttctgtaggtgatacctaatacctatggcctcatacatacagccttttcttcagtgagacgatgaaattttaaaggaatgaaagaaaaatagtgggaagtagatggtcatctttagacttaccttgaaggattactttttgcttttgtttattgaaactatgccatgaacatttgtgcttccacaaatatgtcattgaatacattacccacttgttcaatttttcttgtacaaggatgacagattccttctagaacttaattcc

SEQ ID NO: 104594 - DNA, 197 bp, Homo sapiens
tagagtttcattttccagtctctagagcagcagttcacagttgcagttttaccacacccggagtaactaacacatattatcccagtgggcaccacaggctttatttgaattcaccatagtcaaatgaataggagatatgtaccatattgggtgactgggaaaggggcagggaggtttttatgaaatcagatccataa

SEQ ID NO: 104595 - DNA, 1302 bp, Homo sapiens
gtgctgcaaaggacgccgctgttatacgtcacttccacggctcagcgtcaggcaagttggcctctctgttgtaaattagtggttaaggttatctattattgccacttttccagcgctaaaggctgttttggaaccagtgttgcttgttccgcgggtgattggcttttttttttggcaaaccagttattcaagtttctggtctttaaaaaactctgtggcggtacggtaaccgaggaggttccagcgcggcggaagtaccccgcgggtgggtgtgtgcgcaaggccagggccagaggggcacgtggcgccgggaggagagagaatgtcttttcgaggcggaggtcgtggaggctttaatcgaggtggtggaggtggcggcttcaaccgaggcggcagcagcaaccacttccgaggtggaggcggcggtggaggcggcggcaatttcagaggcggcggcaggggaggatttggacgagggggtggccgcggaggctttaacaaaggccaagaccaaggacctccagaacgtgtagtcttattaggagagttcctgcatccctgtgaagatgacatagtttgtaaatgtaccacagatgaaaataaggtgccttatttcaatgctcctgtttacttagaaaacaaagaacaaattggaaaagtggatgaaatatttggacaactcagagatttttatttttcagttaagttgtcagaaaacatgaaggcttcatcctttaaaaaactacagaagttttatatagacccatataagctgctgccactgcagaggtttttacctcgacctccaggtgagaaaggacctccaagaggtggtggcaggggaggccgaggaggaggaagaggaggaggtggcagaggtggtggcagaggcggtggttttagaggtggaagaggaggtggaggtgggggcttcagaggaggaagaggtggtggtttcagagggagaggacattaagtgaaacagttgacagacatcaccagttgacttctgcattaacctgcatgatctgtttctactatggattggaaacttgtttcttgaacaagtcttgaagatcttggtcattttatgacaatggatctaaaatgtcagcatcatgcaaagtgcaacggaatagtgaattttgctctaaaagagcatgaacaagtctttctaatgttttgtacagtgcctggcactctgtgggtgctcaataaatggataggagttttcatttgaaggatatttgaatttttaaaataaagtgttttattcccttaaaaaaaaaacaacaacccaga

SEQ ID NO: 104596 - DNA, 1023 bp, Homo sapiens
gtgctgcaaaggacgccgctgttatacgtcacttccacggctcagcgtcagggaggagagagaatgtcttttcgaggcggaggtcgtggaggctttaatcgaggtggtggaggtggcggcttcaaccgaggcggcagcagcaaccacttccgaggtggaggcggcggtggaggcggcggcaatttcagaggcggcggcaggggaggatttggacgagggggtggccgcggaggctttaacaaaggccaagaccaaggacctccagaacgtgtagtcttattaggagagttcctgcatccctgtgaagatgacatagtttgtaaatgtaccacagatgaaaataaggtgccttatttcaatgctcctgtttacttagaaaacaaagaacaaattggaaaagtggatgaaatatttggacaactcagagatttttatttttcagttaagttgtcagaaaacatgaaggcttcatcctttaaaaaactacagaagttttatatagacccatataagctgctgccactgcagaggtttttacctcgacctccaggtgagaaaggacctccaagaggtggtggcaggggaggccgaggaggaggaagaggaggaggtggcagaggtggtggcagaggcggtggttttagaggtggaagaggaggtggaggtgggggcttcagaggaggaagaggtggtggtttcagagggagaggacattaagtgaaacagttgacagacatcaccagttgacttctgcattaacctgcatgatctgtttctactatggattggaaacttgtttcttgaacaagtcttgaagatcttggtcattttatgacaatggatctaaaatgtcagcatcatgcaaagtgcaacggaatagtgaattttgctctaaaagagcatgaacaagtctttctaatgttttgtacagtgcctggcactctgtgggtgctcaataaatggataggagttttcatttgaaggatatttgaatttttaaaataaagtgttttattcccttaa

SEQ ID NO: 104597 - DNA, 631 bp, Homo sapiens
taagtttaattttctctgccagcaagtatatagaacaccatggtgttctttgcttagcctaatttgtggtttcattttatatcactttttttttgccttttcttttcaattttttcacctaattctaatttgttttgctttattattaatttgaaaaataaaagtgtaatatgaatgacagttaaatttggtaaagtatgtttgctaaacattattggaactaatgctgattttaaacttgagatttaggttataatactattaaaaatccattttctgtgcccttaatactttaattttctcttaatcagggagaggacattaagtgaaacagttgacagacatcaccagttgacttctgcattaacctgcatgatctgtttctactatggattggaaacttgtttcttgaacaagtcttgaagatcttggtcattttatgacaatggatctaaaatgtcagcatcatgcaaagtgcaacggaatagtgaattttgctctaaaagagcatgaacaagtctttctaatgttttgtacagtgcctggcactctgtgggtgctcaataaatggataggagttttcatttgaaggatatttgaatttttaaaataaagtgttttattcccttaa

SEQ ID NO: 104598 - DNA, 426 bp, Homo sapiens
ggctggctggcctgccatttgcctctccccagaggcggtggttttagaggtggaagaggaggtggaggtgggggcttcagaggaggaagaggtggtggtttcagagggagaggacattaagtgaaacagttgacagacatcaccagttgacttctgcattaacctgcatgatctgtttctactatggattggaaacttgtttcttgaacaagtcttgaagatcttggtcattttatgacaatggatctaaaatgtcagcatcatgcaaagtgcaacggaatagtgaattttgctctaaaagagcatgaacaagtctttctaatgttttgtacagtgcctggcactctgtgggtgctcaataaatggataggagttttcatttgaaggatatttgaatttttaaaataaagtgttttattcccttaa

SEQ ID NO: 104599 - DNA, 148 bp, Homo sapiens
tcaagcttctaacgatgtacggggacatgaacaagtctttctaatgttttgtacagtgcctggcactctgtgggtgctcaataaatggataggagttttcatttgaaggatatttgaatttttaaaataaagtgttttattcccttaa

SEQ ID NO: 104600 - DNA, 1034 bp, Homo sapiens
aggaggaagcccgcattaatcggaagagggcaagttggcctctctgttgtaaattagtggttaaggttatctattattgccacttttccagcgctaaaggctgttttggaaccagtgttgcttgttccgcgggtgattggcttttttttttggcaaaccagttattcaagtttctggtctttaaaaaactctgtggcggtacggtaaccgaggaggttccagcgcggcggaagtaccccgcgggtgggtgtgtgcgcaaggccagggccagaggggcacgtggcgccgtattaggagagttcctgcatccctgtgaagatgacatagtttgtaaatgtaccacagatgaaaataaggtgccttatttcaatgctcctgtttacttagaaaacaaagaacaaattggaaaagtggatgaaatatttggacaactcagagatttttatttttcagttaagttgtcagaaaacatgaaggcttcatcctttaaaaaactacagaagttttatatagacccatataagctgctgccactgcagaggtttttacctcgacctccaggtgagaaaggacctccaagaggtggtggcaggggaggccgaggaggaggaagaggaggaggtggcagaggtggtggcagaggcggtggttttagaggtggaagaggaggtggaggtgggggcttcagaggaggaagaggtggtggtttcagagggagaggacattaagtgaaacagttgacagacatcaccagttgacttctgcattaacctgcatgatctgtttctactatggattggaaacttgtttcttgaacaagtcttgaagatcttggtcattttatgacaatggatctaaaatgtcagcatcatgcaaagtgcaacggaatagtgaattttgctctaaaagagcatgaacaagtctttctaatgttttgtacagtgcctggcactctgtgggtgctcaataaatggataggagttttcatttgaaggatatttgaatttttaaaataaagtgttttattcccttaa

SEQ ID NO: 104601 - DNA, 1684 bp, Homo sapiens
agaagaaaatctactaaagtatacttttgagggacttcatttctttgggttattcatgttttcttggacattttaataaaccgtaagattatcttaattttaattccttagttaatattattgagtgtagactgcatgctgaaagctggtcatacattcttttaatttccatgtatatatttttaatactcagcgaaaccttttgagatagatgatatccttattttatgaatgaggaaacggagacttacagaaattaatttgccccaatcaaacaattggcagacccaagaattaaaatgcatatcttctgatgtcatgtcaagaactattactaataaattcattactgtgatctcactgttgtgatgtatgcctttcccccaaggttttggggtattttgatgtatgcctgttttgatgtatgcctttcccctaaggtttgggcacattcatcattatggacagctaggtgatgagcagggctctggggagtggggctgccatgccctgtgagtaggagaagggcgagtgatggggtgatgggcagagccaaagtggaaagggagaggagctgaaagttgggcttggacagcttttgttactggatcagaaaaagagaaggaacgcctcacttttggcgtttctcaatttaatcaccatttcactccataaaggtatttttttgtgtccatataggtaggaaaattctcaggggtaccttcttgagaatttgatgaacagagattcccctattctcatgttatgttgagtatcatttaacatttcaaaaaattcacagctgtcttatttttttaaaatcttacttatgtagctcagttaatcttaactatcatatttattatcttacccccagagcaaaagcacccatatctgccacccgtcgtgttaggataaaaagccacagttccatcaaactatccttagttgaatcaaaaaagtatttatcataagcaagagctaaggcaatagtcatacatttaacaagactgaatcatactttaacaagtttttctaatttattgaaatggaataatctggggttttagcctgttgcccagttggtaaactactacagtttctccatttttatcttctaaaattttttccctgataaaatatgtgaatctatatttattcattataattatagttattgtattgatctttttaggcttatcaatataagaggttatacagttaataacttaatgattattatattctattgttatttaaatactttgcgttattatttaataaatgttttttaggtggttttagaggtggaagaggaggtggaggtgggggcttcagaggaggaagaggtggtggtttcagagggagaggacattaagtgaaacagttgacagacatcaccagttgacttctgcattaacctgcatgatctgtttctactatggattggaaacttgtttcttgaacaagtcttgaagatcttggtcattttatgacaatggatctaaaatgtcagcatcatgcaaagtgcaacggaatagtgaattttgctctaaaagagcatgaacaagtctttctaatgttttgtacagtgcctggcactctgtgggtgctcaataaatggataggagttttcatttgaaggatatttgaatttttaaaataaagtgttttattcccttaa

SEQ ID NO: 104602 - DNA, 1221 bp, Homo sapiens
gaggatccccgctccacccgacggggtgggagtggggctgccatgccctgtgagtaggagaagggcgagtgatggggtgatgggcagagccaaagtggaaagggagaggagctgaaagttgggcttggacagcttttgttactggatcagaaaaagagaaggaacgcctcacttttggcgtttctcaatttaatcaccatttcactccataaaggtatttttttgtgtccatataggtaggaaaattctcaggggtaccttcttgagaatttgatgaacagagattcccctattctcatgttatgttgagtatcatttaacatttcaaaaaattcacagctgtcttatttttttaaaatcttacttatgtagctcagttaatcttaactatcatatttattatcttacccccagagcaaaagcacccatatctgccacccgtcgtgttaggataaaaagccacagttccatcaaactatccttagttgaatcaaaaaagtatttatcataagcaagagctaaggcaatagtcatacatttaacaagactgaatcatactttaacaagtttttctaatttattgaaatggaataatctggggttttagcctgttgcccagttggtaaactactacagtttctccatttttatcttctaaaattttttccctgataaaatatgtgaatctatatttattcattataattatagttattgtattgatctttttaggcttatcaatataagaggttatacagttaataacttaatgattattatattctattgttatttaaatactttgcgttattatttaataaatgttttttaggtggttttagaggtggaagaggaggtggaggtgggggcttcagaggaggaagaggtggtggtttcagagggagaggacattaagtgaaacagttgacagacatcaccagttgacttctgcattaacctgcatgatctgtttctactatggattggaaacttgtttcttgaacaagtcttgaagatcttggtcattttatgacaatggatctaaaatgtcagcatcatgcaaagtgcaacggaatagtgaattttgctctaaaagagcatgaacaagtctttctaatgttttgtacagtgcctggcactctgtgggtgctcaataaatggataggagttttcatttgaaggatatttgaatttttaaaataaagtgttttattcccttaa

SEQ ID NO: 104603 - DNA, 1203 bp, Homo sapiens
gctggtaactgtcaccagggaactggcaagggaaaaaggacgggggaggcatgcaagagcgagaatcccaaaaaaagttgaaatggttaggagctgaaagttgggcttggacagcttttgttactggatcagaaaaagagaaggaacgcctcacttttggcgtttctcaatttaatcaccatttcactccataaaggtatttttttgtgtccatataggtaggaaaattctcaggggtaccttcttgagaatttgatgaacagagattcccctattctcatgttatgttgagtatcatttaacatttcaaaaaattcacagctgtcttatttttttaaaatcttacttatgtagctcagttaatcttaactatcatatttattatcttacccccagagcaaaagcacccatatctgccacccgtcgtgttaggataaaaagccacagttccatcaaactatccttagttgaatcaaaaaagtatttatcataagcaagagctaaggcaatagtcatacatttaacaagactgaatcatactttaacaagtttttctaatttattgaaatggaataatctggggttttagcctgttgcccagttggtaaactactacagtttctccatttttatcttctaaaattttttccctgataaaatatgtgaatctatatttattcattataattatagttattgtattgatctttttaggcttatcaatataagaggttatacagttaataacttaatgattattatattctattgttatttaaatactttgcgttattatttaataaatgttttttaggtggttttagaggtggaagaggaggtggaggtgggggcttcagaggaggaagaggtggtggtttcagagggagaggacattaagtgaaacagttgacagacatcaccagttgacttctgcattaacctgcatgatctgtttctactatggattggaaacttgtttcttgaacaagtcttgaagatcttggtcattttatgacaatggatctaaaatgtcagcatcatgcaaagtgcaacggaatagtgaattttgctctaaaagagcatgaacaagtctttctaatgttttgtacagtgcctggcactctgtgggtgctcaataaatggataggagttttcatttgaaggatatttgaatttttaaaataaagtgttttattcccttaa

SEQ ID NO: 104604 - DNA, 943 bp, Homo sapiens
ctcatatgatagttcagattaactgagctacatcagtagacttttacaaaaactcagaccgctgtcttatttttttaaaatcttacttatgtagctcagttaatcttaactatcatatttattatcttacccccagagcaaaagcacccatatctgccacccgtcgtgttaggataaaaagccacagttccatcaaactatccttagttgaatcaaaaaagtatttatcataagcaagagctaaggcaatagtcatacatttaacaagactgaatcatactttaacaagtttttctaatttattgaaatggaataatctggggttttagcctgttgcccagttggtaaactactacagtttctccatttttatcttctaaaattttttccctgataaaatatgtgaatctatatttattcattataattatagttattgtattgatctttttaggcttatcaatataagaggttatacagttaataacttaatgattattatattctattgttatttaaatactttgcgttattatttaataaatgttttttaggtggttttagaggtggaagaggaggtggaggtgggggcttcagaggaggaagaggtggtggtttcagagggagaggacattaagtgaaacagttgacagacatcaccagttgacttctgcattaacctgcatgatctgtttctactatggattggaaacttgtttcttgaacaagtcttgaagatcttggtcattttatgacaatggatctaaaatgtcagcatcatgcaaagtgcaacggaatagtgaattttgctctaaaagagcatgaacaagtctttctaatgttttgtacagtgcctggcactctgtgggtgctcaataaatggataggagttttcatttgaaggatatttgaatttttaaaataaagtgttttattcccttaa

SEQ ID NO: 104605 - DNA, 1280 bp, Homo sapiens
aggaggaagcccgcattaatcggaagagggcaagttggcctctctgttgtaaattagtggttaaggttatctattattgccacttttccagcgctaaaggctgttttggaaccagtgttgcttgttccgcgggtgattggcttttttttttggcaaaccagttattcaagtttctggtctttaaaaaactctgtggcggtacggtaaccgaggaggttccagcgcggcggaagtaccccgcgggtgggtgtgtgcgcaaggccagggccagaggggcacgtggcgccgggaggagagagaatgtcttttcgaggcggaggtcgtggaggctttaatcgaggtggtggaggtggcggcttcaaccgaggcggcagcagcaaccacttccgaggtggaggcggcggtggaggcggcggcaatttcagaggcggcggcaggggaggatttggacgagggggtggccgcggaggctttaacaaaggccaagaccaaggacctccagaacgtgtagtcttattaggagagttcctgcatccctgtgaagatgacatagtttgtaaatgtaccacagatgaaaataaggtgccttatttcaatgctcctgtttacttagaaaacaaagaacaaattggaaaagtggatgaaatatttggacaactcagagatttttatttttcagttaagttgtcagaaaacatgaaggcttcatcctttaaaaaactacagaagttttatatagacccatataagctgctgccactgcagaggtttttacctcgacctccaggtgagaaaggacctccaagaggtggtggcaggggaggccgaggaggaggaagaggaggaggtggcagaggtggtggcagaggcggtggttttagaggtggaagaggaggtggaggtgggggcttcagaggaggaagaggtggtggtttcagagggagaggacattaagtgaaacagttgacagacatcaccagttgacttctgcattaacctgcatgatctgtttctactatggattggaaacttgtttcttgaacaagtcttgaagatcttggtcattttatgacaatggatctaaaatgtcagcatcatgcaaagtgcaacggaatagtgaattttgctctaaaagagcatgaacaagtctttctaatgttttgtacagtgcctggcactctgtgggtgctcaataaatggataggagttttcatttgaaggatatttgaatttttaaaataaagtgttttattcccttaaaaaaaaaacaacaacccaga

SEQ ID NO: 104606 - DNA, 292 bp, Homo sapiens
tagatatttcaacctgcttaagtggagaaatagtagacttgaaccaattgaaaaaacccagaacgatacacaccaatttgctgagtcctgaaaagaatgcaattccaaatctattcatctaccgaaaccatgacccaaaccaatatcaccaccaaacctacccaccccaccaaacacacactctgagaagggagagaggatgcggaataaggaccaaaggattaaagaagaatgtcaaataattctgcatagtaaacctgaactaaagtaaaattatatcaatcctcctttt

SEQ ID NO: 104607 - DNA, 256 bp, Homo sapiens
cccacaggtaatagcaaagttttctccctgcctcgtctcccaccccaaatatttgatttccacatatactgcacaggggaattgaatttgatgtcgaaagccataagaaaaagagaaactttgctttttactgcttttactaggaaatagaaaacatttttagtgacaggctatgcttcatcatgaaaatacggttgggtgttttaggccttcacaaatttgatttcattgtacttagtgatggatgttagtaagc

SEQ ID NO: 104608 - DNA, 806 bp, Homo sapiens
cacatacaccagcacggtgctggctgtttcccatgtgcccactctccgtgtgctcaccaggctgcctgtgtggagggcatcaacaaggctggctcctctgccctccgacttctaggtggggaggaggtgctcccaggagactggagcataggagcacagtgaggctgggagggagcagagtgaagttttgtttttgccaattttcctccatgagtctctgctggctggccacgccccacaccgggaaggttgcagctcctgtcaggtagcctccctacctctctccccttcttgtcccgctgggattaggggcagtcagtgagtgggccatcacctccagctggttttccatacctttgtaatttgtcttttgaaaaagactcttcaattacccaacgccagtgcaacatctatttcctcctcagagcttgtcaagaatagcccaggattgtaagtacagttgctagatttagcaaataaaaacgcagcacgtccagttaaatgtgattttcaaataaacaataatgttttagttccaagcatgtcccaaatattgcacatgacaaatattgcatttagtacaagtatatcccatgcagtatttgggatatacactaaagtgttattcattgtttacctgaaactcaaatttaactgggagccgtgtattttatgtggcaatcctgtcttatcctctatttagagggcattaccaagctgatactttcaaaactgaatatttggcatgacagctggttcaactttctctctcccactagacagtgagtgactgaaagacaagggct

SEQ ID NO: 104609 - DNA, 3152 bp, Homo sapiens
gccgcgtttgaagtcgcgcggcctggggatcaggggaaggcgggcggcgggagccccggctgggggtgcgcggggatccccgattccgcgcccggggctggcgtgctccaggccggcgccgtggggccggcgcgcggggggcagggcgcagaggaggtgggggagtcggcaggaggaggggaggagcgccgggttcgccatccccaggcgccggctctgcggctgctgaatcggaagccgcagggaggatccggggaaataaagacgccggagaatgacctccagcgaggccgcctgagccggggcccgcgcacagccccgccagcccccggcatgggcgaccgcagcgggcagcaggagcgctcggtcccgcactctccaggggcccccgtgggcaccagcgccgccgctgtgaacgggctgctgcacaacggcttccatccgccgccagtccagccgccgcacgtctgcagccggggtccagtgggcggcagcgacgcggcgccccagcgcctcccgctcctgccggagctgcagccgcagccactgctccctcagcatgactccccggccaagaaatgccggctgcggaggaggatggactcggggagaaagaacaggccgccattcccatggtttggcatggacatcggtggaacgctggttaaattggtgtatttcgagccgaaggatattacagccgaagaggagcaagaggaagtggagaacctgaagagcatccggaagtatttgacttctaatactgcttatgggaaaactgggatccgagacgtccacctggaactgaaaaacctgaccatgtgtggacgcaaagggaacctgcacttcatccgctttcccagctgtgctatgcacaggttcattcagatgggcagcgagaagaacttctctagccttcacaccaccctctgtgccacaggaggcggggctttcaaattcgaagaggacttcagaatgattgctgacctgcagctgcataaactggatgaactggactgtctgattcagggcctgctttatgtcgactctgttggcttcaacggcaagccagaatgttactattttgaaaatcccacaaatcctgaattgtgtcaaaaaaagccgtactgccttgataacccataccctatgttgctggttaacatgggctcaggtgtcagcattctagccgtgtactccaaggacaactataaaagagttacagggaccagtcttggaggtggaacattcctaggcctatgttgcttgctgactggttgtgagacctttgaagaagctctggaaatggcagctaaaggcgacagcaccaatgttgataaactggtgaaggacatttacggaggagactatgaacgatttggccttcaaggatctgctgtagcatcaagctttggcaacatgatgagtaaagaaaagcgagattccatcagcaaggaagacctcgcccgggccacattggtcaccatcaccaacaacattggctccattgctcggatgtgtgcgttgaatgagaacatagacagagttgtgtttgttggaaattttctcagaatcaatatggtctccatgaagctgctggcatatgccatggatttttggtccaaaggacaactgaaagctctgtttttggaacatgagggttattttggagccgttggggcactgttggaactgttcaaaatgactgatgacaagtagagacgagcagtggaggaaacagcctcccaaaaggacagagaactaaaaaattgctgctggagaaggtgaaagtcgctttgggacggaagccaagccattatggcagatgaacctgctggatttgtaaataatttaaaatccttccagatgatcttttactcttaggttttgagctaatgattcaaaacgggggaatataaaaggttttttttctgtatactgtatttttttaaaaaaatggtgcagcgtggccaaacctaccaattgtatgcattaactttgaaaagttgtttgatgtttaagaaggacctgatatgtaagcgctggtcatttttcttctggggtttactgatcagtgtggtgattttaacttcatttagtaattactctaggagattttaccttgacttatatttttcatgacgtttcatgatttgctgttggtttcaaatgaaactacaaatctggcatgttttactgtgaacacttttgttatttgttttgtacccttttttgtcttgtttttctgttttagttgtcttctgaaaaaagagtcgttccctctgtttctgtcctcagatgatgtccctccccctacctgtaacctttctttgacataattgttcatatcaatgaaggtgctgaccagctcaatacaaagttaagcacaagatctaaagctcttgaaaatgcccgtgaagagaagactgaatgtgttaatgaatttaatgagtctggcaaaagttgcaaattatatgcaagtttgtcctatcgcttataaatgtagtgtttcattggatttattttatgctaggttatattaagttgaaatagtctgtgattaaatgtcctcatccatgcacagaatatgaatggcagcaaatctttgtgcaagaaatttgaaacttattgggaaaagcctcccagtagattaattgttcatatcaggagatttagggtaagtcatgggttgaggtgtcagatagtaatatctatttgttttgtacatgtatatatctaggaactttgtaacaacacatctttaataatgttaaaggttttttcatttttaatattttaaactaaaaactgtacttcaatctcagtttctaaaattaaaaataatttatactgatctatatattttttctttttgaaagatttcattaagactgatgggtaactttcaaatgagggtcatgtacaaatattgggatgcatgagatcccatgatcttgtgtattgagcttattgttgaaagggatttttgaaggacagaacaattactccatgatgaatcttcctttctctgccttctgagcaccgtctttaatttccatatcttcaagtcttgaagaagttgatgttaattgaagaattcacttgtctggttgaaataaagcctgtttctgttgtgatgtttttagtgtata

SEQ ID NO: 104610 - DNA, 2975 bp, Homo sapiens
gccgcgtttgaagtcgcgcggcctggggatcaggggaaggcgggcggcgggagccccggctgggggtgcgcggggatccccgattccgcgcccggggctggcgtgctccaggccggcgccgtggggccggcgcgcggggggcagggcgcagaggaggtgggggagtcggcaggaggaggggaggagcgccgggttcgccatccccaggcgccggctctgcggctgctgaatcggaagccgcagggaggatccggggaaataaagacgccggagaatgacctccagcgaggccgcctgagccggggcccgcgcacagccccgccagcccccggcatgggcgaccgcagcgggcagcaggagcgctcggtcccgcactctccaggggcccccgtgggcaccagcgccgccgctgtgaacgggctgctgcacaacggcttccatccgccgccagtccagccgccgcacgtctgcagccggggtccagtgggcggcagcgacgcggcgccccagcgcctcccgctcctgccggagctgcagccgcagccactgctccctcagcatgactccccggccaagaaatgccggctgcggaggaggatggactcggggagaaagaacaggccgccattcccatggtttggcatggacatcggtggaacgctggttaaattggtgtatttcgagccgaaggatattacagccgaagaggagcaagaggaagtggagaacctgaagagcatccggaagtatttgacttctaatactgcttatgggaaaactgggatccgagacgtccacctggaactgaaaaacctgaccatgtgtggacgcaaagggaacctgcacttcatccgctttcccagctgtgctatgcacaggttcattcagatgggcagcgagaagaacttctctagccttcacaccaccctctgtgccacaggaggcggggctttcaaattcgaagaggacttcagaatgattgctgacctgcagctgcataaactggatgaactggactgtctgattcagggcctgctttatgtcgactctgttggcttcaacggcaagccagaatgttactattttgaaaatcccacaaatcctgaattgtgtcaaaaaaagccgtactgccttgataacccataccctatgttgctggttaacatgggctcaggtgtcagcattctagccgtgtactccaaggacaactataaaagagttacagggaccagctttggcaacatgatgagtaaagaaaagcgagattccatcagcaaggaagacctcgcccgggccacattggtcaccatcaccaacaacattggctccattgctcggatgtgtgcgttgaatgagaacatagacagagttgtgtttgttggaaattttctcagaatcaatatggtctccatgaagctgctggcatatgccatggatttttggtccaaaggacaactgaaagctctgtttttggaacatgagggttattttggagccgttggggcactgttggaactgttcaaaatgactgatgacaagtagagacgagcagtggaggaaacagcctcccaaaaggacagagaactaaaaaattgctgctggagaaggtgaaagtcgctttgggacggaagccaagccattatggcagatgaacctgctggatttgtaaataatttaaaatccttccagatgatcttttactcttaggttttgagctaatgattcaaaacgggggaatataaaaggttttttttctgtatactgtatttttttaaaaaaatggtgcagcgtggccaaacctaccaattgtatgcattaactttgaaaagttgtttgatgtttaagaaggacctgatatgtaagcgctggtcatttttcttctggggtttactgatcagtgtggtgattttaacttcatttagtaattactctaggagattttaccttgacttatatttttcatgacgtttcatgatttgctgttggtttcaaatgaaactacaaatctggcatgttttactgtgaacacttttgttatttgttttgtacccttttttgtcttgtttttctgttttagttgtcttctgaaaaaagagtcgttccctctgtttctgtcctcagatgatgtccctccccctacctgtaacctttctttgacataattgttcatatcaatgaaggtgctgaccagctcaatacaaagttaagcacaagatctaaagctcttgaaaatgcccgtgaagagaagactgaatgtgttaatgaatttaatgagtctggcaaaagttgcaaattatatgcaagtttgtcctatcgcttataaatgtagtgtttcattggatttattttatgctaggttatattaagttgaaatagtctgtgattaaatgtcctcatccatgcacagaatatgaatggcagcaaatctttgtgcaagaaatttgaaacttattgggaaaagcctcccagtagattaattgttcatatcaggagatttagggtaagtcatgggttgaggtgtcagatagtaatatctatttgttttgtacatgtatatatctaggaactttgtaacaacacatctttaataatgttaaaggttttttcatttttaatattttaaactaaaaactgtacttcaatctcagtttctaaaattaaaaataatttatactgatctatatattttttctttttgaaagatttcattaagactgatgggtaactttcaaatgagggtcatgtacaaatattgggatgcatgagatcccatgatcttgtgtattgagcttattgttgaaagggatttttgaaggacagaacaattactccatgatgaatcttcctttctctgccttctgagcaccgtctttaatttccatatcttcaagtcttgaagaagttgatgttaattgaagaattcacttgtctggttgaaataaagcctgtttctgttgtgatgtttttagtgtata

SEQ ID NO: 104611 - DNA, 2289 bp, Homo sapiens
gccgcgtttgaagtcgcgcggcctggggatcaggggaaggcgggcggcgggagccccggctgggggtgcgcggggatccccgattccgcgcccggggctggcgtgctccaggccggcgccgtggggccggcgcgcggggggcagggcgcagaggaggtgggggagtcggcaggaggaggggaggagcgccgggttcgccatccccaggcgccggctctgcggctgctgaatcggaagccgcagggaggatccggggaaataaagacgccggagaatgacctccagcgaggccgcctgagccggggcccgcgcacagccccgccagcccccggcatgggcgaccgcagcgggcagcaggagcgctcggtcccgcactctccaggggcccccgtgggcaccagcgccgccgctgtgaacgggctgctgcacaacggcttccatccgccgccagtccagccgccgcacgtctgcagccggggtccagtgggcggcagcgacgcggcgccccagcgcctcccgctcctgccggagctgcagccgcagccactgctccctcagcatgactccccggccaagaaatgccggctgcggaggaggatggactcggggagaaagaacaggccgccattcccatggtttggcatggacatcggtggaacgctggttaaattggtgtatttcgagccgaaggatattacagccgaagaggagcaagaggaagtggagaacctgaagagcatccggaagtatttgacttctaatactgcttatgggaaaactgggatccgagacgtccacctggaactgaaaaacctgaccatgtgtggacgcaaagggaacctgcacttcatccgctttcccagctgtgctatgcacaggttcattcagatgggcagcgagaagaacttctctagccttcacaccaccctctgtgccacaggaggcggggctttcaaattcgaagaggacttcagaatgattgctgacctgcagctgcataaactggatgaactggactgtctgattcagggcctgctttatgtcgactctgttggcttcaacggcaagccagaatgttactattttgaaaatcccacaaatcctgaattgtgtcaaaaaaagccgtactgccttgataacccataccctatgttgctggttaacatgggctcaggtgtcagcattctagccgtgtactccaaggacaactataaaagagttacagggaccagtcttggaggtggaacattcctaggcctatgttgcttgctgactggttgtgagacctttgaagaagctctggaaatggcagctaaaggcgacagcaccaatgttgataaactggtgaaggacatttacggaggagactatgaacgatttggccttcaaggatctgctgtagcatcaagctttggcaacatgatgagtaaagaaaagcgagattccatcagcaaggaagacctcgcccgggccacattggtcaccatcaccaacaacattggctccattgctcggatgtgtgcgttgaatgagaacatagacagagttgtgtttgttggaaattttctcagaatcaatatggtctccatgaagctgctggcatatgccatggatttttggtccaaaggacaactgaaagctctgtttttggaacatgagggttattttggagccgttggggcactgttggaactgttcaaaatgactgatgacaagtagagacgagcagtggaggaaacagcctcccaaaaggacagagaactaaaaaattgctgctggagaaggtgaaagtcgctttgggacggaagccaagccattatggcagatgaacctgctggatttgtaaataatttaaaatccttccagatgatcttttactcttaggttttgagctaatgattcaaaacgggggaatataaaaggttttttttctgtatactgtatttttttaaaaaaatggtgcagcgtggccaaacctaccaattgtatgcattaactttgaaaagttgtttgatgtttaagaaggacctgatatgtaagcgctggtcatttttcttctggggtttactgatcagtgtggtgattttaacttcatttagtaattactctaggagattttaccttgacttatatttttcatgacgtttcatgatttgctgttggtttcaaatgaaactacaaatctggcatgttttactgtgaacacttttgttatttgttttgtacccttttctgcatgcttcccttcagtctgtaatgaaagactgttgttgtcatcagacaatgtat

SEQ ID NO: 104612 - DNA, 1329 bp, Homo sapiens
gccgcgtttgaagtcgcgcggcctggggatcaggggaaggcgggcggcgggagccccggctgggggtgcgcggggatccccgattccgcgcccggggctggcgtgctccaggccggcgccgtggggccggcgcgcggggggcagggcgcagaggaggtgggggagtcggcaggaggaggggaggagcgccgggttcgccatccccaggcgccggctctgcggctgctgaatcggaagccgcagggaggatccggggaaataaagacgccggagaatgacctccagcgaggccgcctgagccggggcccgcgcacagccccgccagcccccggcatgggcgaccgcagcgggcagcaggagcgctcggtcccgcactctccaggggcccccgtgggcaccagcgccgccgctgtgaacgggctgctgcacaacggcttccatccgccgccagtccagccgccgcacgtctgcagccggggtccagtgggcggcagcgacgcggcgccccagcgcctcccgctcctgccggagctgcagccgcagccactgctccctcagcatgactccccggccaagaaatgccggctgcggaggaggatggactcggggagaaagaacaggccgccattcccatggtttggcatggacatcggtggaacgctggttaaattggtgtatttcgagccgaaggatattacagccgaagaggagcaagaggaagtggagaacctgaagagcatccggaagtatttgacttctaatactgcttatgggaaaactgggatccgagacgtccacctggaactgaaaaacctgaccatgtgtggacgcaaagggaacctgcacttcatccgctttcccagctgtgctatgcacaggttcattcagatgggcagcgagaagaacttctctagccttcacaccaccctctgtgccacaggaggcggggctttcaaattcgaagaggacttcagaatgattgctgacctgcagctgcataaactggatgaactggactgtctgattcagggcctgctttatgtcgactctgttggcttcaacggcaagccagaatgttactattttgaaaatcccacaaatcctgaattgtgtcaaaaaaagccgtactgccttgataacccataccctatgttgctggttaacatgggctcaggtgtcagcattctagccgtgtactccaaggacaactataaaagagttacagggaccaggtaaacatgtttctgcttgtgcttgaacccagacctctttcttgatgaccagtttatagtaaaaggttatttatattgaatacatttttaaaagaaa

SEQ ID NO: 104613 - DNA, 179 bp, Homo sapiens
gtcagcagctacaagtaacacttcattaccaatatattctgcaaaactgtcattgctaaatttcccttctgcaaaaacatcatttcctcagcatgcctgctagattggccatttctattttaaacaacatttaaagacatttaccacaagtttctctttagcaacttgtattaactctg

SEQ ID NO: 104614 - DNA, 618 bp, Homo sapiens
tatggagaattgctccctcttcaagaaacgcctccatcctgatgtatatcagctttcatatccccatggatattttacaggcattgctacctctttaaacatttatgctattaaaaaaatcagaccaattgttgacataaagctaacatagcagcttctatatagacagaatatgaattttttatgctgttgatgagaagtttatgtcatttatatactatagtagggtagaagatggatttggaatcctgaaaaagctactgtttgtaccattcagaatattagcttgtgctttgaatcgaaatattaagatacctgtattgtcaatgtgagtgtttctgtgcaaagtggcttacatatgggtggaatgggagaaattgctctacctggagaaaatagcaatagttttctttcgtttatgttttgttttgtgaaaggaagggttaatagcatttaatacctgatttatctgtgcttctctgcaccattaaaagaatgaactgttgtggtaataaaaccatatttcattgaattaaaagtgccatcacttgcaagatgcaacattattttatgtacctctaaaaaactacactaacaaactgacatgtcaaactgaca

SEQ ID NO: 104615 - DNA, 461 bp, Homo sapiens
tgctatctctttcttgccaagacactaacatatataacaatatgttatgcaacatattgttatagtatatatattagttaaacatatagtgaataatataacaatatactgtgtccataaacaatattttagttctgtcaggtttttatctttaagtgaaggaacacagtatatttttctttttcttggcctttgtcaatatttgtgagattcacccatattgaagcatgtagttattgttcatttttactgccatatggtattgcattggatgaacatatacaaatttacaagtttgtttagtggtggggatggatatttgggttggttattttgaacacatggcacaaaacattcttgtacgtatcttttggtaaagacatagatatacatatacataatatacacctacatatacatatacagagtctctagggtaccaacctgggagtaaaattgct

SEQ ID NO: 104616 - DNA, 409 bp, Homo sapiens
ggcatgtggaggctgagatggaggatatcaccaagcccaagaggtcaaagatgcagtgagccataatcgtgctgttgcactcaaggttgtgcaacagagtgagaccctgtctcaaaaacatacaacagttggtattaagcaattacttacagatctgtgttgaggtagattaatatggcaccaatttgggtagactggaagccatttttctgttgactagaagatcagtttcttggaatagtgcaggcagaggtataataaaggtcttctgctttgtattttcaaccatgtaaatgatctgaattttaaaaaaaattttttaaaaagcttttagattgggaaagggcataagggaacagataagattacataacaagatttgggaaacaggatatgaagagacaaatta

SEQ ID NO: 104617 - DNA, 228 bp, Homo sapiens
tgcttctgctggccctccatgggctgcacccactgtctaaccagtcccaatgagatgaaccgggtacctcagttggaaatgcagaaatcacctgccttctgccttggtctcactgggagctgcagaccggagctgttcctgttctgccatcttgcctgggaatccaaaaacctattacttcttcctaagagctaggccggcacttctggtggctgcctctgtgtgtaa

SEQ ID NO: 104618 - DNA, 262 bp, Homo sapiens
caagggatcctaatcctggtgaaatatacaatcccctcagtacagggaaggcagaagaataattctcttgcttttactgactttgggtctaggagagcgcctttaacttacacctggaattattgaggaataaattgaacaggagataacatttatagagcactgactgcataccagctcctgggctctgtgccttaatgtctgtcatccctacataattacaaggaaggaattgtcctcgttattcaaatgaggcttagag

SEQ ID NO: 104619 - DNA, 316 bp, Homo sapiens
aggtgcaagcccaaataaccacttttctttataaattatccagggtcaggaacttcttcatagcaacgcaaaaacagatgaacacaaccatcaatcaactgtatataatagatatctatagactactttatgcaaaaatagcacaatacacattcttttcaggttcacatggaacactcagtaagacagaccatattctaggccataaaatacacatttctaaatttaaaagaatagaaattatgcaatgtctatccttagactacaatggaattaagttagaaattaataacagaatgaaatgagaaaattccca

SEQ ID NO: 104620 - DNA, 314 bp, Homo sapiens
gccaattggaataatcattttgtactggaaaaaagaaacacaggctttggagtcaaacagaattagtttcaaataccagccttgcccctcagtagtggggtgactcaggcaagttactaacttctctaaatctcagttttttcacctctaaccaaggataatgcattccttacacacttcttgagaagataatttgatgtaaagcacccaggacaatgtttggtgtatagcagttacttcaatttttgaaaggtggcatacaaacataattatagcaggctttggcaggaagaggtataaaatattatcttaag

SEQ ID NO: 104621 - DNA, 401 bp, Homo sapiens
aggcgctgtgttttggagagaggcaatgttagagttctgatggcatccagccagatgcctccaaatgccaattaaaacaagcaccccatctggacgtgtatattttaatacatagccacgggccgttctctcgcttctggaggagctgcacccaacgctcctcgcgctcagtatctttccatgagcacgcccccttcctagggctctgtggcttcccacatgctaagacccttgttttggaaccaagttcttctaatttagttcagagaaaacctaggttggtgtagcaaaggaaccccagtttggccaatgtaaaaaggtccattgctccagataaacggggctggagtccagagggggcacaactgttacgaggtttagacgcacagagtcccatactt

SEQ ID NO: 104622 - DNA, 375 bp, Homo sapiens
cttcattttatcagccacatcctgttgttcatcaaaccttttagaacttctgtcaattcggaattttttttctacttcccactttcattgtattcctacttgttactgtttagtttgggccttcatcagttcaaatcaattatttgcaacagttttccttctttcttggctgcttttaattagatcttccttgttccagtctacactaccaccagagcatagcttcttaatctttttagggcagtagtccagaatccctcttttgtttattgccttaagtctgaacccattgatctttctgtgtcttccattagttggtttaattttgtttacttggttttcttttttgaactccttttctatcagcccgtacca

SEQ ID NO: 104623 - DNA, 412 bp, Homo sapiens
gtcctcaagtgattctctcacctcagcctcctgagtatagatattaaaatataagtgttaatattatgttaatgataattttaccagaattaaaaatacattatatatttgaatctcaggtattcactcccctagtggaattataatcatgaactcatggaaataatggactaagaagcaactagaaaagtccagaaaagattggttaaatcttagttgagccttcttctacttctgatgaggccatgagcaagtcactgagcatatctgggcttaatttcttcatctttaaaatattctttcataaagttgttcaaaggattaatgaagtaaatggtaaatggtaaagtaaatgaagtaatttacttcatgaagtgataaagtaaatggtaaatatattacaaaatatttt

SEQ ID NO: 104624 - DNA, 316 bp, Homo sapiens
aatctcacaccatcccgctcagtcctgctcaagaggtgaatcatctctttgtccatatccgtatccatatccatgttctagacacaacctgcctgttagtcacacagtaaccatctcagttatcagatagaaaaaacacagtacatattacattagggtttggtactatccacggtttcaggcatccactggggaacttgggatgtatcccctgcacgagagggggaattactgtattactatttttgtgccagtttctgaatcccaattcctacagcatgacgtgaagagggttgtattattataggaaaagaac

SEQ ID NO: 104625 - DNA, 375 bp, Homo sapiens
tctggctcctgtgatgtactctgcagagaggccagtggggcgtttattatattttccggggacggccctctcccctgtccctatgcctattttcagggctttggcgtttgtagagggactattttaatccatgtgggaaatgggttcctaaatatggacttagtggggcagaagccttgagaggctccagctcagggcagctccacctgctcctctacctcagcaaagcacaggatgcaggcccaggctggaaggctctccagcccctccttggccatctaccgccctccttctttccctctggctcctcctatctccctccagtcctgggcccatcctcccatcctttgtttgctcggaagcccagtgtttcct

SEQ ID NO: 104626 - DNA, 852 bp, Homo sapiens
gattacgtgaaataggccgggtatggtgcctagtgaagagctcaagaagtgtgagacattattactatcgtgggcagggaatttggacacctgtggtgtaagctgccccaagagattgggtttctgtaagggcgtttcatattaggctgggccctattctagagatgaggatatcttcctataggccagctccgcccctgtcactccagaatcgctctctgcctgcagtatgccacaagagcagacttgcccagggacccagggtggtcactgacaccccattcccaccaaatacacacactctcccctggtgtcctccttagccccttgctgggtctcttctgctagcaggagctgctggatttgccatcaggactggctttccctgtgacccctttgtgggtggggccttgcctggtaatcggagatccagattcagctctgttactgacttatggatatcttaggcaagtcactttcctgttttgggcctcagaactgtacattgacttttccatctagaagactagtctgaggccagtttccaatccaattctctgactctaggtaatgtggaggagagatgaacagtatgtttggggggcggaggatggagcaaggacctgttggtggaagctctagggagacagaaggtcatatgtgggatgggagtgggggtgatttgagctataaatcagcggttgcatcagattcttgtgccctggcataggtatttatttaaatttacataagcttaattgtagtaaattacttactagaattaaggtaattctagtgtgcagtcagtattgaaaactgctgccctagatggtctcataggtcccctaagtc

SEQ ID NO: 104627 - DNA, 299 bp, Homo sapiens
gaaaaggggaagccaattattctttgtcatcaggggaaaggaaagagtaaagaaaggaaactggaaaatatgggtagggatttattaggggccattttgaggacagagctcccaacatcatttgatccaacattcggttgtgtatcattcaatcccaatattcatggagtgcgctggagccatgagcagtgaatgaagaactctggtcaatgtaggtgacacgttgtgcccgccaccccccatttagcagttatcctcccctgttagcttgatttttcaggaggtctggagaggtggtt

SEQ ID NO: 104628 - DNA, 256 bp, Homo sapiens
tttgtgtcatacttaggaagtctttaaaaggagtgttttggacttgtcgagtttgctggacagccagatagaaatgccctttggttgttagaaatatggggctgatattcagataagaattcaggcttggccggatgtggtgactcagtcctgtaatcccagcattttgggaggctgaggtgggcagatcacctgaggtcgggagtttgagaccagcctgggcaacatggtgaaaccctgtctctactaaaaatac

SEQ ID NO: 104629 - DNA, 359 bp, Homo sapiens
tgcattattatagtaataccaaacaataattaatcgatagcaaagtaaatggtttataggaaaagacagcaaatactgtgaagtagttattcccatttttggattaagaaattgatgcttttgaagtcaggagcactctgaaaaagaaggaaggactagcttcttcataaaagagcaaaacatatcataaggttggagtaattaactatgaacataaatgaatagactaacagatcgattgaacagaacagagtctaaaagtagacccaaatacatagctgagtaaataatcacagtaatattaagtattagtgagcaatagaaaactaattcagtaaatggtattgtgacaactgggg

SEQ ID NO: 104630 - DNA, 446 bp, Homo sapiens
cgagccaccgcgcctggctgacaaccttaatgacaacacacatacaaaaaggaaagcattttaaggatgcactgaaatagaatttcgaacaaaaagatttaactccatactgacaggatgcttaggaaacaaacctggacatcagcaggaaacaaactggcgataaaacagacacccattttgagatgaacacacccttaagatacacacattactgtcagccacacatttaaatagaagctgcacccaagaaaattttcacacgcagagtggaaagaaatttaaaactatactagttttctccaccataaaataagtgtatttcctaacaaacaaaaatatgtgggagaggttacctcattttttttttaattttttttttctgagacggagtttcactattgttgcccaagctggagtgcagtggcgccatctcggctaactgc

SEQ ID NO: 104631 - DNA, 429 bp, Homo sapiens
aatccatcctctcatctccatcccactaaaactctgcctaccatgatcgacacaataaaatctgagtccaggcccctgttttttcgctcctcttctaatgcagcagcctcttaactgatcttcctgccttcattcaagactccttaaacccactctccacatggattccagagtgaacaatcaaaaatgcctgccttacatatcatttggggtcaggaattcaagaccagcctggccaacatggtgaaaccccatctctactaaaaatacaaaagtcagccgggcatggtggcatgcaccggtagtcccagctacttgggaggctgaagcaggagaattgcttgcttgaacctgggaggcagaggttgcagtgagccaagatcacgccactgcactccagcctgggtgacagagcaagactccgtctca

SEQ ID NO: 104632 - DNA, 381 bp, Homo sapiens
agttcttcaggaccaagcaggataatttctcagacctctagatcctttgtaagggcttaactgattatgtcaggcccacctaggatactttcccttttgattcattcagtgtcaactaatcaggaaccataattatagctgctaaatctctttgctgtgtaaggagaatttccatcctaatcgtgggtcctgtccacactcaagggggcagggattatgatagagcataggccattgggatcatcttagaattttgcctaccatacctgtttattttctcactgtgtttctctcagggtcaggaggtgggggcaaagatcctctttgctctgcatagctgctttcagactattattttccgtcctctcatgaaaaataaca

SEQ ID NO: 104633 - DNA, 383 bp, Homo sapiens
  misc_feature (63)..(63): n is a, c, g, or t
  misc_feature (249)..(249): n is a, c, g, or t
  misc_feature (262)..(262): n is a, c, g, or t
gcctagtagctgccccaataattagtttccttcccattttccattttatggaatctaatcctngtcttcccaactgtaatgaatttaaggcagagctaatcctttaagaatcctttggccgggcacggtggctcatgcctgtaatcccagcactttgggaggacgaggtgggcaaatcaccaggtcaagagatagagaccatcctggctaacacggtgaaaccccatctctactaaaaatacaaaaaanttagctgggcgtnggtggcgggcacctgtagtcccagctactcaggaggctgaggcaggggaatggcgtgaacccaggaggtggagcttgcagtgagccgagatcgcaccactgcactccagcctggacgacag

SEQ ID NO: 104634 - DNA, 136 bp, Homo sapiens
gctttggtttcccggtctgtaaaatgggctcccacctgcctcactgcattgcctggacagtcagatgaaacccaacaacctcatccagcgaagggactccacaccttcaggaagatgtaactggtccccagagcag

SEQ ID NO: 104635 - DNA, 266 bp, Homo sapiens
gcctgggcgacagagcgagactccgtctcaaaaaaaaaaaaaaagaaagtgttcagtaagtggattttgtaaactgatgtgttcagccctaaaaagcagaatactgatgatcttgattattcagggtcccactggtctagatttatatttttaagaataactaggctgggcacagtggctcacacctataatcccagcactttgggaggtcgaggagagtagatcacctgagaccaggagtccaagaccaccctggccaacatggc

SEQ ID NO: 104636 - DNA, 280 bp, Homo sapiens
ggtatttctcggcccgccctgatagccaaacacaacggatagaaactctggtggtctcttgaaagtgccattgcctggctggaagccaaccaactcagatcattacagcaactcatgacagaataaccctgatcccaggaaggataagataatacctaattctacttcctgcaacgtcctggctaaccagaggtcctgagtgtgtccagaggacaactgtactgctggcataaccagcattggagatagccagtacaataaacatatctacaaccaagga

SEQ ID NO: 104637 - DNA, 135 bp, Homo sapiens
gccgtatgctcccaggccaaggtgtggacgggcctgggaactgcctgcgaaagttacccacgaaagtacaagatcaccttcacccagcaggatacagccctccccgcatctgaagttacccaaataaaagcctcg

SEQ ID NO: 104638 - DNA, 627 bp, Homo sapiens
aacaatatcaggactttgtgaagctgggttttccatggttgccgtgataaaatgcacgcactgcacaaaaatgagtgtggaacaggaaatgacactgacagtgtccactgattccaaggtttgagaagttctatagtgctcaacaggtgcacacatgctattaaatatttgtgattagttaagaatgaaataggaatatgagtttttctttcagtgtctgtgtatttttttaagtcacttttaagctgttaggacatagatacttattaggttgtttagacctaatgactttaaaaattgaactgttaagcatttcttttagcttgggagacactgaaaaatttacaggaacactaaaggtgctaagaatctctgacctacaccttggcttcgcagtattgaccccatggctttcaccattaccaaaacacagggagttgtggacatccaagaccaagacagtataaatgtgcccttgaatgaatcatacttcattttgttaatttgtgtggatcactaaaattagaaagatattcctttcacatgaaagttacatttgagaatagcttcatatattttattttaatacattgactaaaacctactttgtttttcttttcttttctt

SEQ ID NO: 104639 - DNA, 688 bp, Homo sapiens
gatggctatatcctactgtgtaaagggaagaaaggactaacataaaccactctgtcgcccaggctggagtgcagtggcgtgatctcagctcactgcaacctctgctgcccggagtcaagcgattctcctacctcagtctcccgagtaaccagtaattcagggtgaaacatctcacagtggaagaggagcattctgtgttgagaatttccattgacgaagccaactgagtggcctgattcccttggaccagcaatctagagctagggaagatgttgccccaaggaagaggcacagcagacacttggctctcctcttgggtttctgctttctctgagaaaacagaagtttgaggcctctagaagcactgcattccctccaaagggaggttgtagatacattaattaatatgattttaattcaaaacttcctgaggcagataattctaaatgattatcccaaaaatatttccaacacccttctttttaccacccactggcccccaaatcctcaattttccagtctcccttgagctaagtgtggccctatgactcacttccagccatgaaaacaagtgcaaatctgttaggagtatgttctggggcaatttttgctctcctgatgaagacaaaggctgttgatccactgaacccacccaggtaatcacttattttgttcttgttctaagaga

SEQ ID NO: 104640 - DNA, 361 bp, Homo sapiens
  misc_feature (361)..(361): n is a, c, g, or t
ctgtcacccaggctggaatgcagcgatcatggctccctgcagccttgacctcccgggctcgggtggtcttttcatgtcagcccccgcagagccaggaccataggcacacaccaccatgactggctaatgttttaaatttttgtgtagagagagggtctccctatgttatccaggctggtctcaaacccctggctcaagcgatcctcccgccttggcctcccgaagtgttgggattacaggcatgagccaccaagcccggccaaattttttttttccaacatctgttttgtgggaccagccagaattttcaacctccgctgcctcatgacttccaagtcacatggtctaaaaggagctaagn

SEQ ID NO: 104641 - DNA, 320 bp, Homo sapiens
tggagtttgaaggatgtgctatggaaacttgggagacagtttgaagaaaaccaattagcccctcaacaagtattaacaggttggcaaggagctgtgtttgaatcttggctctgctactggcttgctgtatgaacttggcaaggattctctgtgaacttgtttccttatatataaatgaagatagaggtgcctcctctactaacctcagtggtgattgagaagtttcagtaacgttggtaataaatgttaaattctaaagtactacataaatataaagcattaagcaagtgtgcttctaagagtcaagccaattagaaaaa

SEQ ID NO: 104642 - DNA, 343 bp, Homo sapiens
atttaaaagcaaaatttccctcaccctccctgtcattcattcccttaaaggcaaattttaacagagcattcaataaagataagtaaatactaaagtggttttttaaaatatataatcacaaaaatttttaaaggctactcaagtgaagcagtgggagtggagaaagatatgatcacacaattttatatgacaaagatttcttattggtaaacaattttgttctcgttaacaaggaatgtttattctagatttaaaacctaacgtggccaagtgtggtggttcatgcctgtaatcccagccggccagtaaaatgtttaatctggacatcagtaaggatcagttt

SEQ ID NO: 104643 - DNA, 803 bp, Homo sapiens
agcatcgcacttgttgcccaggcttgagtacacaggtgcaatcatggctcactgcaaccttgacttccctgggctcaagcaatcctcccatctcagcctcccaagtagctgggactacaggcacatgccaccactcctggctaatatttttttgtattttgtagaggcaggttttcaccatggtgcccaggctcgtcttaatctcctgggctcgattgatcctcccacctcagcctcccagagtattgagtataggcatgagccactgcacctggcctagtatcagtttttaaaagtagacctgtttatctgcagtgcagggaaggagagcgtatgtcttaggaaaataccaaaaactaaagaaatgtgaatttttataaaatgatatatgttagttctgttctttgctttttattgttttagtcttgactcgttattgattgtggaaattttttttctagtaattcactacagtattactttttgtaagagattgcccgataataattctgaaggatgatgttcacataaaacagttacctaaagatacagtcataacattgatattccacattcataaccctttgaggatgagaacaatacagcttaattggtgcttttatacattttatatagtgtgcttttatatgtttatttttcatgtgttccttaagatatagagactcctttggaatttggatgctagttgctttgttagaacagtgttttcaaattaatgcctcattgggtgacattggggaaaaaattactgattcttgcctttttgccttgctccagatctt

SEQ ID NO: 104644 - DNA, 312 bp, Homo sapiens
ggaaaacatgttttagtgcagagaaaacagaactttcactcacttagttgccatttcattcaacaggcatccatggaagacctttctgtagggctcccagctatacacagacccttccccagatgttgacaattctgaaatgttctgccaccaatattagctttgtgaccctgacgaagttacctaatgtctttgatcttgatttaccttattaagcaaaggagttgtgcagcttatttcacagagagtatgggcattgatgagacaatgcatgtgaaagtagcattgtatgcctgaaatgcacagtgaggt

SEQ ID NO: 104645 - DNA, 975 bp, Homo sapiens
agggggaagagagcggaagcggggcggtgctacacactcttaaacaaccagatctagcaagaactcacccactatcatgagaacagcaaggggaaaattcactcccatgatccagtcatctctcaccaggcccctcctccaacattgggaattacagtttgacatgagatttgggcagggacacaaatccaaaccatatcagtatataaatagttttggtttggtccttgctgggaccaaactgggctgaggtgtggactgatgagcagggcagaaatcagcttgtgacaaggtagacagcaaggagcctggtgggtgaggccacctgaaacacagcacatgcctgcagaacaaacccctcaatgatcctagggcagaagccacctgtctgggagcttcttttctacttcttgcctaggtgggaagtgatctgacattctgagcctttggaggttgcagaaatgactagagtgatgaggatgatatataacatgctctaccacgtatcaaacacctactatgtctaagaagtgctctaatgtaatggatcaccacaacaactttgtagggcttatcaattcaggacgttatgaacatgaacatcattactatcaataattattctgggaagaaggtataaactgacccgggcaaactaggatgcgtaattatcccacttaggaggtgcttacactattcccattttatagatgaggaaactaagaaaataaatagccattgtggatgcttttctgtttcatgccatgatgttggaatgtcatgtttagacacatctcttcattgtttcttccaagaaatcagattagctggtagcaactatattaaaccaaatttcagtatgaaaatgtctccattttgccttcctcctcctgctcagaatgatatgtgggggaagtcatgggcataacgttctgtaatagaagtagaatttcttaaacttgcttctaactaaca

SEQ ID NO: 104646 - DNA, 311 bp, Homo sapiens
ctcaaatataaacagtgcaagcgttggaggaagggcacacaaggagaggaaactatctgcatggggaaaatgtcatgattttattcactgcattaattattagtttaacctcagcttgctaaaaggtagcacattcctaacagaagaaatgagctttccatttgaagatcgagaaaggcagcctgtgttttttctctgtaccgtacattcatccgcttagtgactatctactgggcacctgcctggttctagtcacccagctcctgcaaggcggcagtaagcgagacagcctccctcctccactaaaatga

SEQ ID NO: 104647 - DNA, 332 bp, Homo sapiens
ctttcataaagtgatgtgacttcttaatatttaatcttctctgcgacttcttgattactgtaatttctttgcatctctatcctctttttcttctgattcttttcacatttgttctctcgccgacttcatgtaaatcagggctcttggctgaccttccatggctacaaagtctgagttgctcaagggacttgggcttacttaagaaactattttctgccaactgttagtctccctgcctgccatgccatctcctcctccccccaccttttcaccacacaccaagtcactcttcaggtgtcagcttaatttacttcctgaaaaaggtctgaatc

SEQ ID NO: 104648 - DNA, 665 bp, Homo sapiens
tgcagaagaggcatagaagccttagtttatttaagctgaatcactcctctgtgtttctgttggttacaagtttgctctgccccatcaaagagggccaagatgtcttgtgactacagcggacagtgaaatatgactgccatttaaaagcctcaaacttgatcacccgcctaattttcagtggagccctggtgactgtgtaatatgcaagacacctctgcagctggttcattaaatttggatgattggcattgagttggatgagaataaatccagccattgtgtcagatattaattgtaaatcagaacaagctatttataagtcccaagaagtttgataaagctaatttttccagggtttgtgtttgatgtcaactctttaaaaaatatgcttcaaagtggttttgtgtacatgtatgtcattatttttaaaaattttgagcagaatgttttcttgccctactggaaaataacaggcctcattttgaagtttggctgtaagggactgttgcctagattttcccaggaactacttccagcaccttgcaggaaccttttgtttcaaaactactgttgctgatgtttaaaggccattcctttccctttttctttcttttttcttttctctttctttttgagagagggtattgctctgtcacctaggctgg

SEQ ID NO: 104649 - DNA, 354 bp, Homo sapiens
tgctagctgtggggttgaattgttcttgtttctctaattattttcattgtgatactaggttgttaatttgagatctttctaactttttgatgtggacatttattgctatgaatttccctattaacactatctgagctgtggccgggcgcagtggctcacgcctgtaatctcagcactttgggaggccgagatgggcggatcacgaggtcaggagatcgagataacagtattagcactgaataaaatatttttaaaagtacaatttgtgagatttccattttctttcatagtccctactggaaactcaaactgagcacaacagcttcaatgggaactaataatgatgggaaaggc

SEQ ID NO: 104650 - DNA, 232 bp, Homo sapiens
cgggagcctgaagtggcagggctgcttaagcacccgggcctgcctgactccatgctgtggggctggaggcggcacactgggcaagcttctttaggaccagtagctcccctctgctgtcttattctagtgcctgtaagataaccattcaagtgctttattaagcatcctgtccctccattttctcacttgtaaaatgaggatgataataacaacaaacatatccttaatggtg

SEQ ID NO: 104651 - DNA, 163 bp, Homo sapiens
ggtgattcgaggacttatggagaccaggctgagaatattcgcagtgcacgcacatttttctttactagaatttatattccagattcttgtctggtcacccaccctagacagagctcttgggatcctcagggccttttttacttaaaatacagactgtagtaag

SEQ ID NO: 104652 - DNA, 650 bp, Homo sapiens
ggggagatgggggtaaaataaaggaacagctaagaagtggttctgcagaatgtgtacttatatccgaaagcctggatggaaaggacggtggctttggaaggggtgtaaaatgggagggggtggcaatcgctgaagcatgacaagcctccgaaggcctctgggacttgaacacaaaaaagggagctttttgcagctctttcacatgcacacgtctccctctgccccatccatcctcccctgctgttttgtaaatctcccagttggaaatttttaacatgggagagcttcttcctgtgcttcagttggcagaatgctcacacgcagctgcaaagaatttgcttttccttttcacagcatctctcatttaaaagcattagtgagactacagaacaaaataaaaacttcaggatttttcagaagtggaagccaagtttaattaaagtcaaggaagttcggggctctaactcttttgttaaacctcttaaagtcaggcgtgtgcgtgtgcccatggcaggcaaggtaggaaatgccagtgcctgtttctcgttaggaaatttaaaggcctacttgtctggtgtgtgcttggggaatgtcctagaatttatcaaaagatgtgctgaaccatcatgtctttggtggcctcaaaatgc

SEQ ID NO: 104653 - DNA, 274 bp, Homo sapiens
gtaataaaatattagataatacttctatatttaataaacagtcaatatttgatgtataatgtttaaaaaaatgaaaatcactacaaaatcataatttttaagtatccatcaagaaagaatgctcctttaagattaaaaataaataaatacagcaacagcactaattactaagactaaaacaagtaatctaccctccatagtgaaaagtatttaacttaaatgacaactttggaaacacccaaaatactattataggcctttgtttctaaaaaag

SEQ ID NO: 104654 - DNA, 406 bp, Homo sapiens
tcgatctcctgacctcgtgatcctcccgcctcggcctcccaaagtgctgggattacaagcgtgagccactgcgcccagccccagctttagttctaaaggaaaagatgggccttttgcttaaggagattcacattgattggtcaaagctctcattgacgtatgctgagcaatgtgtcggcagagaaaaccatggcaagcgtgttattatgctctttatagtctagttggatttttagacatatgaattggtctataaaatagacaacaatctcaggtgggaaccttagtacatcaagtttctgaaatgtacaaatgagtattccctggcttgtgttatctgccactgtagaaatgagagcaaaattgaagcatcaaattttaagtcgtgatatgtttgcttctctgc

SEQ ID NO: 104655 - DNA, 441 bp, Homo sapiens
cttatttctcacagttctggaaactagaagtccaagatcaaggtgttggcaggttcagtgtctggtgaaggctattctccccttccaagatgatactttgttgctacatcctccagaggggaagaacgctgctcccttttatggcggaggtacagggtaaaaagggcaaatccctttttataacatcattgatcccaatcatgagggctccaccctcatgacttaatcatctcctagagacccaccacttaatactatcacattgatcacattgatgattaagtttcagcatatgaatttgagaaggcacattcagacagcagcagtgattttcttttttttttttcactctatattgaaattctgtaaggaagatgtcccatctcctgcttattttctcatgtatttatatcagcatggatgtttattttactctatggc

SEQ ID NO: 104656 - DNA, 680 bp, Homo sapiens
gggactatgtcttttacctctggtatctcagagcacgtgactatcccaagggtatttcatgagtgaatatctagatgttgaagttggtgactgatgtttatctcaagagttcccaagtcaatttggagtaagggtagcccaaagaatataggactgagaatcagaagatctcggcttagttcttttccaactaactactagctttgtgaccttgggcagattagccaatcttttctgaatcccaaataacctttttccaaaatgagaataattgtccctaccttgctttcctttcaggtttgccttgagcatcagatgacctcacacaggggagagttttgtgaactgtaaagtatttaacacatgtgcaacattattgtttgtatcatattgccatcaccaccatacttggtgaaacatgagctcacatgtagctcttgttatataaatatcaatatgtcattttggcttcttcacagtgttcaaaactgtagttccttaatgtttgggatgttctttctcctcaaagcaggcatccaaggtattcacctcaagcattttgaagggttttaaatggctcttgattttatcacttgcctgttttaaaatctctggcccaaaatttcaaagttacactttctcccaggagaggtcctgtaagaattgtaactaatcatagc

SEQ ID NO: 104657 - DNA, 710 bp, Homo sapiens
tcatggctccctaggactctgtcctgggttctcagctcagctcagctcagctcatctcctctttacactcagagatctcaaaatagcaaccttcaagaaggcctggtccacagaaatgttctgttggagcttcacaatactttaaaaaaattagtttctacatttccattttttcacctaacaattcctatttctggcttcttttgaaaaatcagggcgtttcagcatgccaggcttgtgtttctgtgtgatcatggccagctggagctatgagtagagcagtcttaatcagggcatttccaaattcttacaaccatcttcacttaattctgttcactgccccgcccctctaggcagcttaagttgtcattcctattgtgctagccctaggtaagttatggctccgcaaaacaaggacagccaaatttttatttttcagcccaccgtgaccctcatgcccacagccaaattcccatacatgttccaataaatcccagactttctccggccctctcttgctgctcacacttgctgcagcccttcttctctatccctttagcataaccttcagaactcaacattccatctgagagagtgttcagatctggaattctaaaaggaaaaaaataaattatgttatgcattactacttggaggcatgctagttgggcaccactactctataagaagactctagttacataataaaa

SEQ ID NO: 104658 - DNA, 411 bp, Homo sapiens
ctccttccctctctcacgtctctttagtatcttttaatttgggagcacagactccatttctctggagtttgtgtttcccagatggccattctcagcttttcacttgaataaagctagactctgattctttcgattatttcaggttaacacttgcttggtgtctggggaaaaaaccccacacatttcacagaagtctactgtgttgattgttgctgggtgagagaacagaaaaagcactttgagtgttttttccatagagatggccatttgtgttctttccaatcttttgctattacaaataaaggcacaaagaatgactttacagatatgttcttttatattttttgcaaatttgcctttgggatatattcccaaaagtgtgattgcttaattaaaggtatatgcatattt

SEQ ID NO: 104659 - DNA, 156 bp, Homo sapiens
ggttgcagtgagccgagattgcgccactgcactccagcctgggcttcagagtgaaactccatctcaaaaaaaccccactcagtgggagttaattaacagattaggcacatctgaagggaaaattactaaactggatcagaatgcaacagattaaag

SEQ ID NO: 104660 - DNA, 306 bp, Homo sapiens
tgcacgcttgaactcctaggctcaagcaatcttcccacctcagactcccaaagtgctggaattacaggtgtgcgtcaccacacccgaccaagagatcatctctgtactccaagtcagaaggcctagctttggactatatctccactcgtctcctctggttcatattaacggtgccactttggggtatttgcccttggccaagcacagccactcattttacagcaggccatcactctatcgttgctcctgccccttggggaagaggtgccaaggagcccagctacactaactgcaggatcagagggc

SEQ ID NO: 104661 - DNA, 444 bp, Homo sapiens
agtcatctgagaactgttgccagaggccccagaggaaaagattgaaggctgcactctcaggtcaagttgtacatggcagtccttgctcaaaaagacaaaagttcaggtctgtgtatttattcttagggctgccataaaaaattaccacaacctggccgggcgcagcgctcatgcccgtaatcccagcactttggtaggccgaggtgggcgggtcacttgagatcaggagttcaagactagcctggccaacatgatgaaaccctgtctctactgaaaatatagaaattagccaggcttggagctgtgtgcctgtaatcccagctaaccaggaggctgaggcaggagaatcacttgaacccaggaggcagaggttgcagtgagccgagaccatgccactgcactccggcctgggtgacaaagcaagactctgtctcaaaaaaaaaa

SEQ ID NO: 104662 - DNA, 453 bp, Homo sapiens
ttttgcttaatttgcaaagtcactgtaatctgatggcaatgatggacaaaatctatttgattcctgccactggtcaaatacattagagaaatgtgcttactggattaatttattgtgtggtttaaactgggcactttaaataaaactaagctatgaaacccagagaaggggtagattctttctttcaaaagataaagaaacaacaatggcattatcacaccttttaaacatatgagagagggccaggtgcggtggctcacgcctgtaatcccagaactttgggaagctgaagcgagtggatcacatgaggtcaggggttcgagaccagcctggccaacatggcaaaatcccacctctactaaaaatacaaaaattagctgcatgtggtggcgtgcgcctgtagtcccagctactcggtaggctgaggcaggagaacctcttgaattcgggagg

SEQ ID NO: 104663 - DNA, 251 bp, Homo sapiens
tctgcattcaaattgattcccattaaataaaattaagaattgagtctcttggtcataccggtcacattgtaagtatgcaagtagctacacatggctagtgacttgttttggacagcacagatttagaacatctccatcgtctcaggaagttctgttgggcagccccgtttcagagggaggagcgacaggctacaagaactgacaggtcagcccgcgcttggcttctcaggagaactgaggcatcgattgtg

SEQ ID NO: 104664 - DNA, 475 bp, Homo sapiens
accaggcaccacattaagagccttatatacgatctgtcattcaatcctcactgcatccaagggtaccctctattattatccccagttaacaggtaatgaagactgaggattgggaaagttacataactcacttaccagccacacaactagctattatgaaatgaacaaatattacaagctaaggattaatagacccactttacaagggaaatttttttttttttttgagacagtcttgctctgtcacccagcctggagtgcagtggtgcgatcttggctcactacaagctccgcctcccgggttcacgccattctcctgcctcagcctcccgagtagctgggactacaggcgcccgccaccacgcccggctaattttttttatttttagtagagacggggtttcaccatgttagccaggatggtcttgatctcctgacctcgtgatctgcccgcctcggcctcccaaagtgctgg

SEQ ID NO: 104665 - DNA, 183 bp, Homo sapiens
ataaaccagatcccacagccaacctggagtcagcttccctgaactgcatgcattgtacatgggagaaaagacagaatccagagctagaccagagatgaacaggaggaggcagaaagacacggaattggctgccatgcctaggaggatcgcaaccctggaaatgggagcagacacccagccctg

SEQ ID NO: 104666 - DNA, 637 bp, Homo sapiens
tggcaaaactttttcttgttcctcaagtttactcaacataagagagttcatactgaagagaaatcccacaaatgtaaagaatgtgggaaagcctttaaccagtccttaagccttactaaacttatgagaattcatactggaaaaaaatcatacaaattggaagactgtggcaaaatcttttaagtattgctcaaatatatccagccataattcatactaaagattatgcctatgaacctaaggaagtttggcaaagcttatgaatacacctcaaactttcctaagccttggagaaatatcagtgagaaacctcagaaaactgaacaatgctgcaagccctttaaatggttgtcacatcttactgtaggtaaaataattgatagtggagaaaatctctacaaacaaagaatgtgtcaaaacttctaacatgctcatactttatggcacataaaagcgtttatacttgaaaaattatacagagtgtggaaaagccatttctatctgctcacatcatagtcaacatcaggaagttcatacttaataaaattattataaatgtaattactgttcaaagaccttggaaaatataaacccttaaaataaaaaagagtattctggagacaaacattacaaatat

SEQ ID NO: 104667 - DNA, 131 bp, Homo sapiens
cccagcagagctggcctgccacagcccaagcgtcttgttttggttaaaaaatgagtctcttggcctttcatgcctgggcgttctccggaactcagatgtttgtgaaccaggttcagggactctcaagttca

SEQ ID NO: 104668 - DNA, 496 bp, Homo sapiens
ggactagttagtcaaagtctatttctaaaacatacctccttttcgtcattgcaaaggagaagtacactttactttcaaggctgactttgggcattgagaacacagaaagatgatttcctacattcttagctaattaattttaagtgtagctggaagcctggtgaggcagaacttaaagaagatgctacttcttgacttttaagcagaggcagcaaatcacttacagtaaaaattactcaaggaaatcactcaattggctttttttgctatggaattgtgacttttttcctataatgccctagggaaagaatataactgtacctcccttccttccaatttcttcaatgtccatagctttaaagaagaggtcaaaattttgtattaaaggactcaagaacctctcggaaagggacaagctctaagagtccaatctcttaccactctcagcgtcaaggttagggcaccttcattggaaggaaactgcacggtccagttc

SEQ ID NO: 104669 - DNA, 793 bp, Homo sapiens
atatctaatgtaactattcttattttatatattttctttattatactggaacagctcgtgccctcggtctcttgcctcggcacctgggcgacttgctgcccacaaaattcaccattgaaataaacctaattagtttaacatctctcttataaggtcacaggacagatcctttgaggtcttccaggggccctccaggaaatctcaagtcagtctgagatcaagacaatgtcacaggccacatgcagtggttcacgcctataatcccaacactttgggagtccgaggagggaggattccttgagcccaggagtttgagaccagcctgagaaacatgctgaggccctgtctctacaaaacaaaaaattgaaaaattagctgggcatggtggtacatgtctgtagtcccatgtactctgaagactgaggcgggaggatcacttgagcccaggagttcaaggttgcagtgagctgtaattgcaccactgcactccagcctcagtaacagagtgagactctgtcactaaaaaaaatttaggctgggtgcagcggctcacgcctataatcccagcattttgggaggtcaaggtggacagatcacctgagatcaggagttcaagaccaggctggccaacatggcaaaaccccatctgtactaaaaatacaaaaattagctgggcgtggtgccatgtgcctgtggtcccagctacttgggaggctgagacagcagaattgcttaagcctgggaggcagaggttacagtgagcccagatcacaccatggcactccagcctggg

SEQ ID NO: 104670 - DNA, 499 bp, Homo sapiens
ttctctcttctactgatcgataatgctccgcaaggacagagacctggtacatcccctttaaattctgagtttcccagtgcctggaacagggcttggtttctgacaggtagtgtagtgggtttgattcctgcacaaaaatctgcttaaccgcaggcctagactataactctaggagggtggagacccagtctccctcccacccacggcgtccccagtactaacatggaacctaccctgaagcccagtcaatactcttgaaatgaatgatgggctgaacagatgctaaaatcacagacaagcatcatttaatcttgtaattatcaatctcagttgacacacgggggaaagaggctcaatgctggcctgatttgtccctcctcaagcaaacaaaacaaaacaaaacatggctgagaagtggagaagtcaaaattaaaacccaggaggccaagatccagcctttaaagctgagcttaattaatcctaaccacaggtgacagag

SEQ ID NO: 104671 - DNA, 413 bp, Homo sapiens
agttgctgtaactcagccacgttccattttatcttcatgttaatgaaaccgcacagcaaaattctggggcacgtggagggcaaagtccgctgcctgctcaccagccctgagagtgccttcttgttgcttctgggccttgtcctgcacgtctcaaaggatatcgcccatttcatggcctgtgaggccatcacacccctttagtgagagttctttctctccctctctttctcatcttttctgcagtgtagacaatttgcatgcactttcccttacccctgccctgccaagatctaggcatggttgatagtgaactgagtagtgttcaaattggaagaaaaagaaaatccctgtccctcctttcagtggttgaggaagtggtcaatacaaaagatctatgtagcatcattttatac

SEQ ID NO: 104672 - DNA, 698 bp, Homo sapiens
gctaaactaaaaattggatataagattgagaatgtattatataatttgcaagacatagaggatgtttatagaatatactaaagtatccctcagcaccaatatgggagtatcctggtctcaagtttataatttttgcacatataatctaaagaagagactttaaaaataaagtacacaaatatgaaccaaagagtagcttaaaaatactttcttctaggtctgaaattttcttttctttctttttttgttttggagacagagtctcactctgtcgcccagggtggagtacagtggcgcaatcccagctcactacaacctccgcctcccaggttcaagcaattctcctgcctcagcctcctgagtagctgggattacacgcatgccctaccacacccagcaaatttttgtatttttagtagagatgacatttcaccatattggccaggctggtctcgaactcctggtctcaggtgatcctccaccttggcctcccaaagtgctgggattacaggtgtgagccattgctcctggccccagctctgaaattttaacttagttttggattccttggaatttgaaaatatgctaacacgaaggattgtaaataggtagtttgaggttatcaggaacagtaacttgaagcaagaacatcagaaattgttcaccatgcaaatatttagtactctgaatcaaggaac

SEQ ID NO: 104673 - DNA, 431 bp, Homo sapiens
tagtgtgcaatgatcactgatcctgtgaatagcccactgccccactccagccctggaaaacatagcgggaactgactaagaaagaaaaaaagacatacaataatatatagatggtcttcaacttacaatttatgcactttacgatggtatgaaagggacacacattcagtcaaaactatactttgaatattgggttttgatcttttcccaggctggcgatatgcagtacagtatctgtcacgaagctgggcagcaacagtgagttgcagttcccagtaagccgcgcaatcactagggtagacaactagtacttggtggctcatgcctggaatcccagcactttgggaggctgaggtgggagggttgtttgagcctaggagtttaagaccagcctgggcaacatatggaaaccctgtctctccaaaaaaaaa

SEQ ID NO: 104674 - DNA, 380 bp, Homo sapiens
tggagaaccattgctacaaggggacagaggactccgtgtgagctctcctgccttccctgaataaacttacacaatttagtgctgggacatttgaaccttttctgaaaatttgagtcagggagagcatcttggggaggtgggaaggaaggtagaaggagcaaagcaacacccccctgaagcctgggaatattgtcagaaccttaaatataattcagctcaccattctgggtaaggacagactctaccaatgaaaatgggtgattaccagctgtgaaacacaaaaacatactttcacggttacacattcctttacaaacaaccgtgtacatttcagcctcctaccccaccatttcttttctccaggcgggaaggctgcatgt

SEQ ID NO: 104675 - DNA, 645 bp, Homo sapiens
caggggacatgttagccacatctccattgaatggcagtagctgtcatttagcaagattgaggaaaaatttctcttaatcttgaacttgaaaagagcagttaccacagagaagagggatttttagcttttttttttctatttgtagagacggggtttcactatgtgtcccaggctggttttgaactcctgagctcaagtgatccttctgcttggcctcccaaaagtgctgggattacaggtgtgagccactgtgcctggtccaaaaaggagagtttattttaaaaaaaaaaacccacaatagcatgtccttgattaggaatccttttaaactgtcagcattacattctctattgtttgttttttgagacagtgtctcactctgtcacccaggctggagtgcaatggagcgatcatggctcactgcaacctccgcttcctgggttcaaccagttctcctgcttcagcctccctagtatatgggactacaggtgtaccaccactatgcccagctaatttttgtattttttggtagagatggggttttactgtgatggctaggctacagtttctattgttttatttagaatgtatcacagatgtcatgtgttaacaacatttaatttttttataactgagttaattatg

SEQ ID NO: 104676 - DNA, 1277 bp, Homo sapiens
ggagactccaggtgcaggagagggggaggtggacttcctcttggtcttcccaagccatgaaacttcctggcttggtggtaacagaagagtctcctccagttcccttgaagaatccaccttcctgcagggttgggggagcgcagaatgggaggaagatacaaataccaattttatagcaagaatgcaaaaagaggccagcgcggtggctcgagcctggaatcccagcactttggaaggcgagctgggcggatcacttgagatgtgaccaggtgacccccctctggccagggaacaatgggccgaagtcctcaggggatttgtggggaagcgcgccccctcctccttggggttttcttgcggagctgctgtgaagactcagctcagctgtgataattacctgaggtcagcttctccagaatgcccttatctcctaaggcctttgagataagcaggaattgtggtgtctgccttgcctccaaacctttatccttgcttatctcagtggaaaattccagcagggatttctgaacaccaagttaaattcctccactcaacaatcagtttggcacgtggctgcccgccagtctgggcagaacagaggggagccaagggaataaacccaagtcctgcccccaggtgcccagagcctggcggggatgggacagttgcctgcagagcaagaggctgccacccagtttcacacaggccagagaggctgacctacctgcccagaggcaggggaagaatccagaggacctctcccggaggaggcacgagaagcccacgtggcagccaagaagagggagagcatcctgggccccggaagcacaatgccaggggcagacatgcactgggaggcacggggccagggacaccttcagtgagcacagggtctgggtaggcttcgggaggggtgagggcggagaggcagccaagccgggttgtgggaggccctgcctaattctgtaaagactaggattagaaacatgacaaaaatgggttaggcacggtggctcacacctgttatccactttgggaggctgaggctggtggatcatctgaggctgggagttcaagaccaacctggccaacatggtgaaaccccgtctctactaaaaatacaaaaattagccgggcgtggtggcgcacacctattaatcccaggtactaaggaggttgaggcaggagaattgcttcaacccaggaggcagaggttgcagtgagcccagaccatgccactgcactccagcctgggcaacagaacaagtctctgtctg

SEQ ID NO: 104677 - DNA, 372 bp, Homo sapiens
agagtctttgagggaaagaatgctgacttacacaggatgcacaaaataaatgtcactgtgtggaggggaaaccagcctgaccttggctatgggtcagaccaagacatttttggctcaagagttaaacggaatctcataatttcaagattagaaacaggacagacatgcaagatagaaaacagaatgaaacttaaagtcttctggatatggagaagcagaaataaattctatggcaatatatggtttaaatacacctatctgaaacacaggtctgagacaggttttccgcttaagaaaaaaacattggctgaagctccatcactgggaaaggaggctgagaaaagctgatgctgctggctatggctcatgtag

SEQ ID NO: 104678 - DNA, 449 bp, Homo sapiens
gttcctgcagctaggtgtgctgctcctggagtgaagtggccactgtaggcctctgtgggtgtctgccccactcatgatgttcccttgtctgggaactgcctctcccatccacagaggtgagcctcaaggagtcacctgtgttctgtgggaccttggattagtcagggtcccccagagaaacggagccgagagaagagtaggatgtgcattaattggctcatgtgattacagaggctgacaagttctaaggcctgcagccagcgagctggagacccaggagaactgaccagttcttgacatcatttctcacacaggcctttgttggagtccaaaggcctgagcccagaaggcccaatggtgtagctcctgttccaaggccagcaggctcccaacccaggaagaaccagtgtccctgttcaaaggtactcaggcagggggagagttccctc

SEQ ID NO: 104679 - DNA, 340 bp, Homo sapiens
aatagaaatttctacagaaacagtaacttttgttattgccactctgactctactttctgactcgttttcccactcaaaaaatcgattttgaagtaattttttatgagctcagttaccttacagattcatatatgacagcatattacactattatctgctcattttgatctaagtgattattattagatattttaatatttgtattacattttatactatcttaagaatacttatttaactttaactttgtttttttttttaattttctgccattcttaccttatttttgtttatcattttgaagagggactgttttttcaacttttagtttagattcatg

SEQ ID NO: 104680 - DNA, 705 bp, Homo sapiens
ttaataaactatgtagttgatactaaagacaattttgctagatagagttttataattaggttcaaaaattctcaagttttaaataatatattaagtatcaataatatgagctttgttagagattagttatcttaaaaaagagttaatatttagctcctctaaatggattgttcatacagtcaactcttttttgaaacctttgctctgtccggtggtgaaacagtgcttgttttataaatttattatagataatactgaaagtataaaatatttatgtaatagtgcagctacagcatgattactgaaagatacctatttatggtagatccataagataaaggcttatgtttagcaaagcattatttgaagtagtaaacattttatgaaatgcagttcttatgggtaaaaatgcccaataaagagctccacaaaagcatttaaaactgatcttattcacctatttctcattgaaaaataaagtgatcttaatttatctagaaatttacttaaactaagatttttttctgtccttggtctttgtctcttagtaaaaaatgtatttaaaagtatcattgatggccaggcacaggggctcacacctgtaattccagcactttggaaggccaaggcaggaggattgcttgaggccaggagttcaagaccagcttggtcaacatagtgagacccccgtgtctttaaaaaaaa

SEQ ID NO: 104681 - DNA, 2977 bp, Homo sapiens
tagcaagtttggcggctccaagccaggcgcgcctcaggatccaggctcatttgcttccacctagcttcggtgccccctgctaggcggggaccctcgagagcgatgccgatggatttgattttagttgtgtggttctgtgtgtgcactgccaggacagtggtgggctttgggatggaccctgaccttcagatggatatcgtcaccgagcttgaccttgtgaacaccacccttggagttgctcaggtgtctggaatgcacaatgccagcaaagcatttttatttcaagacatagaaagagagatccatgcagctcctcatgtgagtgagaaattaattcagctgttccagaacaagagtgaattcaccattttggccactgtacagcagaagccatccacttcaggagtgatactgtccattcgagaactggagcacagctattttgaactggagagcagtggcctgagggatgagattcggtatcactacatacacaatgggaagccaaggacagaggcacttccttaccgcatggcagatggacaatggcacaaggttgcactgtcagttagcgcctctcatctcctgctccatgtcgactgtaacaggatttatgagcgtgtgatagaccctccagataccaaccttcccccaggaatcaatttatggcttggccagcgcaaccaaaagcatggcttattcaaagggatcatccaagatgggaagatcatctttatgccgaatggatatataacacagtgtccaaatctaaatcacacttgcccaacctgcagtgatttcttaagcctggtgcaaggaataatggatttacaagagcttttggccaagatgactgcaaaactaaattatgcagagacaagacttagtcaattggaaaactgtcattgtgagaagacttgtcaagtgagtggactgctctatcgagatcaagactcttgggtagatggtgaccattgcaggaactgcacttgcaaaagtggtgccgtggaatgccgaaggatgtcctgtccccctctcaattgctccccagactccctcccagtgcacattgctggccagtgctgtaaggtctgccgaccaaaatgtatctatggaggaaaagttcttgcagaaggccagcggattttaaccaagagctgtcgggaatgccgaggtggagttttagtaaaaattacagaaatgtgtcctcctttgaactgctcagaaaaggatcacattcttcctgagaatcagtgctgccgtgtctgtagaggtcataacttttgtgcagaaggacctaaatgtggtgaaaactcagagtgcaaaaactggaatacaaaagctacttgtgagtgcaagagtggttacatctctgtccagggagactctgcctactgtgaagatattgatgagtgtgcagctaagatgcattactgtcatgccaatactgtgtgtgtcaaccttcctgggttatatcgctgtgactgtgtcccaggatacattcgtgtggatgacttctcttgtacagaacacgatgaatgtggcagcggccagcacaactgtgatgagaatgccatctgcaccaacactgtccagggacacagctgcacctgcaaaccgggctacgtggggaacgggaccatctgcagagctttctgtgaagagggctgcagatacggtggaacgtgtgtggctcccaacaaatgtgtctgtccatctggattcacaggaagccactgcgagaaagatattgatgaatgttcagagggaatcattgagtgccacaaccattcccgctgcgttaacctgccagggtggtaccactgtgagtgcagaagcggtttccatgacgatgggacctattcactgtccggggagtcctgtattgacattgatgaatgtgccttaagaactcacacctgttggaacgattctgcctgcatcaacctggcagggggttttgactgtctctgcccctctgggccctcctgctctggtgactgtcctcatgaaggggggctgaagcacaatggccaggtgtggaccttgaaagaagacaggtgttctgtctgctcctgcaaggatggcaagatattctgccgacggacagcttgtgattgccagaatccaagtgctgacctattctgttgcccagaatgtgacaccagagtcacaagtcaatgtttagaccaaaatggtcacaagctgtatcgaagtggagacaattggacccatagctgtcagcagtgtcggtgtctggaaggagaggtagattgctggccactcacttgccccaacttgagctgtgagtatacagctatcttagaaggggaatgttgtccccgctgtgtcagtgacccctgcctagctgataacatcacctatgacatcagaaaaacttgcctggacagctatggtgtttcacggcttagtggctcagtgtggacgatggctggatctccctgcacaacctgtaaatgcaagaatggaagagtctgttgttctgtggattttgagtgtcttcaaaataattgaagtatttacagtggactcaacgcagaagaatggacgaaatgaccatccaacgtgattaaggataggaatcggtagtttggtttttttgtttgttttgtttttttaaccacagataattgccaaagtttccacctgaggacggtgtttcggaggttgccttttggacctaccactttgctcattcttgctaacctagtctaggtgacctacagtgccgtgcatttaagtcaatggttgttaaaagaagtttcccgtgttgtaaatcatgtttcccttatcagatcatttgcaaatacatttaaatgatctcatggtaaatggttgatgtattttttgggtttattttgtgtactaaccataatagagagagactcagctccttttatttattttgttgatttatggatcaaattctaaaataaagttgcctgttgtgactttt

SEQ ID NO: 104682 - DNA, 434 bp, Homo sapiens
  misc_feature (426)..(426): n is a, c, g, or t
  misc_feature (429)..(429): n is a, c, g, or t
gagagcctaaagatcatgactaaggccaagtctttgcgcattgctgaatatccttccagctggcccagaagatgggatgcaaaaaagtgatggctgtgcacaaggtcaacatcacgaaactgggagatggtctcttcctccagtgctgtgggggaggtggcatcccgctatcctcagctcaccttagaagacatgattgtggagaatgccacaatgcactttctgtgaagagggctgcagatacggtggaacgtgtgtggctcccaacaaatgtgtctgtccatctggattcacaggaagccactgcgagaaagtggtgagaatgctggctccatgaaagaggtctgcgagagcagggaccttgtttgctctccagggcttactgcaacagactggcacataagtgtctaataaatattccgacanaanaaaaa

SEQ ID NO: 104683 - DNA, 2895 bp, Homo sapiens
ggctggttcatcaggactgacatgcttcatgactcctggctgctgtggaaaagaatttttcccctccttctgatagcaagatggagtctggctctctgtcacccaggctggagtgcagtggcgccaccttggcttattacaacttcctcctcccaggttcaagtgattctcctgccttagcctcccaagttgctgggattacagacatagaaagagagatccatgcagctcctcatgtgagtgagaaattaattcagctgttccagaacaagagtgaattcaccattttggccactgtacagcagaagccatccacttcaggagtgatactgtccattcgagaactggagcacagctattttgaactggagagcagtggcctgagggatgagattcggtatcactacatacacaatgggaagccaaggacagaggcacttccttaccgcatggcagatggacaatggcacaaggttgcactgtcagttagcgcctctcatctcctgctccatgtcgactgtaacaggatttatgagcgtgtgatagaccctccagataccaaccttcccccaggaatcaatttatggcttggccagcgcaaccaaaagcatggcttattcaaagggatcatccaagatgggaagatcatctttatgccgaatggatatataacacagtgtccaaatctaaatcacacttgcccaacctgcagtgatttcttaagcctggtgcaaggaataatggatttacaagagcttttggccaagatgactgcaaaactaaattatgcagagacaagacttagtcaattggaaaactgtcattgtgagaagacttgtcaagtgagtggactgctctatcgagatcaagactcttgggtagatggtgaccattgcaggaactgcacttgcaaaagtggtgccgtggaatgccgaaggatgtcctgtccccctctcaattgctccccagactccctcccagtgcacattgctggccagtgctgtaaggtctgccgaccaaaatgtatctatggaggaaaagttcttgcagaaggccagcggattttaaccaagagctgtcgggaatgccgaggtggagttttagtaaaaattacagaaatgtgtcctcctttgaactgctcagaaaaggatcacattcttcctgagaatcagtgctgccgtgtctgtagaggtcataacttttgtgcagaaggacctaaatgtggtgaaaactcagagtgcaaaaactggaatacaaaagctacttgtgagtgcaagagtggttacatctctgtccagggagactctgcctactgtgaagatattgatgagtgtgcagctaagatgcattactgtcatgccaatactgtgtgtgtcaaccttcctgggttatatcgctgtgactgtgtcccaggatacattcgtgtggatgacttctcttgtacagaacacgatgaatgtggcagcggccagcacaactgtgatgagaatgccatctgcaccaacactgtccagggacacagctgcacctgcaaaccgggctacgtggggaacgggaccatctgcagagctttctgtgaagagggctgcagatacggtggaacgtgtgtggctcccaacaaatgtgtctgtccatctggattcacaggaagccactgcgagaaagatattgatgaatgttcagagggaatcattgagtgccacaaccattcccgctgcgttaacctgccagggtggtaccactgtgagtgcagaagcggtttccatgacgatgggacctattcactgtccggggagtcctgtattgacattgatgaatgtgccttaagaactcacacctgttggaacgattctgcctgcatcaacctggcagggggttttgactgtctctgcccctctgggccctcctgctctggtgactgtcctcatgaaggggggctgaagcacaatggccaggtgtggaccttgaaagaagacaggtgttctgtctgctcctgcaaggatggcaagatattctgccgacggacagcttgtgattgccagaatccaagtgctgacctattctgttgcccagaatgtgacaccagagtcacaagtcaatgtttagaccaaaatggtcacaagctgtatcgaagtggagacaattggacccatagctgtcagcagtgtcggtgtctggaaggagaggtagattgctggccactcacttgccccaacttgagctgtgagtatacagctatcttagaaggggaatgttgtccccgctgtgtcagtgacccctgcctagctgataacatcacctatgacatcagaaaaacttgcctggacagctatggtgtttcacggcttagtggctcagtgtggacgatggctggatctccctgcacaacctgtaaatgcaagaatggaagagtctgttgttctgtggattttgagtgtcttcaaaataattgaagtatttacagtggactcaacgcagaagaatggacgaaatgaccatccaacgtgattaaggataggaatcggtagtttggtttttttgtttgttttgtttttttaaccacagataattgccaaagtttccacctgaggacggtgtttcggaggttgccttttggacctaccactttgctcattcttgctaacctagtctaggtgacctacagtgccgtgcatttaagtcaatggttgttaaaagaagtttcccgtgttgtaaatcatgtttcccttatcagatcatttgcaaatacatttaaatgatctcatggtaaatggttgatgtattttttgggtttattttgtgtactaaccataatagagagagactcagctccttttatttattttgttgatttatggatcaaattctaaaataaagttgcctgttgtgactttt

SEQ ID NO: 104684 - DNA, 2836 bp, Homo sapiens
tagcaagtttggcggctccaagccaggcgcgcctcaggatccaggctcatttgcttccacctagcttcggtgccccctgctaggcggggaccctcgagagcgatgccgatggatttgattttagttgtgtggttctgtgtgtgcactgccaggacagtggtgggctttgggatggaccctgaccttcagatggatatcgtcaccgagcttgaccttgtgaacaccacccttggagttgctcaggtgtctggaatgcacaatgccagcaaagcatttttatttcaagacatagaaagagagatccatgcagctcctcatgtgagtgagaaattaattcagctgttccagaacaagagtgaattcaccattttggccactgtacagcagaagccatccacttcaggagtgatactgtccattcgagaactggagcacagctattttgaactggagagcagtggcctgagggatgagattcggtatcactacatacacaatgggaagccaaggacagaggcacttccttaccgcatggcagatggacaatggcacaaggttgcactgtcagttagcgcctctcatctcctgctccatgtcgactgtaacaggatttatgagcgtgtgatagaccctccagataccaaccttcccccaggaatcaatttatggcttggccagcgcaaccaaaagcatggcttattcaaagggatcatccaagatgggaagatcatctttatgccgaatggatatataacacagtgtccaaatctaaatcacacttgcccaacctgcagtgatttcttaagcctggtgcaaggaataatggatttacaagagcttttggccaagatgactgcaaaactaaattatgcagagacaagacttagtcaattggaaaactgtcattgtgagaagacttgtcaagtgagtggactgctctatcgagatcaagactcttgggtagatggtgaccattgcaggaactgcacttgcaaaagtggtgccgtggaatgccgaaggatgtcctgtccccctctcaattgctccccagactccctcccagtgcacattgctggccagtgctgtaaggtctgccgaccaaaatgtatctatggaggaaaagttcttgcagaaggccagcggattttaaccaagagctgtcgggaatgccgaggtggagttttagtaaaaattacagaaatgtgtcctcctttgaactgctcagaaaaggatcacattcttcctgagaatcagtgctgccgtgtctgtagaggtcataacttttgtgcagaaggacctaaatgtggtgaaaactcagagtgcaaaaactggaatacaaaagctacttgtgagtgcaagagtggttacatctctgtccagggagactctgcctactgtgaagatattgatgagtgtgcagctaagatgcattactgtcatgccaatactgtgtgtgtcaaccttcctgggttatatcgctgtgactgtgtcccaggatacattcgtgtggatgacttctcttgtacagaacacgatgaatgtggcagcggccagcacaactgtgatgagaatgccatctgcaccaacactgtccagggacacagctgcacctgcaaaccgggctacgtggggaacgggaccatctgcagagctttctgtgaagagggctgcagatacggtggaacgtgtgtggctcccaacaaatgtgtctgtccatctggattcacaggaagccactgcgagaaagacattgatgaatgtgccttaagaactcacacctgttggaacgattctgcctgcatcaacctggcagggggttttgactgtctctgcccctctgggccctcctgctctggtgactgtcctcatgaaggggggctgaagcacaatggccaggtgtggaccttgaaagaagacaggtgttctgtctgctcctgcaaggatggcaagatattctgccgacggacagcttgtgattgccagaatccaagtgctgacctattctgttgcccagaatgtgacaccagagtcacaagtcaatgtttagaccaaaatggtcacaagctgtatcgaagtggagacaattggacccatagctgtcagcagtgtcggtgtctggaaggagaggtagattgctggccactcacttgccccaacttgagctgtgagtatacagctatcttagaaggggaatgttgtccccgctgtgtcagtgacccctgcctagctgataacatcacctatgacatcagaaaaacttgcctggacagctatggtgtttcacggcttagtggctcagtgtggacgatggctggatctccctgcacaacctgtaaatgcaagaatggaagagtctgttgttctgtggattttgagtgtcttcaaaataattgaagtatttacagtggactcaacgcagaagaatggacgaaatgaccatccaacgtgattaaggataggaatcggtagtttggtttttttgtttgttttgtttttttaaccacagataattgccaaagtttccacctgaggacggtgtttcggaggttgccttttggacctaccactttgctcattcttgctaacctagtctaggtgacctacagtgccgtgcatttaagtcaatggttgttaaaagaagtttcccgtgttgtaaatcatgtttcccttatcagatcatttgcaaatacatttaaatgatctcatggtaaatggttgatgtattttttgggtttattttgtgtactaaccataatagagagagactcagctccttttatttattttgttgatttatggatcaaattctaaaataaagttgcctgttgtgactttt

SEQ ID NO: 104685 - DNA, 1867 bp, Homo sapiens
  misc_feature (1859)..(1859): n is a, c, g, or t
  misc_feature (1862)..(1862): n is a, c, g, or t
tagcaagtttggcggctccaagccaggcgcgcctcaggatccaggctcatttgcttccacctagcttcggtgccccctgctaggcggggaccctcgagagcgatgccgatggatttgattttagttgtgtggttctgtgtgtgcactgccaggacagtggtgggctttgggatggaccctgaccttcagatggatatcgtcaccgagcttgaccttgtgaacaccacccttggagttgctcaggtgtctggaatgcacaatgccagcaaagcatttttatttcaagacatagaaagagagatccatgcagctcctcatgtgagtgagaaattaattcagctgttccagaacaagagtgaattcaccattttggccactgtacagcagaagccatccacttcaggagtgatactgtccattcgagaactggagcacagctattttgaactggagagcagtggcctgagggatgagattcggtatcactacatacacaatgggaagccaaggacagaggcacttccttaccgcatggcagatggacaatggcacaaggttgcactgtcagttagcgcctctcatctcctgctccatgtcgactgtaacaggatttatgagcgtgtgatagaccctccagataccaaccttcccccaggaatcaatttatggcttggccagcgcaaccaaaagcatggcttattcaaagggatcatccaagatgggaagatcatctttatgccgaatggatatataacacagtgtccaaatctaaatcacacttgcccaacctgcagtgatttcttaagcctggtgcaaggaataatggatttacaagagcttttggccaagatgactgcaaaactaaattatgcagagacaagacttagtcaattggaaaactgtcattgtgagaagacttgtcaagtgagtggactgctctatcgagatcaagactcttgggtagatggtgaccattgcaggaactgcacttgcaaaagtggtgccgtggaatgccgaaggatgtcctgtccccctctcaattgctccccagactccctcccagtgcacattgctggccagtgctgtaaggtctgccgaccaaaatgtatctatggaggaaaagttcttgcagaaggccagcggattttaaccaagagctgtcgggaatgccgaggtggagttttagtaaaaattacagaaatgtgtcctcctttgaactgctcagaaaaggatcacattcttcctgagaatcagtgctgccgtgtctgtagaggtcataacttttgtgcagaaggacctaaatgtggtgaaaactcagagtgcaaaaactggaatacaaaagctacttgtgagtgcaagagtggttacatctctgtccagggagactctgcctactgtgaagatattgatgagtgtgcagctaagatgcattactgtcatgccaatactgtgtgtgtcaaccttcctgggttatatcgctgtgactgtgtcccaggatacattcgtgtggatgacttctcttgtacagaacacgatgaatgtggcagcggccagcacaactgtgatgagaatgccatctgcaccaacactgtccagggacacagctgcacctgcaaaccgggctacgtggggaacgggaccatctgcagagctttctgtgaagagggctgcagatacggtggaacgtgtgtggctcccaacaaatgtgtctgtccatctggattcacaggaagccactgcgagaaagtggtgagaatgctggctccatgaaagaggtctgcgagagcagggaccttgtttgctctccagggcttactgcaacagactggcacataagtgtctaataaatattccgacanaanaaaaa

SEQ ID NO: 104686 - DNA, 670 bp, Homo sapiens
acatgaactgggattgttctgaccatagtgctttaacttggagcatgatttctctggaagttggctgctgggtcttactccttcggagaatggctaagaaaagttggaaagcatgactagaactggacttgtttatcactgcaagtttctcccactgttgtggggatgggggagggttgcactgtgtcttctcactactggaacttagttagattgaaaaactagattaatttatttaaaatggtctgaataacaaagtaagttctggttcctgatttaacctcaggctttgtggaattagggattcttaatctttcagagagcaaagaaagtaattagaattttggatgttggaagaacttataaaaatctgacccatatatacaagtttccaaaataaatctctaaaatttgagctcctcctttatgtaaatttgccaaactcgctatagaaatttatgaaagccagccagcaagtgattttgtagaataggccagaggactggtgaaaactttggagaattactggcttttcaaaagctgataatggccaggtgtggtggcttgtgcccataatcccagatgtttggaggcctggggtgagaggatcgcttggggccaggagttggagaccagtctgggcaacatagacctcagctttaccaaaaaa

SEQ ID NO: 104687 - DNA, 328 bp, Homo sapiens
tgagacagggtcttgctctgtcacccaggctggagtgcagtggcgtgaacgtggctcactgcagcctccacctcttgagctcaaatgattctcctgcctcacctccccctgtagctgggaccacaggtgtgcgtcaccatgcccagctattttttgtgtttatttgtagagacgggatttcagccatgttgcccaggctggtcttgaacatttgaagaggaaggatgaccaaaattagtttgtagagctaataggctttagttttatattattgcagagtctagggagggagagatttatattttaaatttcccttaaaatcatgaaa

SEQ ID NO: 104688 - DNA, 296 bp, Homo sapiens
tgctgggattacaggcatgagccactgcgcctggcctatattcaaatttttatacaacatatctttagattttttttttttcttaagagatgggatctcactgtatttcccaggctggtcttgaactcctgggctcaagcaatcctcccgtcttggcctcccaaagtgctgggactacaggtgtaagccaccctacctggcctctttagaaattttttatctttctaaactgaaactctatataccattgaagaaaaactccgtgtttcccttttcccctattctttggcaacctt

SEQ ID NO: 104689 - DNA, 220 bp, Homo sapiens
agaagttatacgaatttaccatgtgataaggataatccagcaacccggggagaaaaggaaagcttattacaaaagcttgtaaaaaagcttatgtaaagagtttttctccatgataagaagagaacatgctccgttcattagtgattgtagtaattctttctttcttctactttcctgtttttttttgagacagagtcttgctttgttgcccaggctggag

SEQ ID NO: 104690 - DNA, 392 bp, Homo sapiens
tttgagacagagtttcgctctgtcgccaggctggagtacagtgtggcacaatgtcggctcactgcaacctcagactccctggtccaagcgattctcctgcctcagtctcccaagtagctgggaccacaggcgtgtgccaccacacccagctaacttttgtatttttagtagagacagggttccaccatgttggccaggatggtctccatctcttgaccttgtgatctggccccctcggcctcccaaagtgctgggattacaggcgtgagcaccgcacccggccctgatttgactattctttatgcctcatgtaagtgggatcataacagtatttgtccttttgtctgacttactttacttagcataatgtcctcatagttcatccgtgttgt

SEQ ID NO: 104691 - DNA, 226 bp, Homo sapiens
tctcccagtgatgaacacaacctcctttcacactaagcagggcctggagggatgaacttgcccgagctgggagctcagcagggccaggctccagctgtgcccttacaccctgccctctcgccatggacctctgccacctctgccagccagaataccgggggattctcagctttcaagcccctctcctcgtccatcttgggcttcattctcccactctcttgccccc

SEQ ID NO: 104692 - DNA, 794 bp, Homo sapiens
gagggacagagtctgggagatgagatttttggaaaaaccagacttaggactaaggggagtcaactatcagagaattgcatggaaatgtcagtacgaaatgaatcagagtaattgaatatcacattttgttcccaaagggggagattcaagaagctggattgtgaagtaacagtaaaggttctctggttgtaaggaatgataaaaacagtacaacaatacactttttttttctttttaagacggtctcttgctcatgtactcaggatggagtgcaatgcgtgatcttggctcactgcaacctccacttcctgggttcaagcgattctcctgcctcagcctcccaagtagctgggattataggtgcttgccaccacgcccaactgatttttgtatttttagtagagatggggttccaccatgttggccaggctggtctcgaacccctgagctcaggcaatctgcccgccccggcctctcaaagtgttgggattacaggtgtgagccagcgtgcccagccaacaatacacctttgtgtttgtctcccagaagggagttttagtaaagtggtgaagatgaatgatggcagatataggaagtttgagatagaatggatgatgagaagagagaggactgacaatacggtattgccacaccatgtatatccaagaacactacattggtaaaggatatccatagagcagctaaggatatcttcagtgtcttgaattattaaataatgatgacatcatctcatatgtattgtagacttatatatattgattttatatatgata

SEQ ID NO: 104693 - DNA, 491 bp, Homo sapiens
cgcctcagcctcccaaagtgcttggatgacaggcgtgagacactgcacccggccttctggctccttcttacctttcaggtcattaggctgaaacacctcttttgagttgctttccctaaaatcctatccaaagtagaccctttctcctgcactcttctctgccatataatatttatcaagaggcatcctgtgcccttggcagaaagctgatgcttaggggtgagtaccacatatggagtgcagggacaggataacagtcaacatttaccactcaggctacttctcatgtaccccacacacagacattccagattttaaccagtgtggaccaatgacagagagtcagcagaccttgactataaaatccaaacgttcaaatcaggcgcagtggctcacacctgtaatcccagcattttggaaggccaaggcgggaggatcccttgaggccaggagtttgagaccaacctgggcaacataatgagaccgtctca

SEQ ID NO: 104694 - DNA, 296 bp, Homo sapiens
agatcttgccactgcactccgccctgggcaccagagcaaaagtccatctcaaaaaaaaaaagaagtgaatggctccaccatttaccctttgaaagattcttttgttgaaaaactgcatagaaagaataaattatgagaatataatgatttataaacatttcaatatgaactgttataggagacttgcgaaaggtatgagtttttttttttttttaaatccaagaaactggtgtgtaggaatggtctgcagaggcatgctgagataatacagtgttagtcattaaatacaaagcatt

SEQ ID NO: 104695 - DNA, 470 bp, Homo sapiens
ataaaaagtgtattaaaaataatactgcggcgaggcatgatgggtcaggtctgtaaccccagcactttgggaggctgaggtgggtggattggttgaagtcagcagttcgagaccagcctggccaatatggtgaaaccctgtttctactaaaatacaaaaattagctaggcttggtggctggcgcctgtaatcccagctacttgggaggctgaggcaggagaattacttgaacccaggaggcagaggttgccgtgagctgagatagcgccactgcactctagcctgggtgacagagcgagattccatttcaaataattaaataaataaataataatactgcacattgaaaaagttaatgattgtttttaccattattatttaaaaggctttgctcaggaggctgaggccagaggatcaatcgggcccaagagtttaagactagcctgggcaacatagtgagaccctgtctc

SEQ ID NO: 104696 - DNA, 598 bp, Homo sapiens
atttgagtccagaaacaatgtaagaagttaatattatgttgattagtaggtgaggcttcgaaacagagttagacccagcatgtgtaaaattgctttaaaatttgcaccatacactgcctcccctgtccactgttgcctttttctgatgccttctctactcttcagctggagttacctctgtaaaatgaaagtttgatcatgccatcacttaaaaaccctctggtttaaaacactctagtggcttctcctcttcagctgccccatgatgccctgggcagtgtggtcccacctactcctcaggtcccatctcttgtacccagttgactggcctggcctttgtcagggaatcaagtcctttctgtgtcagatgcatttccttctgcctgggacacccttaccattcagttcaccttacctcttatccttcagtttctggctaagtactgattcctcagagacgttttcctgacatcctgcctaggtctgatctcatggcactttgtgcttttccttcagagcacttgtcacagttgaatcacgtgtgttgcgggtgcatatttttaatgtctcgttagatggcgaattctgtgaaacaaga

SEQ ID NO: 104697 - DNA, 999 bp, Homo sapiens
ggaggagagggaggaggaggagggaggtggcggcgccgtggcggaggagcaggagcaggagggggatggagaggagaaggctcctgggtggcatggcgctcctgctcctccaggcgctgcccagccccttgtcagccagggctgaacccccgcaggtaaggaagcctgtgtgggtaccatgcaatcaaagctacatctgtgacttcaggacactgctgtggacagtctcagtgctgcaacgtactactatgaactctggtggttctggctggatgtggatgcctcttcctccacaagggccacagtgttgtggagggctaaggttggttctgtgactcatgcctcataccctaactccatctccttatctctctaaggtcaaatctcaacctacctgttgggtcagagagatgtgtttgaaaagccccctgggtaaggaggctgggactgtgtcctgaggatgatattctctgcgtgactggatatcaggcttggtgcactgacacatagccttatcaaaaagctgagcgcgatactcccttccgggacagggggggtcacgtcataggtactcatgacctcgaacaaaggagaaaggctcaatacgtacttcggactgtctaccggtgctgcccgtgtcactgccatgcttactctcatgcaagcaaaactagggaccgggcaagaatgagaaaggacacggacgccgaccaggtgatcaacgaagaaccggcaggacgataccgacaaaccacgagcacaccacgaggaacaccatccacaagacggaagcaagaccccacacacgacagactgacgatgccacgggaaaggtaccgcgacgcgagagcggaggccacacacaaacgaaccaacagaacacgagccgagactgaagccagggaggcgagagagggaatagcagccacacactacggcccaacaaagacaccggagacccagcccgacaaacacagcgcaaacaactacacgacgcac

SEQ ID NO: 104698 - DNA, 3318 bp, Homo sapiens
aaagcctcggctacttccgagggggtgagtggcttcaccgccggtcccttgcagcgctgcctttcgatctctccacatctcggtggcgcgggatctcaagatgcgcctccacctgctcctgctgctcgcgctgtgcggtgcaggcaccaccgccgcggagctcagttacagcttgcgtggcaactggagcatctgcaatgggaacggctcgctggagctgcccggggcggtccctggctgcgtgcacagcgccttgttccagcagggcctgatccaggattcttactacagatttaatgaccttaactacagatgggtctctttggataactggacctatagcaaagaatttaaaatcccctttgaaattagcaaatggcaaaaagtaaatttgattcttgagggagtggatacggtttcaaaaatcctgttcaatgaagtcactattggggaaacagacaatatgttcaatagatatagctttgatattaccaacgtggtcagggacgtgaactccattgagctgcgtttccagtcagcggtgttgtatgcagcacagcagagcaaagctcacactcgctaccaggttcccccagactgccctccacttgtgcagaagggtgaatgccatgtcaactttgttcggaaggagcaatgttcctttagttgggactgggggccttcctttcctacccagggaatctggaaagatgttagaattgaagcctataatatttgtcacctgaactacttcacattttccccaatatatgataagagtgcccaggagtggaatctggaaatagagtctacatttgatgttgtcagctcaaagccagttggtggtcaagtgatcgtagccatccctaagttgcaaacacaacagacatacagcattgaacttcaacctgggaaaaggattgttgagctatttgtgaacattagcaagaatattactgtagaaacttggtggcctcatggacatggaaaccagactgggtacaacatgactgttctttttgaactggatggaggcttaaatattgaaaaatcagctaaggtttattttaggacagtggaacttatagaagagcctataaaagggtctcctggtttgagtttctatttcaaaattaatggatttcccatatttctaaaaggctcaaactggatcccagcagattcattccaggaccgagtaacctctgagttgttacggctccttttacagtctgttgtggatgctaatatgaatactcttcgggtttggggaggaggaatttatgagcaggatgaattctatgaactctgtgatgaactaggaataatggtatggcaggattttatgtttgcctgtgccctttatccaactgatcagggcttcctggattcagtgacagcagaagttgcctaccagatcaagagactgaaatctcatccttctatcatcatatggagtggcaataatgaaaatgaggaggcgctgatgatgaattggtatcatatcagtttcactgaccggccaatctacatcaaggactatgtgacactctatgtgaaaaacatcagagagctcgtactggcaggagacaagagtcgtccttttattacgtccagtcctacaaatggggctgaaactgttgcagaagcctgggtctctcaaaaccctaatagcaattattttggtgatgtacatttttatgactatatcagtgattgctggaactggaaagttttcccaaaagctcgatttgcatctgaatatggatatcagtcctggccgtccttcagtacattagaaaaggtctcgtctacagaggactggtctttcaatagcaagttttcacttcatcgacaacatcacgaaggtggtaacaaacaaatgctttatcaggctggacttcatttcaaactcccccaaagcacagatccattacgcacatttaaagataccatctaccttactcaggtgatgcaggcccagtgtgtcaaaacagaaactgaattctaccgccgtagtcgcagcgagatagtggatcagcaagggcacacgatgggggcactttattggcagttgaatgacatctggcaagctccttcctgggcttctcttgagtacggaggaaagtggaaaatgcttcattactttgctcagaatttctttgctccactgttgccagtaggctttgagaatgaaaacacgttctatatctatggtgtgtcagatcttcactcggattattcgatgacactcagtgtgagagtccatacatggagctccctggagcccgtgtgctctcgtgtgactgaacgttttgtgatgaaaggaggagaggctgtctgcctttatgaggagccagtgtctgaattgctgaggagatgtgggaattgcacacgggaaagctgtgtggtttccttttacctttcagctgaccatgaactcctgagcccgaccaactaccacttcctgtcctcaccgaaggaggccgtggggctctgcaaggcgcagatcactgccatcatctctcagcaaggtgacatatttgtttttgacctggagacctcagctgtcgctccctttgtttggttggatgtaggaagcatcccagggagatttagtgacaatggtttcctcatgactgagaagacacgaactatattattttacccttgggagcccaccagcaagaatgagttggagcaatcttttcatgtgacctccttaacagatatttactgaaggaatctaggttgtattttcagtggacaatgggaataaagcatttctaaagcaccgactggagaggaaggcaacagagacaaggagagaagccgagagacatgtctgcgtgctgccacgcatctgagcgattgctctgtgaagagttgtacactgaacactttcaggggaggctgtttacccaggcaatgtcctcaaacaagcctgtgccggggtgtcctggaatctgtgccaggactgtgtttttagcccttcacctctcagctttagcaggacatgaaccagttataacaagatggccctgcagctggttacaagaatgtgacatggcaggatctatggaaccaaatggaaggttttgaggtgatgtaggtctttcacagctagctttggggaatacggaatactcaaataaagtgctttgttattatttcagagggaatggcgattgaaatgttacaacagagatttcttggtggtagctatttgggtaaaggtatatgggtatttttctgtacatgtgaaattatataaaaataaaagttatataaattacattgacaactaaaaaaaaaaaa

SEQ ID NO: 104699 - DNA, 3107 bp, Homo sapiens
tggctcccaggaagagtccgtaccatagcaggttctccaggaaagtgggctcaggcacctccagaggattcttactacagatttaatgaccttaactacagatgggtctctttggataactggacctatagcaaagaatttaaaatcccctttgaaattagcaaatggcaaaaagtaaatttgattcttgagggagtggatacggtttcaaaaatcctgttcaatgaagtcactattggggaaacagacaatatgttcaatagatatagctttgatattaccaacgtggtcagggacgtgaactccattgagctgcgtttccagtcagcggtgttgtatgcagcacagcagagcaaagctcacactcgctaccaggttcccccagactgccctccacttgtgcagaagggtgaatgccatgtcaactttgttcggaaggagcaatgttcctttagttgggactgggggccttcctttcctacccagggaatctggaaagatgttagaattgaagcctataatatttgtcacctgaactacttcacattttccccaatatatgataagagtgcccaggagtggaatctggaaatagagtctacatttgatgttgtcagctcaaagccagttggtggtcaagtgatcgtagccatccctaagttgcaaacacaacagacatacagcattgaacttcaacctgggaaaaggattgttgagctatttgtgaacattagcaagaatattactgtagaaacttggtggcctcatggacatggaaaccagactgggtacaacatgactgttctttttgaactggatggaggcttaaatattgaaaaatcagctaaggtttattttaggacagtggaacttatagaagagcctataaaagggtctcctggtttgagtttctatttcaaaattaatggatttcccatatttctaaaaggctcaaactggatcccagcagattcattccaggaccgagtaacctctgagttgttacggctccttttacagtctgttgtggatgctaatatgaatactcttcgggtttggggaggaggaatttatgagcaggatgaattctatgaactctgtgatgaactaggaataatggtatggcaggattttatgtttgcctgtgccctttatccaactgatcagggcttcctggattcagtgacagcagaagttgcctaccagatcaagagactgaaatctcatccttctatcatcatatggagtggcaataatgaaaatgaggaggcgctgatgatgaattggtatcatatcagtttcactgaccggccaatctacatcaaggactatgtgacactctatgtgaaaaacatcagagagctcgtactggcaggagacaagagtcgtccttttattacgtccagtcctacaaatggggctgaaactgttgcagaagcctgggtctctcaaaaccctaatagcaattattttggtgatgtacatttttatgactatatcagtgattgctggaactggaaagttttcccaaaagctcgatttgcatctgaatatggatatcagtcctggccgtccttcagtacattagaaaaggtctcgtctacagaggactggtctttcaatagcaagttttcacttcatcgacaacatcacgaaggtggtaacaaacaaatgctttatcaggctggacttcatttcaaactcccccaaagcacagatccattacgcacatttaaagataccatctaccttactcaggtgatgcaggcccagtgtgtcaaaacagaaactgaattctaccgccgtagtcgcagcgagatagtggatcagcaagggcacacgatgggggcactttattggcagttgaatgacatctggcaagctccttcctgggcttctcttgagtacggaggaaagtggaaaatgcttcattactttgctcagaatttctttgctccactgttgccagtaggctttgagaatgaaaacacgttctatatctatggtgtgtcagatcttcactcggattattcgatgacactcagtgtgagagtccatacatggagctccctggagcccgtgtgctctcgtgtgactgaacgttttgtgatgaaaggaggagaggctgtctgcctttatgaggagccagtgtctgaattgctgaggagatgtgggaattgcacacgggaaagctgtgtggtttccttttacctttcagctgaccatgaactcctgagcccgaccaactaccacttcctgtcctcaccgaaggaggccgtggggctctgcaaggcgcagatcactgccatcatctctcagcaaggtgacatatttgtttttgacctggagacctcagctgtcgctccctttgtttggttggatgtaggaagcatcccagggagatttagtgacaatggtttcctcatgactgagaagacacgaactatattattttacccttgggagcccaccagcaagaatgagttggagcaatcttttcatgtgacctccttaacagatatttactgaaggaatctaggttgtattttcagtggacaatgggaataaagcatttctaaagcaccgactggagaggaaggcaacagagacaaggagagaagccgagagacatgtctgcgtgctgccacgcatctgagcgattgctctgtgaagagttgtacactgaacactttcaggggaggctgtttacccaggcaatgtcctcaaacaagcctgtgccggggtgtcctggaatctgtgccaggactgtgtttttagcccttcacctctcagctttagcaggacatgaaccagttataacaagatggccctgcagctggttacaagaatgtgacatggcaggatctatggaaccaaatggaaggttttgaggtgatgtaggtctttcacagctagctttggggaatacggaatactcaaataaagtgctttgttattatttcagagggaatggcgattgaaatgttacaacagagatttcttggtggtagctatttgggtaaaggtatatgggtatttttctgtacatgtgaaattatataaaaataaaagttatataaattacattgacaactaaaaaaaaaaaa

SEQ ID NO: 104700 - DNA, 3030 bp, Homo sapiens
aaagcctcggctacttccgagggggtgagtggcttcaccgccggtcccttgcagcgctgcctttcgatctctccacatctcggtggcgcgggatctcaagatgcgcctccacctgctcctgctgctcgcgctgtgcggtgcaggcaccaccgccgcggagctcagttacagcttgcgtggcaactggagcatctgcaatgggaacggctcgctggagctgcccggggcggtccctggctgcgtgcacagcgccttgttccagcagggcctgatccaggattcttactacagatttaatgaccttaactacagatgggtctctttggataactggacctatagcaaagaatttaaaatcccctttgaaattagcaaatggcaaaaagtaaatttgattcttgagggagtggatacggtttcaaaaatcctgttcaatgaagtcactattggggaaacagacaatatgttcaatagatatagctttgatattaccaacgtggtcagggacgtgaactccattgagctgcgtttccagtcagcggtgttgtatgcagcacagcagagcaaagctcacactcgctaccaggttcccccagactgccctccacttgtgcagaagggtgaatgccatgtcaactttgttcggaaggagcaatgttcctttagttgggactgggggccttcctttcctacccagggaatctggaaagatgttagaattgaagcctataatatttgtcacctgaactacttcacattttccccaatatatgataagagtgcccaggagtggaatctggaaatagagtctacatttgatgttgtcagctcaaagccagttggtggtcaagtgatcgtagccatccctaagttgcaaacacaacagacatacagcattgaacttcaacctgggaaaaggattgttgagctatttgtgaacattagcaagaatattactgtagaaacttggtggcctcatggacatggaaaccagactgggtacaacatgactgttctttttgaactggatggaggcttaaatattgaaaaatcagctaaggtttattttaggacagtggaacttatagaagagcctataaaagggtctcctggtttgagtttctatttcaaaattaatggatttcccatatttctaaaaggctcaaactggatcccagcagattcattccaggaccgagtaacctctgagttgttacggctccttttacagtctgttgtggatgctaatatgaatactcttcgggtttggggaggaggaatttatgagcaggatgaattctatgaactctgtgatgaactaggaataatggtatggcaggattttatgtttgcctgtgccctttatccaactgatcagggcttcctggattcagtgacagcagaagttgcctaccagatcaagagactgaaatctcatccttctatcatcatatggagtggcaataatgaaaatgaggaggcgctgatgatgaattggtatcatatcagtttcactgaccggccaatctacatcaaggactatgtgacactctatgtgaaaaacatcagagagctcgtactggcaggagacaagagtcgtccttttattacgtccagtcctacaaatggggctgaaactgttgcagaagcctgggtctctcaaaaccctaatagcaattattttggtgatgtacatttttatgactatatcagtgattgctggaactggaaagttttcccaaaagctcgatttgcatctgaatatggatatcagtcctggccgtccttcagtacattagaaaaggtctcgtctacagaggactggtctttcaatagcaagttttcacttcatcgacaacatcacgaaggtggtaacaaacaaatgctttatcaggctggacttcatttcaaactcccccaaagcacagatccattacgcacatttaaagataccatctaccttactcaggtgagagtccatacatggagctccctggagcccgtgtgctctcgtgtgactgaacgttttgtgatgaaaggaggagaggctgtctgcctttatgaggagccagtgtctgaattgctgaggagatgtgggaattgcacacgggaaagctgtgtggtttccttttacctttcagctgaccatgaactcctgagcccgaccaactaccacttcctgtcctcaccgaaggaggccgtggggctctgcaaggcgcagatcactgccatcatctctcagcaaggtgacatatttgtttttgacctggagacctcagctgtcgctccctttgtttggttggatgtaggaagcatcccagggagatttagtgacaatggtttcctcatgactgagaagacacgaactatattattttacccttgggagcccaccagcaagaatgagttggagcaatcttttcatgtgacctccttaacagatatttactgaaggaatctaggttgtattttcagtggacaatgggaataaagcatttctaaagcaccgactggagaggaaggcaacagagacaaggagagaagccgagagacatgtctgcgtgctgccacgcatctgagcgattgctctgtgaagagttgtacactgaacactttcaggggaggctgtttacccaggcaatgtcctcaaacaagcctgtgccggggtgtcctggaatctgtgccaggactgtgtttttagcccttcacctctcagctttagcaggacatgaaccagttataacaagatggccctgcagctggttacaagaatgtgacatggcaggatctatggaaccaaatggaaggttttgaggtgatgtaggtctttcacagctagctttggggaatacggaatactcaaataaagtgctttgttattatttcagagggaatggcgattgaaatgttacaacagagatttcttggtggtagctatttgggtaaaggtatatgggtatttttctgtacatgtgaaattatataaaaataaaagttatataaattacattgacaactaaaaaaaaaaaa

SEQ ID NO: 104701 - DNA, 1029 bp, Homo sapiens
  misc_feature (1029)..(1029): n is a, c, g, or t
aaagcctcggctacttccgagggggtgagtggcttcaccgccggtcccttgcagcgctgcctttcgatctctccacatctcggtggcgcgggatctcaagatgcgcctccacctgctcctgctgctcgcgctgtgcggtgcaggcaccaccgccgcggagctcagttacagcttgcgtggcaactggagcatctgcaatgggaacggctcgctggagctgcccggggcggtccctggctgcgtgcacagcgccttgttccagcagggcctgatccaggattcttactacagatttaatgaccttaactacagatgggtctctttggataactggacctatagcaaagaatttaaaatcccctttgaaattagcaaatggcaaaaagtaaatttgattcttgagggagtggatacggtttcaaaaatcctgttcaatgaagtcactattggggaaacagacaatatgttcaatagatatagctttgatattaccaacgtggtcagggacgtgaactccattgagctgcgtttccagtcagcggtgttgtatgcagcacagcagagcaaagctcacactcgctaccaggttcccccagactgccctccacttgtgcagaagggtgaatgccatgtcaactttgttcggaaggagcaatgttcctttagttgggactgggggccttcctttcctacccagggaatctggaaagatgttagaattgaagcctataatatttgtcacctgaactacttcacattttccccaatatatgataagagtgcccaggagtggaatctggaaatagagtctacatttgatgttgtcagctcaaagccagttggtggtcaagtgatcgtagccatccctaagttgcaaacacaacagacatacagcattgaaccggatagcttgccggcaagctatccggttcaatggacacaggtcacaggtttgactttgagggcttatatgggggcctcacttctggtggtactggttgagtatactttcttgcacaggaggcgtan

SEQ ID NO: 104702 - DNA, 675 bp, Homo sapiens
agctttgatattaccaacgtggtcagggacgtgaactccattgagctgcgtttccagtcagcggtgttgtatgcagcacagcagagcaaagctcacactcgctaccaggttcccccagactgccctccacttgtgcagaagggtgaatgccatgtcaactttgttcggaaggtaatggtctctcaaacaggtcgggttttatttttgaggacggggtgtgctggcatatgaaatgcttatttgaagactcccatggcatttcagaagttaggaatctctttcctgatcccttagtggggtttgaaaatttgaaataagaaccaaaagattatttgaaatattgtggagaatctttatctttttctaagttttcttcctgaagcgtgttcagaacttaggtaacagaaaaagaaaggaaaaatatgtggctgataatggaactttacaaattatttttttaacatttaagtttatcaaacttttcaccagattgtgaaaatgtattagtgattcttgtttctaggaagccctctgcaaatattagtatatttgatgatatgttcttgcatcttactgtcaggttctcataaaatctaacaaaaagataacaaagtccacaaaagtaattatttttcttagagtatgattccagtctaagaggacttggatctattt

SEQ ID NO: 104703 - DNA, 906 bp, Homo sapiens
catgctcactcccttagaaccccgatgagccacaaacagctgggccattggacagtgcctctctgactacttgaccttgccgtctcctgacactcttgattattttcagagtacggaggaaagtggaaaatgcttcattactttgctcagaatttctttgctccactgttgccagtaggctttgagaatgaaaacacgttctatatctatggtgtgtcagatcttcactcggattattcgatgacactcagtgtgagagtccatacatggagctccctggagcccgtgtgctctcgtgtgactgaacgttttgtgatgaaaggaggagaggctgtctgcctttatgaggagccagtgtctgaattgctgaggagatgtgggaattgcacacgggaaagctgtgtggtttccttttacctttcagctgaccatgaactcctgagcccgaccaactaccacttcctgtcctcaccgaaggaggccgtggggctctgcaaggcgcagatcactgtaagcacaggtcatggcggagggcaggggactgtggccttgtggggttctcctgctcttgggccagctccttgcatcctgagatttgcatgtgtcccccttggtgctgagtttacctgaggcttgggggaagattggcctgttcccactaaaagcaaacaccaaatgatttctatttcgaatccaggatttgtcagagttgctggtgaccactactcgtttgtcccatcacccctccttagtgggcaggtgcagtgatgggagaggaggctcgagtcatcaccactgcctgcatgccactaggttccaggctgtgttctaggtccttcactgcatagtctctgactttcaccacagctccaggcattatcatctgcattttcgtaagtttgaagc

SEQ ID NO: 104704 - DNA, 2911 bp, Homo sapiens
aaagcctcggctacttccgagggggtgagtggcttcaccgccggtcccttgcagcgctgcctttcgatctctccacatctcggtggcgcgggatctcaagatgcgcctccacctgctcctgctgctcgcgctgtgcggtgcaggcaccaccgccgcggagctcagttacagcttgcgtggcaactggagcatctgcaatgggaacggctcgctggagctgcccggggcggtccctggctgcgtgcacagcgccttgttccagcagggcctgatccaggattcttactacagatttaatgaccttaactacagatgggtctctttggataactggacctatagcaaagaatttaaaatcccctttgaaattagcaaatggcaaaaagtaaatttgattcttgagggagtggatacggtttcaaaaatcctgttcaatgaagtcactattggggaaacagacaatatgttcaatagatatagctttgatattaccaacgtggtcagggacgtgaactccattgagctgcgtttccagtcagcggtgttgtatgcagcacagcagagcaaagctcacactcgctaccaggttcccccagactgccctccacttgtgcagaagggtgaatgccatgtcaactttgttcggaaggagcaatgttcctttagttgggactgggggccttcctttcctacccagggaatctggaaagatgttagaattgaagcctataatatttgtcacctgaactacttcacattttccccaatatatgataagagtgcccaggagtggaatctggaaatagagtctacatttgatgttgtcagctcaaagccagttggtggtcaagtgatcgtagccatccctaagttgcaaacacaacagacatacagcattgaacttcaacctgggaaaaggattgttgagctatttgtgaacattagcaagaatattactgtagaaacttggtggcctcatggacatggaaaccagactgggtacaacatgactgttctttttgaactggatggaggcttaaatattgaaaaatcagctaaggtttattttaggacagtggaacttatagaagagcctataaaagggtctcctggtttgagtttctatttcaaaattaatggatttcccatatttctaaaaggctcaaactggatcccagcagattcattccaggaccgagtaacctctgagttgttacggctccttttacagtctgttgtggatgctaatatgaatactcttcgggtttggggaggaggaatttatgagcaggatgaattctatgaactctgtgatgaactaggaataatggtatggcaggattttatgtttgcctgtgccctttatccaactgatcagggcttcctggattcagtgacagcagaagttgcctaccagatcaagagactgaaatctcatccttctatcatcatatggagtggcaataatgaaaatgaggaggcgctgatgatgaattggtatcatatcagtttcactgaccggccaatctacatcaaggactatgtgacactctatgtgaaaaacatcagagagctcgtactggcaggagacaagagtcgtccttttattacgtccagtcctacaaatggggctgaaactgttgcagaagcctgggtctctcaaaaccctaatagcaattattttggtgatgtacatttttatgactatatcagtgattgctggaactggaaagttttcccaaaagctcgatttgcatctgaatatggatatcagtcctggccgtccttcagtacattagaaaaggtctcgtctacagaggactggtctttcaatagcaagttttcacttcatcgacaacatcacgaaggtggtaacaaacaaatgctttatcaggctggacttcatttcaaactcccccaaagcacagatccattacgcacatttaaagataccatctaccttactcaggtgatgcaggcccagtgtgtcaaaacagaaactgaattctaccgccgtagtcgcagcgagatagtggatcagcaagggcacacgatgggggcactttattggcagttgaatgacatctggcaagctccttcctgggcttctcttgagtacggaggaaagtggaaaatgcttcattactttgctcagaatttctttgctccactgttgccagtaggctttgagaatgaaaacacgttctatatctatggtgtgtcagatcttcactcggattattcgatgacactcagtgtgagagtccatacatggagctccctggagcccgtgtgctctcgtgtgactgaacgttttgtgatgaaaggaggagaggctgtctgcctttatgaggagccagtgtctgaattgctgaggagatgtgggaattgcacacgggaaagctgtgtggtttccttttacctttcagctgaccatgaactcctgagcccgaccaactaccacttcctgtcctcaccgaaggaggccgtggggctctgcaaggcgcagatcactgtaagcacaggtcatggcggagggcaggggactgtggccttgtggggttctcctgctcttgggccagctccttgcatcctgagatttgcatgtgtcccccttggtgctgagtttacctgaggcttgggggaagattggcctgttcccactaaaagcaaacaccaaatgatttctatttcgaatccaggatttgtcagagttgctggtgaccactactcgtttgtcccatcacccctccttagtgggcaggtgcagtgatgggagaggaggctcgagtcatcaccactgcctgcatgccactaggttccaggctgtgttctaggtccttcactgcatagtctctgactttcaccacagctccaggcattatcatctgcattttcgtaagtttgaagc

SEQ ID NO: 104705 - DNA, 991 bp, Homo sapiens
aaagcctcggctacttccgagggggtgagtggcttcaccgccggtcccttgcagcgctgcctttcgatctctccacatctcggtggcgcgggatctcaagatgcgcctccacctgctcctgctgctcgcgctgtgcggtgcaggcaccaccgccgcggagctcagttacagcttgcgtggcaactggagcatctgcaatgggaacggctcgctggagctgcccggggcggtccctggctgcgtgcacagcgccttgttccagcagggcctgatccaggattcttactacagatttaatgaccttaactacagatgggtctctttggataactggacctatagcaaagaatttaaaatcccctttgaaattagcaaatggcaaaaagtaaatttgattcttgagggagtggatacggtttcaaaaatcctgttcaatgaagtcactattggggaaacagacaatatgttcaatagatatagctttgatattaccaacgtggtcagggacgtgaactccattgagctgcgtttccagtcagcggtgttgtatgcagcacagcagagcaaagctcacactcgctaccaggttcccccagactgccctccacttgtgcagaagggtgaatgccatgtcaactttgttcggaaggagcaatgttcctttagttgggactgggggccttcctttcctacccagggaatctggaaagatgttagaattgaagcctataatatttgtcacctgaactacttcacattttccccaatatatgagtgaggagaaggcttacgtctagtgagggagagattgggtatatgattgagatgggggctagtttttgtcatgtgagaagaagcaggccggatgtcagaggggtgccttgggtaacctctgggactcagaagtgaaagggggctattcctagttttattgctatagccattatgattattaatgatgagtattgataggtagtataggttatggttc

SEQ ID NO: 104706 - DNA, 338 bp, Homo sapiens
gggttggactcacactcagattagacagtgctccgaagagaaggagcccgtcactccacaggcagccatctgtcctcatctgtccactcccggtaaaccaagagtggttgagagacaagatcaggggcccggctggcaccaaggctgcacccaggatcgggctctccctggatcccatggtgctggtgggccccatacggtggtgggcttggaagagagagggtgggaaaggcacgggggagactgagctgagacgggcgaggggaggtggctgggagcggggatgctggctcctcacgtaattctactaagcacctgctacgggttcagccgggtgg

SEQ ID NO: 104707 - DNA, 117 bp, Homo sapiens
taggtcatgaggcagaatgccatttgattattttctttgctttcactaactgccccttgtgcgctggcttggagcaccatcttgttgaaagataaatcctttacataataagggtgg

SEQ ID NO: 104708 - DNA, 473 bp, Homo sapiens
atgagaacacctttggaagcttaaagaaaaatagtaggccaatctagaagacagtgtgcaggtaaaagtgttagaaaaagaccttgccagtgtctaacaatgtagggttctgtagaccaaataacagagttggattttattcttaaaataatgagaagccaggcaaaaatcttaatcaggggagtgccataatctcactttagttgcaaaacatcattctggctacagggtgggaaacagtaggagacaaaagagtaatctagaagccaagtgactagctatgaggcatgtcactcaccatgataaaattcctttttaggaacttagagatgttaattctcagattgcattttcacatctttcttgcagcacttaaaatggctcatgatgttgagcacgttctaatatgcctgttttagaactaatagtgtaatgtggaatgtgttcataatacaaaggataaatgcttaagg

SEQ ID NO: 104709 - DNA, 267 bp, Homo sapiens
tcagggccgtgagggaggcaagactggcctgtccactgcaccgagtggtgccatcagtaaagtgaagactgtgtcctctctcatgtcccacctgccaggagtgtcaggatcacagggatcccaaagggtatggtgcttgtggagctctcaactgccccaccctaaactcgagtgtgcttgttaaagtggacagggtgccagtggaggctggtgggccaatctccacagggacaagtgacgtgtttgttacacacggctgctaggtcg

SEQ ID NO: 104710 - DNA, 464 bp, Homo sapiens
aaaaagcagtttgttccttgaaactattctgtatgctgcaataatggtggatgcatgtaattatacatatgtcaaaacccaaagaatgggtggggcctcagtagctcatgtctataatcctaccattttgggaggctgaagagggaggattgcttcaaccctggagttccagaccagtctgggcaacatagggagaccccgtctctacaaaaaatgtaaaaattagtgggacatggtagtgtatgcctataatcccagctgcttctgaggctgaggcaggatgatcgcttgagcccaggaggtgaggttgcaggaagctgtgattgtgccagtgcactccagcctgggtggcagagcgagaccctgtcacagaaaacaaacccgtaggctatacacaagcaagagtgaaccttgatgtaaaatccggactttgggtaacaatgatgtgtcgatataggtttgtt

SEQ ID NO: 104711 - DNA, 496 bp, Homo sapiens
gggatcggcggcccagagttgattgttgtggccccagcagcaggatgatggctgtagagcacctgctcaggagttggcctatctccagctatggggcgggaaggctccctaccagaccacacacatcttgatgtactcaccctgtgagcccaggacccctgtgatacctgctgaggtgaaggctgaatgagtgagagctcccagcctccagcatcagggcattagggagaagaagcagctagactcaagccagggatgcagagggagggaacaggcatcaggtagtaggtgttttaatgtcacctacctcttattatgttgtatgtttctggaggatgggtccatggctgatccatccttgtgtctctactacaaccagcagattactttacagagagttgatactcagtaagtacagcttattgaaggtgtaaccaaaagccagtaggcaggatgacagatggcatccgccttgcatgtctgggtcatcagggaa

SEQ ID NO: 104712 - DNA, 409 bp, Homo sapiens
gccaaaccctgtttgagacactggggatgtaacgattcattagcttacattctgatgagaaatggtgaagtgagtggtctgtttaaataaacagccaaggccaagtaattgtcaggaataatatttcagaaggtaaatacagtcatgcatcattaggctcttccatcattgtgcaaacatatatttacaaaaacctaaatggtagaacccacggcacacctaggctataaggtgtagcctgttactcctaggctacaaacctctacagcatggtaccatagtgagtactaaaggcagtgtaagacaatggtaagtatttatgtatctaaacatacctaaggcatagtaaatgtatagtaaaaatactgtataaaaggtaaaaaaaaatggagctgtgtgcagtggctca

SEQ ID NO: 104713 - DNA, 234 bp, Homo sapiens
tctgtctcaggatgcaggcagggctggtgcaggcttctccatactcccttccacttggcaccagcaggcatcgagcaaccagggatcttaaactggcctctccaaatactccattgaacaggactgcaggctgcacccaggctaatgggagattggtgtgttgatgatacagtgtttaagatgagattgcagtgagttcctccttaatcccagaagggcaccatgatgagccag

SEQ ID NO: 104714 - DNA, 617 bp, Homo sapiens
attttgtttattataaaggcatactgacttgggttaacattgcctcaaactgaaagacatgaagataaaggacaaagagagatgtctttcttctaagaaacatctcttgctggctccccaagcaagacccgggagtgtggggtttacagttgccgtggtctcaggtctagtactgagcttcatggggccccaaaacttgattttgtcagatttgatgaaggattagttttttagtaaccaaccaactaggaccagatgccaatttattcatttataatgaagcataaaacttccaggtagaccagatgccagaggtgactactcgaccgacctattctctctccagtagcaatgtccagattagagcagaagattgcttgaaagtcgtgaaattaaaactaggtagggaggagaggtgttgagaattttttagtgaccttgatcaagatatgcacattgtccattctgtcagtcatgtttgtgaaatatcttctagagtggatcacatctgtagacaaattaacctcattcatgtattcattcttagtagctttgctctcactttagctcaggttttgggggtacctgtattgcaaatctggcataatgaattgtgc

SEQ ID NO: 104715 - DNA, 229 bp, Homo sapiens
tatacgtatatatgtatatatacacgtatatatgtatatatgtatatatacacgtatatatgtatatatacacgtatatacgtatatatacgtgtatatatatgtatatatgtatatctgtgtgtgtgtatgtatatacatatatatgtatatacatatatacgtatatatgtatactgcaaagctacagtaaccaaaacagcgtgtattggtattaaaacagacacaa

SEQ ID NO: 104716 - DNA, 284 bp, Homo sapiens
aaggcccattgctgcaagacacaggtgactctgtgggtgacttggcctgaggttttaccattgacctggctgaaacattcttaaaactacacagtgcactgagactctgtctcccctaccctctttccctctcctttaccgggagggctgagagctgcatcatagtctgatgcttctccttacttcttccctgcattccgccatcctctcacaagcattttccccagtaaatctcttctacagctaatccaaccttagcttctgcttcttggaggatctgaact

SEQ ID NO: 104717 - DNA, 360 bp, Homo sapiens
ataaaaaggtgttgcccttatagaaccacactaacttccctcccatctttaacccctggcaaccaccagtctgtcctctgtttctaaaactgtcattccaaaatgttacataaatgaaatcatataggatgtactcttttgagactggcttttttcactccacataagtccctggagattcttccaaggtgttgctcatttcatgtttgtgtctttattgctgagtggtactcatggtatgtatggatgcgccacagtttgatgaaccgttcacctgtggaaggatatctggacagctatcagtatgtggtgccaccttatcacagggccctggtggctgaggccacccaccctccaacc

SEQ ID NO: 104718 - DNA, 417 bp, Homo sapiens
tgtcactgcaaactgaggctcaggtggccagtgacttgcccaagtccacaaggctgtgggaggtggagcagggattcaagggaggccctgaggccacccagcctgggtgggtctcaaaagcaattttcttctcttccctcctccacccattcatagtggaaagcaagcctgcaccccaggagctcccattcataccctctctgtcccctctctgttcttcctcctcccgcctgccccatgcacctcccaccctgaagttccctgccacccctcgccctgtgccagcttgtctctgcaggctctcagtcctgggggctggagaacaggtgctcagtcctctttgctgcccacagaagtctcagaacattcttgccccaccctcccttgggccaaagccctttagggtcccgtcctttc

SEQ ID NO: 104719 - DNA, 552 bp, Homo sapiens
gatttgtgtacatcaagtcctagaaaatacaatattggaccaggtcccgctctaactgataactagaatagctagctttgccttcaagtcctttaatgctacagtaataaatacactagagcaagaagtcttctgtcgtggcgaatgttaggtgcacagcgtaaatttgtggaagctttcgcccctcgctctgtatttaagccatcagacactgagttcagccgacttaaccaattattcagtgtaagactcatttagtgattaatcagtgtcattttaaatagtgagttccctgaatacctgttaagtaggattcacgtcttcgaaaagttttatttgcacgaaggtcataacttcagttgcattatgcaaaatttgcccgtaggtcttttaggatctctgcagggttgggtatgttttcatgtttccttataccccccgtaggaggtagggggcagggccgctgccacagaatgggcactactgaggccaagaatgcttgaccccactagggagaatttttgagagcctgacttgggaggtggaagcagg

SEQ ID NO: 104720 - DNA, 386 bp, Homo sapiens
tcgcgacgtgtatccagttatacctaaaaatgtggtaacactataaagaaaagcaggaaataactgatataaattactttctgggaaaaaaggataaaggaattaacaaggaccacgtaaggagcctctaagataatgacaacagtgtttttatttcttcagctacgtagggggtacaacagttggggtttttttattactatcctttaaaatatgtgtgtggtaaattataatcattatgaacgatctcttttctaaaaagaaaaaatgctgaactgaggttgagaatgtcaagtcgtgaacgtagaattataccccatgtgaactcaattctaacaaacggcctacaaaaaatggagtacacatggtgataacacgttcgcgag

SEQ ID NO: 104721 - DNA, 269 bp, Homo sapiens
ttttctctcccctgtgctagatctcctgtcctcattcttagtaaaacatatctttcattagcttcaggaaaaatgatgtgtaggaggtaatcttttttgagtcttgcatgtctgaaaatgtctttatgctattctcaaatttgactaatagtttacagctaaatatacaattctggactggaaaaaaatttccttcagaattttgagggcattcctcattgttctctagcttctgatattgcttattgtaagtccgcagcctttctgat

SEQ ID NO: 104722 - DNA, 796 bp, Homo sapiens
tttgattgacttgtccccagaacttcaatattgactttgatgccatatttaagaattacaatctagggacacaggccccattggaaataccatcaaacctgtcatttaaaaaaaaagtctcagaaataggtttttgtgactctactattactactaatgatatagccacaccactattgaggttttaatattaatttttggtgtgggagaatggttcagaacatcttagattatagactataaatagtgtgctatgataggctggctttgttgaggttaaacataaaaagaaacatctgattaaagagaaggtcatgcaaatcaacttactttgatccttttccttaacttgccccaaaacgcagccttggagatagaacgttcatctcagccctgttccacggagcattccagctgccgaaagcagggataagataactgcagcttctgtggcaaaagagcaagtgtctgaagggatgattcctaaatactcagtaacctccgaaaaaaactccccctgaaccgtaagcagccagcacatcagaacttactggaatagttctcttaggttacataacatcgattcgattatgctaccggagccatgcattaaattttaacttgtcacagatacattacattaacacttcacaaatccacagagtaccaggtagctttggggtgttggtaattgtgtaggacttgctgcaatccaggcaaaaatacttacttgtacattttgtttcttctgtactatagtttaactcttttcaggggtgcaaacatcctgcaaata

SEQ ID NO: 104723 - DNA, 225 bp, Homo sapiens
cagaggctgggccaggacagcctcacgcctgagcaggtggcctggcgcaagctgcaggaggagtactacgaagagaaacggcggaaagaggaacagattgggctgcatgggagccgtcctctgcaggacatgatgggcatggggggcatgatggtgagggggcccccgcctccttaccacagcaagcctggggatcagtggccacctgggaggtggtgcgcagct

SEQ ID NO: 104724 - DNA, 454 bp, Homo sapiens
tgagacacagtctcactctgtagcccaagctggagtgcagtggtgcaatctcagctcattgcaacctccacctccggggctcaagcgatttttgtgcctcagcctcctgagtagctgggaccacaggtgtgcgccaccacgcccagctaattttttgtattttagtagagacggggatttgccatgtaacccagggtggtctcgaactcctgagctcaggagatccacctgcctcagcctcctaaagtgttgggattacaggcatgaaccattgcgcccagccagaaaatttttctagagcaggtctatcttctctccattctagaactctctcttatcctccaaatgagccaagattctttcagttcttcaactttcttcagcctcaacctctccccaacctcttgattccttaaagggctgttattttcggaatcaaaagaaaaccaaaccc

SEQ ID NO: 104725 - DNA, 448 bp, Homo sapiens
gaaaaatacaaaacattagctgggtgtgatggtgcgcacttgtagttccagctacttgggggagctgaggcgggaggattgcttgagcccagagaggtcaaggctagagtgagccgagatcgtactgctacattccaacccgggtaacaaagtaagaccttgtctcaaataaaaaaaagaaaaaaacaatttgcggtaaaccgtttgtcagtgaccacttctgccaccaggagtagaactgcctgtgtcttcctgcctccacgaccctctcactggagctactggtcggcttgctgcctgtttccctgttttagggtccttcccacctcttaagggaggagtccgaaggagtctacccatgggcctgcttgctctttctcccactgctggctgacctcatccacgccagtttcttcaaccactcctcatacattcattgtgcccagat

SEQ ID NO: 104726 - DNA, 266 bp, Homo sapiens
gacaggagaatcgcttgaacccgggaagtggaggttgcagtaaaccaagattgcaccattgcactctagcctgggcaacaagaatgagactccgtctcaaaaaaaaaaaaaagagagagagattttctctatataaaataatgcatgtgtatttcctttatttttactctttttttttaaagtacaaatgatagcactcattaaatactattatgtatcttttctttctcaaagatatatcttggagaccattattttattccata

SEQ ID NO: 104727 - DNA, 378 bp, Homo sapiens
attttctaccacaaccaaaggttctgatttactttcagagaaaaccctcctaggctgggcatgatggctgacaccagtaataccaggtctttggcagcccaaggcagacgggatcatttgaagccaggagtttgagaccagcctgtgcaacacagcaagacacctcccccctaccctcacccaccccactcgtctctacaaaaaataaaaattagcctggtgtggtgacatgtgcttgtaatcccacctactcaggaggtgaggcaggaggatctcttgaacccaggagtttgaggctgcagtgagctatgcttacaccactgcaccaccactctgtctgggtgacagagcaggactgtgccccttgggaaaaaaaaa

SEQ ID NO: 104728 - DNA, 627 bp, Homo sapiens
gggttcacctacattatggaggacagtctgctttactcaaagtccatcaatgtaaatgttagtgtcatctaaaagtactctcacagaaagacccataataatgtttacccaaatatctgggcacactgtggttcatccaagatgacacataaaattaaccatcatggacatcttaatttgaggcagccagtgtgtctgcactctaggggaagggtcggcaaactacagtccacaggacaaatctgttttgtaagtaaaggtttgggaattcagccacacttgttcatgtacatattgtctatggctgcttttgcagtaccatgccaaaactgagtgttctaatgagaccatatggcgtacaaaaccgaaatttgactctgtctgtacagaatggctgatccctgttttaggcagttatgtgcccagctaaatactgggattatttagagagagagaaaggaaatggtggtaggcagatagcaatcttgatccacagcagcataaaggacttgctgctgagatcttctaagaaatctcccagccattcagcagcaatttttttgtgcaatctatgagatactgaaggaattacaaagaagtacaagccatttcccccaatctcaggaa

SEQ ID NO: 104729 - DNA, 320 bp, Homo sapiens
tctaacatagatctatgatcgaattctgtcaatttcctctcaagagggtgagacgattgaattggataaacctgtcatggcagagggcaatgtggaagtttggcttaattctcttttggaagaatctcagtcctcattgcatcttgtgattcgccaggcagccgcaaatattcaagaaacaggtttccaactaactgaatttctttcatccttccctgctcaggtcagtgtattgaaatttgaaagtatgttttgtaaaatagtcattttaagtctcagacattacctattgtaagcttcaaaaatggctataatttaac

SEQ ID NO: 104730 - DNA, 394 bp, Homo sapiens
taatataaagaaaagtggtttatttggttcatggttctgtacatttgttcaaagtctcaccgtacccactcttacttgtcccctgcctcgggggttatctgagcctttcagaaatgcagcagcggtcatcagaaactttgagaatttgcccagagcacttgaaggtgtttccagacctgggaggtttctggtcacagccaagggtgagcagcagggtggggaagggaatctcatcccccagaggcagacagagctcagcctgaagaccctggcccagcacttccctgctggggatgaccccgggcaagttagcaggctccctgtgcttcagttttctcttctgtaaaatggggacactagttcctgtatcatagggttgctgtactaatcaagt

SEQ ID NO: 104731 - DNA, 690 bp, Homo sapiens
gatgtgctgtgagcatttgtctttcagctcttcttcagcatggaaatatttaaaccacaggctcttctctgccaccacggatgtgctagctttcaggagcagattaagatttgggtgactggggccgggcgcggtggctcgcgcctgtaatcccagcactttgggaggctgaggcgggcagatcaccaagtcaggagatgaaggctaacacggtgaaaccccgtctctactaaaaatacaaaaaaattagccaggcgtggtgggcggctttgtcccagctactcaggaggctgaggcaggagaatggcgtgaacccaggagacggaggttgcagtgagctgagatcatgccactgcactccagcctgggcgacagagtgagactccgtctcaaaaaaaaaaaaaaaaaaaaaagatttgggtgactggcccagtacctgaaaacatacattcccatggttttcagacttctttccgagcagggccctttcttcaaataaaatctcacatgacacccaaacagacatagcagatcccaggagagctgcccagaggaaacccagagttgtgttcactcagtccccagcccccagcagccttgaaagcccaaaagctggccagccgcggtggctcacgcctgtaatctcagcacttttgggaggccaaggtgggcggatcaccggaggtcagg

SEQ ID NO: 104732 - DNA, 182 bp, Homo sapiens
aggcagaaccattcctgtggtagttgcctctgcactaccttatttaaaactgacaatagcccatcaaggtaattatcacaggcctgttctcaggcaaggaaactgagacctagagtcattacagagaatagctaaggccccatgactgcaggaggcaggagaaggatttgactttaagttca

SEQ ID NO: 104733 - DNA, 333 bp, Homo sapiens
gtcaagtgaaaaatagagataaaaagtaaagtaatttgagtcaaaaatctctttgcttctagcatcaaaacagttcaggcaaaaatcttttattttttttcatgtatttttcctttgcaaacatcagggcatcataaagggatatcttcaaactgaattgataccacttagtattaaactcaaaacagttgtaagtaaaatattaatattttattggatctctcataactcactcatcactaccgtggtgtgctatgtttacattaaaaggagaatctaacacttggcggcggggagggggcaaactagctatgtgctataaactgccgcaag

SEQ ID NO: 104734 - DNA, 297 bp, Homo sapiens
cagtcaaaaacttcaatactttttctaaataatttataaaacaagtagacagtaaggaaatagaatagaataatactaactgacttgacctaagtgttgttaatggaatatgataccatgaacagaatacataatattttcaaatgaaagtgaaaaaatttaccaagacatatcacattacaggccatcaaacagacctacaaattaaaaatattagaaatgatgtgaattatttttttaaaacaaaattaaacataattagtaacaaaatctgcaaattttcaaaatatttataat

SEQ ID NO: 104735 - DNA, 337 bp, Homo sapiens
tctgagacccctgcagccacctcagggcagcgggctcaggatgccaggcccaaggctcagcgtgggcatgtgaagtgttttggggacagaagggcgcgcccaggggaggacctgcttccgcaggaggaacagagcagcatatggtttgggcagctggtcttcagaagctcgcggcttcgggagtgaaaattacctgacggggccccggcctagctctcctcctggcaccccagtgctggccatggacacagccattccctgcccacgcagcctgcccagtggtgccccagctttgcagctgccaaggagaaaggcagctttgttgacctcagggcct

SEQ ID NO: 104736 - DNA, 422 bp, Homo sapiens
ggagctgttggaaatttaaggtttgcttcaagtggttctggaaattaattggtctttgttctctactcacgattttaggggttaaagttgagactcgagattaaaatatgggttataagcatgagtgtgatcgcttctgaatagctagacgtttttaagttgtataaagaatgagtttcagccaggcgcggtggctcaggcctgttatcccagcactttgggaggccgaagcgggcggatcacgaggtcaggagatcgagaccatcctggctaacacggtgagaccccgtctctgctaaaaatacaaaacattagccgggcgtggtggcgggcgcctgcagtcccagctgctcgggaggctgaggcaggagaatggcgtgaacccgggaggcggagcttgcagtgagccgagatcgcgccac

SEQ ID NO: 104737 - DNA, 964 bp, Homo sapiens
gaagagggccgtcctctggagccgagagagtctggttgaagccccaggtctgtggtcgtttgttagggctgcgggagctgagactccccgggggctccagggcctcatcattcgccaggggttttgaggcagcttctcctgaaatccggagtttctggggaaggacagcagcagtgggcatctggttcacccagatccgtcagccaccgtctgcctgggctcacagtgtgagtggagcacagaaagcagcgtcttcagggagcttcctgtccactgctgttcagcccccaggttctggagagccgggctttgcgggctcagctctgacccccgtttgtggtggctgagggaacagatctgggggcagacgtggtgtgaacacccagacgtctgtattttcctttcaatcatggcctcagataggccgcaaaaaacacggagccataaatgcagatcactaagggaaagaaaatgctacacactgtgattccaaccctagggggttctggaaaaggcaacaccgtgaggaccaaaaacatcaagagagtgcaggggctaggaaggcacaggcggagcacaggaggtctccggggcatgggctcctctgcatggccccacagtggtgaatccacactgtcacgtgcctgtccacacccacgggactgacggtgccctgggcgagctgggcgggaactctgggcgtggggcgacgacaagggcaggcccagcagctgtgagcagcgtgtcctgtggtgggggaggctgggcagggcaggacgggcaaggcaggggcatggggacttggctgcaccttctgctcattttgctgggagcctaaaactgccctgatatatgcctacttaagaaaatggcttcaggccgggcgcggtagctcacgcctgtaatcccagagctttggagaggctgaggcaggtggatcacctgaggtcaggagttcaagacc

SEQ ID NO: 104738 - DNA, 730 bp, Homo sapiens
gagctactggtgatttttatctatttgcacaaatcttggtttcactgccctcatgtattttattactgaatacattatctgataatcagagttaggaacttcagttttattgtgaatacaattaaatttacagcagaacagtaatttacagacagaagttatctctaaattaaaaattataatctcataacttataatttgtcagtattcacataaaattttcaacatataagtacatgtattttggcataaataaacataattttatagtttataatttctgcatataaatttttctctgtctctattttatttaattataagtgagttttcttcctgtacttgttttcatactttttagagaagttaaaattattagttgataatattttacgactttaataagatgagaaaaatctaattttgaattcatactttttgccccaaatttcattatactaaaaactaataaaaaatgtaaaacaacagtgcttggtgatttaacatccaaacctaacatataagtaattaaccttttaaaaagatttagtctcctttacatatctattcatttatgagcctcaattcttgaaatttatattttttaagtgataaatactttaaaatagttttctttgatgaccaaaagttttaaccctaatcagatttcaaatactaatttagcctccattgtgtggtttggtggcaagaaggaaatatattttttctc

SEQ ID NO: 104739 - DNA, 225 bp, Homo sapiens
gggtcaggccagctacatgctcagcctctgagcctcagctctcagctctcatccagtgagggggcgtggtgctctcagccaagagctgccccgggtgaggagggctgggggtgtcgggggcaggccaggcggcgctcatctctctgtctcccctcactgctgctgctgcaggatctgtgtgaggtagggtcccgagtcctcccctgccctcccctccctgcaccc

SEQ ID NO: 104740 - DNA, 383 bp, Homo sapiens
ccaagggatgttttcaggctctgcaagtgagcccagtgtgctgccagggctgagaaccacagggcaagaaggctgagagaacgggagaaagctggggctcaaagctgcacttcccaagatatccctatgtccacagagtggtcattccttgagatagtcctaaaatagtttttgggaaatgatagatgctatatcatttcccattatatgatatcacatatatcacatgctatatctctttgagggtccttccacagagtattgtcttttaattcattacactgagatttgaacttgcccagcttgtttgaatacggtatcctttattcagtatttccctaatgccatcctattattgatccaagatacgtatgatgggaaac

SEQ ID NO: 104741 - DNA, 392 bp, Homo sapiens
gtaatgttacattttttcaattcaattgagaaaatacttattgagtgccaagaatttgcacagcattttgcaatgaatgattggtgatgccaaaatgatgagagatgttctctgctaatttatggagcagataattatttccccaaaaccccaaaatttataagacaaattctgaaatgcacagtaattatttatttctacatttgctaaattcatgctatatgaaaggcattttgaaaagcaatgatcatattagacaaaaagacccaggccttatctttaaatatcacataatcaaaatttagacacacaaagaagcacggaattagagactataacaattgctataaagaacataggcacatatacagtgtgcctctgagccatatata

SEQ ID NO: 104742 - DNA, 211 bp, Homo sapiens
acttttcacccaatttcaccttcccccatactcccatataattatgtttcaattttggttaaaccaatatgagatgattgcattgttgctgaacaagaggtacaatattacgttctctttttgtatacaaagactattaatttagagacctagagctttcagatcttggaggggttcttctatctcaataactacccaacccccattttct

SEQ ID NO: 104743 - DNA, 367 bp, Homo sapiens
aaggaacccaccgggtacaagacatgctccgtacctcaccgtccagttgcccatctccagagcccacagcacccttccaccctgagcactgtgggatggagtctggtatcctaagagggccccaggtacatggctggctggccaggcccaccttatttggatctgattctgatccataaggcacccttctcagaactctataaagataaagcacctttgcagagaggctttactattgccacaactgagactacaggagagggaaagtcagccagacccaaaagctggccttaaaaggcccagctccccaaaggccaaagccccacacagctacacagagcccagccccaggtggccagcagaggcc

SEQ ID NO: 104744 - DNA, 533 bp, Homo sapiens
gatagccagtctgtgaggcactggcatgaaggactaacaggttttctgtgtgccgtctttcccctgacagtcacacccttcttaatttggcattttatcttttgtgcttcaacacatagaacagctatgttttctcaggaaatacttgctgtttctgaaatgtctccacttttctttgatacaaatgtcataaacgcatatactgaaacagatgaaattgcgacggatcaccctgtttcttcacctgaatttagaattcgaggagacctaggaattatgttcaatcacgccatttcacaatgaagaaattaaggtccactggagctaagatattaccaagggtcaccctgctaggaatcagaaaagccgaggtttagaacagatttcactaatcagaatcgtccctttgaaaagtccatgttccattgtaaaattcacttagcgttttggcgttttgtcatgtttacacattacagctttcctagttataaaaaatatcagtaatttttttttttttttgagatggagtctca

SEQ ID NO: 104745 - DNA, 374 bp, Homo sapiens
gcatctaatttatgtttcagttgctttattggctccctgtaaagcaaaatattgacaataaaattgctatttttgtcttaccagctaccacatggtctttgttcctctgtctttaatggttgcatgctcttctcttccaaatgcctccctgttcccttgacagaaagccacggcaatggtggttccagaataatgtctgtaatctttaccagcaaactgtctatcctgctgaccctgtggaaaactaggaacatattgaatatatcacagaacaaattaagggtgtgaggtttaatgcagccaaggaagtgatcataatgccacatgtctgggaactttgagtgattcttagagcttcagcttatagagttact

SEQ ID NO: 104746 - DNA, 271 bp, Homo sapiens
tatctctatcaaatatgtgaaaacaaaagtggtctccttgatttccatgtaattatggttcagggtatgtcagaaaaactcaaaaacagattagaaagtactttcaaaggctatgggaggatttaaacgattactattggtatccaagaccctcaggttagcctcccaggaatcatggtgttcagaggttgtattttgggaatactcatgagcagatatgcaagagattatacaatgctggcaatgtagcatggcttaaatgtaatgttcc

SEQ ID NO: 104747 - DNA, 187 bp, Homo sapiens
ttactctgggatgcctagaacttataaaaaccaagacagggatctaactccaagtaaaaaatatttacctctttattgttttataccagtaaagtttgattcaatatgtagtcatctggaaaactagaacaatcttttcttatacaaattaacttcctccctcttcattgtgacatagcatgaaggc

SEQ ID NO: 104748 - DNA, 345 bp, Homo sapiens
ctgccccagcttcccaagtagctgctgggttataggttcatactaccgcagctggtgggatttctcttaagttagaggggctgggctgtagctgcattattttgagggtcatcccaaggcccaccttcctgtctagtgagggctccagaacacaagttcactctcagagtctgtcgggagccgcgggggggaatagtgctgggcattttgtccccagtgcaggaataagggtgccagccagtccagagtgggatcctgaggcagctgaagggatttgcgtaacctttcaagtcattgagcttggccatctcaccctcccacctctactgggcccaggccccagtg

SEQ ID NO: 104749 - DNA, 495 bp, Homo sapiens
ggaaggggagagggaggggactatattttttaaaaagaatgaagaatctagtgttttggatttggaaaataagttcatatttcataaataatatgatcagttgtctaaatcaaaatagtcatgcttgggaaaatgttcataattagcttaagtggggaaaaatacaacatacattctatcatctcaatctctgtgtacatgtgtcggaaggaaatagatcaaaatgataatagcttctgtcacccactgggctgtaggattttgaatggaatgatttttatgttcttttttatatctttcaactttttaaaagcacacatattttataattaaagaagtactttaaaaaaataaaatagggtaggcgcagtggccattcctgtaatcccagcactttgggaggctgaggtggctggatcacttgaggctgggagttggagaccagcctggccaacatggtgaaactctgtgtctactaaaaatacaaaaattagc

SEQ ID NO: 104750 - DNA, 375 bp, Homo sapiens
actgttccttccctgcatctatcctcaacagacctgccagagattgattcaaatcacatcactcctctgtttgtaagtttcatcatgtcactctgcccagaatcccccagtggcttcctatctctcactcacagttcatgccaaggtctttacaatgatcttctgggccctatatgacctgacctgtctgtacccagctcccaccatcctttcctgccatcatcctttccctccttcattctgctccagccacgctgacctctctgctgttcctcagacctaccaggaactattcccacctcagggcctttggacttgctgttccttcagctgatattcttctcctagacatcctcacttccttcaagtcctccc

SEQ ID NO: 104751 - DNA, 539 bp, Homo sapiens
aacaggaaatgggattgcaaacctagtagctgcgcgtgccggctattcaggactagcgcaggactctgggcgacctcacatcccactcgtgctgctgccccgggcactcgcctcccgcgaaaagtcgtgggaccacgtcgaatatggggagtatcctttcctgtttgaaaagctgctcttagggcatagggaaaggtggggagggcagaggttgggaccctgggaggtgcctggtagtgacctttttggtctagctgtggagggctgagagcgctggcaccgattggtgggctccagcagcttggttttagtttttctgttttttgtttttttttttcctgggactcgctgccatcctagaatcaggggaggtgggactgctttaaagaatggtcaggggagtcgccgcactggtttgagatttagagcgcgagccctcccactctgagagcttctgtcacctgtcctttagtgaattcgtcctctttgaaattgttgggaaactgtgcgagaacagaggcaaggcaacaggagtttgc

SEQ ID NO: 104752 - DNA, 405 bp, Homo sapiens
gtcgacttttaaaagcagtgctgcaaagaatatatatgcatgtatcagaaaatttttgtaaatgttgatttttttttaatgtaatgggagttgaatctagaaaggactaaataattatcagtaaagtataaatcaaacaattattattgtaaggtacccatgtgttcaataagaatcaacatttacggctgggtgtggtggctcacgcctgtaaccccaacaccttgggaggctgaggcggatggatcacttgaggtcaggagttcgagaccagcctgaccaacatggagaaaccccatctctactaaaatacaaaattagccaggcgtggtggcgcatgcctgtaatcccagctactcaagaggctgaggcaggagactcgcttgaacccaggaggtggaggtt

SEQ ID NO: 104753 - DNA, 339 bp, Homo sapiens
gagagaggtacgtagttgttatttgaggctaggttttcgaagtgggacatagcgtgttccgaacaaaccgacgtttggcatcactgattgctgtctggagcagtgcttcgcaaaagtttggcacaattaccggtgctggtccttgaagaaacaaatatggaaattgaaagcgtttaaaaccttttgaaagcaatataacaataattttatacctgttaaatgtaataaattggggcctgcattttgtatgtttcttttattccatatttctctaaggattcatttttattgttttatgaaactaccagtctgtgacatggaaggtagaggaaaaagatt

SEQ ID NO: 104754 - DNA, 559 bp, Homo sapiens
tgagacagagtctcactctgttgcccaggctggagtgcagtggtgtgatctcagctcactggaaactctgcctcccgggttcaaacgattctcctgcctcagcctcctgagttgctgggactacaggtgtgcactaccatgcctggctaatttttgtatttttagtagagacggggtttccccatgttggccaggctggtctcaaattcctgacctcaagtgatccacccgcctcggcctcccaaagtaccgggattataggcaggagccaccgcacccagccgagcatctttcactaatcttggtataaaaggctaattatgctgttaagatgtagctaatttaagatttaaataacttttaagtctgatatgttttcttttaaaagcaatatgggagcatcagtggaaagttgaggatagtggtttccaacctggattcccaatccacatttgggggcccctgaaggaaatactaggcaataataatgaagatctgaaaagttattgctaagtatcaaaatgaagattcacaactacatcttactaagctcacatac

SEQ ID NO: 104755 - DNA, 390 bp, Homo sapiens
aattcctgatcccatctaaatcatgttaatacctgtcataaacagataactaacagattaataagcagcttatatacaggcttagctacaaatcattccatataatattttacacaaactgttttttcctagttttgtgttgaagtgaatgaagctctagaaagccaaaggacagaaggagccaggacctctgagtcatttggaggagtgctaccctagaaagccacccctatcatgttaaaccacaaatttgggacttgtttgctatagtagatagtgctaattctatgtaatatactctcgtttttacttctcatagcatttattgttctctaccataaataattattcgcgtaaatatattttttcattttagtctattagttgctt

SEQ ID NO: 104756 - DNA, 358 bp, Homo sapiens
cctgtgccacagtgcaggaagaaaaggaacagagagatcacgggcatgtttttttaggtggtttcatgccatcttattttctccttgaaatacattcacattttgtgttgaagtgaatgaagctctagaaagccaaaggacagaaggagccaggacctctgagtcatttggaggagtgctaccctagaaagccacccctatcatgttaaaccacaaatttgggacttgtttgctatagtagatagtgctaattctatgtaatatactctcgtttttacttctcatagcatttattgttctctaccataaataattattcgcgtaaatatattttttcattttagtctattagttgctt

SEQ ID NO: 104757 - DNA, 530 bp, Homo sapiens
ttttttttgagacagagtgtcactctgtcacccaggccggagtgcaactggcataatcttggctcactgcaacctccccacctctcaggctcaagtgatcctcccacctcagcctccagagtagctgggactacaggtgtgtgccatcacgcccagcaaatgttttgtatttttggtagagatgaggtttcgtcatgttgcccaggatggtctctaactcctgagctcagatgatctacctgccttggctttccaaagtgctgggattacaggggtgagccaccatgcctggcctaatgctaattagagagatggttagcataaggtttttattactagtactgtttttgtggactgatatcaatgaataaagtaatggattaaaaattaaaatatgttaccagatcattttaacattattactcctgtgataaaagttaatattttattgggccatattttataacttactatgcatactcaatgtagaaagaaaacaaaatcaaaatcacctttaatcccacatgaaa

SEQ ID NO: 104758 - DNA, 262 bp, Homo sapiens
gtttgactttttcattataaccattctattgggtgaaaaatgatattaaatctgttgttttaatttgcatttccctgatgactaattaagttgaacatctttgcatgtgcatattggccattcatatatcttctttggataaacattgcaagagcacatcttaagttattgtgtacttctatcagggggcacatagtgtatgcttgtctcattttattgggatatcagccattggtataatagattcataataataataata

SEQ ID NO: 104759 - DNA, 501 bp, Homo sapiens
gaatgtgaccctgtctcttaaaaaataaaaataaaaagatatgaatagtgaccatttcaggatggtagggtagactatgaagaattaatttcctctctacttttgtgtatttcctaattttaaaaattagcatacattttatttcttaaagccttattttttaaattaaaaagcatgaagggagggagggtgagaagagatcttctgatttgccagccaggtactccttctccagccccctccccgcaatccagccatcttattgtcctgtggcaggtggcctgtcccccagaggggacagtgggttaagtgcatgaacatacctgagagtttgctgcccctgtgaggtgagtcctgcctgacactgagccattgctgtgtctatgggcttttgcctgcaaaatcaaagtgctctgcctggggaggggcagtggtcacagggctaaggatcaggcaacacctctaccaccaggaccattgcctgccatcctgggttttacc

SEQ ID NO: 104760 - DNA, 223 bp, Homo sapiens
gtacaactaagagggttgcattttattggtgtaaattttacctcaaaaaatctgacctaaaataaaacagaaaaagtatgatttccacaaaagatgcaatttgagaacacaactgttcctttttttctatgtaccctactaaaggtgctcatccaggattctgtctttggcattaacttcacgttattagactctcctgtgccactgtatggtatctactccc

SEQ ID NO: 104761 - DNA, 331 bp, Homo sapiens
catcctacccagcagttgaaactactgcagcgaaactgcaaggaaacctaacccatgttttcttgtaatgctaccctttgggggtcatgcatgctgctttctgctccaacagtcttaacgtgggaattggggacacttactttttgacctggaacaaatctctaagactcgtaagccaccaattgattcaccttttgtagcagggcttgtatgacaaactcttttgtgagaacaaaaggaaagtcccttccctttttgccattcttgttctgtagattaattagcaaagacgtagtggagaaatgtgtcacttgcaagacatttctggcac

SEQ ID NO: 104762 - DNA, 279 bp, Homo sapiens
aaatgcaaaacaatgaaactcatagaaaataacataggaaaaaatctcagtaatcttggatattgtgatgactttttagttacagcaccaaaggcactatctgtgaaagaaatccctgattagctggacttcattaaaattgtaaacttccactctgtgaaagacaatgtcaagagaatgagaatacaaaccacaggttgagaaaaatacagatggtgctgacttaaaacggttcaacttacgatttttcaactttacgacagtgcaaaagtgatactc

SEQ ID NO: 104763 - DNA, 681 bp, Homo sapiens
ttgattatagcaactacatgaggacatatatttaacagtgaaatgaagatactttatttcaggggaaaaatgacttttaagaggctctaattttttttcttggctttgcacagacaaaatcaccacattttgctcaaccctaattttgtcatttataaaatgaaacgtttagcctaaataatctctcaggtctctttccaactcgtaccatgaatctgagagacctggaaaggaagtgggacaacatttctgttgtgaagaaggcaaggctggtgatgtgggcgtgaaggttaaagatgctggcccctcatgacattggcgaacgtggcccttcttccacctgctcagccagaaacgctactgagtgcagacgtttgtatactaagaggtatttgggtgcatacgatttaatccttagcctgatgagcttataagtgtgaagagaagcaagactgttcacaaattgctaaaacaaaatatgatgctacatttacccaacaaacctaagattctgtgtacaaaacattgcagtagtatcactggaattgtgtgtgggctgctgtgagttcagcgtcctctcagagcaccgtggttccaagtggacggaccttaaagggttccataatcaggacaggttgaaagaatagtgaatgccacacaaatgcccccacacccttgacc

SEQ ID NO: 104764 - DNA, 728 bp, Homo sapiens
gtataggtatgtggttggcagggacatgaaggatgctgaagaaaggagagcctgggctgggcatgatggctcatgcctgtaataccagcacttagggaggctgaggtgggtggatcacttgaggtcaggagttcaagaccagcctggccaacatggtgaaaccctgcctctactaaaaatagaaaaagctactaaaaatagaaaaggaaaaattagccaggtgtggtggtgcactcctgtaatcctaactactcaggaggctgaggtgggaggattgcttaaacctaggagggagaggttgcagtgagccaagatcgcaccactgtactctccagcctaggcgacagagtgagatttcatcgataaataaataaataaaaatacaaaaattagatgggcatagtggcatgcatctgtaatcccagctactcgggaggctgaggcagaagaatcacttgaacccgattaaagggaggcagaggttgcagtgagccaagatcgtgccactgcactccagcccgggtgacagagcaagactgtctcgcaaaataaaaatacaaaagaaaggagagcctggagccggagagaaagctgggaggtggttgtggtattccttgacacaaagagatgaggattttggttagaggaatggctgtgaaaatggtgagaaaatgtgaatactataggcaattcagaggaataaatgagagaccatcatcctttttttt

SEQ ID NO: 104765 - DNA, 223 bp, Homo sapiens
cagtaaagttgctcttcggcaagctttacatgtggtcagaggtggcttgtattggtcattctttcatgcccgtgtactatcaggctgtttctggtccgcctgctactgctcattccagggtgattttttacctcctccaggctacagatcaattcttcctttaggttttctttgtgtcagaatatgcctttaactcgctctttcagaagatatcataggatgg

SEQ ID NO: 104766 - DNA, 815 bp, Homo sapiens
tttataggtgttttgaaatacacaatacattgctgttaacaatagttactctactctgctattaaacattataaattattccttcttggccatatgtggtggcttacacctgtaatcccagcacttgaggaggctacagtgggaggatagcttgaggccaggaatttgagacaagcctggacgacatagccagaatccatatctacaaaaaaattcctctcatgaactgtgtatttgtatacatcaatcaacctctctttatcccctcaccacctttacactgaagtatatcattctactctctacatccatgagaccaagtttttagcttccacatatgagtgagaacatgaggtatttgtctgatggtgcctggtttatttcacttagcataatgacctccagttccatccatattgcagcaaatgacatgatttaattctttgttatgaccaaacagtattcaaataggtatatataccacattttttttatccattcatctattgatggacacttagcttaattccatatcttgaatattatgaatagtgctgcaataaaaatgggagtgtaggtatccctttgacatatactaatttatttgcctttgaataaatacatagtagagggattgctggattatatggtagttttatttttggtgttttgtaaatctccatactgtttaccatagtggctgtactaatttacatttccgctgacggtgtataagagttcccttttctccatattgtcaccaacagctgttaatttttctctttttaatctagccattctgaggttagatgtta

SEQ ID NO: 104767 - DNA, 550 bp, Homo sapiens
  misc_feature (465)..(465): n is a, c, g, or t
gtaaaaactgaagttgaaaaaaatgtattcatgctaatagcacaggaatgatccacaattggattccaaggcttcttgtacattcagcatagggtgtatgaaagagtccactattctagcaacagataaaattcctactgacacgcaacctcaggttcccactcgtttagaaggctgcgtatggtcttctacttaaagcctcaagtagcagtcatggcagtgacaaatcctcattgcctccatagaacctctaggctcatgtgtgagcccaggctgggctggggcccctgggagcccagggtgaggggccagtccctgggcagctccgtgagccaggagcagctgtgccacctggggaagggctgcacggtcgatgggtcttttctgcagaagagtgtgccccagcccttgctgggcacagatcaaagaggtgttcatgggtcgaaatacaattaaagctgtttnagatagtggggcctgggctagccattaaaattaagggtttttcaagtgaaaaagtttttccccattcccggcttcccacctgggt

SEQ ID NO: 104768 - DNA, 440 bp, Homo sapiens
gaggtttgtagtggtgtttattcttgctccttcctcgtggttcctaaacttttgatttttgtgaaatgaaggaaatatggttataggccccagctgcaggggagacttggttgcccctgggtataagcacctcagtgtggatttccatgtcatcaagcaattttagcagatacatttttttgaagggggctgacagtaattggtttttctttgcaagtgctgataggcaggcagtggtgtcactcttgcccgaattacttagagcacaagcatcatacataaaaaccctttatttatttgtttatttatttatttcaaaccaaaaataaacaattatgaagagcatgtggccaaaatgaaaactcagcttttggtttatttccaatgcctccttgctctccaacatctttatgttgtttatcaaaaccataagttagttc

SEQ ID NO: 104769 - DNA, 312 bp, Homo sapiens
gtcaaagtctatacactgttaggatgggactgtacagttttaatatgagtctttcgggttaggctttaagaaaagaagaagaatctgcttggcttgtgattattgaagccaatgtttttaatgccagaactgattcttctaccacttgtgacttctgtttgaaagttgctattaaggtcttaaggaaaggattttcccacacacatgtttctgaataacctattctggtcaagttcacagtcttgacctgccaccatgtttcatcctacctggtctgggtgcccagagacctggagcatctgagctggcagg

SEQ ID NO: 104770 - DNA, 516 bp, Homo sapiens
tcccattcatgagggctctaccctcatgacctaaccacatcccaaaggccccacctgctaacgctatcacattggtgattagctttcaacacgtgaattttgggggcatagtgggtccacctggatggtccaggataatctccccatctcaaaaaattgaatcacatcttcaaagtcacttttgccatataaggtctaatcttgggttctagggattgggatgtggatatatttggaggttgtatgtgggagaggggctggatggggctaattcctaatctgggcttgactgcatggctggaagaggtggtctggcagactaggaggaaggtctgggagcaaaacatggctcactttgagatgagggggccaagccggcccaccacttgggcagacctgccatcatcaccgactctcgtgggccgctgtcagaattcaggcagatgcgagaccaccagcttctcctgcgatctggctttgggaggcagtggaagacagatctttgaaagcagcacg

SEQ ID NO: 104771 - DNA, 114 bp, Homo sapiens
gtatttgtagaagttaacattctggaacactgacttccaacacagcaagagggacagccacacatgtaaaatacaatgacagagcaggactcacaagtgcattctgctgaaaag

SEQ ID NO: 104772 - DNA, 461 bp, Homo sapiens
tgcatctggctctcagaggtacattacaataggtaccatgtttacattatcgtaagtgaacacgacttttatcctgaaaatttctggctgggcgcagtggctcacacctgtaatcccagcacttggggaggccgaggtttcaccatgttggtcaggatggtcttgatttctgtgtttttatgtttgtctcttcttccaaatatgtctgaggatcttaggataatatgtaaataacaattgatagcaaatacataatggatttgccaaaaatgactatttataatctttattccacttaatgggataaatatttacacagtgattactttgcatcaggcactgttctaactgttttatggatattaacccatatagtcctcataacaagtttatgagttcaactcatttcattacattgtcaattttataggtgatgaaatggaggcacagaaaggttagta

SEQ ID NO: 104773 - DNA, 111 bp, Homo sapiens
tgagattctgtgatgtgagtagaatcaagggcttaaagctgaaggggatctcaagaggttagcgaatgcagtctccttcatcaaatggtgacaatattacacacccatttt

SEQ ID NO: 104774 - DNA, 335 bp, Homo sapiens
aggacttaaagattatctagtcaagaggttgcaaactataggcctttggtgtggctcccacacatgggattttgtttggataacacagtattttaaaggcctttggatttaacatttaaacattgggaaagctcacatgaaacccagatttgtggcttcacttggcagcacggggcccacattcctacatctgacaatctgcaggagctaaatagtggctgttctcttttggaatgacccgtttgcttcagtattgcacagtctctacctgtgcacttcactctttacctctggtgagtgttacaatcccggtctaatccagtctacccatttta

SEQ ID NO: 104775 - DNA, 804 bp, Homo sapiens
atatcgtcgacccacgccgtcgttattagacatgcctttcatgtaagcataaagacaacaaacagttattactgaatatatacattctttgcttttaaattcaaattactctatacttaatataattatcaatatctaaaatataattcttatgtattttatttatatggaaatatgtaagcacaggtattaattataacttcatttttattacattctgattgaacattaccaagtgtttaaactctgttgttcccttatgttttcataataaatattttcattgtttactttccacatagaaacttgttaatttaatacaatttacaacacacctgctggcactttgatcttggacctccctgctgtctgaactgtgagtaatatatctgtatggttaatagattgcttagtttgtgatattttattatagcagtacaaacaaagtaagattactctctattttatttaccagttagcctgtatctgctccccaaattctaatacaaatatttatttcaatgttggaaactttgtcattaatacactatctattcaatatccaattaggtatatccacataattcctttacgtcttctttttgaatatccaagttttcattgggaaggtgtgcttaatctattgaagaaatttaaattttattttctttagagtttgtaataactaattcactccaattttttaaattccttgaaaattattttgtttcatgttacattaaaagtatattttcacttcttattgacttccaacttagccataacccataggaaaccagatat

SEQ ID NO: 104776 - DNA, 3305 bp, Homo sapiens
actgggctcgtgcggggccccgggcgtcgcgatgaacatcgtggtggagttcttcgtggtcactttcaaagtgctctgggcgttcgtgctggccgcggcgcgctggctggtgcggcccaaggagaagagcgtggcgggccaggtgtgcctcatcaccggcgccggcagcggcctgggccgcctcttcgcgctggagttcgcccggcgtcgggcgctgctggtgctgtgggacatcaacacgcaaagcaacgaggagacggctggcatggtgcgccacatctaccgcgacctggaggcggccgacgccgctgcgctgcaagctgggaatggtgaggaagaaattctgccccactgtaacttgcaggtttttacctacacctgtgacgtggggaagagggagaacgtctacctgacggctgaaagagtccgcaaggaggttggcgaagtctcagtcctggtcaataatgctggtgtggtctctgggcatcaccttctggaatgtcctgatgagctcattgagagaaccatgatggtcaattgccatgcacacttctggaccactaaggcttttcttcctacgatgctggagattaatcatggtcatattgtgacagttgcaagttccttgggattgttcagtactgccggagttgaggattactgtgccagtaaatttggagttgtgggttttcatgaatccctgagccatgaactaaaggctgctgaaaaggatggaattaaaacaaccttggtttgcccttatcttgtagacactggcatgttcagaggctgccgaatcaggaaagaaattgagccttttctgccacctctgaagcctgattactgtgtgaagcaggccatgaaggccatcctcactgaccagcccatgatctgcactccccgcctcatgtacatcgtgaccttcatgaagagcatcctaccatttgaagcagttgtgtgcatgtatcggttcctaggagcggacaagtgtatgtacccctttattgctcaaagaaagcaagccacaaacaataatgaagcaaaaaatggaatctaagaatctttttgtatggaatattacttctatcagaagatgatcaagatgtttcagtccagtgcacatcagcattgctgacattttatggattctaaacttgtgttgtttcttttttaaatcaactttttaaaaaaataaagtgtaaattaaccgactagagtacttggaaaatgtgatcagtacaagtgaacttaggttgttgccaacagggtccttttaggcagaacccagaaaccagtcaaatctgtagagaagcagtgtgacatcttcaggttaccattattttttaatgagcaggaagtctagaaatgataactagactgtatgtttcatgtgtgtgatttttcagaattcccagagtttactcattcttgttattaaactctagccagttgacatcttcgcaatttcaaggactgatagtgctgtattttctcacgttttctaagtttccgttttgcaaggcctaggtgactttttcatggtgttgtatgtttagctcttttgaaaaggaattttgaaatctccatcaactgaagtaaatgatgtctgagtgttacagtaaaggtgaccaagtctctttcttaaagtcacaatgactaaagtattagttgaattttttttttttttttttggatggagtctcgctcttgtcaccaggctggagtgcagtagcacaatcacggctcactgcaatctctgcctcccggtttcaaggtgattctgctgtctcagcctcccaagtagctgggactacaggcatgcgccaccacgcccagctaatttttgtatttttagtagagacggggtttcaccatgttggtcaggatggtctccatctcttgacattgtgatccacctgcctcggcctcccaaagtgctgggattacaggcatgagccactgcacccagccttgaatttttaattttatctctgatatacttcattaagtgtctggagacctaattatcctaaaagatcatacattttctacctatgaattttgctgcatacagaaagtgccctttcctcaggaagttgctgtgtttcatttctttggatggactcttatctagaatacatagcagctctgcaaagaaacagtttttaaaaatgggaacttctacattgaaaagtccccatttttgtgccaactatgattagtgagaggaagaaatcttattctatggcatatgtatggaagggtgtaaagattcttttgaaaggtttattcacattgtagaacagcaaatgacatttttacagtatttttttgtaaagcaaactattttgtgccttgaatttggtatatgtgtattagtgaaacattgtaaaggtgaacttctacctctgtatctaaatgtataccatccacttgtaaatgactataaactattatgtgattgcttttttttttagaatgtcttgtttaaatagtggccaatgtttaaggctgttaaaataagccaacttttactaattggggagttttataaatgactgattaaatttaaagaattaacttacatgcaattgtgtgattattagttatcagcagtgttgtaaggaaaattattgtgtttttttttatgatcattatcccactttaggtaaagaaaaatattggaatggaatagtgttgggaaacagacattaacaacctagggtgcctgcactcaaatagccgatgttactgtccctagattagagacttgattaagggcttgtttgtaccaaaagtggggaaacaatgccatgacctgtgttttagtttggctgcaccacagatcaaatctgcactgtgtctacatataggaaaggtcctggtgtgtgctaatgttcccaatgcaggacttgaggaagagctctgttatatgtttccatttctctttatcaaagataaccaaaccttatggcccttataacaatggaggcactggctgcctcttaattttcaatcatggacctaaagaagtactctgaagggtctcaacaatgccaggtggggacagatatactcagagattatccaggtctgcctcccagcgagcctggagtacaccagaccctcctagagaaatctgttataatttaacaacccacttatccaccttaaaactgaggaaagtcgtctttacatctaattttattcttgtgtgttataacttaaacctatttctatttttgtttgttattgcccttataagggtgtccatctccaagttcaataaactaattcatttaact

SEQ ID NO: 104777 - DNA, 3251 bp, Homo sapiens
actgggctcgtgcggggccccgggcgtcgcgatgaacatcgtggtggagttcttcgtggtcactttcaaagtgctctgggcgttcgtgctggccgcggcgcgctggctggtgcggcccaaggagaagagcgtggcgggccaggtgtgcctcatcaccggcgccggcagcggcctgggccgcctcttcgcgctggagttcgcccggcgtcgggcgctgctggtgctgtgggacatcaacacgcaaagcaacgaggagacggctggcatggtgcgccacatctaccgcgacctggaggcggccgacgccgctgcgctgcaagctgggaatggtgaggaagaaattctgccccactgtaacttgcaggtttttacctacacctgtgacgtggggaagagggagaacgtctacctgacggctgaaagagtccgcaaggaggttggcgaagtctcagtcctggtcaataatgctggtgtggtctctgggcatcaccttctggaatgtcctgatgagctcattgagagaaccatgatggtcaattgccatgcacacttctggaccactaaggcttttcttcctacgatgctggagattaatcatggtcatattgtgacagttgcaagttccttgggattgttcagtactgccggagttgaggattactgtgccagtaaatttggagttgtgggttttcatgaatccctgagccatgaactaaaggctgctgaaaaggatggaattaaaacaacgaaagaaattgagccttttctgccacctctgaagcctgattactgtgtgaagcaggccatgaaggccatcctcactgaccagcccatgatctgcactccccgcctcatgtacatcgtgaccttcatgaagagcatcctaccatttgaagcagttgtgtgcatgtatcggttcctaggagcggacaagtgtatgtacccctttattgctcaaagaaagcaagccacaaacaataatgaagcaaaaaatggaatctaagaatctttttgtatggaatattacttctatcagaagatgatcaagatgtttcagtccagtgcacatcagcattgctgacattttatggattctaaacttgtgttgtttcttttttaaatcaactttttaaaaaaataaagtgtaaattaaccgactagagtacttggaaaatgtgatcagtacaagtgaacttaggttgttgccaacagggtccttttaggcagaacccagaaaccagtcaaatctgtagagaagcagtgtgacatcttcaggttaccattattttttaatgagcaggaagtctagaaatgataactagactgtatgtttcatgtgtgtgatttttcagaattcccagagtttactcattcttgttattaaactctagccagttgacatcttcgcaatttcaaggactgatagtgctgtattttctcacgttttctaagtttccgttttgcaaggcctaggtgactttttcatggtgttgtatgtttagctcttttgaaaaggaattttgaaatctccatcaactgaagtaaatgatgtctgagtgttacagtaaaggtgaccaagtctctttcttaaagtcacaatgactaaagtattagttgaattttttttttttttttttggatggagtctcgctcttgtcaccaggctggagtgcagtagcacaatcacggctcactgcaatctctgcctcccggtttcaaggtgattctgctgtctcagcctcccaagtagctgggactacaggcatgcgccaccacgcccagctaatttttgtatttttagtagagacggggtttcaccatgttggtcaggatggtctccatctcttgacattgtgatccacctgcctcggcctcccaaagtgctgggattacaggcatgagccactgcacccagccttgaatttttaattttatctctgatatacttcattaagtgtctggagacctaattatcctaaaagatcatacattttctacctatgaattttgctgcatacagaaagtgccctttcctcaggaagttgctgtgtttcatttctttggatggactcttatctagaatacatagcagctctgcaaagaaacagtttttaaaaatgggaacttctacattgaaaagtccccatttttgtgccaactatgattagtgagaggaagaaatcttattctatggcatatgtatggaagggtgtaaagattcttttgaaaggtttattcacattgtagaacagcaaatgacatttttacagtatttttttgtaaagcaaactattttgtgccttgaatttggtatatgtgtattagtgaaacattgtaaaggtgaacttctacctctgtatctaaatgtataccatccacttgtaaatgactataaactattatgtgattgcttttttttttagaatgtcttgtttaaatagtggccaatgtttaaggctgttaaaataagccaacttttactaattggggagttttataaatgactgattaaatttaaagaattaacttacatgcaattgtgtgattattagttatcagcagtgttgtaaggaaaattattgtgtttttttttatgatcattatcccactttaggtaaagaaaaatattggaatggaatagtgttgggaaacagacattaacaacctagggtgcctgcactcaaatagccgatgttactgtccctagattagagacttgattaagggcttgtttgtaccaaaagtggggaaacaatgccatgacctgtgttttagtttggctgcaccacagatcaaatctgcactgtgtctacatataggaaaggtcctggtgtgtgctaatgttcccaatgcaggacttgaggaagagctctgttatatgtttccatttctctttatcaaagataaccaaaccttatggcccttataacaatggaggcactggctgcctcttaattttcaatcatggacctaaagaagtactctgaagggtctcaacaatgccaggtggggacagatatactcagagattatccaggtctgcctcccagcgagcctggagtacaccagaccctcctagagaaatctgttataatttaacaacccacttatccaccttaaaactgaggaaagtcgtctttacatctaattttattcttgtgtgttataacttaaacctatttctatttttgtttgttattgcccttataagggtgtccatctccaagttcaataaactaattcatttaact

SEQ ID NO: 104778 - DNA, 3171 bp, Homo sapiens
actgggctcgtgcggggccccgggcgtcgcgatgaacatcgtggtggagttcttcgtggtcactttcaaagtgctctgggcgttcgtgctggccgcggcgcgctggctggtgcggcccaaggagaagagcgtggcgggccaggtgtgcctcatcaccggcgccggcagcggcctgggccgcctcttcgcgctggagttcgcccggcgtcgggcgctgctggtgctgtgggacatcaacacgcaaagcaacgaggagacggctggcatggtgcgccacatctaccgcgacctggaggcggccgacgccgctgcgctgcaagctgggaatggtgaggaagaaattctgccccactgtaacttgcaggtttttacctacacctgtgacgtggggaagagggagaacgtctacctgacggctgaaagagtccgcaaggaggttggcgaagtctcagtcctggtcaataatgctggtgtggtctctgggcatcaccttctggaatgtcctgatgagctcattgagagaaccatgatggtcaattgccatgcacacttctggaccactaaggcttttcttcctacgatgctggagattaatcatggtcatattgtgacagttgcaagttccttgggattgttcagtactgccggagttgaggattactgtgccagtaaatttggagttgtgggttttcatgaatccctgagccatgaactaaaggctgctgaaaaggatggaattaaaacaaccttggtttgcccttatcttgtagacactggcatgttcagaggctgccgaatcaggaaagaaattgagccttttctgccacctctgaagcctgattactgtgtgaagcaggccatgaaggccatcctcactgaccagcccatgatctgcactccccgcctcatgtacatcgtgaccttcatgaagagcatcctaccatttgaagcagttgtgtgcatgtatcggttcctaggagcggacaagtgtatgtacccctttattgctcaaagaaagcaagccacaaacaataatgaagcaaaaaatggaatctaagaatctttttgtatggaatattacttctatcagaagatgatcaagatgtttcagtccagtgcacatcagcattgctgacattttatggattctaaacttgtgttgtttcttttttaaatcaactttttaaaaaaataaagtgtaaattaaccgactagagtacttggaaaatgtgatcagtacaagtgaacttaggttgttgccaacagggtccttttaggcagaacccagaaaccagtcaaatctgtagagaagcagtgtgacatcttcaggttaccattattttttaatgagcaggaagtctagaaatgataactagactgtatgtttcatgtgtgtgatttttcagaattcccagagtttactcattcttgttattaaactctagccagttgacatcttcgcaatttcaaggactgatagtgctgtattttctcacgttttctaagtttccgttttgcaaggcctaggtgactttttcatggtgttgtatgtttagctcttttgaaaaggaattttgaaatctccatcaactgaagtaaatgatgtctgagtgttacagtaaaggtgaccaagtctctttcttaaagtcacaatgactaaagtattagttgaattttttttttttttttttggatggagtctcgctcttgtcaccaggctggagtgcagtagcacaatcacggctcactgcaatctctgcctcccggtttcaaggtgattctgctgtctcagcctcccaagtagtgggattacaggcatgagccactgcacccagccttgaatttttaattttatctctgatatacttcattaagtgtctggagacctaattatcctaaaagatcatacattttctacctatgaattttgctgcatacagaaagtgccctttcctcaggaagttgctgtgtttcatttctttggatggactcttatctagaatacatagcagctctgcaaagaaacagtttttaaaaatgggaacttctacattgaaaagtccccatttttgtgccaactatgattagtgagaggaagaaatcttattctatggcatatgtatggaagggtgtaaagattcttttgaaaggtttattcacattgtagaacagcaaatgacatttttacagtatttttttgtaaagcaaactattttgtgccttgaatttggtatatgtgtattagtgaaacattgtaaaggtgaacttctacctctgtatctaaatgtataccatccacttgtaaatgactataaactattatgtgattgcttttttttttagaatgtcttgtttaaatagtggccaatgtttaaggctgttaaaataagccaacttttactaattggggagttttataaatgactgattaaatttaaagaattaacttacatgcaattgtgtgattattagttatcagcagtgttgtaaggaaaattattgtgtttttttttatgatcattatcccactttaggtaaagaaaaatattggaatggaatagtgttgggaaacagacattaacaacctagggtgcctgcactcaaatagccgatgttactgtccctagattagagacttgattaagggcttgtttgtaccaaaagtggggaaacaatgccatgacctgtgttttagtttggctgcaccacagatcaaatctgcactgtgtctacatataggaaaggtcctggtgtgtgctaatgttcccaatgcaggacttgaggaagagctctgttatatgtttccatttctctttatcaaagataaccaaaccttatggcccttataacaatggaggcactggctgcctcttaattttcaatcatggacctaaagaagtactctgaagggtctcaacaatgccaggtggggacagatatactcagagattatccaggtctgcctcccagcgagcctggagtacaccagaccctcctagagaaatctgttataatttaacaacccacttatccaccttaaaactgaggaaagtcgtctttacatctaattttattcttgtgtgttataacttaaacctatttctatttttgtttgttattgcccttataagggtgtccatctccaagttcaataaactaattcatttaact

SEQ ID NO: 104779 - DNA, 3342 bp, Homo sapiens
actgggctcgtgcggggccccgggcgtcgcgatgaacatcgtggtggagttcttcgtggtcactttcaaagtgctctgggcgttcgtgctggccgcggcgcgctggctggtgcggcccaaggagaagagcgtggcgggccaggtgtgcctcatcaccggcgccggcagcggcctgggccgcctcttcgcgctggagttcgcccggcgtcgggcgctgctggtgctgtgggacatcaacacgcaaagcaacgaggagacggctggcatggtgcgccacatctaccgcgacctggaggcggccgacgccgctgcgctgcaagctgggaatggtgaggaagaaattctgccccactgtaacttgcaggtttttacctacacctgtgacgtggggaagagggagaacgtctacctgacggctgaaagagtccgcaaggaggttggcgaagtctcagtcctggtcaataatgctggtgtggtctctgggcatcaccttctggaatgtcctgatgagctcattgagagaaccatgatggtcaattgccatgcacacttctggaccactaaggcttttcttcctacgatgctggagattaatcatggtcatattgtgacagttgcaagttccttgggattgttcagtactgccggagttgaggattactgtgccagtaaatttggagttgtgggttttcatgaatccctgagccatgaactaaaggctgctgaaaaggatggaattaaaacaaccttggtttgcccttatcttgtagacactggcatgttcagaggctgccgaatcaggaaagaaattgagccttttctgccacctctgaagcctgattactgtgtgaagcaggccatgaaggccatcctcactgaccagcccatgatctgcactccccgcctcatgtacatcgtgaccttcatgaagagcatcctaccatttgaagcagttgtgtgcatgtatcggttcctaggagcggacaagtgtatgtacccctttattgctcaaagaaagcaagccacaaacaataatgaagcaaaaaatggaatctaagaatctttttgtatggaatattacttctatcagaagatgatcaagatgtttcagtccagtgcacatcagcattgctgacattttatggattctaaacttgtgttgtttcttttttaaatcaactttttaaaaaaataaagtgtaaattaaccgactagagtacttggaaaatgtgatcagtacaagtgaacttaggttgttgccaacagggtccttttaggcagaacccagaaaccagtcaaatctgtagagaagcagtgtgacatcttcaggttaccattattttttaatgagcaggaagtctagaaatgataactagactgtatgtttcatgtgtgtgatttttcagaattcccagagtttactcattcttgttattaaactctagccagttgacatcttcgcaatttcaaggactgatagtgctgtattttctcacgttttctaagtttccgttttgcaaggcctaggtgactttttcatggtgttgtatgtttagctcttttgaaaaggaattttgaaatctccatcaactgaagtaaatgatgtctgagtgttacagtaaaggtgaccaagtctctttcttaaagtcacaatgactaaagtattagttgaattttttttttttttttttggatggagtctcgctcttgtcaccaggctggagtgcagtagcacaatcacggctcactgcaatctctgcctcccggtttcaaggtgattctgctgtctcagcctcccaagtagctgggactacaggcatgcgccaccacgcccagctaatttttgtatttttagtagagacggggtttcaccatgttggtcaggatggtctccatctcttgacattgtgatccacctgcctcggcctcccaaagtgctgggattacaggcatgagccactgcacccagccttgaatttttaattttatctctgatatacttcattaagtgtctggagacctaattatcctaaaagatcatacattttctacctatgaattttgctgcatacagaaagtgccctttcctcaggaagttgctgtgtttcatttctttggatggactcttatctagaatacatagcagctctgcaaagaaacagtttttaaaaatgggaacttctacattgaaaagtccccatttttgtgccaactatgattagtgagaggaagaaatcttattctatggcatatgtatggaagggtgtaaagattcttttgaaaggtttattcacattgtagaacagcaaatgacatttttacagtatttttttgtaaagcaaactattttgtgccttgaatttggtatatgtgtattagtgaaacattgtaaaggtgaacttctacctctgtatctaaatgtataccatccacttgtaaatgactataaactattatgtgattgcttttttttttagaatgtcttgtttaaatagtggccaatgtttaaggctgttaaaataagccaacttttactaattggggagttttataaatgactgattaaatttaaagaattaacttacatgcaattgtgtgattattagttatcagcagtgttgtaaggaaaattattgtgtttttttttatgatcattatcccactttaggtaaagaaaaatattggaatggaatagtgttgggaaacagacattaacaacctagggtgcctgcactcaaatagccgatgttactgtccctagattagagacttgattaagggcttgtttgtaccaaaagtggggaaacaatgccatgacctgtgttttagtttggctgcaccacagatcaaatctgcactgtgtctacatataggaaaggtcctggtgtgtgctaatgttcccaatgcaggacttgaggaagagctctgttatatgtttccatttctctttatcaaagataaccaaaccttatggcccttataacaatggaggcactggctgcctcttaattttcaatcatggacctaaagaagtactctgaagggtctcaacaatgccaggtggggacagatatactcagagattatccaggtctgcctcccagcgagcctggagtacaccagaccctcctagagaaatctgttataatttaacaacccacttatccaccttaaaactgaggaaagtcgtctttacatctaattttattcttgtgtgttataacttaaacctatttctatttttgtttgttattgcccttataagggtgtccatctccaagttcaataaactaattcatttaactcttaaaaaaaaaattactggccggcgtttaccagcgt

SEQ ID NO: 104780 - DNA, 3247 bp, Homo sapiens
actgggctcgtgcggggccccgggcgtcgcgatgaacatcgtggtggagttcttcgtggtcactttcaaagtgctctgggcgttcgtgctggccgcggcgcgctggctggtgcggcccaaggagaagagcgtggcgggccaggtgtgcctcatcaccggcgccggcagcggcctgggccgcctcttcgcgctggagttcgcccggcgtcgggcgctgctggtgctgtgggacatcaacacgcaaagcaacgaggagacggctggcatggtgcgccacatctaccgcgacctggaggcggccgacgccgctgcgctgcaagctgggaatggtgaggaagaaattctgccccactgtaacttgcaggtttttacctacacctgtgacgtggggaagagggagaacgtctacctgacggctgaaagagtccgcaaggaggttggcgaagtctcagtcctggtcaataatgctggtgtggtctctgggcatcaccttctggaatgtcctgatgagctcattgagagaaccatgatggtcaattgccatgcacacttctggaccactaaggcttttcttcctacgatgctggagattaatcatggtcatattgtgacagttgcaagttccttgggattgttcagtactgccggagttgaggattactgtgccagtaaatttggagttgtgggttttcatgaatccctgagccatgaactaaaggctgctgaaaaggatggaattaaaacaaccttggtttgcccttatcttgtagacactggcatgttcagaggctgccgaatcaggaaagaaattgagccttttctgccacctctgaagcctgattactgtgtgaagcaggccatgaaggccatcctcactgaccagcccatgatctgcactccccgcctcatgtacatcgtgaccttcatgaagagcatcctaccatttgaagcagttgtgtgcatgtatcggttcctaggagcggacaagtgtatgtacccctttattgctcaaagaaagcaagccacaaacaataatgaagcaaaaaatggaatctaagaatctttttgtatggaatattacttctatcagaagatgatcaagatgtttcagtccagtgcacatcagcattgctgacattttatggattctaaacttgtgttgtttcttttttaaatcaactttttaaaaaaataaagtgtaaattaaccgactagagtacttggaaaatgtgatcagtacaagtgaacttaggttgttgccaacagggtccttttaggcagaacccagaaaccagtcaaatctgtagagaagcagtgtgacatcttcaggttaccattattttttaatgagcaggaagtctagaaatgataactagactgtatgtttcatgtgtgtgatttttcagaattcccagagtttactcattcttgttattaaactctagccagttgacatcttcgcaatttcaaggactgatagtgctgtattttctcacgttttctaagtttccgttttgcaaggcctaggtgactttttcatggtgttgtatgtttagctcttttgaaaaggaattttgaaatctccatcaactgaagtaaatgatgtctgagtgttacagtaaaggtgaccaagtctctttcttaaagtcacaatgactaaagtattagttgaattttttttttttttttttggatggagtctcgctcttgtcaccaggctggagtgcagtagcacaatcacggctcactgcaatctctgcctcccggtttcaaggtgattctgctgtctcagcctcccaagtagctgggactacaggcatgcgccaccacgcccagctaatttttgtatttttagtagagacggggtttcaccatgttggtcaggatggtctccatctcttgacattgtgatccacctgcctcggcctcccaaagtgctgggattacaggcatgagccactgcacccagccttgaatttttaattttatctctgatatacttcattaagtgtctggagacctaattatcctaaaagatcatacattttctacctatgaattttgctgcatacagaaagtgccctttcctcaggaagttgctgtgtttcatttctttggatggactcttatctagaatacatagcagctctgcaaagaaacagtttttaaaaatgggaacttctacattgaaaagtccccatttttgtgccaactatgattagtgagaggaagaaatcttattctatggcatatgtatggaagggtgtaaagattcttttgaaaggtttattcacattgtagaacagcaaatgacatttttacagtatttttttgtaaagcaaactattttgtgccttgaatttggtatatgtgtattagtgaaacattgtaaaggtgaacttctacctctgtatctaaatgtataccatccacttgtaaatgactataaactattatgtgattgcttttttttttagaatgtcttgtttaaatagtggccaatgtttaaggctgttaaaataagccaacttttactaattggggagttttataaatgactgattaaatttaaagaattaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaacaaacaacacaaacaaaaacaacaagaaaaacacaaaaaaagacaaacacaacgaagaggaggcgggcggcgcggcagcagacaatcaaaacatcacaggcgcggagggaggcagacaaatgaccagcctccccacatccttcatcttgcatcaaagacagcacccgccctactactgatagagcagagagctaaaatcataaaagcagcagcaggcgcgggcgagtcaacaaaacacccagagtagcacagaaaacaacacaaaacgcagtaaattagaaagacaacaagaccccacaccactgcgggcgagggagagatcacacaacacagcagaacacaccacaccgaccaacgcatagagaagacccgacgacagggaacctacaacaaaaagtagagagcgcagaggagtcgagcacgacaacaccacacactagaacaaggcgcgcgacagaagaacatcgcgacagaggacgccatcaattataaacaacaaaataaacggagagcgagaacgaaaaacacacgcacgacctcgaccacgaacacaaaacacagccaccagacaccagac

SEQ ID NO: 104781 - DNA, 931 bp, Homo sapiens
acctatacagcataaactattacagcataaactattacagcataaactattacagcataaactattacagtataaactattatgtgattgcttttttttttagaatgtcttgtttaaatagtggccaatgtttaaggctgttaaaataagccaacttttactaattggggagttttataaatgactgattaaatttaaagaattaacttacatgcaattgtgtgattattagttatcagcagtgttgtaaggaaaattattgtgtttttttttatgatcattatcccactttaggtaaagaaaaatattggaatggaatagtgttgggaaacagacattaacaacctagggtgcctgcactcaaatagccgatgttactgtccctagattagagacttgattaagggcttgtttgtaccaaaagtggggaaacaatgccatgacctgtgttttagtttggctgcaccacagatcaaatctgcactgtgtctacatataggaaaggtcctggtgtgtgctaatgttcccaatgcaggacttgaggaagagctctgttatatgtttccatttctctttatcaaagataaccaaaccttatggcccttataacaatggaggcactggctgcctcttaattttcaatcatggacctaaagaagtactctgaagggtctcaacaatgccaggtggggacagatatactcagagattatccaggtctgcctcccagcgagcctggagtacaccagaccctcctagagaaatctgttataatttaacaacccacttatccaccttaaaactgaggaaagtcgtctttacatctaattttattcttgtgtgttataacttaaacctatttctatttttgtttgttattgcccttataagggtgtccatctccaagttcaataaactaattcatttaact

SEQ ID NO: 104782 - DNA, 2741 bp, Homo sapiens
actgggctcgtgcggggccccgggcgtcgcgatgaacatcgtggtggagttcttcgtggtcactttcaaagtgctctgggcgttcgtgctggccgcggcgcgctggctggtgcggcccaaggagaagagcgtggcgggccaggtgtgcctcatcaccggcgccggcagcggcctgggccgcctcttcgcgctggagttcgcccggcgtcgggcgctgctggtgctgtgggacatcaacacgcaaagcaacgaggagacggctggcatggtgcgccacatctaccgcgacctggaggcggccgacgccgctgcgctgcaagctgggaatggtgaggaagaaattctgccccactgtaacttgcaggtttttacctacacctgtgacgtggggaagagggagaacgtctacctgacggctgaaagagtccgcaaggaggttggcgaagtctcagtcctggtcaataatgctggtgtggtctctgggcatcaccttctggaatgtcctgatgagctcattgagagaaccatgatggtcaattgccatgcacacttctggaccactaaggcttttcttcctacgatgctggagattaatcatggtcatattgtgacagttgcaagttccttgggattgttcagtactgccggagttgaggattactgtgccagtaaatttggagttgtgggttttcatgaatccctgagccatgaactaaaggctgctgaaaaggatggaattaaaacaaccttggtttgcccttatcttgtagacactggcatgttcagaggctgccgaatcaggaaagaaattgagccttttctgccacctctgaagcctgattactgtgtgaagcaggccatgaaggccatcctcactgaccagcccatgatctgcactccccgcctcatgtacatcgtgaccttcatgaagagcatcctaccatttgaagcagttgtgtgcatgtatcggttcctaggagcggacaagtgtatgtacccctttattgctcaaagaaagcaagccacaaacaataatgaagcaaaaaatggaatctaagaatctttttgtatggaatattacttctatcagaagatgatcaagatgtttcagtccagtgcacatcagcattgctgacattttatggattctaaacttgtgttgtttcttttttaaatcaactttttaaaaaaataaagtgtaaattaaccgactagagtacttggaaaatgtgatcagtacaagtgaacttaggttgttgccaacagggtccttttaggcagaacccagaaaccagtcaaatctgtagagaagcagtgtgacatcttcaggttaccattattttttaatgagcaggaagtctagaaatgataactagactgtatgtttcatgtgtgtgatttttcagaattcccagagtttactcattcttgttattaaactctagccagttgacatcttcgcaatttcaaggactgatagtgctgtattttctcacgttttctaagtttccgttttgcaaggcctaggtgactttttcatggtgttgtatgtttagctcttttgaaaaggaattttgaaatctccatcaactgaagtaaatgatgtctgagtgttacagtaaaggtgaccaagtctctttcttaaagtcacaatgactaaagtattagttgaattttttttttttttttttggatggagtctcgctcttgtcaccaggctggagtgcagtagcacaatcacggctcactgcaatctctgcctcccggtttcaaggtgattctgctgtctcagcctcccaagtagctgggactacaggcatgcgccaccacgcccagctaatttttgtatttttagtagagacggggtttcaccatgttggtcaggatggtctccatctcttgacattgtgatccacctgcctcggcctcccaaagtgctgggattacaggcatgagccactgcacccagccttgaatttttaattttatctctgatatacttcattaagtgtctggagacctaattatcctaaaagatcatacattttctacctatgaattttgctgcatacagaaagtgccctttcctcaggaagttgctgtgtttcatttctttggatggactcttatctagaatacatagcagctctgcaaagaaacagtttttaaaaatgggaacttctacattgaaaagtccccatttttgtgccaactatgattagtgagaggaagaaatcttattctatggcatatgtatggaagggtgtaaagattcttttgaaaggtttattcacattgtagaacagcaaatgacatttttacagtatttttttgtaaagcaaactattttgtgccttgaatttggtatatgtttccatttctctttatcaaagataaccaaaccttatggcccttataacaatggaggcactggctgcctcttaattttcaatcatggacctaaagaagtactctgaagggtctcaacaatgccaggtggggacagatatactcagagattatccaggtctgcctcccagcgagcctggagtacaccagaccctcctagagaaatctgttataatttaacaacccacttatccaccttaaaactgaggaaagtcgtctttacatctaattttattcttgtgtgttataacttaaacctatttctatttttgtttgttattgcccttataagggtgtccatctccaagttcaataaactaattcatttaact

SEQ ID NO: 104783 - DNA, 469 bp, Homo sapiens
tgaacattcgtgtcccataatagaaccttgataaatatccatgaaagaaatttatatatgagattcaaggcaggacttgaggaagagctctgttatatgtttccatttctctttatcaaagataaccaaaccttatggcccttataacaatggaggcactggctgcctcttaattttcaatcatggacctaaagaagtactctgaagggtctcaacaatgccaggtggggacagatatactcagagattatccaggtctgcctcccagcgagcctggagtacaccagaccctcctagagaaatctgttataatttaacaacccacttatccaccttaaaactgaggaaagtcgtctttacatctaattttattcttgtgtgttataacttaaacctatttctatttttgtttgttattgcccttataagggtgtccatctccaagttcaataaactaattcatttaact

SEQ ID NO: 104784 - DNA, 792 bp, Homo sapiens
actgggctcgtgcggggccccgggcgtcgcgatgaacatcgtggtggagttcttcgtggtcactttcaaagtgctctgggcgttcgtgctggccgcggcgcgctggctggtgcggcccaaggagaagagcgtggcgggccaggtgtgcctcatcaccggcgccggcagcggcctgggccgcctcttcgcgctggagttcgcccggcgtcgggcgctgctggtgctgtgggacatcaacacgcaaagcaacgaggagacggctggcatggtgcgccacatctaccgcgacctggaggcggccgacgccgctgcgctgcaagctgggaatggtgaggaagaaattctgccccactgtaacttgcaggtttttacctacacctgtgacgtggggaagagggagaacgtctacctgacggctgaaagagtccgcaaggaggttggcgaagtctcagtcctggtcaataatgctggtgtggtctctgggcatcaccttctggaatgtcctgatgagctcattgagagaaccatgatggtcaattgccatgcacacttctggaccactaaggcttttcttcctacgatgctggagattaatcatggtcatattgtgacagttgcaagttccttgggattgttcagtactgccggagttgaggattactgtgccagtaaatttggagttgtgggttttcatgaatccctgagccatgaactaccagctgatctataggttgggagtctatcctgcctctggtcgcccttatttttgacgacactggcagtgttcagagc

SEQ ID NO: 104785 - DNA, 931 bp, Homo sapiens
tacaaacagaaaaatataacattttcccccttagaataatatatatatatatataaaacttaaggttctattgtatgtatccgaacaacaaaatctggaaaccagcatgaaactctattattcacatgttaaaatgttgaaactatgaccaaaatatgaaaactgctggagctatcagaaagacacaagacaaaaagcttcttgcatatgtataaactaaatgtgataatctcaaaaaactgttcaaaattataattactttccagtttaaaaactttaatcctaaattaaaaaaaaaaaatctatacacaaaccactgatttgcccagagcaaagaaagaaagaaagaaagaaagaaagaaagaaagagaaatcagcggtaaggtaagcaggacccagaggagctgatattcacagttcttacatgtacaactctttcaggaattatccataaagtactttattttacaacctgctttacttgtaaaactaaaggtgcacttttttacataaaagttttatacagtgttaaaaccagaactgtgtgtaaaatactgcatgtaaatgtttctaaatagtcttgttccagtggttcatcggtgacttctgtggcttcgtcatcattatccatggatgattctgaaagaatctctccagttttactggaattggatcctactaattcttctgtttcacggcagtcagaagaaccactactttcagggccttcgttttcactaccttcagaatgtagtaaatctttctcagcttgagacacatcagattcctccatttcattattttcctcagaagtctcttcattcacagttgaggcatcatcagattctttttcttggttttttctttctgggaccatttctcttgatgtcataaaagactctaaaaataagcaaatgttgttgtacttaaa

SEQ ID NO: 104786 - DNA, 750 bp, Homo sapiens
atggagtctcactgtcttgcccaggctggtctcaaactcctaggctcaagcgatcctcccgcctctactaatatgaattattagcctatactaatatgaattcctatactaatatgattgaaattagtttgacttgtataataattgttctcccagattggccttctgttttgatagtagaactaaattattaggctatttcaagaaattaatatattactggtagaaaaactgaagctacaaaatggcctggtttctcacttcagttaaatttgtgcttctgagtgcttgtattgtaggtgaaaccgcactgagaaggtatttgtggcccgtatgctgattgattgatgagacttctttgcacaggagagctgctaaaaattactgcggtgaacagtcttgttccagtggttcatcggtgacttctgtggcttcgtcatcattatccatggatgattctgaaagaatctctccagttttactggaattggatcctactaattcttctgtttcacggcagtcagaagaaccactactttcagggccttcgttttcactaccttcagaatgtagtaaatctttctcagcttgagacacatcagattcctccatttcattattttcctcagaagtctcttcattcacagttgaggcatcatcagattctttttcttggttttttctttctgggaccatttctcttgatgtcataaaagactctaaaaataagcaaatgttgttgtacttaaa

SEQ ID NO: 104787 - DNA, 460 bp, Homo sapiens
atggagtctcactgtcttgcccaggctggtctcaaactcctaggctcaagcgatcctcccgcctctactaatatgaattattagcctatactaatatgaattcctatactaatatgattgaaattagtttgacttgtataataattgttctcccagattggccttctgttttgatagtagaactaaattattaggctatttcaagaaattaatatattactggtagaaaaactgaagctacaaaatggcctggtttctcacttcagttaaatttgtgcttctgagtgcttgtattgtaggtgaaaccgcactgagaaggtatttgtggcccgtatgctgattgattgatgagacttctttgcacaggagagctgctaaaaattactgcggtgaacaggtatgaagaagactgttctctgcccttctttttgcaataaaatgttacaaactatcttgagat

SEQ ID NO: 104788 - DNA, 229 bp, Homo sapiens
attcttgaagtttcttaatacatcactgtgcttttacacgatacgtgagttcacaaaagtgcctggaaagattataaaggactgtcatggaagtgctaaggtgctttaccagtgctttaaaatcccctaatcaaacactaatatttaagggtacatactctctgccaggccctgtgacaatcttacctcatttttaaaacaaccccacagatgcaggttctactatcac

SEQ ID NO: 104789 - DNA, 292 bp, Homo sapiens
acctctatgatactgccatatacacgagggtcaattctagctagtatactaggaatattgagaacatccatgatgataaagacaaattccaaagtaacctcccctaaaaagaatataatgccagccaggcatggtggctcacgcctgtaatcccagcactttgggaggctgaggcgggtggatcacttgaggtcaggagttcgagaccagcctaggcaacaaggcaaaaccccgtctctactaaatatacaaaaattagccgggcatggtggcacatgcctgtgatcccagc

SEQ ID NO: 104790 - DNA, 338 bp, Homo sapiens
atataatgtagtacaaaatagctggaaacttttctcatgtccagaatatattatgcatttaatacatatgtgtttattgaatgaatatattaatgtctctatacttttggaaagtggagtgattagacagacaattaatacaagcatttcatgtattcaatcattcgttacttatgtattgagggcctactctgtgccaaatactgtgataagaattactgataaaagaataagtaatatgagcatcctgcctcagaagaattcaacatctagaaaagaaaacgaaattcaactttaaaacatcatgttgaacagcataaatatatacgatatttatc

SEQ ID NO: 104791 - DNA, 632 bp, Homo sapiens
ataaaccataacaaaaaacaactaacaaaccataataccaaaacaacacacccacacaacaccaccacaaccaaaaaaaaaaaaaaaaaaaaaaaaaaaaaccaaaaaacaaaaaaaaaaaaaaaaaaaaaacaaaaaaaaaaacaaaaaccagaaagactgattctgccaccgtgaaatgacgccgtggttaacgtctgtagcagccgcgtgtgctgaggatttctgcagtgggcatgtttgcttttccatccacagcgagtcctcactcagtgtcacccgccccgaggcccttggaaactgcaacttttttttttttgagagggtctccctctgtcacccaggctgaagtgcaatggcgtgatcctggctcactgtagcctcaacctccctggctcaagtgatcctcccacctcagcctcccaagtagctgggaccacaggtttatgtatcaccatgcccagctaaattttgtattttttgtagggacagagtctccctacgttgcctaggctggtcttgaaatcccagagtgctgggatttcagggatgagccacctcacctggccagaaactgtgactttaagcaaaacgacaaacagcaggcccttgaataaagactgttttgttca

SEQ ID NO: 104792 - DNA, 269 bp, Homo sapiens
ttgcaggagcagctgggagctgtcacctgtgtaggcagcctggatctgtcagacaatgggttcgactcggacctcctgacactggtgcctgcacttggcaagaacaagtccctcaagcacctgtttttgggcaagaacttcaatgtcaaggccaagtgaggccccctttccatgcccacagaccctcatcccatcattcacccatcctcttggctcaccgtattacctctggccacctctctcctcctccaatagcatgaccccagccc

SEQ ID NO: 104793 - DNA, 808 bp, Homo sapiens
cactactctcttcaaagctgtcagacagggacatttaagtctgcagaagtttctgctgccgtttgttcaactatgccctgcccccagtactggagtccaggaaggcaggcaggcctccttgagctttggtgggctccacccagttcagtcttcccggctgctttgtttacctactcaagcttcagcaatggcggatgcccctccctcagccttgctgacaccttgcggcttgatctcagactgctgtgttagcagtgagtgaggctccgtgggtgtgggactctccgagccaggtgcgggatataatctcctggtgttccgtttgctaagaccattggaaaagcgcagtattagggtgggagggtcccgattttccaggtactatctgtcatggcttcccttggctaggaaagggaattccccaaccccttgcacttcccaggtgaggcaatgccccacgctgctccttgggctgcacccactgtgtgacaagccccagtgagatgaacccggtacctctgttggaaatgcagaaatcacctgtcttctgcgtcgctcacgctgggagctgtagactggagctgttcctttttggccatcttggaacctcggttcaaacctgagttgtaatactcactcttcctgttgctgcctatgtaattttgtagaagttacctaattgcttccaagcttctgttggattttttgagaactgaatgacatagtacattttgaatgcttaatgtattgctttgtgcatggtattatttaataaatattagctttggttatacttgcaatgttctgt

SEQ ID NO: 104794 - DNA, 490 bp, Homo sapiens
ttgggtcacagtgggagaattaaatagttgttaaattattcctttattttattgaatatattccaagtttaaaacatgatattttgatatatatatttacatagtaaaatgattactatagccaagctaataacatatccatcatctcatatagttaccctttgtgtgtgtatggcaaaattacctaaaacctacgtgccttttttttcaaatttctggtttatgactcaattttattaactataattctcatgcagtacattagatctccagataacctgtttttttaaagaaagacagttgtgtgcagcttataaaaaatacactggattacaaagggcttaaaacaaacactgaaattcaccaggatgcttaaaatttgtcaattatccagctatgacaaaaccaccgccaacaatatactgaatcagcaaagcctggaaatatccccctagagaactagaacaagacaaggattcccagtctcacc

SEQ ID NO: 104795 - DNA, 226 bp, Homo sapiens
ttttgaatcatattagattcttgtaaaattacaaatattttatttatagctactatgtcataaaacctttgctgtcaaattatgtctgtctatatgcttgactatgcagaatgactagcaaatattacatttaataagttggaacttaaactcagagtaataccttatcaacctcattcagtatgatattgtaatatttccaagatatttcaatcattgtgttttc

SEQ ID NO: 104796 - DNA, 711 bp, Homo sapiens
tctgagccctgtgctggcatgagactgtagggctggcccacattactagccacaccaatgcctcagttctccctggaggcctactcaccccactccaaacagctctgagatctcaattctccccttggttcctgggcctgaaaggaacccctggagccccacagtgcaaggcctcttgttcattcttgcaggcaggtagttctttcatgttgtaagcataattacagcaacaatgataataacagcaggcacagctgcatgcttgcctcgtgcacttatgtagacaaacatccttggccctcaccaccacctgatgagctgggtgccggatcccagtttcgaagatggggaaactgaggtacagaaagattgatgccacttccttacagtcactcagggtgtgtctgggccttaaacctgttcctggctgccgggctggcctgccagagtcagtagtaacccgtggtaggtggtgtttcatcaaattcaacctggtgttctgtaatcggtggggttttcaggctcccatggtcccggtgggacataaaacttgttacaggagggctttgtgagtccgttggaggcatcatataccattgcctcagcatccagacctgtgccaaaaatttcaggcatggcagcaaaaaccctcaaccttgtaagctttcaaaatttgtctaaaatttgtctagttactgtggtgcacgcctg

SEQ ID NO: 104797 - DNA, 444 bp, Homo sapiens
tgggtagggggttccccaggagtcacacagtgcctcccagtgggggtgccaaggaccacgttgcacaggagccctggcttaggctgtgctggggaaaccaagaggacttgggggatctcccaggaatgtgaggctggggagggagtgagtcattctcccactggtgtttggagaaagcttcagagatccagacagctctccaatattcttcctaaaaagccacatcagggctgtcagggccagagggccaggaagctcaagaatgtctgggcagcatggtgggatcattccagatcgagaccttgcatggagacattgtcttttccattattatttttttttccaaaatggaaaaagctctattgcttttctcctattataaaagtaatacacctgcactactggtagtgtatcaccagtacggtaagaaagtaaaatttctcg

SEQ ID NO: 104798 - DNA, 713 bp, Homo sapiens
ggaggggataggacgagaaacatgaaagaaaagaaagtaaaaagagattatactaaaaaaatttccaataactctgacacaaactatacacctgtcttcaaagagattgtgtctaaaaccaaagtgctacatctataggcctgggggctttgtcagtcaaaaaggatgagttaaatctctagtgacctccttctttggagaaagcctaagacaaaatcatttgcaacatctaaattatttgaaatttttaaatattatttgaaatttctaaatattaagtatacaaaaaaaaaccacactaaagctaatagattacttttaagaagcaacaaaatttgaactatgacagttacaaaaaggactctgtaatgaagatcacagagaaacagatcatgatagtaagaaaatcctacagttctgaggacaagagaaacatatttcttaacagactggaaaaatatatagtttatacaaagaaaaactatcccacattttaatcaagagcaaagcaatagaaaataatggctcttgtctatggccataccaccttaaatgtgcccaatcttgtctgatgtcggaagtttagcaggactggggctggttaatacttggatgggagactgcctgggaatatcaggtgctataggctttaaaatatatatatatatatataagaaagaaagaaaataatggttataactgagattgagctt

SEQ ID NO: 104799 - DNA, 314 bp, Homo sapiens
gtagattaaaatctgctaaacatacttctgtctcttggtagaaatgtgtaaagtccttgaaaagtgaaacaaaatattttctacatttgtactctactccatgcgtagcaaagtatgaagggcattttaataatgaaagttgtcagttatgtagatgattattgctgttgcatgaaaacagtattcaagtgagtgcatgactacatataggatattaaggtcccaacaagcatctgttttcaaattaatgtagcagaatagaagtttcaaggtcagtgctttcaacccagctatagaacatgctatgtgagagt

SEQ ID NO: 104800 - DNA, 352 bp, Homo sapiens
ttgttgcccaggctggaatgcagtggcgtgatcatggcacactgcagccttcaattcctgaactcaagcgatctttctgcctcagcctcccgagtagctaaaactactggtgcacagcaccacacttggctaattttcaaagacttttggtagagatggagtctcctatgttgcccaggctggggctgttacctgcagcataatctagcctatcctgtctactaaaggcactgaatttgagagacagtactgtaatataatgaggccatctagatgttccagaatatgtttacatggtgttatttacattattaaaacaaaagttaaaattatcataaccagaatgatattg

SEQ ID NO: 104801 - DNA, 902 bp, Homo sapiens
gatcccttgaaaactaggagagaggaagcacattcatctttaacttgaattcaagtgaaaagcaagcactaatagaatactatgctttcttcctacattgattttatctgcttcagaaaattgacaacctaaattgaaatcaggtagatgaaaaatacatttcttcaaacattgtgcccttgagggaaaaattacacacacagcgtgatatgtgcatgcacacatgcgcacacacacacacaaaattgaaaagtgaagacattttaatggagatttaatagtgcttccagactaatgaactaatggagtttggctccactcatgagtgtatttgaaatgtaagtaaccagctacaaagaataagtgtcacttcatttgattatgactaccaatcaagagaaggaggaatacatttctgaggagtgatactaaaccatttgagcttaaatgagtacctgattttgcagccattaaaatgagtcaataactatgtggaaatatagaaacaatattttataatataatactaagaaagaggacagtaggccataaatgtgttagcagtgttatgctatgtctatataaataagcgtggccattaaaatagcaactgaaacagtcatgtgtggggggcaagttcagaagtacttctatgtttctaagaagggagttcctttatggttggccccggtcgaggactaaaaactgggtagatccgaattacccaaagttgtttaggtcctcgtctaggaattaacccaggcatggacccccgggggggcacctgtaacacccttggggaaggcggaacttacccaggtgagcacccggcacgaagtgtctttaaaaggaggcttctcgagggagaaaaaacttcaaggaaaacaccagacaaagaggca

SEQ ID NO: 104802 - DNA, 227 bp, Homo sapiens
ggctccctgtgtggggctcccttgcaaggcttggggtgcagcattccctcagccagtgccgtcccctttgttccactcgagcctctggcggggccgtgtattgacaaacctagtgaccagaagtggggtctcactgctaggggcttaagcggagggagtcgagccactcgcgcagggggtggaagctacgccgaggactacgattccgatgcgactcgcacgtatac

SEQ ID NO: 104803 - DNA, 278 bp, Homo sapiens
gttcatcattccaaataaaatcaaaataagatatctttaaaggtttctcactagaaatgatgatgaagagagcaccatcaataaaagagacagacgtgcctgaaagctccttccctgccctgccctttccagtttcctgtggattctcaagaccatgaaaggttagaaatattagctgcagagagaaaagaaacataacatgaacatattttcctatcagtggattttcccctacaagatcatttttgaagaagctaatggttaggagcacggcctct

SEQ ID NO: 104804 - DNA, 306 bp, Homo sapiens
gagacggagtctcgctctgtcacccaggctggagtgcagtggcgctatctcagctcactgcaagctctgcctcctgggttcacgccattctcctgcctcagcctcccaaagtgctgggattacaggcgtgagccaccgcacctggccttcagtgtttcttttaaatatgctctgaaaactgtgtaccattaatttctgtataagccaaatatctaaaactttgcatagagactcacttgttttactagttttttgtcaactaaagaatttaggcttctcagtcctaattactgtaattaaaaatgt

SEQ ID NO: 104805 - DNA, 2823 bp, Homo sapiens
agattcactggtgtggcaagttgtctctcagactgtacatgcattaaaattttgcttggcattactcaaaagcaaaagaaaagtaaaaggaagaaacaagaacaagaaaaaagattatattgattttaaaatcatgcaaaaactgcaactctgtgtttatatttacctgtttatgctgattgttgctggtccagtggatctaaatgagaacagtgagcaaaaagaaaatgtggaaaaagaggggctgtgtaatgcatgtacttggagacaaaacactaaatcttcaagaatagaagccattaagatacaaatcctcagtaaacttcgtctggaaacagctcctaacatcagcaaagatgttataagacaacttttacccaaagctcctccactccgggaactgattgatcagtatgatgtccagagggatgacagcagcgatggctctttggaagatgacgattatcacgctacaacggaaacaatcattaccatgcctacagagtctgattttctaatgcaagtggatggaaaacccaaatgttgcttctttaaatttagctctaaaatacaatacaataaagtagtaaaggcccaactatggatatatttgagacccgtcgagactcctacaacagtgtttgtgcaaatcctgagactcatcaaacctatgaaagacggtacaaggtatactggaatccgatctctgaaacttgacatgaacccaggcactggtatttggcagagcattgatgtgaagacagtgttgcaaaattggctcaaacaacctgaatccaacttaggcattgaaataaaagctttagatgagaatggtcatgatcttgctgtaaccttcccaggaccaggagaagatgggctgaatccgtttttagaggtcaaggtaacagacacaccaaaaagatccagaagggattttggtcttgactgtgatgagcactcaacagaatcacgatgctgtcgttaccctctaactgtggattttgaagcttttggatgggattggattatcgctcctaaaagatataaggccaattactgctctggagagtgtgaatttgtatttttacaaaaatatcctcatactcatctggtacaccaagcaaaccccagaggttcagcaggcccttgctgtactcccacaaagatgtctccaattaatatgctatattttaatggcaaagaacaaataatatatgggaaaattccagcgatggtagtagaccgctgtgggtgctcatgagatttatattaagcgttcataacttcctaaaacatggaaggttttcccctcaacaattttgaagctgtgaaattaagtaccacaggctataggcctagagtatgctacagtcacttaagcataagctacagtatgtaaactaaaagggggaatatatgcaatggttggcatttaaccatccaaacaaatcatacaagaaagttttatgatttccagagtttttgagctagaaggagatcaaattacatttatgttcctatatattacaacatcggcgaggaaatgaaagcgattctccttgagttctgatgaattaaaggagtatgctttaaagtctatttctttaaagttttgtttaatatttacagaaaaatccacatacagtattggtaaaatgcaggattgttatataccatcattcgaatcatccttaaacacttgaatttatattgtatggtagtatacttggtaagataaaattccacaaaaatagggatggtgcagcatatgcaatttccattcctattataattgacacagtacattaacaatccatgccaacggtgctaatacgataggctgaatgtctgaggctaccaggtttatcacataaaaaacattcagtaaaatagtaagtttctcttttcttcaggggcattttcctacacctccaaatgaggaatggattttctttaatgtaagaagaatcatttttctagaggttggctttcaattctgtagcatacttggagaaactgcattatcttaaaaggcagtcaaatggtgtttgtttttatcaaaatgtcaaaataacatacttggagaagtatgtaattttgtctttggaaaattacaacactgcctttgcaacactgcagtttttatggtaaaataatagaaatgatcgactctatcaatattgtataaaaagactgaaacaatgcatttatataatatgtatacaatattgttttgtaaataagtgtctccttttttatttactttggtatatttttacactaaggacatttcaaattaagtactaaggcacaaagacatgtcatgcatcacagaaaagcaactacttatatttcagagcaaattagcagattaaatagtggtcttaaaactccatatgttaatgattagatggttatattacaatcattttatatttttttacatgattaacattcacttatggattcatgatggctgtataaagtgaatttgaaatttcaatggtttactgtcattgtgtttaaatctcaacgttccattattttaatacttgcaaaaacattactaagtataccaaaataattgactctattatctgaaatgaagaataaactgatgctatctcaacaataactgttacttttattttataatttgataatgaatatatttctgcatttatttacttctgttttgtaaattgggattttgttaatcaaatttattgtactatgactaaatgaaattatttcttacatctaatttgtagaaacagtataagttatattaaagtgttttcacatttttttgaaagacaaaaa

SEQ ID NO: 104806 - DNA, 319 bp, Homo sapiens
caccaccacgcccagctaatttttgtatttttagtagagacgaggtttcaccatgttggccaggctggtcttgaactcctgatctcaagtgatccgcctgcctcagcttcccaaagtgttgggattacaggcgtgagccaccactcccagccaattacagacaattaatataacaattatgtgcaacatgcaaacgtcttttttttctttctttctttcttttgtttttgtgagatggagtcttgctctcttgccaggctggagtgcagtggtaggaatctccacttgctgcaacctccacctcccaggttcaagtgat

SEQ ID NO: 104807 - DNA, 221 bp, Homo sapiens
atgagatgaacgatgagatgaaatgatgagatgaaatgagatgaaaaatgatgagatgaaaaatgagatgaaatgaaataatgaaatgagatgaaatgaaatgaagtaatgaaaggaaattatgaaatgtaatgatgaaattgaaatgaaattgaaatgagatgatttgacatgatgagatgtaatgatgaaatgaaatgatgaaatgagatgagataaaa

SEQ ID NO: 104808 - DNA, 125 bp, Homo sapiens
tgctcactgcttgcctcaccggcctctttcctcttcttcctgttgtgactccaggcatggctgggaccccgaagccgtgggccaggtctttgcttcctgcctcctcgtagttttgacctagtttg

SEQ ID NO: 104809 - DNA, 266 bp, Homo sapiens
acaaataaaccacatttcacattcacttaattggaccatgtggcggatttatgccaacagaatgcagacagaagtgatattcatcatttctagactgtagtggtttgaaaatatgttcacaaattctttgatactacttctttcaagaagtggaacttgattccccttcttctgagtgggggttggacatagtgattctcttctaatgaacaaatacggcggagatggcagtatatgacttctgagactagatcataaaagccatt

SEQ ID NO: 104810 - DNA, 381 bp, Homo sapiens
gtaatatgagggtacataattttgttattctggggtagttttgaagaaaattgcccttatctgaacttttgcctacccttttgctctataaatgttttgtaagttctataggtttaactttaaagaataatacaaatgttaaataatgtgaaagccctaaaatcaagatgtaaggtattctaataaaaccaggacagttacttcaattatcatacatgcttcagtgggcagaattcttgaacaacagtgtgaagaatgttgagagttttttttttggtttctttttctttgttatttgttttttgacaggatcttgctctgtcgcccaggctgaaatgcagtgatgtgatcatagcttattgcagcctcaaactcctgggc

SEQ ID NO: 104811 - DNA, 147 bp, Homo sapiens
gcctgcatgaagggcaattatgtaatatatattaaagtgacaaatgcttttacgctttggcctagcaattcctcttctagaaattgtcatttagatattgtgtacagggaaataatgtatgtattccatttggtggaataatctgga

SEQ ID NO: 104812 - DNA, 201 bp, Homo sapiens
tgagctgggtaaaggatatgtggggactctgtacaatctctgcaacttactctgtaacaccgaacttttttcaaaatagagttagaacgaaaaaacctttaaaaattttggttttctggcttctcttgaaaattgggcagacctggcccttgggcacctgcatgcctctggcacccacccccagagccaagcaatcggctg

SEQ ID NO: 104813 - DNA, 381 bp, Homo sapiens
tgggaacgatgcatctacaagctaagttacaccaagaattattggtaactctaggaaactaggagaggccaagaaaggtcttctctagagccttcaggagaagcatggccctgtggacaccctgacttcaggcttctagattattccagaactgtgagagaatacatttctgttgtgtttaagtcactgagtttgtggtactttgttatggcagccccaggaaatgaataaacatagtaatggaagattctgagacaggcactatgctttacgtacactgtgtgtatgtatgtatgtatgtatatatgtatgtatgtatgtatgtatgtatgtacgtacatacttacttacttatttgagacagagccttgctctgtcatc

SEQ ID NO: 104814 - DNA, 264 bp, Homo sapiens
gaccaagtctaatgttgactaggctagttttgaatttctagcttcaagggatcctcccacctctgcctcccaaagtgctggggttgcaggcatgagctactacaccaaatgggaaagtatttttttaaagatgcctatgaacggagactcctgaaggttgttgacttcacggtagcattttcagcctagctagtgttatcgtgggttaagaaagataaattcattagcaatataactttactaaggataacctgattgtgatat

SEQ ID NO: 104815 - DNA, 264 bp, Homo sapiens
ttcatatacagttgacccttgaacaacatggtggttaggggcaccaattccctgcatagtggaagaaaagccatatataattgttgattctccaaaagtttaagtactcaatagcatgctgttgactggaaatcttaacaacaacataaacattcaattaaatatatgtacgttatatgtattaaatactgtattctttttttttttttttttttttgagacagggtctgactttgtcacccaggctggagtgcagcggcatga

SEQ ID NO: 104816 - DNA, 314 bp, Homo sapiens
caagagagtatgagagcaagagagggccaaactcactcttgtaacaacccactctcatgataatgacattaatcaattcatgaaggcagattcctcatggcctgatcagctttttacagtccaatctctgaataccatcacaatgacaattaaatttaaatacgggttttgacaaacatattcaaaccattgcacttaccatccaacagtggtatctttttaatagcatctgtgacagtgagtcatccagccactgcattaacacttccagtaacagtgaatacctcaagaaatgttttctatgcacattaaag

SEQ ID NO: 104817 - DNA, 1972 bp, Homo sapiens
  misc_feature (10)..(10): n is a, c, g, or t
  misc_feature (15)..(15): n is a, c, g, or t
  misc_feature (1709)..(1709): n is a, c, g, or t
  misc_feature (1713)..(1714): n is a, c, g, or t
ggatgtaagngggangccgccgcccaccgcccgccgccatggggctgaaggccgcccagaagacgctgttcccgctgcgctccatcgacgacgtggtgcgcctgtttgctgccgagctgggccgagaggagccggacctggtgctcctttccttggtgctgggcttcgtggagcattttctggctgtcaaccgcgtcatccctaccaacgttcccgagctcaccttccagcccagccccgcccccgacccgcctggcggcctcacctactttcccgtggccgacctgtctatcatcgccgccctctatgcccgcttcaccgcccagatccgaggcgccgtcgacctgtccctctatcctcgagaagggggtgtctccagccgtgagctggtgaagaaggtctccgatgtcatatggaacagcctcagccgctcctacttcaaggatcgggcccacatccagtccctcttcagcttcatcacaggcaccaaattggacagctccggtgtggcctttgctgtggttggggcctgccaggccctgggtctccgggatgtccacctcgccctgtctgaggatcatgcctgggtagtgtttgggcccaatggggagcagacagctgaggtcacctggcacggcaagggcaacgaggaccgcaggggccagacagtcaatgccggtgtggctgagcggagctggctgtacctgaaaggatcatacatgcgctgtgaccgcaagatggaggtggcgttcatggtgtgtgccatcaacccttccattgacctgcacaccgactcgctggagcttctgcagctgcagcagaagctgctctggctgctctatgacctgggacatctggaaaggtaccccatggccttagggaacctggcagatctagaggagctggagcccacccctggccggccagacccactcaccctctaccacaagggcattgcctcagccaagacctactatcgggatgaacacatctacccctacatgtacctggctggctaccactgtcgcaaccgcaatgtgcgggaagccctgcaggcctgggcggacacggccactgtcatccaggactacaactactgccgggaagacgaggagatctacaaggagttctttgaagtagccaatgatgtcatccccaacctgctgaaggaggcagccagcttgctggaggcgggcgaggagcggccgggggagcaaagccaggcacccagagccaaggttccgccctccaggaccctgagtgcttcgcccacctgctgcgattctacgacggcatctgcaaatgggaggagggcagtcccacgcctgtgctgcacgtgggctgggccacctttcttgtgcagtccctaggccgttttgagggacaggtgcggcagaaggtgcgcatagtgagccgagaggccgaggcggccgaggccgaggagccgtggggcgaggaagcccgggaaggccggcggcggggcccacggcgggagtccaagccagaggagcccccgccgccaagaagccagcactggacaagggcctgggcaccggccaggtgcagtgtcaggacccccccggaagcctcctgggactgtcgcatggcacagcccgaggccctgaaggtggcagcacggctcaggtgccagcaaccgcaagcatcaccaccggcggagggtccagtgctcactttccagagtgagaagntgannggcatgaaggagctgatggtggccacaaagatcactcgagcgccattcaaagcctgcagtcacggcacagtcgcagttgcagatgaggaagcagaaagtgtccaccctagtggttaactctgtcttgtctcaagcggaacgcgaaaggcctcttgaactaatggggactacggaccgttgttgggacccaggtccgcctaatccccaattgtaacccatgtctgcccgacccaaggggacagcttcccttaacaagct

SEQ ID NO: 104818 - DNA, 2182 bp, Homo sapiens
  misc_feature (10)..(10): n is a, c, g, or t
  misc_feature (15)..(15): n is a, c, g, or t
  misc_feature (1919)..(1919): n is a, c, g, or t
  misc_feature (1923)..(1924): n is a, c, g, or t
ggatgtaagngggangccgccgcccaccgcccgccgccatggggctgaaggccgcccagaagacgctgttcccgctgcgctccatcgacgacgtggtgcgcctgtttgctgccgagctgggccgagaggagccggacctggtgctcctttccttggtgctgggcttcgtggagcattttctggctgtcaaccgcgtcatccctaccaacgttcccgagctcaccttccagcccagccccgcccccgacccgcctggcggcctcacctactttcccgtggccgacctgtctatcatcgccgccctctatgcccgcttcaccgcccagatccgaggcgccgtcgacctgtccctctatcctcgagaagggggtgtctccagccgtgagctggtgaagaaggtctccgatgtcatatggaacagcctcagccgctcctacttcaaggatcgggcccacatccagtccctcttcagcttcatcacaggcaccaaattggacagctccggtgtggcctttgctgtggttggggcctgccaggccctgggtctccgggatgtccacctcgccctgtctgaggatcatgcctgggtagtgtttgggcccaatggggagcagacagctgaggtcacctggcacggcaagggcaacgaggaccgcaggggccagacagtcaatgccggtgtggctgagcgggtattgttccctccccccagccttgtccccttcatactgtagtagcccaagccacccaagggactccattttcttgggccacacccctttcttcccatcaccacccacataggaagggaagacagaagagccccttttcctggctgtcattccctgaagcaggcacagggtgggccatcatgagacataatgatctcatccccccctaagagctggctgtacctgaaaggatcatacatgcgctgtgaccgcaagatggaggtggcgttcatggtgtgtgccatcaacccttccattgacctgcacaccgactcgctggagcttctgcagctgcagcagaagctgctctggctgctctatgacctgggacatctggaaaggtaccccatggccttagggaacctggcagatctagaggagctggagcccacccctggccggccagacccactcaccctctaccacaagggcattgcctcagccaagacctactatcgggatgaacacatctacccctacatgtacctggctggctaccactgtcgcaaccgcaatgtgcgggaagccctgcaggcctgggcggacacggccactgtcatccaggactacaactactgccgggaagacgaggagatctacaaggagttctttgaagtagccaatgatgtcatccccaacctgctgaaggaggcagccagcttgctggaggcgggcgaggagcggccgggggagcaaagccaggcacccagagccaaggttccgccctccaggaccctgagtgcttcgcccacctgctgcgattctacgacggcatctgcaaatgggaggagggcagtcccacgcctgtgctgcacgtgggctgggccacctttcttgtgcagtccctaggccgttttgagggacaggtgcggcagaaggtgcgcatagtgagccgagaggccgaggcggccgaggccgaggagccgtggggcgaggaagcccgggaaggccggcggcggggcccacggcgggagtccaagccagaggagcccccgccgccaagaagccagcactggacaagggcctgggcaccggccaggtgcagtgtcaggacccccccggaagcctcctgggactgtcgcatggcacagcccgaggccctgaaggtggcagcacggctcaggtgccagcaaccgcaagcatcaccaccggcggagggtccagtgctcactttccagagtgagaagntgannggcatgaaggagctgatggtggccacaaagatcactcgagcgccattcaaagcctgcagtcacggcacagtcgcagttgcagatgaggaagcagaaagtgtccaccctagtggttaactctgtcttgtctcaagcggaacgcgaaaggcctcttgaactaatggggactacggaccgttgttgggacccaggtccgcctaatccccaattgtaacccatgtctgcccgacccaaggggacagcttcccttaacaagct

SEQ ID NO: 104819 - DNA, 1833 bp, Homo sapiens
  misc_feature (1570)..(1570): n is a, c, g, or t
  misc_feature (1574)..(1575): n is a, c, g, or t
gggatgtaatgcgcggaggtgggcgatgggggaccgaggccaggactctccttggggtttgggggcttgacctgggtgcgctttctggacagactttacagcccccgacccgcctggcggcctcacctactttcccgtggccgacctgtctatcatcgccgccctctatgcccgcttcaccgcccagatccgaggcgccgtcgacctgtccctctatcctcgagaagggggtgtctccagccgtgagctggtgaagaaggtctccgatgtcatatggaacagcctcagccgctcctacttcaaggatcgggcccacatccagtccctcttcagcttcatcacaggcaccaaattggacagctccggtgtggcctttgctgtggttggggcctgccaggccctgggtctccgggatgtccacctcgccctgtctgaggatcatgcctgggtagtgtttgggcccaatggggagcagacagctgaggtcacctggcacggcaagggcaacgaggaccgcaggggccagacagtcaatgccggtgtggctgagcggagctggctgtacctgaaaggatcatacatgcgctgtgaccgcaagatggaggtggcgttcatggtgtgtgccatcaacccttccattgacctgcacaccgactcgctggagcttctgcagctgcagcagaagctgctctggctgctctatgacctgggacatctggaaaggtaccccatggccttagggaacctggcagatctagaggagctggagcccacccctggccggccagacccactcaccctctaccacaagggcattgcctcagccaagacctactatcgggatgaacacatctacccctacatgtacctggctggctaccactgtcgcaaccgcaatgtgcgggaagccctgcaggcctgggcggacacggccactgtcatccaggactacaactactgccgggaagacgaggagatctacaaggagttctttgaagtagccaatgatgtcatccccaacctgctgaaggaggcagccagcttgctggaggcgggcgaggagcggccgggggagcaaagccaggcacccagagccaaggttccgccctccaggaccctgagtgcttcgcccacctgctgcgattctacgacggcatctgcaaatgggaggagggcagtcccacgcctgtgctgcacgtgggctgggccacctttcttgtgcagtccctaggccgttttgagggacaggtgcggcagaaggtgcgcatagtgagccgagaggccgaggcggccgaggccgaggagccgtggggcgaggaagcccgggaaggccggcggcggggcccacggcgggagtccaagccagaggagcccccgccgccaagaagccagcactggacaagggcctgggcaccggccaggtgcagtgtcaggacccccccggaagcctcctgggactgtcgcatggcacagcccgaggccctgaaggtggcagcacggctcaggtgccagcaaccgcaagcatcaccaccggcggagggtccagtgctcactttccagagtgagaagntgannggcatgaaggagctgatggtggccacaaagatcactcgagcgccattcaaagcctgcagtcacggcacagtcgcagttgcagatgaggaagcagaaagtgtccaccctagtggttaactctgtcttgtctcaagcggaacgcgaaaggcctcttgaactaatggggactacggaccgttgttgggacccaggtccgcctaatccccaattgtaacccatgtctgcccgacccaaggggacagcttcccttaacaagct

SEQ ID NO: 104820 - DNA, 1867 bp, Homo sapiens
  misc_feature (10)..(10): n is a, c, g, or t
  misc_feature (15)..(15): n is a, c, g, or t
  misc_feature (1604)..(1604): n is a, c, g, or t
  misc_feature (1608)..(1609): n is a, c, g, or t
ggatgtaagngggangccgccgcccaccgcccgccgccatggggctgaaggccgcccagaagacgctgttcccgctgcgctccatcgacgacgtggtgcgcctgtttgctgccgagctgggccgagaggagccggacctggtgctcctttccttggtgctgggcttcgtggagcattttctggctgtcaaccgcgtcatccctaccaacgttcccgagctcaccttccagcccagccccgcccccgacccgcctggcggcctcacctactttcccgtggccgacctgtctatcatcgccgccctctatgcccgcttcaccgcccagatccgaggcgccgtcgacctgtccctctatcctcgagaagggggtgtctccagccgtgagctggtgaagaaggtctccgatgtcatatggaacagcctcagccgctcctacttcaaggatcgggcccacatccagtccctcttcagcttcatcacaggcaccaaattggacagctccggtgtggcctttgctgtggttggggcctgccaggccctgggtctccgggatgtccacctcgccctgtctgaggatcatgcctggagctggctgtacctgaaaggatcatacatgcgctgtgaccgcaagatggaggtggcgttcatggtgtgtgccatcaacccttccattgacctgcacaccgactcgctggagcttctgcagctgcagcagaagctgctctggctgctctatgacctgggacatctggaaaggtaccccatggccttagggaacctggcagatctagaggagctggagcccacccctggccggccagacccactcaccctctaccacaagggcattgcctcagccaagacctactatcgggatgaacacatctacccctacatgtacctggctggctaccactgtcgcaaccgcaatgtgcgggaagccctgcaggcctgggcggacacggccactgtcatccaggactacaactactgccgggaagacgaggagatctacaaggagttctttgaagtagccaatgatgtcatccccaacctgctgaaggaggcagccagcttgctggaggcgggcgaggagcggccgggggagcaaagccaggcacccagagccaaggttccgccctccaggaccctgagtgcttcgcccacctgctgcgattctacgacggcatctgcaaatgggaggagggcagtcccacgcctgtgctgcacgtgggctgggccacctttcttgtgcagtccctaggccgttttgagggacaggtgcggcagaaggtgcgcatagtgagccgagaggccgaggcggccgaggccgaggagccgtggggcgaggaagcccgggaaggccggcggcggggcccacggcgggagtccaagccagaggagcccccgccgccaagaagccagcactggacaagggcctgggcaccggccaggtgcagtgtcaggacccccccggaagcctcctgggactgtcgcatggcacagcccgaggccctgaaggtggcagcacggctcaggtgccagcaaccgcaagcatcaccaccggcggagggtccagtgctcactttccagagtgagaagntgannggcatgaaggagctgatggtggccacaaagatcactcgagcgccattcaaagcctgcagtcacggcacagtcgcagttgcagatgaggaagcagaaagtgtccaccctagtggttaactctgtcttgtctcaagcggaacgcgaaaggcctcttgaactaatggggactacggaccgttgttgggacccaggtccgcctaatccccaattgtaacccatgtctgcccgacccaaggggacagcttcccttaacaagct

SEQ ID NO: 104821 - DNA, 482 bp, Homo sapiens
ggggtctcaccatgtggtccaggctaagaatttgcgtttctaacaagttgccaggtggtgctgctgcagctgatcctgtgaacacgcttggcgaagcacagcactagcagaaacaggacagctcctctgaggatgaaccgctgagtttctggaatgttttctgtggcagtcagtgtgcttgcgttttccttggatgatctcagattgtccccatagcctgccagaaactggcgctttcattatacccactttgcagatgagaatgccgaggcaccaagagaatcagacagctgtgggcacagactcccgagcctgtcctctttactaccacgctgatcagcagtcctcaaaatgggctccccagactagcagcatcactggaaacctgttagatctgcagattcccaagcccattcagacctactgaattagcacctctgcaggtggctgcggtgggctcagtattttgtggtttcacaggc

SEQ ID NO: 104822 - DNA, 425 bp, Homo sapiens
tgatgattcaagctcattacatttttcattagattctcctaagaagcacgcaacccagatcccttgcatgcacagttcacaataaggttcgtgctcctttgagaatctaatgcctccactgatctgacagaagatggattgcttgcctgccactcacctcttgctgtgcagcctagttcctaaacccagggattggggtcccctgtcctagatgacatcttcttccaatataaggccattttgtctacactgaaaacctgttgtctagttgtagccatcttcatcaatgatcttagctccatattctagataacttgtgcagcttctacatcagcacttgctgcttcaccttgcacttctatgttatggagatggcttctttccttaaatctcatgaactgccgggcacactggctcatacctgt

SEQ ID NO: 104823 - DNA, 444 bp, Homo sapiens
acagacattttttaaagcactgctgctctgagaagagcacccggaagttatagaagagcaactaaaacacacacacacacagtgtcttccttgaagaataactggtcagtcgagagacgcaggtggcctgaggccaatgacctcagtggctcaataaatcccaggaaaagatcccatggaaggtcactgctgtcatcctgggctagggaggaaggaaacaaagcttcaggctacaggttggagacagtctgggacccaggatgaatgtaactgagccttcacctgtcgctacctcagtttacccatctgcaagatgcagtggtccccacatataaatgtcctttctgggctgggcacggtggctcacgcctgtaatcccaacactttgggaggccgaagcgagtggatcacctgaggccaggagttccagaccagcctggtcaa

SEQ ID NO: 104824 - DNA, 288 bp, Homo sapiens
taaaaatgtatataacctacagtctaaaaaacactgataatacagctcttcaatatgtcatttttaaatgttaaagttgagggttaagatgataatggataaattatttgtaacaaataaacaaaaccacctttcaaagcaacaacagtagcaagctcataaaacagatggaagtgatagagccaacatcaggctatagatgttaactgtaacaaatgaggggataaaggcaacaactaagccttcctaaggaagaagacctgcttcatggaaaagttaccacagcgc

SEQ ID NO: 104825 - DNA, 186 bp, Homo sapiens
aatttggcaactctcttgatgttgttgccatttttggtgggaagagagggatacgtatttacatgtatgttgaggtgggagagggagagacatggaagtgactagaaaagtactctccaccgcttgcagtgagccgagatcgcgccactgcactccagcctgggcgacagagcgagactctgtctc

SEQ ID NO: 104826 - DNA, 481 bp, Homo sapiens
ctgaagtggagagaatggttcctggagcctagggaaggtaatttttatgagaagacatgacctgttaaggagggagctagaaaagtaaataactgatctcaactcttctcataccctccagtctcttgtttgtgtcttgtaagggcaagagggcaagggatctcattgatgcagttgattcaagtcagcctcttgggtggagtagggtggaatgggaaagggacgatacatagcatcttttctagtttgattttttcttttttgagatagggtctggctctgttgcccaggctgaagtgcagtggcatgatgttgattcattgcaacctctgcctcccaggctcaagctattctcccacctcagcctgtgcctcctaagtggctgaaactacaggcgtgtgccacgcagcccggctaatttttgcattttttgtagagatggggtctcactttgttgtccaggctggtcttaaacacttaa

SEQ ID NO: 104827 - DNA, 145 bp, Homo sapiens
gaccctcttttccagcaacatctttcagcaacaccgtgaacggacaccaagacaagacccccactccaaggaaaacaatctacacagaatcagtcagctgacacctggcaagtgtgctgtcttttagaatcgtgaagccattctg

SEQ ID NO: 104828 - DNA, 210 bp, Homo sapiens
tggcatttgcttctgttccttgtatctgtggaagtcaagtagcccttctcaaaaatgagaagccaagctttaaatagcaaactacagggtattaaaagactaactcttcagttaagaacactgtagaaatggtagaccaacttaaagtctaccttttaacaatctttaccccaaacctaaagattctaggggtcacttatctctattacg

SEQ ID NO: 104829 - DNA, 739 bp, Homo sapiens
ttttaaatggaattaagaggaggtttttagagctttggtaataatcagcaccctgctgaatgttgctggtctcctggaatccttttatgttgtcagccttacctgatgaagacttgccccatttctcctggtggctggccttgctggcgtgtgcgtaacagatccaggtcatgggatgtctggggccctggtggtgatggtccggttccatcactaccactgccagagcattttgcaaacaagtactgtgtactggtttgtctcaaggatccagaatctttttttttttgaaacaaggtcttgctttgtcacccaggctggggtgcagtggtacaatctcggctcattgcaccctctgcctcctgggttcaagcagttcttgtgccttggcctcccaagtagctggaattataggcatggaccaccaaccccagctaatttctacatttttagtagagatggggtttcactgtgttggccaggctggtcttgaactcctggcctcaagtgatccacctgccttggcctcccaaagtgctgggattacaggcatgagccactgctcctggcagattcagaatcttgaaggctgcaacttcccctaaatggaaggcattgaacaatcagatttcaagatcagaattcccagtagaaaactcctgctaataaagagacgtccatgagtctgaggaagtaaattgctcctgctaagtctcctccactccatcttattaaattt

SEQ ID NO: 104830 - DNA, 1141 bp, Homo sapiens
  misc_feature (795)..(795): n is a, c, g, or t
  misc_feature (1140)..(1140): n is a, c, g, or t
ggggattctgggaggtgacgtcgcgggtctcggtcgcggggcccgtttgcagagcccgcggcgccgggaggactttgttcttcttcagaagagaaaactgaagaaggaggaatggctgtggggctttgtaaagccatgtcccaggggttggtgaccttcagagatgtggcgctagacttttcccaagaagagtgggaatggctgaagccatctcagaaggatttatacagagatgtcatgttggagaactacaggaacttggtatggcttggactctccatttctaagcccaacatgatctccttactggagcaagggaaggaaccgtggatggtggagagaaagatgtcacagggtcactgtgcaggttctcactctgttgcccaggctggagtgcagtggcatgatcttggctcactgcagcctatacctacggaactcaagcaatcttctcacctcagcatgcacaccactgcacctggttaatttttttgtttatttttcttgtagagacgaggtctcactgtgttgcccaggctggtctagcactcctgggctcaagcgatcctcccatcttggcatcccaaactgttgggattactggcatacttccacttttggagaattagattatttttctttttcttactgatttgtagtagaactaaattctgggcattattcatttttctatgatatatgttttagttgttttttctcagattgtcccttgccttttgactttgtgttttctcccgcacacaagttttcaaggttaatgtcaaattcattccnttcaaccagatgtcgtcaggatggtagtgaggaggtcatgctccccttcactgtgttctctgtgtcttgcaggtttttaatgctgtaagtgtgtttctcttgatatttttttcatgaccttttccacaatgatagggaattttacaagtcaaccctggttgagttctttcacagagattttggtggaagaaaggtataaaatgcaagggcttaggtcctattattggttttggaatgttctttttttgttcataattttcttttatattattgattacttttgtccaagtttatttaaaataattttcttaagttctgaaataaaatccttatggaattctggtng

SEQ ID NO: 104831 - DNA, 5130 bp, Homo sapiens
  misc_feature (2155)..(2155): n is a, c, g, or t
  misc_feature (3377)..(3377): n is a, c, g, or t
  misc_feature (3446)..(3446): n is a, c, g, or t
ggggattctgggaggtgacgtcgcgggtctcggtcgcggggcccgtttgcagagcccgcggcgccgggaggactttgttcttcttcagaagagaaaactgaagaaggaggaatggctgtggggctttgtaaagccatgtcccaggggttggtgaccttcagagatgtggcgctagacttttcccaagaagagtgggaatggctgaagccatctcagaaggatttatacagagatgtcatgttggagaactacaggaacttggtatggcttggactctccatttctaagcccaacatgatctccttactggagcaagggaaggaaccgtggatggtggagagaaagatgtcacagggtcactgtgcagactgggagtcttggtgtgaaattgaggaattatctccaaaatggttcattgatgaagatgaaatatcccaggagatggtaatggaaaggctagcaagtcatggccttgaatgctccagtttcagagaagcctggaaatataagggtgaatttgagctacatcagggaaatgcggagaggcatttcatgcaagtgacagctgttaaggaaatctctactgggaaaagagacaatgaatttagtaattctgggagaagcatacccctgaaatcagtatttttaacacaacagaaagttcctaccatacagcaagtacataaatttgatatttatgataaactcttcccccaaaattcagtcataattgaatataaaagactccatgctgagaaggaatctttgataggtaatgaatgtgaagaattcaaccagagtacgtaccttagtaaagatataggaattcctcctggggagaaaccttatgaaagtcatgatttttcaaagctcttaagtttccactcattatttactcaacatcagaccactcattttggaaaattaccccatggatacgatgaatgtggtgatgcctttagctgttactcattctttactcaacctcagagaattcacagtggagaaaaaccatatgcatgcaatgactgtggaaaagcctttagccacgacttctttctcagtgaacatcaaagaactcatattggggagaaaccttatgaatgtaaggaatgtaacaaagctttcagacagagtgctcaccttgctcaacatcagaggatccacactggagagaaaccgtttgcgtgcaatgaatgtgggaaggcctttagccgttatgccttccttgttgaacatcagagaattcacacaggtgagaaaccatatgaatgtaaagaatgtaataaagccttcagacagagtgctcaccttaatcaacatcagaggattcacactggagagaaaccctatgaatgtaatcagtgtggaaaagccttcagcagacgcatagcccttactctacatcaaagaattcacacaggagagaaacccttcaaatgtagtgaatgtgggaagacctttggctatcgctcacacctgaatcaacatcagagaattcataccggagaaaagccctatgaatgcatcaaatgtgggaagttttttaggactgactcacaacttaatcgacatcatagaattcacactggagagagaccatttgaatgcagtaaatgtgggaaagccttcagtgatgctttagttctaattcaccataagagaagtcatgcaggagagaaaccctatgaatgtaacaaatgtggaaaggccttcagttgtggctcatatcttaatcaacatcaaagaattcatactggagagaaaccctatgaatgtagtgaatgtgggaaggcttttcatcagatcttgtccctaagactacaccagagaattcacgctggagaaaaaccttataaatgtaacgaatgtgggaataattttagctgtgtctcagcccttagacgacatcagagaattcataatagagaaacgctctgattataacaagtataggaaagaaaacatgtggttaccactcaatccttattaaatattagtgagttctttttggttagtaattctttgaatgtagttcatatttcagttcatgagtatccgttatttgaagtagctcagtagtagacatctgttacttttttttttttcagacagagtctcgctctgttgcccaggctggagtgcagtggtgtantcttggctcactgcagcctctgcctcctgggttcaagcaatcctcctgcctcagcctcctgagtagctgggattacaggtgcctgccaccatacctggctaatttttgtatttttagtagagacggggtttcaccacattggtcaggctgatctcgaactcctgactttaggtgatccacacgcctcagactcccaaagtgctgggattatgggcgtgagccaccgcgcctggccacatctgttactttttgatctgttctatacctggcttagcccaccctcaatgcatatgattcagatgaaactgttaatcagggacagcagtggactggtcacaggctggccaattatttcccccaacctagtgataagggattggcaaatggccctgtctggatcaatgaagtcctttgcgggtattcctatgggcagtaagagaggttttattctggaactgcaagtttcaaggatttaataagattaaaaactcaccagtagcctttttgccactcatgaggaaagctttcccaaagagaaatctaacagaggaaaatggagatgagagacagaaatatgatgatacagcttgatctcctggatccagtcattcctgacagctacaccatcaccatcctttttcattttttgtgatccaataaatttcctttttttgcttaatttggattatatttttgcctcatggaattagagtgctgattcacacattctatgtttgctatacataaaagaaagccttaattttttacgtggcataattatttatcctgaggagcaaccttctgatataacaagtttatgaaagttgaatacacagccttcataaaactgagataattgttacattttatttgtcgataaaactattttagtgtttcttagtttttttcacattatggctgaatattttaaaattcaccaagtaaaattctttaacaggcttccccttaaggagttaaaatcatttgtcacagtgactcaccatttgcctgtaaagagagaatggaaagctaagagaataatactttcatttgtttaatgaatggctcttcatcttcaaggaattacttgattttcttctttcagtatgggtctaaacatattctgtggcagaatataataacaattaaattgtaaatgaggtcttttgtgggtgggctctaaatttggtttaagacccagtgcggtggctcacgcctgtantccgagcactttgggaggccgaggtgggcagatcacctgaggtcaggagttcgagaccagcctgaccancatggagaaaccccgtctctactaaaaatacaaaattagccgggtgtggtggtgcgtgcttgtagtcccagctactcaggagggtggggcgggagaatcacttgagcctgggaagtggaggttacagtgagcgaagatcgcgccattgtactccagcctgggcaacaagagcgaaactccttctcaaaaaaaaaaaaaaaataaataaataaataaataaataaataaataaatttggtttaagaagtgtatggataacttctttgcagctagagatatcaaacaaagatattgctggcagaaagaatgagtcatttttaacaaatggtaaaagtaaagcagttaatgcctaaaatttttagagactaaatcatttccattattgggagtaatgaggaagatgaaggtgtagggcaatacgtttcttttttatctgagtggatatagggaaataaactggtgatatggcagctgggccatcttgaatagtgagaaccagtaagaatattgggtattgcctgaagagcatctgtaaaaacatatcagaacaaatgaaagaggaaagaatgaaggatttatatgtgtgcatagagtgaatatatgtgtgcatagagtgaaatattcaacttatacttatttctaataaaatctgaaaattatttttcataaatattcaaattccctttaaacagcttaaaatacagatttagtgactcagtacttcaaaccttgaatagaaacaaatatgattataaaatatttccaaacttatgttacatctaatctgaaacatattaatattataagcttaattcatgtcatcatttctttattttttattatatttcctggaggtataaggatatttatttttataatttccaagcactgagtaataatttatttcagaaagtttcagaaggttacagtaaactttaccaaacttgaagaagaatgactcagatcagtaagaagagtctgagttactcactaattgatttttattttatttatttattttttttgagacagggtctcactctgttatccaggctggaatgcggtgacacaatcatggctcgctgcagcctcaacttcccaggctcaagcgaccctcccgcctcagcctcctgagtagctgggactgcaggtgtgctctaccacacctggctaagtttcgcgtttttctgtagagatggggtttcgcgagttgcccaggctggtctccaactcttggcctggagtgatttgcccatctcggcttcccaaagtgctgagattatagggatgagtcactgtgcacagctactaattgatttttgatctatgtatggcacctgatttcatcctcgagagtgacgtaaacctaagctactggttcattctctgtttatatagttaaacttcacttgtaatgttgataaaatcttttgtacccatgtgtttagcttcagtgtattttacaatctgatgtttctcctcacaatgaagtactaaattttgtttcttttcaactgtacaacccattgtcttgtgatatattgacctgatctcttaggattagtgaaaatttatgctttattaatatttgattgttattaggaccatctagagatttctgtttatgtgtgtgtatgtgcatctgaagatgtgtattttatttaaattttttgtattaagtgcc

SEQ ID NO: 104832 - DNA, 723 bp, Homo sapiens
ggtgcaagaattttgccttttttagggatttatttgtatctgaaaaataaatgataaagaaggagtatattaatttgtaggccatttttatggttttatgtgataacatttaacttttggtaaaccttatattacttactgagaaactattttttaaaaaagatagggaggttaagataaaatactctttttgctttagtagacaaaatttgaaatgagcattctgaattgacatggatcataggaatttatttgaccactacttcattggcttagatttgattctttttttgacagttacctttatttgctttttactgatcaatttctcttatcatacagtagaagtatctataaagtaatgttcaaatgtacatattggagccttgattttaatactataatatttcaacattagcatacgaagtagtggattacaagaaatactaacaagctcttgttaaaatacagtttgtcacatgaattctacaagtaacgtcacaaagtgttactgtattttttccccctagtgtgatggtgaaaatagtttgcatcatagtgaaagagaatagacattttagaaattgtcttttaggacagtttcctttgtgacttaaaataatcttgtattgttaagatgttaaacttgttgagtcctagttccatacaaagtaccagccttttaattttattaatatagttataaattctttttatataatt

SEQ ID NO: 104833 - DNA, 825 bp, Homo sapiens
gaggtgtcactatgttggccaggctggtcttgaactcctggcctcaggtgatccgcccttctcggcctcccaaagtgctgggattacaggcatgagccactgtgcccggccacctgtttctctaaagtaataattcgtcacagctggtgccagggaaggacagtttcctaatagatagaaaatacctgaaactgatcagcagcttcccagtaagatctcaggaatggggagaagttataatgcaagatcccggaagtatgccaatatataaagccccaagtccagaggtcaagctgcacactggtttctcaggtcatcccacttccctcttccaagttgtattttccttcttttttttccctttccttcctttccttactgttctaaagctttttaataaacttccactcctgctctgaaacatgcctctgtctcttctgccctatgcccctcggttgaattctttcttccaaggaggcaagaattaaggttgccgcagatccgtacagattcaccgtgggtaactccaggtaactcagatatcttccatcagtaacgaaactgtttaatttactaatgaaccattgattaaattatgtaacactattttttaaaatcgaggtaacattcacataaatttacattcacaacaaatttaaacttcatcatttaagaatttaaaatttaggctaagcacagtggctcatgcctgtaattttaacactttgagacaggaggctgagacaggaagattgcttgaggccaggagtttgagaccaggcttggcaatatagcaagaccttgtctctacaaaaaatagaaaaa

SEQ ID NO: 104834 - DNA, 835 bp, Homo sapiens
ccccacgcgtggaccctagaagaccgactaggtatgggcgttcactcggagcctctgttcacgctcttgaaaaccgaatgaacagagaagtgccctccacccttcgcctgcgccagggcagttaacgtgcaggcgccgccgggattttcctggaacaaacccgggcacttgatcttccgcaccctcggagctgccctgggaagtcgaaacaagtctgggcgcccggactgcggagactggaaagcagggggcggagggcgggagactgggggcgggaagtggaggtgcaggctgcagctggggaccgcggtgggcgttggaggggagggtctgtgtgcgcggctgtcctccagcgctgggggagcggacgggccaggggcctctagggaagcggcgctccgggaccggggtggctttcccgtctctgtgtgcgcggcgatccccacacccagctcgggcggaggagccctgagagaagcggctagctgagagtggggtgggcgttttggggaaaggtttgcgtgcgctgcggccctaccgctgctagagaagtggaagagagagagtgggcgccgggagggggtctataggcgccgcgacctaccccatctccctccacgcttgtgggggagtgagtggggaaggggctttgggagaggcggcgcgcgggcactgaggtgcatcgtgagcttcccggacttgacagcatcaaaggaaaatcctggcgagcagccagggccagcgagcgaccccagcagcagggacgcggccgtgcgagagctcgcggacaggcgagggggatcccaggggagcagctgctgcccacgggccacgg

SEQ ID NO: 104835 - DNA, 115 bp, Homo sapiens
gtggcagccaagttcatcagttatgtgaagaattgcttccggatgactgaccaagaggctattcaagatctctggcagtggaggaagtctctttaagaaaatagtttaaacaatt

SEQ ID NO: 104836 - DNA, 437 bp, Homo sapiens
tttctttgcaactctgagctcttattgccaacaatttgggagctcatctgggattaccgttctccttcaggagaagcccacgatcacctctcttgaggagaggcatcccaccacctctttgcggtggcctcacaaacaggagattgggtcccacccaaggtgacacataaacccagactctcagcaacacaggcggaaaggatcctcacatactgcggtgaccaggtaactgcacagaccaagttaagaaaagtcacaggggcgacaaagtatttccttggtggtcagggcattttagaggttgaaagtgtgtcaatgagacgcacaactgagtgcgaagcgagcgatgattccggatctgtgattccatggtcacctcgtatagcttatggtggattcctgtcatggggcttatactgacacaccaatgctaagga

SEQ ID NO: 104837 - DNA, 342 bp, Homo sapiens
ccctttcagcgatgtgcattttgtaagcactttggagccactatcaaatgctgtgaagagaaatgtacccagatgtatcattatccttgtgctgcaggagccggctcctttcaggatttcagtcacatcttcctgctttgtccagaacacattgaccaagctcctgaaagatgatgagttcctgtcctttgtagggacacggatgaagatggaaaccatcattctcagcaaactatcgcaaggacaaaaaaacaaacactgcatgttctcactcataggtgggaattgaacaatgagaaacatggacacaggaaggggaacatcacacaccggggactgttg

SEQ ID NO: 104838 - DNA, 359 bp, Homo sapiens
taaataagagactgttactcatgctggagtgcagtggccaatcatggttcactgcaaactccacctcccaggctcaggtgatcctcccaccttagcctcctgggtagctgggaccacaggtgcacaccaccacacctggctaattttttgtagagacaaggtttcaccacgttgcccaggctggtctcgaactctcgagctcaagtgatctgctcacttcagcctcccaaagtgctgggattacagacatgaaccaccgcgcccggccagggtattttcaagtgtgaatcttgtagcccctaccaccattccctgccaccgttttggcattctttgaagttaaagctttcttatcatag

SEQ ID NO: 104839 - DNA, 350 bp, Homo sapiens
gaggtgaattgatgaggaaacaggcagtaagaagttattcagcatctgtctttttaatcatctaatttgtgcaaaactgagtgggagtttataaactactctttatagcactgccgtaggatttttgcctcatttagtatttagcacatgtgagtcatttattccttcttctcaatgatggtaaacagtatgatggtagggactgttttatttttttgtttaattagtttttgtttttgtaacagcactaactacagtgctcttcccacaaatatcaacaaatacctgttaaataagaaaacatttaagggtttgacagtgaaagaaaagaccaagcaagataacagcac

SEQ ID NO: 104840 - DNA, 443 bp, Homo sapiens
tttttttgagaccaagtttccctcttattgcccaggctagagtgcacaggtgtgatcctggctcactgcaaactctgtctcctgggttcacgcaactctcctgcctcagtctcctgagtagctgggattacaggcgcccgccaccatgcccagctaatttttgtatttttagtagagatagggtttcacgatgttgcccaggcttgtcttgaactcctgaactcaggtgatccgctcacctcggcctcccaaagcactgggattacaggcgtgagccactgtgtctggccaggattttgctttttagacattgtggttcatttttctatacatgggtgcacgttacacaatctccatagcagatttttctcttttagtaatgtaatgatctcccactaggtatgtggcaaaatactggaacacgagggaaaatcagagcattg

SEQ ID NO: 104841 - DNA, 168 bp, Homo sapiens
caccaaatatgtccatgtcctcataaaaagagaggagacacacagagggaagatgatgtaaagacagggaaggaggctatgtaaagatataggcagagattggagttaagcagctgcaagctgagaaaagcaaaggattgcgggaaccaccagaagcgaggaagaggc

SEQ ID NO: 104842 - DNA, 309 bp, Homo sapiens
ctgtttacatttctcctgtccacttaaaaacatgtcctctttctcagtttgttttgacattggtatttgccagttttttctaaggcctaagtggttgtaatttctttttcgttgcggatatccattttcgttcctggtttttgcattttttttcccgagagcgctccaaacagcacgacgatcccggtggcccgcagagtgcgcgcagtcggggagtgatacgtcgcactccagcgcctgcgcactcgtcgctgcgtctctgcgccccgcactggacgtgggcacgccacgtgacccccccccccgccg

SEQ ID NO: 104843 - DNA, 251 bp, Homo sapiens
gggcagagggtgcgccggagctgctctctgattcaggtggtcacccgttttcatcccagatatccattttcgttcctggtttttgcattttttttcccgagagcgctccaaacagcacgacgatcccggtggcccgcagagtgcgcgcagtcggggagtgatacgtcgcactccagcgcctgcgcactcgtcgctgcgtctctgcgccccgcactggacgtgggcacgccacgtgacccccccccccgccg

SEQ ID NO: 104844 - DNA, 259 bp, Homo sapiens
tatgatgcaggcaaaagtgatctgtgatctgttaccattatgatgcaggcaaaagtgatctgtgatctgttaccattatgatgcaggtgaaagtgatctgtgatctgttaccattatgatgcaggcagaagtgatctgtgatctgttaccattatgctgcagatgaaagtgatctgttaccattatgatgcaggcagaagtgatctgtgatctgttaccattatgatgcagatgaaagtgatctgtgatctgttaccat

SEQ ID NO: 104845 - DNA, 375 bp, Homo sapiens
ggaatatcatgatgttctccaagttaatgaggaacatatcgagcatcagaaagctaaatcattataaaatgaaatctgcaagattttctttggattttagctttccaatcatttttttaaatatatatatttataggtttctaaaagattctataatgtggtcttctctccactaacatgaataaattcattttaccaaacatattctctgaattcattcacataaatactaatgtttccaaacatgaatataaagtgggcaaaataaaaaacagtggtctctggagagcttacatctgtcacaagttggcttaggctattgcaaatgaatttgtaagatgagccaagaaacttatcaaagggaaggaaaacaat

SEQ ID NO: 104846 - DNA, 349 bp, Homo sapiens
tgagacggggtctcgctgtcgcccaagctggagtgcaatggccacccggcacctcgcccagctaattttttttggatttttagtagagacggggtttcaccgtgttaggcaggatggtctcgatctcctgacaggtggtatatagaaatgtattcagtataatttagaagtctcaaataaatagcttgtatttttttggtgacttgaatatattaataatacatttttgaactttttactgaagtgtaacataagtacagaaaagtaaatagcttatttgattttcacaaactgaggaacactccaaaccaggacccagatcaagaactagaacctaaccagcacccca

SEQ ID NO: 104847 - DNA, 189 bp, Homo sapiens
tgatagtaaagtgtgggcagtctcaagtaactcggtgtaacaagagcctgagtgtgtgaataggaaattaatcaaaactcccttgtatgttgtgttgggcagtacttagaggatcaggctatagcaactgtactttccccctcttctgtagaatagggattgggctggatcgtgatcctcaggcctttt

SEQ ID NO: 104848 - DNA, 728 bp, Homo sapiens
ggactggaaggtcagggagctcaggtgacgtgcccaaggtcatggagccaataaatggcagatccaaaattcataccagatcagccttattccaaaatccatgttggcgggagaggggaaatgcagtgccagagagatttaagatcctcaatttagactgctggtagggtaccaagaaatggcagctctgtgaataggatgttttactgtaaagctcgtaaatagtttacctgtttaatttttctctgccttttaaaagtttggcttttttaagattccataaacacactattcaatatagatgcagtaaaatcgtttttcttcaaaatacacagtattcagaagattctagtttcaggaattgtggagtagctcatatcagactactcctcccacagatagcaatgataaactatggacaaagtagcaaccaccaggacaaaaagaaacaactatttgaaggccctggagaataacaaagatcaggtagaaactggagagaatttcatgcttgataaaaaggaactgcattgggtgagatgcatgttacttatacggccccttcctgaagggcactttctaggccacagcacttaggagttagaactcaaaaagttccattattattggcttgagatcttgtaggatggggtttagagctgccagagtagctggaagtggaggagggaaatcccaaaaagaagggagactaaagggtgggactccca

SEQ ID NO: 104849 - DNA, 319 bp, Homo sapiens
tcctgttgagttgtaggagttatttatatattctgagtatcaatcccttttgagatatatgatttgcaaatattttctattttataggttgtcttttcactctgttgatagctaataaacaaaagtttttaatttgatgaaatccaatttatctatttttttacttttgttacctatgcttttggtttcaaattcaagaagtcactgtcatatccaatgtcacaaagattatcccctaggttttcttgtaagttttatagttttagctcttaaatctttgatccatttggagttcatttctgtacgtggcataattctt

SEQ ID NO: 104850 - DNA, 115 bp, Homo sapiens
ttggctgagcgcagtggcgtacacctgtagtcccatctacttgggaggtcgagatgggaggatggcttgccattactagaatgggcaaagtcacaggagggcaggttggaggagg

SEQ ID NO: 104851 - DNA, 194 bp, Homo sapiens
taagaattggatgaaattatagctataaaaatttaagacaaatctgaattcatgagaatataagtgaaacaagtaaaagcaggttgtttttagttaataaatgtttacttacagtaaggaaacagtagttgtttaatgctatgaacatttccacagcaatatatcaatagaggtagtctaaccttaataggcta

SEQ ID NO: 104852 - DNA, 338 bp, Homo sapiens
actaccgctactacctccctagttcaagccaccatcattcccagcctcaattgttacaaatcctaactggttctccctgcttctgcactttgctcttcataatttattcttgaaacaggcataactctgcctcagagaaatcctgttaagtgttaagatgtaagtcacctggccaggcgcagtagctcacgcctgtaatcccaacactttgggaggccaaggctggtggattacttaagaccaggagttcaagaccagcctggccaacatggtctctactaaaaatacaaaaattagcatggtggcacacacttgtaatcccagccactcaggtggct

SEQ ID NO: 104853 - DNA, 578 bp, Homo sapiens
ctttaagatctcagatgctctgatcaagcgcgtccaggtgtctcaggagcagtgggtcaaaggcgccctggagccgaaagtgtctgcggagtttgatctgactttggacagcgagccgctgctgcaggccatccaccagctggacttcattcagatgaaatgtagggtgccacccgtccccctactgcagctggagaaatgctgcacccgtaacaacagcgtcacgctggcctggaggatgccacccttcacccacagccccgtggacggctacatcctggagctggacgacggtgccgggggacagttccgggaagtgtacgtcggtaaggagactttgtgtaccatcgacggtcttcacttcaacagcacctacaacgcccgagtcaaagctttcaactcttctggtgtcgggccttacagtaaaactgtcgtcctgcagacatccgatgtggcctggttcacatttgaccccaactctgggcatcgggacatcattttatccaatgacaaccagacagccacctgcagcagctatgacgaccgggtggtgctgggcacagctgcgttctccaagg

SEQ ID NO: 104854 - DNA, 288 bp, Homo sapiens
gggtgacatggctctatatgattattattatttgaatagcaatcagtgtgtagctagacggagcacagaaggctccccacggtggggacgctctgtttggctttcatgcctcacctgtccctctactctcccaggctcacctgatctccatttggttctgtactctccctgtcatcctcactcaggtggtaggtcccagctgttaacctgagctattgccacctgtactgcaacctgccatggccaattttcttttctttctttctagttttcttttctttcttttgt

SEQ ID NO: 104855 - DNA, 399 bp, Homo sapiens
cactcaatctgtctctcaaactataccaagaagttgtccctgatttctagttttagaatcatcagagatgatttctggttttattttgatttgctttagacaacctaatatttcccatatataacaaataaaagcagtaaattagtgaatcagtagcagttcactaagagctatttggcaaaatcattctaccaaacagcttgaatacttccaaagcaccagaggacatcaacacattaagcacggcaaggcaaaaactgatgctattaatgattccaaatcttgaaatacattttaagaaaacaaaagttaaattgtattgactgtattgtttaatgagaagagtacacagtttataagaacatctgctctacaagaatccttttttctttttttgag

SEQ ID NO: 104856 - DNA, 683 bp, Homo sapiens
tcaggtgatgggtatcccaaaatctcagaaatcaccactaaagaacttatccatgtaaccaaataccacttgttccctaaaaactattgaaataaaaaaattaagctaaaacatttcaaaataagatagaaacattaaatatctaatgaatggaaaaataacacggaatatactgaagatacaagtgaaacaagtcaaaaatacaaattccaaaatgaaaatatctgtaccaacctcacgcaggtggcgtgaggtggtgctgagaaccagcaggccttctttgggccaaatttctggttacagatcccacaagtagaaaacaggacctttgggctctcccgtatttgcagaaggttcaacacttcattccttctaggttaaaaataagaatgtgggagggagatggctcctagagagccttgagctctaggttattcatctcctccccataaatcaagcaaaagcacccatgatctcctctccccaaacccagcttttaaattaagttttaactcagaatgagagtgacaaattccttaatagcagtatataaataatttttgtgttttgaccaaatttaattcaggcatatcttaaaaagatcaatgttaatcatatttaaaattatgttttgaagttaatttaaattatatgtttagtctgtcctagatattaaacacaat

SEQ ID NO: 104857 - DNA, 440 bp, Homo sapiens
caaaataggttcacgattcatatccaaattatgctttgcaattggaaaagggtttaaaattttatttatatttctggtagtacctgcactaactgaattgaaggtagtgcttatgttatttttgttcctttttttcctgacttcggtttatgttttccatttcctttggagtaatgcctgcctctagattgttctaaatagaatgtgggcttcataatttttttttcccacaaaaacagagtagtcaacttatatagtcaattacatcaggacattttgtgtttcttacagaagcaaaccataggctcctcttttccttaaaactacttagataaactgtattcgtgaactgcatgctggaaaatgctactattatgctaaataatgctaaccaacatttaaaatgtgcaaaactaataaagattacattttttatttta

SEQ ID NO: 104858 - DNA, 533 bp, Homo sapiens
caaaataggttcacgattcatatccaaattatgctttgcaattggaaaagggtttaaaattttatttatatttctggtagtacctgcactaactgaattgaaggtagtgcttatgttatttttgttcctttttttcctgacttcggtttatgttttccatttcctttggagtaatgcctgcctctagattgttctaaatagaatgtgggcttcataatttttttttcccacaaaaacagagtagtcaacttatatagtcaattacatcaggacattttgtgtttcttacagaagcaaaccataggctcctcttttccttaaaactacttagataaactgtattcgtgaactgcatgctggaaaatgctactattatgctaaataatgctaaccaacatttaaaatgtgcaaaactaataaagattacattttttattttattgtttgcccagtcactttttgttaacagaatattctaatgatatggagattttttacattacaaattgggggagaaggggagcgcgcgcgca

SEQ ID NO: 104859 - DNA, 108 bp, Homo sapiens
gacactctccaagatgaaattaaccatcacacatccaccccttgtcatcctggtgctcatacacatctccttacaccacgattaatctccactaaaggcgataacaag

SEQ ID NO: 104860 - DNA, 398 bp, Homo sapiens
cagggatgctgtcggggactatggcggggatgctgctggggaccttctgtagacgtggatgccgcccccaccgcacgatagcggcagtgcatttcttccttctgttttagtggtacattcacaggaaatcgcccgtttctagaacttgctgtttcatataggacctggtggtgtcagggagaccagcctggccccatgggaagcgtctgtggctcctgctgcccgtggttagcacactctgctgggggtctgtgtggcctatcatctgtggccacacggacgcagggcctctgggtgtctggcctggttcccacactgcccctcggaaggctgccaggatggaggccatgctctcgcgtgctggggcctttggatgcaaagtgctggcccgagcagtc

SEQ ID NO: 104861 - DNA, 497 bp, Homo sapiens
  misc_feature (17)..(17): n is a, c, g, or t
atctagaggatcctatnagagcatacccctctggaagagagagttgagtgaagctgtaggagtagatttcatagcttagaaagagtgtaaagaatctgaagagaaaaggactagggatgggatcctggaaacacccgcctgtaaggggttgaccagagagcagcactgtcctaagacttcaccaacaggcaacaaaagacctgtgctttaaaggtcctcatatggccttcctccagcagctacaaccctacccatagagtgaagactttgtggggggccaaggtgactagactagtctacctggtctctttctagatcagtctttgaatatttgatcctagaatttcctgcccatgtgtcccttcacaactgtcttctctgattctttcctctcttgactgtacgacacatatgggatcccctgtgtttaagggatggccaaggagcagctgtttgcagtcatgtgaccagagcttggacctgtaggctttatatat

SEQ ID NO: 104862 - DNA, 544 bp, Homo sapiens
tgctctcaaatcaggagacattaatttagaagttgacaccccctcggaaaataataacagaaacatctatctactctgaggcagataatcattcccactttacaaatgaggaaatgcggataatataaacttttgtgactcacctacattgctgatgagtaacaaatactggattcaaactcacatctcttctgcttcaaactccaggtagccttctctatgtgcagtggaggttataggattcttgtttcataggttgtcgtaagaatgttgacagggctttgcagacttcagagataagggggattgctgttgctgctgttaaaatataagccccaaggcaggaagaggtgaggattcacatgaggtatagagaagggtgtaagcagagaacaaagttagagggaagaataagttagtagcccagtgggatgggtgaacggatgaaaaagggtgtcagagaacagttaaccacagcgcgccctgatttcaaagctctggcctgttgggttgtgacattacatagatgtgttctgacccatct

SEQ ID NO: 104863 - DNA, 441 bp, Homo sapiens
gtgtttttcgttctgacaaagtattttcatgtggccttttattatagtatagttaagctagatttaaaatcacattccagactgagggaaaagcgtagtcgtttcagcacatttgagatttgccccttaaactaaaacagtattatatctcctttttagaacaacgtttttggaaattaactgacaagaaatataaactgaagcgtgtgccggctgggccctgcccccattctgttgcttcctataaccgctgttaatggatgggtggcagacccttctaggtttttcctgagcacacgggcagccgtcgtgctattcctaatattacggttttcttccttaataacaaccgatttcaatattaattggtgattaaataaattagtgattaattagttattagtattttatggcttcagagtatggaataaagaaatttac

SEQ ID NO: 104864 - DNA, 615 bp, Homo sapiens
cctgccttgggttggggaaaggagagcaggaaaacatcaaagagactctgtttcccaaggccggctttctgaggtccacagcgcccagcatataacaagatgttgtaacaaaacttatgggagttgggagctaggaactgtggatgaaaaccaataagtatataattataatatcacagattgtgatattgctttggagagacattttatctgttgtgataattaacttttattataggtcttttcccccaagtctctcctagtttttccctttgtgacttgttttttgtcacactttaaaattctgtgtgttaaattataaaattattcattatagcccaggcgaggtggctcacccctgtaatcccaaaactctgggaggccgaggcgggcggatcacgaggtcaggagattgagaccatcctggccaacatgatgaaaccccatctgtactaaaaatacaaaaattagccaggtgtggtggcacacgcctgtagtcccagctactcgggaggctgaggcaggagaatcgcttgaacccaggaagcagaggttgcagtgagctgagattgcgccactgcactccagcctgacaacagagcgagactccgtctc

SEQ ID NO: 104865 - DNA, 997 bp, Homo sapiens
gagatcattaccctgttctgtctcttgtaaaatatatgaaaactctcagggcatatattttctatagtcctccctgtatttaaggcaggaagttaaatctggccctattactttatcatggacaatagtagtagtcctgtattccttcttgaatcaaaattaatatatacttttctataaatttttccatttcttctaatttattgataagctaattaataattttatctttatcttttaattctgcttttctatagttaggtctacttttctatttataagaaatatatatgtgactttttgttttccttgactattctttccaaagttctgtattgtttgttagactgttcaatgaaacaaatttgctttctttgagccttttatttgttttttctgtttacttgacttttctgttattgttactattttctaatattatttttactttcttcaatttttaatagtttactatcttctgctttctcttagtttattctgttgtttcttttctactttattagttgaactttaatgttcttcctttattatttttgtaatacaagcacttacactataaatttagattgaaatagagcttttactgaaccccacaaattttggtatgtgatgttgtcattatcacccaatttttagtatttttacaattccattataatttctaacttgatcctgaaaatatgttttttaaaaatttccaggccagacgtggaggctcacacctgtaatcccagcactttgggaggctgaggtgtgaggatggcttgagtctaggagtttgagaccagcctaggcaacagaatgagactctatctctacaaaaattttaaaaaatacctgggcacagtggcgcatgcctgtagtctcagctgctcaggaggctaaggcaagaggattgcttgagctcaggaggttgaagctgcattgggccgtccttacaccactgcactccagcctgagcaacagagtgagactg

SEQ ID NO: 104866 - DNA, 339 bp, Homo sapiens
ttcttagtgaacatgttgaggatgtacatttccccgtgtattgaagggcggtgcccctcaccttaaatattgttaccagagctcattttcctttgcccagagtgcctggaacattgaggcccaaggtcaaagggatgggggtgtctgaaagctggcagagagccctgggcactagatggggtacaggcactctcacagcctgacatgatggaaggaacagatcacctgctacagagagtcagcagatcttcatttgtttgtttgtttttattagcttctcaaccagctcctcaaagtgggttccatggaccactgcatttccatgagattcagctgagt

SEQ ID NO: 104867 - DNA, 565 bp, Homo sapiens
  misc_feature (18)..(18): n is a, c, g, or t
  misc_feature (29)..(29): n is a, c, g, or t
  misc_feature (47)..(47): n is a, c, g, or t
  misc_feature (443)..(443): n is a, c, g, or t
  misc_feature (455)..(455): n is a, c, g, or t
  misc_feature (499)..(499): n is a, c, g, or t
  misc_feature (514)..(514): n is a, c, g, or t
  misc_feature (519)..(519): n is a, c, g, or t
  misc_feature (531)..(531): n is a, c, g, or t
aggaccaggattacgaanttaatacgacncaccaatagggaaatttngccctcgaggcccaagaattccggcacgagtgcagaaaacacctttgagtatatggatttcttcatatttctagttatttccttaaggtaggttcccaggtatgatttttgagtcaaaggatatgagagttttttaatcttgaaatgtggttaaattgcttctcaaaaggatagtattactagtactgtttcactgtattcttttagattgggtattagtgctgttttctccttcccccaacttactaggcgagaaaggtacttcactgttgtggttttagagtgcatttctttatgtaacagttttttcatgaagagtaaaattgattataatgtcctaagacatgaactttaaaaaatgtgatattacttttaattaagcggccgcaagcttanttccctttagtngaggggttaatttttagcttgggcactgggccgttcgtttttancaacgtccgtggacnggggnaaaacccgggcntttaccccacttaattcgccttggcaggcacagg

SEQ ID NO: 104868 - DNA, 458 bp, Homo sapiens
tgactagtcagtactgctcaaaaatgtcaagattatgaaagacaaagaaagactaaggtactttccagatttaaagaaattaaatagacaggactactaaatgcaatatatgagtctgaattggaccctggactaaaattaggcagacagttggtgaattttgagtcaagtctgtagagtagttaatagtatttctggttttgatcatcataatatggttatttaagatgttaacatttggtggatctgggtgaaaagtatatgaggattctctcgcagtatttttgcaatttttttaaatctgaaattcttttaaaatgagaagttggctgggcacagtggctcacacctgtaatcccagcactttgaaacaccaaggcaggagactcgcttgagcccaggagtttgagaccatcctgcgtaagatggcaagactccatctctttaaaaaaaaagaa

SEQ ID NO: 104869 - DNA, 737 bp, Homo sapiens
ttatgatccttagtttcaaccttaaaattaaaatacccactttattaacttgctcattccctatcttatctattgaaaaaggaacaaaacatgaaactgagcttagttatagatgaatgtcttttaggatgcagctcattaatatgatagatcagaggataatgatctttcagcttccctgggccacactggaagaattgtcttaggccacacataaaatacactaatgctaatgatagctgatgagctaaacaacaacaacaaatcacaaaatgttttaagaaagtttacaaatttgtgttgggctgatttaaacgccatcctgggccacagactggacaagcttgttctaaattaatcaatttttttcacttctataacattttttgttgttgttgacagtcttcttgctctgtcaccctggctggaatgcagtggtgcgatcttggctcactacaccctctgcctcccaagtccctctgcctcccaagttcaagcaattctcatgcctcagcctcccaagtggttgggactacaggtgtgtgccaccacgcccagctaatttttgtattttttatagaaacagggtttcactgtgttggccaggctggtcttgaactcctgtcctcaggacatccaactgcctcagcttcctaaagtgctgggattataggcattaaccaccacacctggcccctaacaagttttaattcactttatccatgaccattaacgtt

SEQ ID NO: 104870 - DNA, 217 bp, Homo sapiens
ggcatgtgatccgacactactgagagcccaactagtctgggaagccggacacaggcacagcagattctgatgcaggagatgactgaccacactgggaaactgctgctgagtcccttcccttcttgcgtctctcctgcacccgaatcagctgcctttcctgccatgctcccatctccaagggaagaaccaaatgctgggaggcccagtcatcagtcag

SEQ ID NO: 104871 - DNA, 739 bp, Homo sapiens
caaaaagatgcacatagaacccactgggatcacttcttatggatatagaagctggagaatgagagctgttttttggtgtaaatgagccaaaatcagggtcacttttgttcaagctgttattgacttggttttcactgtaaacactggaagtagtctcgaattttagcccaggatgtacagcctcagagcaaaagacaagtaggtggaacacagcatcccttcctctagacaccgttacattaaaatggcaatcattacaagtacagcaagtatacttcataatgaattcattattctgttcataagctttttagggactatattattatcccatctaagaggcaggatccactgatcatgcttggtcgaggttggcttcccctgcctgtttgcgaatggtgccttgtaacgtggagacagggagtggggagagtgagggctgagaatctctactcagaggctttttcacactgtccagatatcatgaaataaaaataaatattttgacagtctaagagaagattacagtaacgtgatctaccttaacacaatagaacacagataataaggacacttgtaagaaccagaattcacaaaaggacaaatattcctctagattcctaagagtttaaactaagcaaaaaaatcctaagtggtgaatttttaaagtgtcttttaaaatttcactaattcagtaaacaacatataaatggattttttattgctttcactggtttct

SEQ ID NO: 104872 - DNA, 221 bp, Homo sapiens
ctttgccttttagatgcgattttttttttttggggagaccaaatgtcaccagcttatcatctacattgatagtaccattctcagaacatttctcaactgacactgtatggacatacttagtaattcttttcacataaagcattacattctgattcaacatgaaatttttaaatagcattattattaattgagaagagcttccactcaattccattagtcct

SEQ ID NO: 104873 - DNA, 176 bp, Homo sapiens
gtggcaacccccgatctgttttttgtctctgtagtttcagcagtgtgattttaactgaaagccttgatgaaccagagcttattgttgttttttctgtggaaagcaagtgcacatcagggattcagtgtaaaacctttccaggggccgggtgcagtggctcatgcctgcaatcccag

SEQ ID NO: 104874 - DNA, 400 bp, Homo sapiens
ggttgttgattttaatgtcctcgataccgtacatgttacatacattctttggtgttgtacaatatttcacaagaaaaagatgatggaagacagtcgcccaccctcagccacagaaccgtcacccactggcccgggttctacacacgtactcccctcttccctccctcaaaccatgcctaccatctcagccttgacgaaaagcagctgtgaactaagtaaatgtcctttgctgaggggttccccaaggagggagtgagctaaggctgcttttgggggatgttaggattggaaagagcagttacaactgtccccaggttttgcccaccagtccagtaggttttcataaaaactaggtgtctatccaaatcttccaccaacatagctacttttagtttctttc

SEQ ID NO: 104875 - DNA, 216 bp, Homo sapiens
tatagaggtttccgattttgaatcagaagtttcacatttcgttgaaggtagacatcactctttctctatttgcttttgtgatttgtgtcttgctcaaggccttccctgtcctacccccatgtcataagcatgttctccactattttctttcagtccttaatctttcttccgtaggtagccaatgtccagcacgtttggtaatgacacctcctcggt

SEQ ID NO: 104876 - DNA, 363 bp, Homo sapiens
gctctgtcacccaggctggagtgcagtggcacaatcttggctcactgcaacctccacctcctgggttcaagtaattctcctgtctcaccctccaagtagctgggattacaggcgtgtgccgccatgcccagctaatttttgtattttgggtagaggtgggggtttcaccatcttgaccaggctggtctcgaactcctgacctcaggtgatccgcccacctcggcctcccaaagtattgggattacaggcatgagccaccacgccctgcccacttttgcattttaaaatgattaaaggaaaaacaaggagagacgtgaaccaaagggtgcaaagtttcagatgggaggaatacgttctaggaat

SEQ ID NO: 104877 - DNA, 793 bp, Homo sapiens
gtctgcttctaacaaataagatacagcaaaggggatgaaatggatgtgatcctgtgtccatgatcatgttacataactcagaaacctgctgggagaggaaacactctgccttgctggccttgataaagcaagcaaccatgttgggaaggctcctatggcaaagaactaaggactgcttccagccaacagccagcaagagactgaggcccttagtccaacaacctgcaagaaacttaattttgccaaaaccacatgagcttggaaatggacccttccccagttgagcctcagatgagacagcagctgtagccaacacctccatggcaggtttgcaagactctgcagcagaggacccagctaagccacgcctggattcgtgactcaaagaaactgtaagatccaaatgtgtgtcgcttcaagccactaagtttgtggctgcatggctatggcagccaatcagttgccatccccatttggcctgccagctgtgagacactgggcaagtttctcacctttactgagctgcagttttctcctctgtaaaatgagggcactgccaccatctaagaggattacatggagagtgagtgagagggtacatgggaaaggcctagcaagggcctggcacacagcacacactccatacatcagcactgcttaacactgggtttgcacaacaggctggattaatggaatcgaagtctagtgattacacatgacctatgcttataaaaagctttttaaacgtaaaaacattttgattttgtaaaataaaatatcaatggtgtgcgat

SEQ ID NO: 104878 - DNA, 126 bp, Homo sapiens
gacacctatgggcattcaatacagcagttccagtatttcaaagcagcatttccataacgtcatggaacttactttcaaaactaggagactaggggtttttgaaagtatttgttcccttactcccct

SEQ ID NO: 104879 - DNA, 452 bp, Homo sapiens
ttttttccctttgagacagggtctcactctattgccaggctggagtgcaatggcattatcatggctcactgtagcagtcttgaactcccaggctcaagtgatcctcccaccttggcctcctgagtagctggggctacaggtgcatgccatcatgcctggctaactttttaatttttcttttgtagagaaagggtctcactatgttgcccaggctggtctcaagtgatcctcacacctcagcctcctaaagtgctgggattacaggtgtgagccaccacacccagctaaatactgccttttaataatacaatcctttcataaataaacgattaggtataatgggaaaaaatcctccaagctgtacatactgaaatacttgaatccaataatttagaaatgatatcttacatttcatttagctaactagaccctaactagaatcctgggtgtac

SEQ ID NO: 104880 - DNA, 376 bp, Homo sapiens
attgttctgagacttggctgcatggctgaccacgtgtgcatgcgcatatacaagcacatacacacatgctgcaaatacgggcatatatacacacacacatacacatacacgtgcacacactcacataaatgtccatcttccaaggccatgtgcagtgctagatgtgcaaaggaattcaaacgcttggctcataatccagggcaactaggaagatcagggaaacaaactttgaaatttctcaaaggctaaagtgagtgaacttaagaatgatacaatttgtccaaagcaaactgctgaagtgtactacccagcccatcattagggaaacttcaaatcacaagctataagtagccaaggctgtatttcctgtaagact

SEQ ID NO: 104881 - DNA, 416 bp, Homo sapiens
tgcttatcacagcagtgggctaaagtattatacgtgtggttggcttcctcattacatgacaagccccactagggcagggacagcctcttattcttctgtttcccccgtgaccagtgcctgccacacaaatcatgagtaactattgcaggtttcacaaatggctggaaatgggagacacaaagatgaattagatataggcccagaccttaaagaatctataaggagtggaggaaataaaacatacacacaaagatattagagagtaaaaagtattaataatgcctacctgacaaaggggaaaaaatcactttaattagttcaagttttaatatggtgtccatattgtaccatgtaccccaaatttaggacaaacaatgtctgtgatttaaaagtttacacaaaaagtaaaaaaaaaa

SEQ ID NO: 104882 - DNA, 206 bp, Homo sapiens
ctttttcttgactcatccattcgtaggaagcttcatcttagacttcttagtttattaaagtttattaagagtatttggggctgggcatggtggctagtgcctgtaatcccagcgctttgggaagccgaggcgggtggatcacctaaggtcaggagttggagaccagcctgaccaacatgaagaaaccccgtctctactaaaaatac

SEQ ID NO: 104883 - DNA, 206 bp, Homo sapiens
ttcctaagataaaagtgagcaccccatcacctctatgggtgccccatgatcatgcccatttatcagggataacaccagtgactggggccagccaattcggggagggggcccttccaacccacagatcccagaaaaatgtactccttggagacatttaaaccaataccccagctggtgcggtggctcatgctggtagaatttgggaa

SEQ ID NO: 104884 - DNA, 695 bp, Homo sapiens
ctgataaggtgtacactccctgctggtgcacctgctgcccattcttagccacacctttttccaggtggctcagatcagcagtcaaggagaaagtgggggtggcagactaaattcattaaaccaccaaagcaccagcccagatggcctctttttcagttaattcgcattagctacttattcaggtttgataagtgggagagaagttgttacttgcagaagcatcttgtgatagatgttttgcattgttctaaggcctgagcagtcttggagacaggcagacactggtcgctcactgtgatcactggaggaaacagttactgagaggcagctgacagggtgaagggagtgggggaggaaggccacgcatttgtgcttcccaaggtcccacaggtgacatcctttaaaggaaactgtgtcatacttggggtggaagatttgaaaggcagaggaaaagaatgctttataattagggacctgtcttcatctcaggcgactcttcccgagcacgaactctgtctttccacacaccttgggaataaaagtattggagaaagagagtgaaagggtccctttgatcagtggtccagggcacgatatagaggtctcagttgttcaggaatctctgtctctagggaaccaaatttattccaacccccagatccttcactcattagaatgggattctgcaaatctct

SEQ ID NO: 104885 - DNA, 482 bp, Homo sapiens
caaaactattaaacttctagaagaaaatagaagggaaaggatttaggacagtaatttcttgtctatgacaccaaatgcaaggcaacaaaataaaaaaacaaacaaacaaatgggactacatcaaacttaaaaacttctgcatagccatagaaaacaatcaacagaatgaaaaggcaaccaacagtatgggaagaaataattgcaaatattatatctgataaggtattaatatccagaatatgtaaaaaaacaaatagatttaaaaattgggcaaagaagttgaatagatatttcttcacaaaagatatacaagtgggcccattaaacacataaaaagatgttcaatatcactaatcattaggggaactgcaaattcaaatttacattgagggtttcaccttcacatccctcaggatgggccgctttcaaccggaacaccaaaacaggcagtgttttgttgaggggtgtgaagaagctggaac

SEQ ID NO: 104886 - DNA, 328 bp, Homo sapiens
ctgtgatggtgccatcacactccagcctgggtgacagagcaagaccctgtctcaaaataataataataattttttttttaaaaaaatcctgagttgtttgtagatagtagcaaagacaagtgaaatttttggctacatatttcaaaattttactttctatcaatcattactactaaacatctattttatatattcagctatcataaccaagactaaagtatatcagattattattgttctatgtgattttcttttttactttgctgagtcagtgagtgggatcccaactaaattctatgaagagatcaaatctgaactaaaagttctt

SEQ ID NO: 104887 - DNA, 458 bp, Homo sapiens
gttttttccctaccctagcactggaattaatcatttctgcatggatccctacttccttttattgggaaatgacttttagaaaccaagatctgggcactagatgttgagttgtcattttttaacctgtcagaatgtcagatataaaaactgataacactaaatgttgctaagggtacggaaaatagacactcttgtaggctttggatgggagtataagtaagtataacctttggggagggcatttggcattatctattaaaattttaagtatgtagatttagaaaatccacattttgatctctattatatagaaatacttacatgtgttcaaagagataggcacaagaatattcattgcatcgtaatagcaaaaacctggaaacaaaatttcatcaataggggactgattggtttaaaattatggtacaaccgtgcaataaaatatcatgttggcagtc

SEQ ID NO: 104888 - DNA, 382 bp, Homo sapiens
aatttagtttagaggcaataaatgtttcaatcattggcatctaaactaggcagattacagtgtcctgttatctttgccttgttcctattttttctcttcattcccattttattttctaagtttaaatcttcatttcttcttggattattaatcaggtatttaatggttacttggcatgtccttcagtgtatggagctttcttaatatcaaaaacttcattttctgatctacagcaatactttcacgtacatgtttgtcatttgttaaatttgggctatttcatgtctatttcttgtgtatgtcttatcaaaaagtcatgagtttttagttggtataggtacttttttggaaaactggcaaggggctgctaggtaacaatttt

SEQ ID NO: 104889 - DNA, 88 bp, Homo sapiens
agaccatagtgtcttgagacctgaaactgagttggagactattaggaccagaagaacaattagggtgacatgtgtgcattgagtaaac

SEQ ID NO: 104890 - DNA, 251 bp, Homo sapiens
agatgctgggattacaggtgtgagccaccacacccagctaattttatatttttagtagagatggggtttcaccatgttggccaggctggtctcgaactcctgacctcaggtgatctgcccgcctcgacctcccaaaatgttgggattacaggtgtgagccactgcgcccagcctccccatgttcccttcattccaaaaagttactagtatctgcttagggcagcgagactcaaggatgtagcccagggtgg

SEQ ID NO: 104891 - DNA, 482 bp, Homo sapiens
acagcagcactattcacagagccagaaggtggaggcaccccaagcatccatcgacaggtgaatggacaaaaagtggtgcatccaaacaatggaatcccattcagcctttgaaaggaaggaaattctcacgcatgcgacgacatgggtgaacttgaaacaagccaagcacaaaaaggcaaatactgtatgattccacttttgtgaggtccctagaggtccctaggtagtcacagtcatagagatgaagatagaatggtgggcgccagaggctgcaggaggagagatgggagttaagagttggatggggacagagcttcagtggagaagatgaacgttctaagacggatggtggtgatagctgcagagcaatgggaatgctcctagtgccgctgagctgcgcacttacaaatagttaagatgttatattttatgttacgtgtgttttcccacatttaaaattaataataaagtttttaaaaaag

SEQ ID NO: 104892 - DNA, 292 bp, Homo sapiens
tggttctataacaggcttttcattttaaactttagctgtctgggccaccaccactgtgacaaaatgctctgactacagtctacggttaggttaaatctgcaagagaaaagattatgtgttgctttaccaggttttagcttgcttccaaaatccatctttttagtttactttttagagaccttgtgaattatcctggtgggctcatgtaattgttaagtgtccttaaaagacaaaagaaggaagcagaagccaagacttggagagatatttgaagatggtccactgctggctt

SEQ ID NO: 104893 - DNA, 380 bp, Homo sapiens
tcctctcactcagcgtcctgtgattccaaagaaatgagtctctgctgtttttgggcagcagatatcctagaatggactctgacctaagcatcaaaattaatcatcataacgttatcattttatggccccttcttcctatatctggtagcttttaaatgatgaccatgtagataatctttattgttcctctttcagcagacggtattttcttatgctacagtatgactgctaatacttacacgttagaaccattctgagtcctcaagaatctcatttaactcttattatcagtgaatttatcatcatccccaattttacataaggaaatggggttagaaagaccaaataacattttttcaacatcaaaacactagcttgag

SEQ ID NO: 104894 - DNA, 146 bp, Homo sapiens
ggctgtgttctccaatgacagtcacatcaagctgggagatggaatccaccccaaagacaagagagcaaaccaagaaagaggaagacaccaaatagaggaaatcagaattccaacaatggaaagaagtgaaaaaaagaaaatccttg

SEQ ID NO: 104895 - DNA, 367 bp, Homo sapiens
gcagggctagctgcttgtccaggggcccatgattccagggctatatttggccccacagccatccaggatgagttgtttctcagccaccaagtcttaaaatgtatatgcattaaacttagtaaaatcgcacttctttgagatgtggctttttgggcattcactgaacttgaatttggccctaaataaggcctcagtcacatgctccagggtttgcagcttggtatggatgaacatggccaatgtgaactctgacctctgggtcctgaggctttccaaaggcatactacatccggtcttaaacctagactagggaaagcactagatccaagacataaatgtccaatggcaaaggctgttgtacgcaagg

SEQ ID NO: 104896 - DNA, 270 bp, Homo sapiens
caaattaccctctctgtttaacaatttaccactttgtcctccttcagtgcttcctcaaagcttaattcttccaagacgtctttctagatgaacaaaaagtccttaaagatgtgttagtgtcagcatgcatggcgttgaacagtttgcactgagaacaaaatctgtctttctctgtgactttcacttttttcctattgatttgtttttggtctatgtaatttagattatgaagccttcttaatatgaaaatgtcatcctttatacaatatt

SEQ ID NO: 104897 - DNA, 489 bp, Homo sapiens
tgagacggagtctcgctctgtcgcccaggctggagtgcagtggtgcgatctcagctcactgcaagcttcgcctcccgggttcgtgccattctcctgcctcaggctcccgagtagctgggactacaggcacccaccaccacgcctggctaatttttttgtatttttagtagagacgggctttcattgtgttagctaggatggtctcgatcgtctgacctcgtgatccgcccgcctcggcctcccaaagtactgggattacaggcatgagccaccgtgcccggccggtaccttgggttttaagataacagaaaatatttacagattaatattttctgaaatttaaagtatttttataagagatatactgttaacaaatgactaggaaagagaatgtaacttattttagagaaaagaatactcaatacacaatcctataaataatatgaacatttaaatggaaaacagggaaaaaatagttaattatagaca

SEQ ID NO: 104898 - DNA, 374 bp, Homo sapiens
ccttcagattgagaacggggtgaaaaggcatccccacacagaaccgacgccccagtcgctagctggctccttggcacccgtcgcatggccccgaagctctggcagggactctgggcatctgtaccagtgagcacccggccatctcggccaggtctgtgagggagcgattctacccttgccatgtgacagccggcaactagggcccagatctcttctttcaagtagcacctaaaatattctccgggtgaacctagggctaaatacggcatggcctacaggtgccgggtctggaccttttaacgccattctaagatacgatcgagaacccacgaggcctttggtagcctggagtccagttactggggccaaatggg

SEQ ID NO: 104899 - DNA, 425 bp, Homo sapiens
ttgaaggatgcactggagttgggcaggtagctattaggcatatgaggaggaggggacagcccagcaatgattctgagatgagaaagcttgccctgcttgaggtgattgagtggctaatgttgggggagcatagcactgaaggggactctggttttcctgctccaaatgccagaccaagttgttggaatgccaatctttcaggagtgtagagaagcagtgcatttcaaacttgggaatgatgggacaatgaccttttagggaggtgatgctaatgttctggagaggagaaatgggaggtgaggctgcagcagaataaggagtaagaggggctctcggctcaggagtggttgtgttaagccgtgttcagaggaagctcagacatgcatcgtagcatactggcacaggaagagatggaggactgggac

SEQ ID NO: 104900 - DNA, 168 bp, Homo sapiens
gcttattggctcattcaggggctactacagtacgatatgggttagggggtgctgctctgaaaagggggacatttgcgctgaggcctgaaggaagccagggaacacactgtggggccctggagtaagtgactcatgggaggacggaagatcacggggtaccgaagctcg

SEQ ID NO: 104901 - DNA, 346 bp, Homo sapiens
gttttgctgtgaaactaaaattgctctaaaaaatacattcaaaacaaaagcagcttgttaaaattgctctaaaaaatacattcaaaataaaaactaaaattgctctaaaaaataaattcaaaacaaaagcagcttgttaggaagttattagggtgtttcctctctaaatatgaaatttttagaaatgttcccacatttttaaatttggtattcttcaatgtctgtgaccaaacatttttctagggaaatgcatatctagttttaacagaaatttagtttacatcaaacttttccagatttattttgttaaactgactttttatccaagtgtacggtggatttaatg

SEQ ID NO: 104902 - DNA, 374 bp, Homo sapiens
atttaaaatgaatttattccaaaagttcctaggttgtggatattctatgtgaggtttgggagatttcaatggaaatccacttccagcccattcaatttctcatcccaggaatcctagcttgtatttaaaaatgattccgccattccctagaagatcccactaatctgccttttaaaaatacactttcatgatgcctactctatggtcactctgagttaaatggaaaaaaacagaataatctacagaaaacaggaaaaaagtcatttgtatacctttagagatggctctctggggctttaaataaagtaaaagactggagtaggaaaaatcatacaaatatagctctgaaatctacccggagaacagagtttcaa

SEQ ID NO: 104903 - DNA, 793 bp, Homo sapiens
cctggaggaccttatgctaaatgaaataaggcagacaaacattgcatgatctcacttacaggtggaatccaaaaataaaagtcaaactcatagtaagagtagatgagtggttggcagggtctagggagcatgggaaaggaagagatggtggtcaaagggtgcaaacttgcagttagaggatgagtaagttctggagacctaacgtacagcacagtgactactgttgatcacagtgtattgtgcgttgctaacggagtagctctccagtgttctcactacacacaaacacacatgcacgcacacaagcatgcatacacacaaaaacgcacatacattcacacacaaatgcatgcatgcacacgaacacacacgtgcaggcacacatgtgcacacaaacacacacacacgaaaggtgactatgtgaggatatgctaaccacgttatacaacttaaatatatacaatttttatttgtcaatcatttctcaatataactggggcaaaaaagaacactgcctcccctctaccctgccctactgggcccagcaggtgggaaagggactcaaaatgctaggtaaatgaatgaatgattttttaaacaaaaatatttgttctggatatgccaattggcctaggcatcataattataactcttgagcatttttatactgttaagcaccctaaaaatgcttcagcattaatgtacattttataataaatttgggaaatcggcaggaattccagcaagatcctagcaagggctaggaaatggggagagggttgcctaaaagagt

SEQ ID NO: 104904 - DNA, 742 bp, Homo sapiens
ctacaaaaacatggaaaaaactaatcttaaaggaagcaggtgattcagagttcagaaagtgcagaaaataaaaaagttataattggcctcctcagagagatgtgagatattacatccataaaacagagcatgatgctgtaaaagtgaataatcagggaataaagaagagcttctaaaggtaaaaatattactattgatatacaaaatacattagaagatttggaagttaaatttttaagatagctgtgagaatatagcataaaaagacaagaaaacagaaacaagagaaaaagataagacacagaaatcaatctataaatgttcaatgttcaactggtaggaattctagaaattaataagtgaaaaaaatcaatggaaataaatttgtaatcatataggaaaattttccagagttaaaaattgtcacaaattctcacattgaaaagacagtgggctgatcagaatgataatatagttttttttttttttcagacagagtcttactctgtctcccaggctgaagtgcagtgaagtgaccatggctcgttgcagccttgacctcccgtgttcaggtgatcctcccacctcagcctcccaagtggctgggacgacaggtgtgcacaaccatacccaactaattttttgtaaagacggagtttcaccatgttgcccagactggtcttgaactcctgagctcaggtaatccatccatcttggcttcccaaagtgctgggattccaag

SEQ ID NO: 104905 - DNA, 348 bp, Homo sapiens
cagtggcgcgatctcggctcattgcaagctccgcctcccaggttcacgccattttcctgcctcagcctcccgagtagctgggactacaggtgcccgccaccacgcccggctaattttttgcatttttagtagagacggggtttcaccgtgttagccaggatggtctcgatctcttgacctcgtgatccgcctgcctcggcctccctatttcactggcttacctttctcagtttaccttgtgccgcctcctgttttttgtttctcagttgttaatattttctagaattcattcggttacatcccctgcagtttatattaatgcttatccttgggtgatgcatcaactta

SEQ ID NO: 104906 - DNA, 4079 bp, Homo sapiens
accgccgctagatccgctgctgctgccgcggcgggcggacctgcaggaggcggcggcggcggcggcggccgaggctgaaggaagatggcggacggcgtggaccacatagacatttacgcggatgtcggcgaagagttcaaccaggaagctgaatatggtgggcatgatcagatagatttgtatgacgatgtcatatctccatctgcaaataatggagatgccccagaagaccgagattacatggatactctcccaccaactgttggtgatgatgtgggtaaaggagcagcaccaaatgttgtctatacatatactggaaagagaattgcattatatattggaaatctaacatggtggacaacagatgaagacttaactgaagcagttcattctttgggagtaaatgatattttggagataaaattttttgaaaatcgagcaaatggccagtcaaaggggtttgcccttgttggtgttggatctgaagcatcttcaaaaaagttaatggatctgttacctaaaagagaacttcatggtcagaatcctgttgtaactccatgcaataaacagttcctgagtcaatttgaaatgcagtccaggaaaactacacaatcaggacaaatgtctggggaaggtaaagctggtcctccaggaggcagttcccgtgcagcatttccacaaggtggtagaggacggggccgttttccaggggctgttcctggtggggacagatttcctgggccagcaggaccaggagggccacccccaccttttccagctggacagactccaccacgtccacccttaggtcctccaggcccacctggtccaccaggtcctccacctcctggtcaggttctgcctcctcctctagctgggcctcctaatcgaggagatcgccctccaccaccagttctttttcctggacaaccttttgggcagcctccattgggtccacttcctcctggccctccacctccagttccaggctacggcccccctcctggcccaccacctccacaacagggaccacctccacctccaggcccctttccacctcgtccacccggtccacttgggccaccccttacactagctcctcctccgcatcttcctggaccacctccaggtgccccaccgccagctccgcatgtgaacccagctttctttcctccaccaactaacagtggcatgcctacatcagatagccgaggtccaccaccaacagatccatatgggcgacctccaccatatgataggggtgactatggcccccctggaagggaaatggatactgcaagaacgccattgagtgaagctgaatttgaagaaatcatgaatagaaatagggcaatctcaagcagtgctatttcgagagctgtgtctgatgccagtgctggtgattatgggagtgctattgagacactggtaactgcaatttctttaattaaacaatccaaagtatctgctgatgatcgttgcaaagttcttattagttctttgcaagattgccttcatggaattgagtccaagtcttatggttctggatcaagacgtgaacgatcaagagagagggaccatagtagatcacgagaaaagagtcgacgtcataaatcccgtagtagagaccgtcatgacgattattacagagagagaagcagagaacgagagaggcaccgggatcgtgaccgagaccgtgaccgagagcgtgaccgagagcgcgaatatcgtcatcgttagaagctgaaggaagaggatcaccttccaagacaaaacagtcttcatgggggaaaaatgacgcttgtccagcagtttgcttcttgtgattgaactgaacctgtaaggattcatggataaaatgaacaggaatagatctgaataaagcaaatctgcataaatggtaaccagtagctctacttttattttttatgttgcttaactgttttatttgaaggaaacctgtgtgatttaaaaagttatagcttttgcaactttattactggttatatacatttggccattatgatgtgcaagcaattggaaaaaaagtcaagtaaatgcttgtttttgtagtagtttgttcttgttaaaaatgtttatatgataatgtctgtaaacagcatcactttgattacaatagatgtagtgttgtaataaactgtttaatggggctgatgtgtaaagctgttcaagttatttgatgtttacacctcagggaaagtcttgtgttcagcaatatctaaagataatgttactatgacaacatttttactgtcctttaaagcattgcaatagcgtttttggatatgcctcaatctaatcttgcgttcagtgaattaaacatagtaattaagtgtcttttgcccttgattttgatattagaataggtgattacatggatatttaatatttctatattctgcttttctagctgtttttacctagttagcttgtgactttgctgaatggtatgtaaacttgtaaaaatagagatttgacagacatagcaatctagtcaatgtgtaaggggtcaaaaaaacagaggttttaacacataagtaaaaacccgtacatatttgatgtgtaatgcaggttaattacaacacagatgtaccgaaacacttaattgtgaaccgctaacattgaagaaattttgacaattccgatttgatgctgcaattacttgctgtttttattgatcttatggtttatttcttaagccatagtcagtgtaaatacagccctgcagcaggtaaatgtgagtaaagagagccttatattttccaattggtataaatttttgaaggatgtgatgttcattaacattcggttgtattccccagtatttgtaatgggaaattacagataaaccgtgtctgcacagtttaaggaatactatgtatattcatgcaccgtattgattcatgctatagttacttaatcaaagatttttttcaaacctgccttacatataggcccactttaaaagcacctgactagcatgtgttcttgattgcaaaattggcagaggcagggtgtcaacttgattaggtgtttttatgggaatgtaatttgaaatcactacttcagaaatttgacttaaaattcttgagcacgttaatatgtttttaagatctgattatctttgagagatcttctgttaatacacattggttgttaaagagtacccaaattctaggacaatgcttaaagtgttaaaataccctagatactgtgttatgtgcaactgtagaaaccctccagaaatttccactgctgttcttcactttcatcttgtctgctatcaaaccacttctgacaaaattagctgttttgaattacccatatcactgccagttttattttaaaatattttgtgtttgaagtatctgtgcatgggatcgttgatgtttatcagaactgttcactttcagaaatgattttttaaagcattttgttgaaaatgcggttgcttttttaacattattttagagttgtatcaaaattttcctgttttctgtatattgttgtgtcatttcttggctttttaatattttgactacaatgccctaatgcgaagaagtatggacatataaatattacaagagaaattagttaatagtaaagggttaaaaggtaagtaaaatgtccatgaaaataaaattttctttgaacagtttaaaaatggaatcacaaaaatctaactgcacttgaaatgaaactggaaattttatactaattaaatcctttatttaccttttcatattttatcaatggaaccttttaattgctccttctatatcactcttctccttgcttggctgatctcattacatgactttcgttacagacagtgtgagtgtactagatttgtttgctgctaatccgttattttaagtgttgtcagaaggaaataacttcttggtttgaccaagtaattttgcaaagtccttctctacctgataacacgtgaatgtatagcagtaaaggtgaaaattgcaggccttgttttgttcttcatacccccttcagttgtttatgggttaatgttatttgaaaactcttcctttttttaatgt

SEQ ID NO: 104907 - DNA, 2280 bp, Homo sapiens
accgccgctagatccgctgctgctgccgcggcgggcggacctgcaggaggcggcggcggcggcggcggccgaggctgaaggaagatggcggacggcgtggaccacatagacatttacgcggatgtcggcgaagagttcaaccaggaagctgaatatggtgggcatgatcagatagatttgtatgacgatgtcatatctccatctgcaaataatggagatgccccagaagaccgagattacatggatactctcccaccaactgttggtgatgatgtgggtaaaggagcagcaccaaatgttgtctatacatatactggaaagagaattgcattatatattggaaatctaacatggtggacaacagatgaagacttaactgaagcagttcattctttgggagtaaatgatattttggagataaaattttttgaaaatcgagcaaatggccagtcaaaggggtttgcccttgttggtgttggatctgaagcatcttcaaaaaagttaatggatctgttacctaaaagagaacttcatggtcagaatcctgttgtaactccatgcaataaacagttcctgagtcaatttgaaatgcagtccaggaaaactacacaatcaggacaaatgtctggggaaggtaaagctggtcctccaggaggcagttcccgtgcagcatttccacaaggtggtagaggacggggccgttttccaggggctgttcctggtggggacagatttcctgggccagcaggaccaggagggccacccccaccttttccaggaaatttgatcaagcatcttgttaaaggaactcggcctttgttcctggaaactaggattccatggcatatggggcacagcatagaggaaatacccatttttggcctaaaagctggacagactccaccacgtccacccttaggtcctccaggcccacctggtccaccaggtcctccacctcctggtcaggttctgcctcctcctctagctgggcctcctaatcgaggagatcgccctccaccaccagttctttttcctggacaaccttttgggcagcctccattgggtccacttcctcctggccctccacctccagttccaggctacggcccccctcctggcccaccacctccacaacagggaccacctccacctccaggcccctttccacctcgtccacccggtccacttgggccaccccttacactagctcctcctccgcatcttcctggaccacctccaggtgccccaccgccagctccgcatgtgaacccagctttctttcctccaccaactaacagtggcatgcctacatcagatagccgaggtccaccaccaacagatccatatgggcgacctccaccatatgataggggtgactatggcccccctggaagggaaatggatactgcaagaacgccattgagtgaagctgaatttgaagaaatcatgaatagaaatagggcaatctcaagcagtgctatttcgagagctgtgtctgatgccagtgctggtgattatgggagtgctattgagacactggtaactgcaatttctttaattaaacaatccaaagtatctgctgatgatcgttgcaaagttcttattagttctttgcaagattgccttcatggaattgagtccaagtcttatggttctggatcaagacgtgaacgatcaagagagagggaccatagtagatcacgagaaaagagtcgacgtcataaatcccgtagtagagaccgtcatgacgattattacagagagagaagcagagaacgagagaggcaccgggatcgtgaccgagaccgtgaccgagagcgtgaccgagagcgcgaatatcgtcatcgttagaagctgaaggaagaggatcaccttccaagacaaaacagtcttcatgggggaaaaatgacgcttgtccagcagtttgcttcttgtgattgaactgaacctgtaaggattcatggataaaatgaacaggaatagatctgaataaagcaaatctgcataaatggtaaccagtagctctacttttattttttatgttgcttaactgttttatttgaaggaaacctgtgtgatttaaaaagttatagcttttgcaactttattactggttatatacatttggccattatgatgtgcaagcaattggaaaaaaagtcaagtaaatgcttgtttttgtagtagtttgttcttgttaaaaatgtttatatgataatgtctgtaaacagcatcactttgattacaatagatgtagtgttgtaataaactgtttaatgg

SEQ ID NO: 104908 - DNA, 1950 bp, Homo sapiens
accgccgctagatccgctgctgctgccgcggcgggcggacctgcaggaggcggcggcggcggcggcggccgaggctgaaggaagatggcggacggcgtggaccacatagacatttacgcggatgtcggcgaagagttcaaccaggaagctgaatatggtgggcatgatcagatagatttgtatgacgatgtcatatctccatctgcaaataatggagatgccccagaagaccgagattacatggatactctcccaccaactgttggtgatgatgtgggtaaaggagcagcaccaaatgttgtctatacatatactggaaagagaattgcattatatattggaaatctaacatggtggacaacagatgaagacttaactgaagcagttcattctttgggagtaaatgatattttggagataaaattttttgaaaatcgagcaaatggccagtcaaaggggtttgcccttgttggtgttggatctgaagcatcttcaaaaaagttaatggatctgttacctaaaagagaacttcatggtcagaatcctgttgtaactccatgcaataaacagttcctgagtcaatttgaaatgcagtccaggaaaactacacaatcaggacaaatgtctggggaaggtaaagctggtcctcctctagctgggcctcctaatcgaggagatcgccctccaccaccagttctttttcctggacaaccttttgggcagcctccattgggtccacttcctcctggccctccacctccagttccaggctacggcccccctcctggcccaccacctccacaacagggaccacctccacctccaggcccctttccacctcgtccacccggtccacttgggccaccccttacactagctcctcctccgcatcttcctggaccacctccaggtgccccaccgccagctccgcatgtgaacccagctttctttcctccaccaactaacagtggcatgcctacatcagatagccgaggtccaccaccaacagatccatatgggcgacctccaccatatgataggggtgactatggcccccctggaagggaaatggatactgcaagaacgccattgagtgaagctgaatttgaagaaatcatgaatagaaatagggcaatctcaagcagtgctatttcgagagctgtgtctgatgccagtgctggtgattatgggagtgctattgagacactggtaactgcaatttctttaattaaacaatccaaagtatctgctgatgatcgttgcaaagttcttattagttctttgcaagattgccttcatggaattgagtccaagtcttatggttctggatcaagacgtgaacgatcaagagagagggaccatagtagatcacgagaaaagagtcgacgtcataaatcccgtagtagagaccgtcatgacgattattacagagagagaagcagagaacgagagaggcaccgggatcgtgaccgagaccgtgaccgagagcgtgaccgagagcgcgaatatcgtcatcgttagaagctgaaggaagaggatcaccttccaagacaaaacagtcttcatgggggaaaaatgacgcttgtccagcagtttgcttcttgtgattgaactgaacctgtaaggattcatggataaaatgaacaggaatagatctgaataaagcaaatctgcataaatggtaaccagtagctctacttttattttttatgttgcttaactgttttatttgaaggaaacctgtgtgatttaaaaagttatagcttttgcaactttattactggttatatacatttggccattatgatgtgcaagcaattggaaaaaaagtcaagtaaatgcttgtttttgtagtagtttgttcttgttaaaaatgtttatatgataatgtctgtaaacagcatcactttgattacaatagatgtagtgttgtaataaactgtttaatgg

SEQ ID NO: 104909 - DNA, 653 bp, Homo sapiens
ataatatttaagaagaatgaaatcagaatgtctcagtttaatcatcaggtaaattggaacatttcaccaccacaaaggcagctactgtttcagttaattcttattttgtgttagaatacataacagtgaagtagatgcacgacttgtgtatgtatagttaagccagcgtttttctgtgtattttggggaatagcaaaatctacatcacaaattttgacacattacagctgaaggaagaggatcaccttccaagacaaaacagtcttcatgggggaaaaatgacgcttgtccagcagtttgcttcttgtgattgaactgaacctgtaaggattcatggataaaatgaacaggaatagatctgaataaagcaaatctgcataaatggtaaccagtagctctacttttattttttatgttgcttaactgttttatttgaaggaaacctgtgtgatttaaaaagttatagcttttgcaactttattactggttatatacatttggccattatgatgtgcaagcaattggaaaaaaagtcaagtaaatgcttgtttttgtagtagtttgttcttgttaaaaatgtttatatgataatgtctgtaaacagcatcactttgattacaatagatgtagtgttgtaataaactgtttaatgg

SEQ ID NO: 104910 - DNA, 671 bp, Homo sapiens
accgccgctagatccgctgctgctgccgcggcgggcggacctgcaggaggcggcggcggcggcggcggccgaggctgaaggaagatggcggacggcgtggaccacatagacatttacgcggatgtcggcgaagagttcaaccagattacagagagagaagcagagaacgagagaggcaccgggatcgtgaccgagaccgtgaccgagagcgtgaccgagagcgcgaatatcgtcatcgttagaagctgaaggaagaggatcaccttccaagacaaaacagtcttcatgggggaaaaatgacgcttgtccagcagtttgcttcttgtgattgaactgaacctgtaaggattcatggataaaatgaacaggaatagatctgaataaagcaaatctgcataaatggtaaccagtagctctacttttattttttatgttgcttaactgttttatttgaaggaaacctgtgtgatttaaaaagttatagcttttgcaactttattactggttatatacatttggccattatgatgtgcaagcaattggaaaaaaagtcaagtaaatgcttgtttttgtagtagtttgttcttgttaaaaatgtttatatgataatgtctgtaaacagcatcactttgattacaatagatgtagtgttgtaataaactgtttaatgg

SEQ ID NO: 104911 - DNA, 404 bp, Homo sapiens
accgccgctagatccgctgctgctgccgcggcgggcggacctgcaggaggcggcggcggcggcggcggccgaggctgaaggaagatggcggacggcgtggaccacatagacatttacgcggatgtcggcgaagagttcaaccagattacagagagagaagcagagaacgagagaggcaccgggatcgtgaccgagaccgtgaccgagagcgtgaccgagagcgcgaatatcgtcatcgttagaagctgaaggaagaggatcaccttccaagacaaaacagtcttcatgggggaaaaatgacgcttgtccagcagtttgcttcttgtgattgaactgaacctgtaaggattcatggataaaatgaacaggaatagatctgaataaagcaaatctgcataaatggt

SEQ ID NO: 104912 - DNA, 3006 bp, Homo sapiens
accgccgctagatccgctgctgctgccgcggcgggcggacctgcaggaggcggcggcggcggcggcggccgaggctgaaggaagatggcggacggcgtggaccacatagacatttacgcggatgtcggcgaagagttcaaccaggaagctgaatatggtgggcatgatcagatagatttgtatgacgatgtcatatctccatctgcaaataatggagatgccccagaagaccgagattacatggatactctcccaccaactgttggtgatgatgtgggtaaaggagcagcaccaaatgttgtctatacatatactggaaagagaattgcattatatattggaaatctaacatggtggacaacagatgaagacttaactgaagcagttcattctttgggagtaaatgatattttggagataaaattttttgaaaatcgagcaaatggccagtcaaaggggtttgcccttgttggtgttggatctgaagcatcttcaaaaaagttaatggatctgttacctaaaagagaacttcatggtcagaatcctgttgtaactccatgcaataaacagttcctgagtcaatttgaaatgcagtccaggaaaactacacaatcaggacaaatgtctggggaaggtaaagctggtcctccaggaggcagttcccgtgcagcatttccacaaggtggtagaggacggggccgttttccaggggctgttcctggtggggacagatttcctgggccagcaggaccaggagggccacccccaccttttccagctggacagactccaccacgtccacccttaggtcctccaggcccacctggtccaccaggtcctccacctcctggtcaggttctgcctcctcctctagctgggcctcctaatcgaggagatcgccctccaccaccagttctttttcctggacaaccttttgggcagcctccattgggtccacttcctcctggccctccacctccagttccaggctacggcccccctcctggcccaccacctccacaacagggaccacctccacctccaggcccctttccacctcgtccacccggtccacttgggccaccccttacactagctcctcctccgcatcttcctggaccacctccaggtgccccaccgccagctccgcatgtgaacccagctttctttcctccaccaactaacagtggcatgcctacatcagatagccgaggtccaccaccaacagatccatatgggcgacctccaccatatgataggggtgactatggcccccctggaagggaaatggatactgcaagaacgccattgagtgaagctgaatttgaagaaatcatgaatagaaatagggcaatctcaagcagtgctatttcgagagctgtgtctgatgccagtgctggtgattatgggagtgctattgagacactggtaactgcaatttctttaattaaacaatccaaagtatctgctgatgatcgttgcaaagttcttattagttctttgcaagattgccttcatggaattgagtccaagtcttatggttctggatcaagacgtgaacgatcaagagagagggaccatagtagatcacgagaaaagagtcgacgtcataaatcccgtagtagagaccgtcatgacgattattacagagagagaagcagagaacgagagaggcaccgggatcgtgaccgagaccgtgaccgagagcgtgaccgagagcgcgaatatcgtcatcgttagaagctgaaggaagaggatcaccttccaagacaaaacagtcttcatgggggaaaaatgacgcttgtccagcagtttgcttcttgtgattgaactgaacctgtaaggattcatggataaaatgaacaggaatagatctgaataaagcaaatctgcataaatggtaaccagtagctctacttttattttttatgttgcttaactgttttatttgaaggaaacctgtgtgatttaaaaagttatagcttttgcaactttattactggttatatacatttggccattatgatgtgcaagcaattggaaaaaaagtcaagtaaatgcttgtttttgtagtagtttgttcttgttaaaaatgtttatatgataatgtctgtaaacagcatcactttgattacaatagatgtagtgttgtaataaactgtttaatggggctgatgtgtaaagctgttcaagttatttgatgtttacacctcagggaaagtcttgtgttcagcaatatctaaagataatgttactatgacaacatttttactgtcctttaaagcattgcaatagcgtttttggatatgcctcaatctaatcttgcgttcagtgaattaaacatagtaattaagtgtcttttgcccttgattttgatattagaataggtgattacatggatatttaatatttctatattctgcttttctagctgtttttacctagttagcttgtgactttgctgaatggtatgtaaacttgtaaaaatagagatttgacagacatagcaatctagtcaatgtgtaaggggtcaaaaaaacagaggttttaacacataagtaaaaacccgtacatatttgatgtgtaatgcaggttaattacaacacagatgtaccgaaacacttaattgtgaaccgctaacattgaagaaattttgacaattccgatttgatgctgcaattacttgctgtttttattgatcttatggtttatttcttaagccatagtcagtgtaaatacagccctgcagcaggtaaatgtgagtaaagagagccttatattttccaattggtataaatttttgaaggatgtgatgttcattaacattcggttgtattccccagtatttgtaatgggaaattacagataaaccgtgtctgcacagtttaaggaatactatgtatattcatgcacagatacttcaaacacaaaatattttaaaataaaactggcagtgatatgggtaattcaaaacagctaattttgtcagaagtggtttggtcgacg

SEQ ID NO: 104913 - DNA, 2697 bp, Homo sapiens
accgccgctagatccgctgctgctgccgcggcgggcggacctgcaggaggcggcggcggcggcggcggccgaggctgaaggaagatggcggacggcgtggaccacatagacatttacgcggatgtcggcgaagagttcaaccaggaagctgaatatggtgggcatgatcagatagatttgtatgacgatgtcatatctccatctgcaaataatggagatgccccagaagaccgagattacatggatactctcccaccaactgttggtgatgatgtgggtaaaggagcagcaccaaatgttgtctatacatatactggaaagagaattgcattatatattggaaatctaacatggtggacaacagatgaagacttaactgaagcagttcattctttgggagtaaatgatattttggagataaaattttttgaaaatcgagcaaatggccagtcaaaggggtttgcccttgttggtgttggatctgaagcatcttcaaaaaagttaatggatctgttacctaaaagagaacttcatggtcagaatcctgttgtaactccatgcaataaacagttcctgagtcaatttgaaatgcagtccaggaaaactacacaatcaggacaaatgtctggggaaggtaaagctggtcctccaggaggcagttcccgtgcagcatttccacaaggtggtagaggacggggccgttttccaggggctgttcctggtggggacagatttcctgggccagcaggaccaggagggccacccccaccttttccagctggacagactccaccacgtccacccttaggtcctccaggcccacctggtccaccaggtcctccacctcctggtcaggttctgcctcctcctctagctgggcctcctaatcgaggagatcgccctccaccaccagttctttttcctggacaaccttttgggcagcctccattgggtccacttcctcctggccctccacctccagttccaggctacggcccccctcctggcccaccacctccacaacagggaccacctccacctccaggcccctttccacctcgtccacccggtccacttgggccaccccttacactagctcctcctccgcatcttcctggaccacctccaggtgccccaccgccagctccgcatgtgaacccagctttctttcctccaccaactaacagtggcatgcctacatcagatagccgaggtccaccaccaacagatccatatgggcgacctccaccatatgataggggtgactatggcccccctggaagggaaatggatactgcaagaacgccattgagtgaagctgaatttgaagaaatcatgaatagaaatagggcaatctcaagcagtgctatttcgagagctgtgtctgatgccagtgctggtgattatgggagtgctattgagacactggtaactgcaatttctttaattaaacaatccaaagtatctgctgatgatcgttgcaaagttcttattagttctttgcaagattgccttcatggaattgagtccaagtcttatggttctggatcaagacgtgaacgatcaagagagagggaccatagtagatcacgagaaaagagtcgacgtcataaatcccgtagtagagaccgtcatgacgattattacagagagagaagcagagaacgagagaggcaccgggatcgtgaccgagaccgtgaccgagagcgtgaccgagagcgcgaatatcgtcatcgttagaagctgaaggaagaggatcaccttccaagacaaaacagtcttcatgggggaaaaatgacgcttgtccagcagtttgcttcttgtgattgaactgaacctgtaaggattcatggataaaatgaacaggaatagatctgaataaagcaaatctgcataaatggtaaccagtagctctacttttattttttatgttgcttaactgttttatttgaaggaaacctgtgtgatttaaaaagttatagcttttgcaactttattactggttatatacatttggccattatgatgtgcaagcaattggaaaaaaagtcaagtaaatgcttgtttttgtagtagtttgttcttgttaaaaatgtttatatgataatgtctgtaaacagcatcactttgattacaatagatgtagtgttgtaataaactgtttaatggggctgatgtgtaaagctgttcaagttatttgatgtttacacctcagggaaagtcttgtgttcagcaatatctaaagataatgttactatgacaacatttttactgtcctttaaagcattgcaatagcgtttttggatatgcctcaatctaatcttgcgttcagtgaattaaacatagtaattaaaaaaaaaaaaaaaaaaaaaaaaaaaaaaaaaaaaaaaaaaaaaaaaaaaaaaaaaaaaaaaaaaaaaaaaaaaaagaaaaaaaaaagaaaaaagaaaaaaaaaaaaacaaggaataagacaataaaaaaaaaaaataacaaaaaaaaaggaaaataaaaaacaaggacgtgcagcgagtcagtctatctatatattctatctagtcacgtaagtaggtagcatcgacgcccacccccatattatatataagtggaagcacgctcaaatcatgtaagtgttagaaaaataaaacgacgaagactggcgcgaataactaaacacaagtgcccacatacaatacgat

SEQ ID NO: 104914 - DNA, 4031 bp, Homo sapiens
accgccgctagatccgctgctgctgccgcggcgggcggacctgcaggaggcggcggcggcggcggcggccgaggctgaaggaagatggcggacggcgtggaccacatagacatttacgcggatgtcggcgaagagttcaaccaggaagctgaatatggtgggcatgatcagatagatttgtatgacgatgtcatatctccatctgcaaataatggagatgccccagaagaccgagattacatggatactctcccaccaactgttggtgatgatgtgggtaaaggagcagcaccaaatgttgtctatacatatactggaaagagaattgcattatatattggaaatctaacatggtggacaacagatgaagacttaactgaagcagttcattctttgggagtaaatgatattttggagataaaattttttgaaaatcgagcaaatggccagtcaaaggggtttgcccttgttggtgttggatctgaagcatcttcaaaaaagttaatggatctgttacctaaaagagaacttcatggtcagaatcctgttgtaactccatgcaataaacagttcctgagtcaatttgaaatgcagtccaggaaaactacacaatcaggacaaatgtctggggaaggtaaagctggtcctccaggaggcagttcccgtgcagcatttccacaaggtggtagaggacggggccgttttccaggggctgttcctggtggggacagatttcctgggccagcaggaccaggagggccacccccaccttttccagctggacagactccaccacgtccacccttaggtcctccaggcccacctggtccaccaggtcctccacctcctggtcaggttctgcctcctcctctagctgggcctcctaatcgaggagatcgccctccaccaccagttctttttcctggacaaccttttgggcagcctccattgggtccacttcctcctggccctccacctccagttccaggctacggcccccctcctggcccaccacctccacaacagggaccacctccacctccaggcccctttccacctcgtccacccggtccacttgggccaccccttacactagctcctcctccgcatcttcctggaccacctccaggtgccccaccgccagctccgcatgtgaacccagctttctttcctccaccaactaacagtggcatgcctacatcagatagccgaggtccaccaccaacagatccatatgggcgacctccaccatatgataggggtgactatggcccccctggaagggaaatggatactgcaagaacgccattgagtgaagctgaatttgaagaaatcatgaatagaaatagggcaatctcaagcagtgctatttcgagagctgtgtctgatgccagtgctggtgattatgggagtgctattgagacactggtaactgcaatttctttaattaaacaatccaaagtatctgctgatgatcgttgcaaagttcttattagttctttgcaagattgccttcatggaattgagtccaagtcttatggttctggatcaagacgtgaacgatcaagagagagggaccatagtagatcacgagattacagagagagaagcagagaacgagagaggcaccgggatcgtgaccgagaccgtgaccgagagcgtgaccgagagcgcgaatatcgtcatcgttagaagctgaaggaagaggatcaccttccaagacaaaacagtcttcatgggggaaaaatgacgcttgtccagcagtttgcttcttgtgattgaactgaacctgtaaggattcatggataaaatgaacaggaatagatctgaataaagcaaatctgcataaatggtaaccagtagctctacttttattttttatgttgcttaactgttttatttgaaggaaacctgtgtgatttaaaaagttatagcttttgcaactttattactggttatatacatttggccattatgatgtgcaagcaattggaaaaaaagtcaagtaaatgcttgtttttgtagtagtttgttcttgttaaaaatgtttatatgataatgtctgtaaacagcatcactttgattacaatagatgtagtgttgtaataaactgtttaatggggctgatgtgtaaagctgttcaagttatttgatgtttacacctcagggaaagtcttgtgttcagcaatatctaaagataatgttactatgacaacatttttactgtcctttaaagcattgcaatagcgtttttggatatgcctcaatctaatcttgcgttcagtgaattaaacatagtaattaagtgtcttttgcccttgattttgatattagaataggtgattacatggatatttaatatttctatattctgcttttctagctgtttttacctagttagcttgtgactttgctgaatggtatgtaaacttgtaaaaatagagatttgacagacatagcaatctagtcaatgtgtaaggggtcaaaaaaacagaggttttaacacataagtaaaaacccgtacatatttgatgtgtaatgcaggttaattacaacacagatgtaccgaaacacttaattgtgaaccgctaacattgaagaaattttgacaattccgatttgatgctgcaattacttgctgtttttattgatcttatggtttatttcttaagccatagtcagtgtaaatacagccctgcagcaggtaaatgtgagtaaagagagccttatattttccaattggtataaatttttgaaggatgtgatgttcattaacattcggttgtattccccagtatttgtaatgggaaattacagataaaccgtgtctgcacagtttaaggaatactatgtatattcatgcaccgtattgattcatgctatagttacttaatcaaagatttttttcaaacctgccttacatataggcccactttaaaagcacctgactagcatgtgttcttgattgcaaaattggcagaggcagggtgtcaacttgattaggtgtttttatgggaatgtaatttgaaatcactacttcagaaatttgacttaaaattcttgagcacgttaatatgtttttaagatctgattatctttgagagatcttctgttaatacacattggttgttaaagagtacccaaattctaggacaatgcttaaagtgttaaaataccctagatactgtgttatgtgcaactgtagaaaccctccagaaatttccactgctgttcttcactttcatcttgtctgctatcaaaccacttctgacaaaattagctgttttgaattacccatatcactgccagttttattttaaaatattttgtgtttgaagtatctgtgcatgggatcgttgatgtttatcagaactgttcactttcagaaatgattttttaaagcattttgttgaaaatgcggttgcttttttaacattattttagagttgtatcaaaattttcctgttttctgtatattgttgtgtcatttcttggctttttaatattttgactacaatgccctaatgcgaagaagtatggacatataaatattacaagagaaattagttaatagtaaagggttaaaaggtaagtaaaatgtccatgaaaataaaattttctttgaacagtttaaaaatggaatcacaaaaatctaactgcacttgaaatgaaactggaaattttatactaattaaatcctttatttaccttttcatattttatcaatggaaccttttaattgctccttctatatcactcttctccttgcttggctgatctcattacatgactttcgttacagacagtgtgagtgtactagatttgtttgctgctaatccgttattttaagtgttgtcagaaggaaataacttcttggtttgaccaagtaattttgcaaagtccttctctacctgataacacgtgaatgtatagcagtaaaggtgaaaattgcaggccttgttttgttcttcatacccccttcagttgtttatgggttaatgttatttgaaaactcttcctttttttaatgt

SEQ ID NO: 104915 - DNA, 4190 bp, Homo sapiens
accgccgctagatccgctgctgctgccgcggcgggcggacctgcaggaggcggcggcggcggcggcggccgaggctgaaggaagatggcggacggcgtggaccacatagacatttacgcggatgtcggcgaagagttcaaccaggaagctgaatatggtgggcatgatcagatagatttgtatgacgatgtcatatctccatctgcaaataatggagatgccccagaagaccgagattacatggatactctcccaccaactgttggtgatgatgtgggtaaaggagcagcaccaaatgttgtctatacatatactggaaagagaattgcattatatattggaaatctaacatggtggacaacagatgaagacttaactgaagcagttcattctttgggagtaaatgatattttggagataaaattttttgaaaatcgagcaaatggccagtcaaaggggtttgcccttgttggtgttggatctgaagcatcttcaaaaaagttaatggatctgttacctaaaagagaacttcatggtcagaatcctgttgtaactccatgcaataaacagttcctgagtcaatttgaaatgcagtccaggaaaactacacaatcaggacaaatgtctggggaaggtaaagctggtcctccaggaggcagttcccgtgcagcatttccacaaggtggtagaggacggggccgttttccaggggctgttcctggtggggacagatttcctgggccagcaggaccaggagggccacccccaccttttccaggaaatttgatcaagcatcttgttaaaggaactcggcctttgttcctggaaactaggattccatggcatatggggcacagcatagaggaaatacccatttttggcctaaaagctggacagactccaccacgtccacccttaggtcctccaggcccacctggtccaccaggtcctccacctcctggtcaggttctgcctcctcctctagctgggcctcctaatcgaggagatcgccctccaccaccagttctttttcctggacaaccttttgggcagcctccattgggtccacttcctcctggccctccacctccagttccaggctacggcccccctcctggcccaccacctccacaacagggaccacctccacctccaggcccctttccacctcgtccacccggtccacttgggccaccccttacactagctcctcctccgcatcttcctggaccacctccaggtgccccaccgccagctccgcatgtgaacccagctttctttcctccaccaactaacagtggcatgcctacatcagatagccgaggtccaccaccaacagatccatatgggcgacctccaccatatgataggggtgactatggcccccctggaagggaaatggatactgcaagaacgccattgagtgaagctgaatttgaagaaatcatgaatagaaatagggcaatctcaagcagtgctatttcgagagctgtgtctgatgccagtgctggtgattatgggagtgctattgagacactggtaactgcaatttctttaattaaacaatccaaagtatctgctgatgatcgttgcaaagttcttattagttctttgcaagattgccttcatggaattgagtccaagtcttatggttctggatcaagacgtgaacgatcaagagagagggaccatagtagatcacgagaaaagagtcgacgtcataaatcccgtagtagagaccgtcatgacgattattacagagagagaagcagagaacgagagaggcaccgggatcgtgaccgagaccgtgaccgagagcgtgaccgagagcgcgaatatcgtcatcgttagaagctgaaggaagaggatcaccttccaagacaaaacagtcttcatgggggaaaaatgacgcttgtccagcagtttgcttcttgtgattgaactgaacctgtaaggattcatggataaaatgaacaggaatagatctgaataaagcaaatctgcataaatggtaaccagtagctctacttttattttttatgttgcttaactgttttatttgaaggaaacctgtgtgatttaaaaagttatagcttttgcaactttattactggttatatacatttggccattatgatgtgcaagcaattggaaaaaaagtcaagtaaatgcttgtttttgtagtagtttgttcttgttaaaaatgtttatatgataatgtctgtaaacagcatcactttgattacaatagatgtagtgttgtaataaactgtttaatggggctgatgtgtaaagctgttcaagttatttgatgtttacacctcagggaaagtcttgtgttcagcaatatctaaagataatgttactatgacaacatttttactgtcctttaaagcattgcaatagcgtttttggatatgcctcaatctaatcttgcgttcagtgaattaaacatagtaattaagtgtcttttgcccttgattttgatattagaataggtgattacatggatatttaatatttctatattctgcttttctagctgtttttacctagttagcttgtgactttgctgaatggtatgtaaacttgtaaaaatagagatttgacagacatagcaatctagtcaatgtgtaaggggtcaaaaaaacagaggttttaacacataagtaaaaacccgtacatatttgatgtgtaatgcaggttaattacaacacagatgtaccgaaacacttaattgtgaaccgctaacattgaagaaattttgacaattccgatttgatgctgcaattacttgctgtttttattgatcttatggtttatttcttaagccatagtcagtgtaaatacagccctgcagcaggtaaatgtgagtaaagagagccttatattttccaattggtataaatttttgaaggatgtgatgttcattaacattcggttgtattccccagtatttgtaatgggaaattacagataaaccgtgtctgcacagtttaaggaatactatgtatattcatgcaccgtattgattcatgctatagttacttaatcaaagatttttttcaaacctgccttacatataggcccactttaaaagcacctgactagcatgtgttcttgattgcaaaattggcagaggcagggtgtcaacttgattaggtgtttttatgggaatgtaatttgaaatcactacttcagaaatttgacttaaaattcttgagcacgttaatatgtttttaagatctgattatctttgagagatcttctgttaatacacattggttgttaaagagtacccaaattctaggacaatgcttaaagtgttaaaataccctagatactgtgttatgtgcaactgtagaaaccctccagaaatttccactgctgttcttcactttcatcttgtctgctatcaaaccacttctgacaaaattagctgttttgaattacccatatcactgccagttttattttaaaatattttgtgtttgaagtatctgtgcatgggatcgttgatgtttatcagaactgttcactttcagaaatgattttttaaagcattttgttgaaaatgcggttgcttttttaacattattttagagttgtatcaaaattttcctgttttctgtatattgttgtgtcatttcttggctttttaatattttgactacaatgccctaatgcgaagaagtatggacatataaatattacaagagaaattagttaatagtaaagggttaaaaggtaagtaaaatgtccatgaaaataaaattttctttgaacagtttaaaaatggaatcacaaaaatctaactgcacttgaaatgaaactggaaattttatactaattaaatcctttatttaccttttcatattttatcaatggaaccttttaattgctccttctatatcactcttctccttgcttggctgatctcattacatgactttcgttacagacagtgtgagtgtactagatttgtttgctgctaatccgttattttaagtgttgtcagaaggaaataacttcttggtttgaccaagtaattttgcaaagtccttctctacctgataacacgtgaatgtatagcagtaaaggtgaaaattgcaggccttgttttgttcttcatacccccttcagttgtttatgggttaatgttatttgaaaactcttcctttttttaatgt

SEQ ID NO: 104916 - DNA, 4128 bp, Homo sapiens
actcccggcaagaaattcactttttagacctgttcaagaatacatctattgcataaagtggaaaaagatttgtactgaaatccttggcctttttccatcagatttttaaaacaaaaagttgaatttgtattcaagtctattttagtagtattttgacttttgtataatctagagcattatttctgtatctcaggaagctgaatatggtgggcatgatcagatagatttgtatgacgatgtcatatctccatctgcaaataatggagatgccccagaagaccgagattacatggatactctcccaccaactgttggtgatgatgtgggtaaaggagcagcaccaaatgttgtctatacatatactggaaagagaattgcattatatattggaaatctaacatggtggacaacagatgaagacttaactgaagcagttcattctttgggagtaaatgatattttggagataaaattttttgaaaatcgagcaaatggccagtcaaaggggtttgcccttgttggtgttggatctgaagcatcttcaaaaaagttaatggatctgttacctaaaagagaacttcatggtcagaatcctgttgtaactccatgcaataaacagttcctgagtcaatttgaaatgcagtccaggaaaactacacaatcaggacaaatgtctggggaaggtaaagctggtcctccaggaggcagttcccgtgcagcatttccacaaggtggtagaggacggggccgttttccaggggctgttcctggtggggacagatttcctgggccagcaggaccaggagggccacccccaccttttccagctggacagactccaccacgtccacccttaggtcctccaggcccacctggtccaccaggtcctccacctcctggtcaggttctgcctcctcctctagctgggcctcctaatcgaggagatcgccctccaccaccagttctttttcctggacaaccttttgggcagcctccattgggtccacttcctcctggccctccacctccagttccaggctacggcccccctcctggcccaccacctccacaacagggaccacctccacctccaggcccctttccacctcgtccacccggtccacttgggccaccccttacactagctcctcctccgcatcttcctggaccacctccaggtgccccaccgccagctccgcatgtgaacccagctttctttcctccaccaactaacagtggcatgcctacatcagatagccgaggtccaccaccaacagatccatatgggcgacctccaccatatgataggggtgactatggcccccctggaagggaaatggatactgcaagaacgccattgagtgaagctgaatttgaagaaatcatgaatagaaatagggcaatctcaagcagtgctatttcgagagctgtgtctgatgccagtgctggtgattatgggagtgctattgagacactggtaactgcaatttctttaattaaacaatccaaagtatctgctgatgatcgttgcaaagttcttattagttctttgcaagattgccttcatggaattgagtccaagtcttatggttctggatcaagacgtgaacgatcaagagagagggaccatagtagatcacgagaaaagagtcgacgtcataaatcccgtagtagagaccgtcatgacgattattacagagagagaagcagagaacgagagaggcaccgggatcgtgaccgagaccgtgaccgagagcgtgaccgagagcgcgaatatcgtcatcgttagaagctgaaggaagaggatcaccttccaagacaaaacagtcttcatgggggaaaaatgacgcttgtccagcagtttgcttcttgtgattgaactgaacctgtaaggattcatggataaaatgaacaggaatagatctgaataaagcaaatctgcataaatggtaaccagtagctctacttttattttttatgttgcttaactgttttatttgaaggaaacctgtgtgatttaaaaagttatagcttttgcaactttattactggttatatacatttggccattatgatgtgcaagcaattggaaaaaaagtcaagtaaatgcttgtttttgtagtagtttgttcttgttaaaaatgtttatatgataatgtctgtaaacagcatcactttgattacaatagatgtagtgttgtaataaactgtttaatggggctgatgtgtaaagctgttcaagttatttgatgtttacacctcagggaaagtcttgtgttcagcaatatctaaagataatgttactatgacaacatttttactgtcctttaaagcattgcaatagcgtttttggatatgcctcaatctaatcttgcgttcagtgaattaaacatagtaattaagtgtcttttgcccttgattttgatattagaataggtgattacatggatatttaatatttctatattctgcttttctagctgtttttacctagttagcttgtgactttgctgaatggtatgtaaacttgtaaaaatagagatttgacagacatagcaatctagtcaatgtgtaaggggtcaaaaaaacagaggttttaacacataagtaaaaacccgtacatatttgatgtgtaatgcaggttaattacaacacagatgtaccgaaacacttaattgtgaaccgctaacattgaagaaattttgacaattccgatttgatgctgcaattacttgctgtttttattgatcttatggtttatttcttaagccatagtcagtgtaaatacagccctgcagcaggtaaatgtgagtaaagagagccttatattttccaattggtataaatttttgaaggatgtgatgttcattaacattcggttgtattccccagtatttgtaatgggaaattacagataaaccgtgtctgcacagtttaaggaatactatgtatattcatgcaccgtattgattcatgctatagttacttaatcaaagatttttttcaaacctgccttacatataggcccactttaaaagcacctgactagcatgtgttcttgattgcaaaattggcagaggcagggtgtcaacttgattaggtgtttttatgggaatgtaatttgaaatcactacttcagaaatttgacttaaaattcttgagcacgttaatatgtttttaagatctgattatctttgagagatcttctgttaatacacattggttgttaaagagtacccaaattctaggacaatgcttaaagtgttaaaataccctagatactgtgttatgtgcaactgtagaaaccctccagaaatttccactgctgttcttcactttcatcttgtctgctatcaaaccacttctgacaaaattagctgttttgaattacccatatcactgccagttttattttaaaatattttgtgtttgaagtatctgtgcatgggatcgttgatgtttatcagaactgttcactttcagaaatgattttttaaagcattttgttgaaaatgcggttgcttttttaacattattttagagttgtatcaaaattttcctgttttctgtatattgttgtgtcatttcttggctttttaatattttgactacaatgccctaatgcgaagaagtatggacatataaatattacaagagaaattagttaatagtaaagggttaaaaggtaagtaaaatgtccatgaaaataaaattttctttgaacagtttaaaaatggaatcacaaaaatctaactgcacttgaaatgaaactggaaattttatactaattaaatcctttatttaccttttcatattttatcaatggaaccttttaattgctccttctatatcactcttctccttgcttggctgatctcattacatgactttcgttacagacagtgtgagtgtactagatttgtttgctgctaatccgttattttaagtgttgtcagaaggaaataacttcttggtttgaccaagtaattttgcaaagtccttctctacctgataacacgtgaatgtatagcagtaaaggtgaaaattgcaggccttgttttgttcttcatacccccttcagttgtttatgggttaatgttatttgaaaactcttcctttttttaatgt

SEQ ID NO: 104917 - DNA, 3860 bp, Homo sapiens
accgccgctagatccgctgctgctgccgcggcgggcggacctgcaggaggcggcggcggcggcggcggccgaggctgaaggaagatggcggacggcgtggaccacatagacatttacgcggatgtcggcgaagagttcaaccaggaagctgaatatggtgggcatgatcagatagatttgtatgacgatgtcatatctccatctgcaaataatggagatgccccagaagaccgagattacatggatactctcccaccaactgttggtgatgatgtgggtaaaggagcagcaccaaatgttgtctatacatatactggaaagagaattgcattatatattggaaatctaacatggtggacaacagatgaagacttaactgaagcagttcattctttgggagtaaatgatattttggagataaaattttttgaaaatcgagcaaatggccagtcaaaggggtttgcccttgttggtgttggatctgaagcatcttcaaaaaagttaatggatctgttacctaaaagagaacttcatggtcagaatcctgttgtaactccatgcaataaacagttcctgagtcaatttgaaatgcagtccaggaaaactacacaatcaggacaaatgtctggggaaggtaaagctggtcctcctctagctgggcctcctaatcgaggagatcgccctccaccaccagttctttttcctggacaaccttttgggcagcctccattgggtccacttcctcctggccctccacctccagttccaggctacggcccccctcctggcccaccacctccacaacagggaccacctccacctccaggcccctttccacctcgtccacccggtccacttgggccaccccttacactagctcctcctccgcatcttcctggaccacctccaggtgccccaccgccagctccgcatgtgaacccagctttctttcctccaccaactaacagtggcatgcctacatcagatagccgaggtccaccaccaacagatccatatgggcgacctccaccatatgataggggtgactatggcccccctggaagggaaatggatactgcaagaacgccattgagtgaagctgaatttgaagaaatcatgaatagaaatagggcaatctcaagcagtgctatttcgagagctgtgtctgatgccagtgctggtgattatgggagtgctattgagacactggtaactgcaatttctttaattaaacaatccaaagtatctgctgatgatcgttgcaaagttcttattagttctttgcaagattgccttcatggaattgagtccaagtcttatggttctggatcaagacgtgaacgatcaagagagagggaccatagtagatcacgagaaaagagtcgacgtcataaatcccgtagtagagaccgtcatgacgattattacagagagagaagcagagaacgagagaggcaccgggatcgtgaccgagaccgtgaccgagagcgtgaccgagagcgcgaatatcgtcatcgttagaagctgaaggaagaggatcaccttccaagacaaaacagtcttcatgggggaaaaatgacgcttgtccagcagtttgcttcttgtgattgaactgaacctgtaaggattcatggataaaatgaacaggaatagatctgaataaagcaaatctgcataaatggtaaccagtagctctacttttattttttatgttgcttaactgttttatttgaaggaaacctgtgtgatttaaaaagttatagcttttgcaactttattactggttatatacatttggccattatgatgtgcaagcaattggaaaaaaagtcaagtaaatgcttgtttttgtagtagtttgttcttgttaaaaatgtttatatgataatgtctgtaaacagcatcactttgattacaatagatgtagtgttgtaataaactgtttaatggggctgatgtgtaaagctgttcaagttatttgatgtttacacctcagggaaagtcttgtgttcagcaatatctaaagataatgttactatgacaacatttttactgtcctttaaagcattgcaatagcgtttttggatatgcctcaatctaatcttgcgttcagtgaattaaacatagtaattaagtgtcttttgcccttgattttgatattagaataggtgattacatggatatttaatatttctatattctgcttttctagctgtttttacctagttagcttgtgactttgctgaatggtatgtaaacttgtaaaaatagagatttgacagacatagcaatctagtcaatgtgtaaggggtcaaaaaaacagaggttttaacacataagtaaaaacccgtacatatttgatgtgtaatgcaggttaattacaacacagatgtaccgaaacacttaattgtgaaccgctaacattgaagaaattttgacaattccgatttgatgctgcaattacttgctgtttttattgatcttatggtttatttcttaagccatagtcagtgtaaatacagccctgcagcaggtaaatgtgagtaaagagagccttatattttccaattggtataaatttttgaaggatgtgatgttcattaacattcggttgtattccccagtatttgtaatgggaaattacagataaaccgtgtctgcacagtttaaggaatactatgtatattcatgcaccgtattgattcatgctatagttacttaatcaaagatttttttcaaacctgccttacatataggcccactttaaaagcacctgactagcatgtgttcttgattgcaaaattggcagaggcagggtgtcaacttgattaggtgtttttatgggaatgtaatttgaaatcactacttcagaaatttgacttaaaattcttgagcacgttaatatgtttttaagatctgattatctttgagagatcttctgttaatacacattggttgttaaagagtacccaaattctaggacaatgcttaaagtgttaaaataccctagatactgtgttatgtgcaactgtagaaaccctccagaaatttccactgctgttcttcactttcatcttgtctgctatcaaaccacttctgacaaaattagctgttttgaattacccatatcactgccagttttattttaaaatattttgtgtttgaagtatctgtgcatgggatcgttgatgtttatcagaactgttcactttcagaaatgattttttaaagcattttgttgaaaatgcggttgcttttttaacattattttagagttgtatcaaaattttcctgttttctgtatattgttgtgtcatttcttggctttttaatattttgactacaatgccctaatgcgaagaagtatggacatataaatattacaagagaaattagttaatagtaaagggttaaaaggtaagtaaaatgtccatgaaaataaaattttctttgaacagtttaaaaatggaatcacaaaaatctaactgcacttgaaatgaaactggaaattttatactaattaaatcctttatttaccttttcatattttatcaatggaaccttttaattgctccttctatatcactcttctccttgcttggctgatctcattacatgactttcgttacagacagtgtgagtgtactagatttgtttgctgctaatccgttattttaagtgttgtcagaaggaaataacttcttggtttgaccaagtaattttgcaaagtccttctctacctgataacacgtgaatgtatagcagtaaaggtgaaaattgcaggccttgttttgttcttcatacccccttcagttgtttatgggttaatgttatttgaaaactcttcctttttttaatgt

SEQ ID NO: 104918 - DNA, 3632 bp, Homo sapiens
accgccgctagatccgctgctgctgccgcggcgggcggacctgcaggaggcggcggcggcggcggcggccgaggctgaaggaagatggcggacggcgtggaccacatagacatttacgcggatgtcggcgaagagttcaaccaggaagctgaatatggtgggcatgatcagatagatttgtatgacgatgtcatatctccatctgcaaataatggagatgccccagaagaccgagattacatggatactctcccaccaactgttggtgatgatgtgggtaaaggagcagcaccaaatgttgtctatacatatactggaaagagaattgcattatatattggaaatctaacatggtggacaacagatgaagacttaactgaagcagttcattctttgggagtaaatgatattttggagataaaattttttgaaaatcgagcaaatggccagtcaaaggggtttgcccttgttggtgttggatctgaagcatcttcaaaaaagttaatggatctgttacctaaaagagaacttcatggtcagaatcctgttgtaactccatgcaataaacagttcctgagtcaatttgaaatgcagtccaggaaaattccacctcgtccacccggtccacttgggccaccccttacactagctcctcctccgcatcttcctggaccacctccaggtgccccaccgccagctccgcatgtgaacccagctttctttcctccaccaactaacagtggcatgcctacatcagatagccgaggtccaccaccaacagatccatatgggcgacctccaccatatgataggggtgactatggcccccctggaagggaaatggatactgcaagaacgccattgagtgaagctgaatttgaagaaatcatgaatagaaatagggcaatctcaagcagtgctatttcgagagctgtgtctgatgccagtgctggtgattatgggagtgctattgagacactggtaactgcaatttctttaattaaacaatccaaagtatctgctgatgatcgttgcaaagttcttattagttctttgcaagattgccttcatggaattgagtccaagtcttatggttctggatcaagacgtgaacgatcaagagagagggaccatagtagatcacgagaaaagagtcgacgtcataaatcccgtagtagagaccgtcatgacgattattacagagagagaagcagagaacgagagaggcaccgggatcgtgaccgagaccgtgaccgagagcgtgaccgagagcgcgaatatcgtcatcgttagaagctgaaggaagaggatcaccttccaagacaaaacagtcttcatgggggaaaaatgacgcttgtccagcagtttgcttcttgtgattgaactgaacctgtaaggattcatggataaaatgaacaggaatagatctgaataaagcaaatctgcataaatggtaaccagtagctctacttttattttttatgttgcttaactgttttatttgaaggaaacctgtgtgatttaaaaagttatagcttttgcaactttattactggttatatacatttggccattatgatgtgcaagcaattggaaaaaaagtcaagtaaatgcttgtttttgtagtagtttgttcttgttaaaaatgtttatatgataatgtctgtaaacagcatcactttgattacaatagatgtagtgttgtaataaactgtttaatggggctgatgtgtaaagctgttcaagttatttgatgtttacacctcagggaaagtcttgtgttcagcaatatctaaagataatgttactatgacaacatttttactgtcctttaaagcattgcaatagcgtttttggatatgcctcaatctaatcttgcgttcagtgaattaaacatagtaattaagtgtcttttgcccttgattttgatattagaataggtgattacatggatatttaatatttctatattctgcttttctagctgtttttacctagttagcttgtgactttgctgaatggtatgtaaacttgtaaaaatagagatttgacagacatagcaatctagtcaatgtgtaaggggtcaaaaaaacagaggttttaacacataagtaaaaacccgtacatatttgatgtgtaatgcaggttaattacaacacagatgtaccgaaacacttaattgtgaaccgctaacattgaagaaattttgacaattccgatttgatgctgcaattacttgctgtttttattgatcttatggtttatttcttaagccatagtcagtgtaaatacagccctgcagcaggtaaatgtgagtaaagagagccttatattttccaattggtataaatttttgaaggatgtgatgttcattaacattcggttgtattccccagtatttgtaatgggaaattacagataaaccgtgtctgcacagtttaaggaatactatgtatattcatgcaccgtattgattcatgctatagttacttaatcaaagatttttttcaaacctgccttacatataggcccactttaaaagcacctgactagcatgtgttcttgattgcaaaattggcagaggcagggtgtcaacttgattaggtgtttttatgggaatgtaatttgaaatcactacttcagaaatttgacttaaaattcttgagcacgttaatatgtttttaagatctgattatctttgagagatcttctgttaatacacattggttgttaaagagtacccaaattctaggacaatgcttaaagtgttaaaataccctagatactgtgttatgtgcaactgtagaaaccctccagaaatttccactgctgttcttcactttcatcttgtctgctatcaaaccacttctgacaaaattagctgttttgaattacccatatcactgccagttttattttaaaatattttgtgtttgaagtatctgtgcatgggatcgttgatgtttatcagaactgttcactttcagaaatgattttttaaagcattttgttgaaaatgcggttgcttttttaacattattttagagttgtatcaaaattttcctgttttctgtatattgttgtgtcatttcttggctttttaatattttgactacaatgccctaatgcgaagaagtatggacatataaatattacaagagaaattagttaatagtaaagggttaaaaggtaagtaaaatgtccatgaaaataaaattttctttgaacagtttaaaaatggaatcacaaaaatctaactgcacttgaaatgaaactggaaattttatactaattaaatcctttatttaccttttcatattttatcaatggaaccttttaattgctccttctatatcactcttctccttgcttggctgatctcattacatgactttcgttacagacagtgtgagtgtactagatttgtttgctgctaatccgttattttaagtgttgtcagaaggaaataacttcttggtttgaccaagtaattttgcaaagtccttctctacctgataacacgtgaatgtatagcagtaaaggtgaaaattgcaggccttgttttgttcttcatacccccttcagttgtttatgggttaatgttatttgaaaactcttcctttttttaatgt

SEQ ID NO: 104919 - DNA, 3716 bp, Homo sapiens
tatatatagaatatttacatccgtcttactttcttacctcttaaaaaaatcctttcaagatcatttttccttgtttcactttctagcttggcatcagagtagaatataaggtgggtgatttcactgtaagaagtgtgtgtacacggaaagatggaaaatatctctaggcattgtaatatttttttattaaagttttcgtttcaataatttttcttaagcataaattgagctagttaaatttgtaaggatatacttcattgtagttggtagtgtaacatttaccatacgggtttaatttaaagacaaagacttggtgtatgctctatgcgtttaaagtataatcttggcatataaaagttaaaatatcttattagtgaagtgttttttttttctctctttctcctttgttttttagctggacagactccaccacgtccacccttaggtcctccaggcccacctggtccaccaggtcctccacctcctggtcaggttctgcctcctcctctagctgggcctcctaatcgaggagatcgccctccaccaccagttctttttcctggacaaccttttgggcagcctccattgggtccacttcctcctggccctccacctccagttccaggctacggcccccctcctggcccaccacctccacaacagggaccacctccacctccaggcccctttccacctcgtccacccggtccacttgggccaccccttacactagctcctcctccgcatcttcctggaccacctccaggtgccccaccgccagctccgcatgtgaacccagctttctttcctccaccaactaacagtggcatgcctacatcagatagccgaggtccaccaccaacagatccatatgggcgacctccaccatatgataggggtgactatggcccccctggaagggaaatggatactgcaagaacgccattgagtgaagctgaatttgaagaaatcatgaatagaaatagggcaatctcaagcagtgctatttcgagagctgtgtctgatgccagtgctggtgattatgggagtgctattgagacactggtaactgcaatttctttaattaaacaatccaaagtatctgctgatgatcgttgcaaagttcttattagttctttgcaagattgccttcatggaattgagtccaagtcttatggttctggatcaagacgtgaacgatcaagagagagggaccatagtagatcacgagaaaagagtcgacgtcataaatcccgtagtagagaccgtcatgacgattattacagagagagaagcagagaacgagagaggcaccgggatcgtgaccgagaccgtgaccgagagcgtgaccgagagcgcgaatatcgtcatcgttagaagctgaaggaagaggatcaccttccaagacaaaacagtcttcatgggggaaaaatgacgcttgtccagcagtttgcttcttgtgattgaactgaacctgtaaggattcatggataaaatgaacaggaatagatctgaataaagcaaatctgcataaatggtaaccagtagctctacttttattttttatgttgcttaactgttttatttgaaggaaacctgtgtgatttaaaaagttatagcttttgcaactttattactggttatatacatttggccattatgatgtgcaagcaattggaaaaaaagtcaagtaaatgcttgtttttgtagtagtttgttcttgttaaaaatgtttatatgataatgtctgtaaacagcatcactttgattacaatagatgtagtgttgtaataaactgtttaatggggctgatgtgtaaagctgttcaagttatttgatgtttacacctcagggaaagtcttgtgttcagcaatatctaaagataatgttactatgacaacatttttactgtcctttaaagcattgcaatagcgtttttggatatgcctcaatctaatcttgcgttcagtgaattaaacatagtaattaagtgtcttttgcccttgattttgatattagaataggtgattacatggatatttaatatttctatattctgcttttctagctgtttttacctagttagcttgtgactttgctgaatggtatgtaaacttgtaaaaatagagatttgacagacatagcaatctagtcaatgtgtaaggggtcaaaaaaacagaggttttaacacataagtaaaaacccgtacatatttgatgtgtaatgcaggttaattacaacacagatgtaccgaaacacttaattgtgaaccgctaacattgaagaaattttgacaattccgatttgatgctgcaattacttgctgtttttattgatcttatggtttatttcttaagccatagtcagtgtaaatacagccctgcagcaggtaaatgtgagtaaagagagccttatattttccaattggtataaatttttgaaggatgtgatgttcattaacattcggttgtattccccagtatttgtaatgggaaattacagataaaccgtgtctgcacagtttaaggaatactatgtatattcatgcaccgtattgattcatgctatagttacttaatcaaagatttttttcaaacctgccttacatataggcccactttaaaagcacctgactagcatgtgttcttgattgcaaaattggcagaggcagggtgtcaacttgattaggtgtttttatgggaatgtaatttgaaatcactacttcagaaatttgacttaaaattcttgagcacgttaatatgtttttaagatctgattatctttgagagatcttctgttaatacacattggttgttaaagagtacccaaattctaggacaatgcttaaagtgttaaaataccctagatactgtgttatgtgcaactgtagaaaccctccagaaatttccactgctgttcttcactttcatcttgtctgctatcaaaccacttctgacaaaattagctgttttgaattacccatatcactgccagttttattttaaaatattttgtgtttgaagtatctgtgcatgggatcgttgatgtttatcagaactgttcactttcagaaatgattttttaaagcattttgttgaaaatgcggttgcttttttaacattattttagagttgtatcaaaattttcctgttttctgtatattgttgtgtcatttcttggctttttaatattttgactacaatgccctaatgcgaagaagtatggacatataaatattacaagagaaattagttaatagtaaagggttaaaaggtaagtaaaatgtccatgaaaataaaattttctttgaacagtttaaaaatggaatcacaaaaatctaactgcacttgaaatgaaactggaaattttatactaattaaatcctttatttaccttttcatattttatcaatggaaccttttaattgctccttctatatcactcttctccttgcttggctgatctcattacatgactttcgttacagacagtgtgagtgtactagatttgtttgctgctaatccgttattttaagtgttgtcagaaggaaataacttcttggtttgaccaagtaattttgcaaagtccttctctacctgataacacgtgaatgtatagcagtaaaggtgaaaattgcaggccttgttttgttcttcatacccccttcagttgtttatgggttaatgttatttgaaaactcttcctttttttaatgt

SEQ ID NO: 104920 - DNA, 2169 bp, Homo sapiens
accgccgctagatccgctgctgctgccgcggcgggcggacctgcaggaggcggcggcggcggcggcggccgaggctgaaggaagatggcggacggcgtggaccacatagacatttacgcggatgtcggcgaagagttcaaccaggaagctgaatatggtgggcatgatcagatagatttgtatgacgatgtcatatctccatctgcaaataatggagatgccccagaagaccgagattacatggatactctcccaccaactgttggtgatgatgtgggtaaaggagcagcaccaaatgttgtctatacatatactggaaagagaattgcattatatattggaaatctaacatggtggacaacagatgaagacttaactgaagcagttcattctttgggagtaaatgatattttggagataaaattttttgaaaatcgagcaaatggccagtcaaaggggtttgcccttgttggtgttggatctgaagcatcttcaaaaaagttaatggatctgttacctaaaagagaacttcatggtcagaatcctgttgtaactccatgcaataaacagttcctgagtcaatttgaaatgcagtccaggaaaactacacaatcaggacaaatgtctggggaaggtaaagctggtcctccaggaggcagttcccgtgcagcatttccacaaggtggtagaggacggggccgttttccaggggctgttcctggtggggacagatttcctgggccagcaggaccaggagggccacccccaccttttccagctggacagactccaccacgtccacccttaggtcctccaggcccacctggtccaccaggtcctccacctcctggtcaggttctgcctcctcctctagctgggcctcctaatcgaggagatcgccctccaccaccagttctttttcctggacaaccttttgggcagcctccattgggtccacttcctcctggccctccacctccagttccaggctacggcccccctcctggcccaccacctccacaacagggaccacctccacctccaggcccctttccacctcgtccacccggtccacttgggccaccccttacactagctcctcctccgcatcttcctggaccacctccaggtgccccaccgccagctccgcatgtgaacccagctttctttcctccaccaactaacagtggcatgcctacatcagatagccgaggtccaccaccaacagatccatatgggcgacctccaccatatgataggggtgactatggcccccctggaagggaaatggatactgcaagaacgccattgagtgaagctgaatttgaagaaatcatgaatagaaatagggcaatctcaagcagtgctatttcgagagctgtgtctgatgccagtgctggtgattatgggagtgctattgagacactggtaactgcaatttctttaattaaacaatccaaagtatctgctgatgatcgttgcaaagttcttattagttctttgcaagattgccttcatggaattgagtccaagtcttatggttctggatcaagacgtgaacgatcaagagagagggaccatagtagatcacgagaaaagagtcgacgtcataaatcccgtagtagagaccgtcatgacgattattacagagagagaagcagagaacgagagaggcaccgggatcgtgaccgagaccgtgaccgagagcgtgaccgagagcgcgaatatcgtcatcgttagaagctgaaggaagaggatcaccttccaagacaaaacagtcttcatgggggaaaaatgacgcttgtccagcagtttgcttcttgtgattgaactgaacctgtaaggattcatggataaaatgaacaggaatagatctgaataaagcaaatctgcataaatggtaaccagtagctctacttttattttttatgttgcttaactgttttatttgaaggaaacctgtgtgatttaaaaagttatagcttttgcaactttattactggttatatacatttggccattatgatgtgcaagcaattggaaaaaaagtcaagtaaatgcttgtttttgtagtagtttgttcttgttaaaaatgtttatatgataatgtctgtaaacagcatcactttgattacaatagatgtagtgttgtaataaactgtttaatgg

SEQ ID NO: 104921 - DNA, 2439 bp, Homo sapiens
accgccgctagatccgctgctgctgccgcggcgggcggacctgcaggaggcggcggcggcggcggcggccgaggctgaaggaagatggcggacggcgtggaccacatagacatttacgcggatgtcggcgaagagttcaaccaggaagctgaatatggtgggcatgatcagatagatttgtatgacgatgtcatatctccatctgcaaataatggagatgccccagaagaccgagattacatggatactctcccaccaactgttggtgatgatgtgggtaaaggagcagcaccaaatgttgtctatacatatactggaaagagaattgcattatatattggaaatctaacatggtggacaacagatgaagacttaactgaagcagttcattctttgggagtaaatgatattttggagataaaattttttgaaaatcgagcaaatggccagtcaaaggggtttgcccttgttggtgttggatctgaagcatcttcaaaaaagttaatggatctgttacctaaaagagaacttcatggtcagaatcctgttgtaactccatgcaataaacagttcctgagtcaatttgaaatgcagtccaggaaaactacacaatcaggacaaatgtctggggaaggtaaagctggtcctccaggaggcagttcccgtgcagcatttccacaaggtggtagaggacggggccgttttccaggggctgttcctggtggggacagatttcctgggccagcaggaccaggagggccacccccaccttttccagctggacagactccaccacgtccacccttaggtcctccaggcccacctggtccaccaggtcctccacctcctggtcaggttctgcctcctcctctagctgggcctcctaatcgaggagatcgccctccaccaccagttctttttcctggacaaccttttgggcagcctccattgggtccacttcctcctggccctccacctccagttccaggctacggcccccctcctggcccaccacctccacaacagggaccacctccacctccaggcccctttccacctcgtccacccggtccacttgggccaccccttacactagctcctcctccgcatcttcctggaccacctccaggtgccccaccgccagctccgcatgtgaacccagctttctttcctccaccaactaacagtggcatgcctacatcagatagccgaggtccaccaccaacagatccatatgggcgacctccaccatatgataggggtgactatggcccccctggaagggaaatggatactgcaagaacgccattgagtgaagctgaatttgaagaaatcatgaatagaaatagggcaatctcaagcagtgctatttcgagagctgtgtctgatgccagtgctggtgattatgggagtgctattgagacactggtaactgcaatttctttaattaaacaatccaaagtatctgctgatgatcgttgcaaagttcttattagttctttgcaagattgccttcatggaattgagtccaagtcttatggttctggatcaagacgtgaacgatcaagagagagggaccatagtagatcacgagaaaagagtcgacgtcataaatcccgtagtagagaccgtcatgacgattattacagagagagaagcagagaacgagagaggcaccgggatcgtgaccgagaccgtgaccgagagcgtgaccgagagcgcgaatatcgtcatcgttagaagctgaaggaagaggatcaccttccaagacaaaacagtcttcatgggggaaaaatgacgcttgtccagcagtttgcttcttgtgattgaactgaacctgtaaggattcatggataaaatgaacaggaatagatctgaataaagcaaatctgcataaatggtaaccagtagctctacttttattttttatgttgcttaactgttttatttgaaggaaacctgtgtgatttaaaaagttatagcttttgcaactttattactggttatatacatttggccattatgatgtgcaagcaattggaaaaaaagtcaagtaaatgcttgtttttgtagtagtttgttcttgttaaaaatgtttatatgataatgtctgtaaacagcatcactttgattacaatagatgtagtgttgtaataaactgtttaatggccgccgattcccaaagctcttatacttatatacagtaaacaacctttttctattttctccctgtcattataactggcacttcctccatccacatttcccactccttttcccatctccttctatctcaacccccccatctcgttcctcatccatctcttacttatgtaacacattaaatcgtcccacccgttatacccacactccactctttactctccctaagaataatacttctacacttcttctaccatacacttttagcaaacaaag

SEQ ID NO: 104922 - DNA, 3356 bp, Homo sapiens
accgccgctagatccgctgctgctgccgcggcgggcggacctgcaggaggcggcggcggcggcggcggccgaggctgaaggaagatggcggacggcgtggaccacatagacatttacgcggatgtcggcgaagagttcaaccaggaagctgaatatggtgggcatgatcagatagatttgtatgacgatgtcatatctccatctgcaaataatggagatgccccagaagaccgagattacatggatactccacctccagttccaggctacggcccccctcctggcccaccacctccacaacagggaccacctccacctccaggcccctttccacctcgtccacccggtccacttgggccaccccttacactagctcctcctccgcatcttcctggaccacctccaggtgccccaccgccagctccgcatgtgaacccagctttctttcctccaccaactaacagtggcatgcctacatcagatagccgaggtccaccaccaacagatccatatgggcgacctccaccatatgataggggtgactatggcccccctggaagggaaatggatactgcaagaacgccattgagtgaagctgaatttgaagaaatcatgaatagaaatagggcaatctcaagcagtgctatttcgagagctgtgtctgatgccagtgctggtgattatgggagtgctattgagacactggtaactgcaatttctttaattaaacaatccaaagtatctgctgatgatcgttgcaaagttcttattagttctttgcaagattgccttcatggaattgagtccaagtcttatggttctggatcaagacgtgaacgatcaagagagagggaccatagtagatcacgagaaaagagtcgacgtcataaatcccgtagtagagaccgtcatgacgattattacagagagagaagcagagaacgagagaggcaccgggatcgtgaccgagaccgtgaccgagagcgtgaccgagagcgcgaatatcgtcatcgttagaagctgaaggaagaggatcaccttccaagacaaaacagtcttcatgggggaaaaatgacgcttgtccagcagtttgcttcttgtgattgaactgaacctgtaaggattcatggataaaatgaacaggaatagatctgaataaagcaaatctgcataaatggtaaccagtagctctacttttattttttatgttgcttaactgttttatttgaaggaaacctgtgtgatttaaaaagttatagcttttgcaactttattactggttatatacatttggccattatgatgtgcaagcaattggaaaaaaagtcaagtaaatgcttgtttttgtagtagtttgttcttgttaaaaatgtttatatgataatgtctgtaaacagcatcactttgattacaatagatgtagtgttgtaataaactgtttaatggggctgatgtgtaaagctgttcaagttatttgatgtttacacctcagggaaagtcttgtgttcagcaatatctaaagataatgttactatgacaacatttttactgtcctttaaagcattgcaatagcgtttttggatatgcctcaatctaatcttgcgttcagtgaattaaacatagtaattaagtgtcttttgcccttgattttgatattagaataggtgattacatggatatttaatatttctatattctgcttttctagctgtttttacctagttagcttgtgactttgctgaatggtatgtaaacttgtaaaaatagagatttgacagacatagcaatctagtcaatgtgtaaggggtcaaaaaaacagaggttttaacacataagtaaaaacccgtacatatttgatgtgtaatgcaggttaattacaacacagatgtaccgaaacacttaattgtgaaccgctaacattgaagaaattttgacaattccgatttgatgctgcaattacttgctgtttttattgatcttatggtttatttcttaagccatagtcagtgtaaatacagccctgcagcaggtaaatgtgagtaaagagagccttatattttccaattggtataaatttttgaaggatgtgatgttcattaacattcggttgtattccccagtatttgtaatgggaaattacagataaaccgtgtctgcacagtttaaggaatactatgtatattcatgcaccgtattgattcatgctatagttacttaatcaaagatttttttcaaacctgccttacatataggcccactttaaaagcacctgactagcatgtgttcttgattgcaaaattggcagaggcagggtgtcaacttgattaggtgtttttatgggaatgtaatttgaaatcactacttcagaaatttgacttaaaattcttgagcacgttaatatgtttttaagatctgattatctttgagagatcttctgttaatacacattggttgttaaagagtacccaaattctaggacaatgcttaaagtgttaaaataccctagatactgtgttatgtgcaactgtagaaaccctccagaaatttccactgctgttcttcactttcatcttgtctgctatcaaaccacttctgacaaaattagctgttttgaattacccatatcactgccagttttattttaaaatattttgtgtttgaagtatctgtgcatgggatcgttgatgtttatcagaactgttcactttcagaaatgattttttaaagcattttgttgaaaatgcggttgcttttttaacattattttagagttgtatcaaaattttcctgttttctgtatattgttgtgtcatttcttggctttttaatattttgactacaatgccctaatgcgaagaagtatggacatataaatattacaagagaaattagttaatagtaaagggttaaaaggtaagtaaaatgtccatgaaaataaaattttctttgaacagtttaaaaatggaatcacaaaaatctaactgcacttgaaatgaaactggaaattttatactaattaaatcctttatttaccttttcatattttatcaatggaaccttttaattgctccttctatatcactcttctccttgcttggctgatctcattacatgactttcgttacagacagtgtgagtgtactagatttgtttgctgctaatccgttattttaagtgttgtcagaaggaaataacttcttggtttgaccaagtaattttgcaaagtccttctctacctgataacacgtgaatgtatagcagtaaaggtgaaaattgcaggccttgttttgttcttcatacccccttcagttgtttatgggttaatgttatttgaaaactcttcctttttttaatgt

SEQ ID NO: 104923 - DNA, 3537 bp, Homo sapiens
tttaataattcttgggtgtcctctagaggtgaccgtctcataaaaaggctatggtccctggcattgctggcagaagaggtacgcatatgcgagagcatttaccgaacatataaataaacacttctgaagtctatagcaaaactaaaagttaccagtgttctgaagatttcctcaacttctcttttgatacaaatgtcaaaaatctaaaatgacaattcatgttcagaagagatataaaatataagaaacctgtgaaaagccatcatctcaaggtcaagagttatctgaatcactgacatcgagcaaaggaaatttacaccataaaaagtatgaacagtttttaaattcacttttaagactgtcagtagttcaaaacctctatcatttctttaaaccaacgaacacttccaaatgtgtagagacagtaagatctgccatgtataaatccatgagtactatttcgagagtcttggccaagccaagactctcgaaatcgaccccttgtacagttccacctcgtccacccggtccacttgggccaccccttacactagctcctcctccgcatcttcctggaccacctccaggtgccccaccgccagctccgcatgtgaacccagctttctttcctccaccaactaacagtggcatgcctacatcagatagccgaggtccaccaccaacagatccatatgggcgacctccaccatatgataggggtgactatggcccccctggaagggaaatggatactgcaagaacgccattgagtgaagctgaatttgaagaaatcatgaatagaaatagggcaatctcaagcagtgctatttcgagagctgtgtctgatgccagtgctggtgattatgggagtgctattgagacactggtaactgcaatttctttaattaaacaatccaaagtatctgctgatgatcgttgcaaagttcttattagttctttgcaagattgccttcatggaattgagtccaagtcttatggttctggatcaagacgtgaacgatcaagagagagggaccatagtagatcacgagaaaagagtcgacgtcataaatcccgtagtagagaccgtcatgacgattattacagagagagaagcagagaacgagagaggcaccgggatcgtgaccgagaccgtgaccgagagcgtgaccgagagcgcgaatatcgtcatcgttagaagctgaaggaagaggatcaccttccaagacaaaacagtcttcatgggggaaaaatgacgcttgtccagcagtttgcttcttgtgattgaactgaacctgtaaggattcatggataaaatgaacaggaatagatctgaataaagcaaatctgcataaatggtaaccagtagctctacttttattttttatgttgcttaactgttttatttgaaggaaacctgtgtgatttaaaaagttatagcttttgcaactttattactggttatatacatttggccattatgatgtgcaagcaattggaaaaaaagtcaagtaaatgcttgtttttgtagtagtttgttcttgttaaaaatgtttatatgataatgtctgtaaacagcatcactttgattacaatagatgtagtgttgtaataaactgtttaatggggctgatgtgtaaagctgttcaagttatttgatgtttacacctcagggaaagtcttgtgttcagcaatatctaaagataatgttactatgacaacatttttactgtcctttaaagcattgcaatagcgtttttggatatgcctcaatctaatcttgcgttcagtgaattaaacatagtaattaagtgtcttttgcccttgattttgatattagaataggtgattacatggatatttaatatttctatattctgcttttctagctgtttttacctagttagcttgtgactttgctgaatggtatgtaaacttgtaaaaatagagatttgacagacatagcaatctagtcaatgtgtaaggggtcaaaaaaacagaggttttaacacataagtaaaaacccgtacatatttgatgtgtaatgcaggttaattacaacacagatgtaccgaaacacttaattgtgaaccgctaacattgaagaaattttgacaattccgatttgatgctgcaattacttgctgtttttattgatcttatggtttatttcttaagccatagtcagtgtaaatacagccctgcagcaggtaaatgtgagtaaagagagccttatattttccaattggtataaatttttgaaggatgtgatgttcattaacattcggttgtattccccagtatttgtaatgggaaattacagataaaccgtgtctgcacagtttaaggaatactatgtatattcatgcaccgtattgattcatgctatagttacttaatcaaagatttttttcaaacctgccttacatataggcccactttaaaagcacctgactagcatgtgttcttgattgcaaaattggcagaggcagggtgtcaacttgattaggtgtttttatgggaatgtaatttgaaatcactacttcagaaatttgacttaaaattcttgagcacgttaatatgtttttaagatctgattatctttgagagatcttctgttaatacacattggttgttaaagagtacccaaattctaggacaatgcttaaagtgttaaaataccctagatactgtgttatgtgcaactgtagaaaccctccagaaatttccactgctgttcttcactttcatcttgtctgctatcaaaccacttctgacaaaattagctgttttgaattacccatatcactgccagttttattttaaaatattttgtgtttgaagtatctgtgcatgggatcgttgatgtttatcagaactgttcactttcagaaatgattttttaaagcattttgttgaaaatgcggttgcttttttaacattattttagagttgtatcaaaattttcctgttttctgtatattgttgtgtcatttcttggctttttaatattttgactacaatgccctaatgcgaagaagtatggacatataaatattacaagagaaattagttaatagtaaagggttaaaaggtaagtaaaatgtccatgaaaataaaattttctttgaacagtttaaaaatggaatcacaaaaatctaactgcacttgaaatgaaactggaaattttatactaattaaatcctttatttaccttttcatattttatcaatggaaccttttaattgctccttctatatcactcttctccttgcttggctgatctcattacatgactttcgttacagacagtgtgagtgtactagatttgtttgctgctaatccgttattttaagtgttgtcagaaggaaataacttcttggtttgaccaagtaattttgcaaagtccttctctacctgataacacgtgaatgtatagcagtaaaggtgaaaattgcaggccttgttttgttcttcatacccccttcagttgtttatgggttaatgttatttgaaaactcttcctttttttaatgt

SEQ ID NO: 104924 - DNA, 3056 bp, Homo sapiens
agctatctagaggatcccagactcggcattccacctcgtccacccggtccacttgggccaccccttacactagctcctcctccgcatcttcctggaccacctccaggtgccccaccgccagctccgcatgtgaacccagctttctttcctccaccaactaacagtggcatgcctacatcagatagccgaggtccaccaccaacagatccatatgggcgacctccaccatatgataggggtgactatggcccccctggaagggaaatggatactgcaagaacgccattgagtgaagctgaatttgaagaaatcatgaatagaaatagggcaatctcaagcagtgctatttcgagagctgtgtctgatgccagtgctggtgattatgggagtgctattgagacactggtaactgcaatttctttaattaaacaatccaaagtatctgctgatgatcgttgcaaagttcttattagttctttgcaagattgccttcatggaattgagtccaagtcttatggttctggatcaagacgtgaacgatcaagagagagggaccatagtagatcacgagaaaagagtcgacgtcataaatcccgtagtagagaccgtcatgacgattattacagagagagaagcagagaacgagagaggcaccgggatcgtgaccgagaccgtgaccgagagcgtgaccgagagcgcgaatatcgtcatcgttagaagctgaaggaagaggatcaccttccaagacaaaacagtcttcatgggggaaaaatgacgcttgtccagcagtttgcttcttgtgattgaactgaacctgtaaggattcatggataaaatgaacaggaatagatctgaataaagcaaatctgcataaatggtaaccagtagctctacttttattttttatgttgcttaactgttttatttgaaggaaacctgtgtgatttaaaaagttatagcttttgcaactttattactggttatatacatttggccattatgatgtgcaagcaattggaaaaaaagtcaagtaaatgcttgtttttgtagtagtttgttcttgttaaaaatgtttatatgataatgtctgtaaacagcatcactttgattacaatagatgtagtgttgtaataaactgtttaatggggctgatgtgtaaagctgttcaagttatttgatgtttacacctcagggaaagtcttgtgttcagcaatatctaaagataatgttactatgacaacatttttactgtcctttaaagcattgcaatagcgtttttggatatgcctcaatctaatcttgcgttcagtgaattaaacatagtaattaagtgtcttttgcccttgattttgatattagaataggtgattacatggatatttaatatttctatattctgcttttctagctgtttttacctagttagcttgtgactttgctgaatggtatgtaaacttgtaaaaatagagatttgacagacatagcaatctagtcaatgtgtaaggggtcaaaaaaacagaggttttaacacataagtaaaaacccgtacatatttgatgtgtaatgcaggttaattacaacacagatgtaccgaaacacttaattgtgaaccgctaacattgaagaaattttgacaattccgatttgatgctgcaattacttgctgtttttattgatcttatggtttatttcttaagccatagtcagtgtaaatacagccctgcagcaggtaaatgtgagtaaagagagccttatattttccaattggtataaatttttgaaggatgtgatgttcattaacattcggttgtattccccagtatttgtaatgggaaattacagataaaccgtgtctgcacagtttaaggaatactatgtatattcatgcaccgtattgattcatgctatagttacttaatcaaagatttttttcaaacctgccttacatataggcccactttaaaagcacctgactagcatgtgttcttgattgcaaaattggcagaggcagggtgtcaacttgattaggtgtttttatgggaatgtaatttgaaatcactacttcagaaatttgacttaaaattcttgagcacgttaatatgtttttaagatctgattatctttgagagatcttctgttaatacacattggttgttaaagagtacccaaattctaggacaatgcttaaagtgttaaaataccctagatactgtgttatgtgcaactgtagaaaccctccagaaatttccactgctgttcttcactttcatcttgtctgctatcaaaccacttctgacaaaattagctgttttgaattacccatatcactgccagttttattttaaaatattttgtgtttgaagtatctgtgcatgggatcgttgatgtttatcagaactgttcactttcagaaatgattttttaaagcattttgttgaaaatgcggttgcttttttaacattattttagagttgtatcaaaattttcctgttttctgtatattgttgtgtcatttcttggctttttaatattttgactacaatgccctaatgcgaagaagtatggacatataaatattacaagagaaattagttaatagtaaagggttaaaaggtaagtaaaatgtccatgaaaataaaattttctttgaacagtttaaaaatggaatcacaaaaatctaactgcacttgaaatgaaactggaaattttatactaattaaatcctttatttaccttttcatattttatcaatggaaccttttaattgctccttctatatcactcttctccttgcttggctgatctcattacatgactttcgttacagacagtgtgagtgtactagatttgtttgctgctaatccgttattttaagtgttgtcagaaggaaataacttcttggtttgaccaagtaattttgcaaagtccttctctacctgataacacgtgaatgtatagcagtaaaggtgaaaattgcaggccttgttttgttcttcatacccccttcagttgtttatgggttaatgttatttgaaaactcttcctttttttaatgt

SEQ ID NO: 104925 - DNA, 2739 bp, Homo sapiens
aagaaattgcagttaccagtgtctcaatagcactcccataatcaccagcactggcatcagacacagctctcgaaatagcactgcttgagattgcccaatttctttaattaaacaatccaaagtatctgctgatgatcgttgcaaagttcttattagttctttgcaagattgccttcatggaattgagtccaagtcttatggttctggatcaagacgtgaacgatcaagagagagggaccatagtagatcacgagaaaagagtcgacgtcataaatcccgtagtagagaccgtcatgacgattattacagagagagaagcagagaacgagagaggcaccgggatcgtgaccgagaccgtgaccgagagcgtgaccgagagcgcgaatatcgtcatcgttagaagctgaaggaagaggatcaccttccaagacaaaacagtcttcatgggggaaaaatgacgcttgtccagcagtttgcttcttgtgattgaactgaacctgtaaggattcatggataaaatgaacaggaatagatctgaataaagcaaatctgcataaatggtaaccagtagctctacttttattttttatgttgcttaactgttttatttgaaggaaacctgtgtgatttaaaaagttatagcttttgcaactttattactggttatatacatttggccattatgatgtgcaagcaattggaaaaaaagtcaagtaaatgcttgtttttgtagtagtttgttcttgttaaaaatgtttatatgataatgtctgtaaacagcatcactttgattacaatagatgtagtgttgtaataaactgtttaatggggctgatgtgtaaagctgttcaagttatttgatgtttacacctcagggaaagtcttgtgttcagcaatatctaaagataatgttactatgacaacatttttactgtcctttaaagcattgcaatagcgtttttggatatgcctcaatctaatcttgcgttcagtgaattaaacatagtaattaagtgtcttttgcccttgattttgatattagaataggtgattacatggatatttaatatttctatattctgcttttctagctgtttttacctagttagcttgtgactttgctgaatggtatgtaaacttgtaaaaatagagatttgacagacatagcaatctagtcaatgtgtaaggggtcaaaaaaacagaggttttaacacataagtaaaaacccgtacatatttgatgtgtaatgcaggttaattacaacacagatgtaccgaaacacttaattgtgaaccgctaacattgaagaaattttgacaattccgatttgatgctgcaattacttgctgtttttattgatcttatggtttatttcttaagccatagtcagtgtaaatacagccctgcagcaggtaaatgtgagtaaagagagccttatattttccaattggtataaatttttgaaggatgtgatgttcattaacattcggttgtattccccagtatttgtaatgggaaattacagataaaccgtgtctgcacagtttaaggaatactatgtatattcatgcaccgtattgattcatgctatagttacttaatcaaagatttttttcaaacctgccttacatataggcccactttaaaagcacctgactagcatgtgttcttgattgcaaaattggcagaggcagggtgtcaacttgattaggtgtttttatgggaatgtaatttgaaatcactacttcagaaatttgacttaaaattcttgagcacgttaatatgtttttaagatctgattatctttgagagatcttctgttaatacacattggttgttaaagagtacccaaattctaggacaatgcttaaagtgttaaaataccctagatactgtgttatgtgcaactgtagaaaccctccagaaatttccactgctgttcttcactttcatcttgtctgctatcaaaccacttctgacaaaattagctgttttgaattacccatatcactgccagttttattttaaaatattttgtgtttgaagtatctgtgcatgggatcgttgatgtttatcagaactgttcactttcagaaatgattttttaaagcattttgttgaaaatgcggttgcttttttaacattattttagagttgtatcaaaattttcctgttttctgtatattgttgtgtcatttcttggctttttaatattttgactacaatgccctaatgcgaagaagtatggacatataaatattacaagagaaattagttaatagtaaagggttaaaaggtaagtaaaatgtccatgaaaataaaattttctttgaacagtttaaaaatggaatcacaaaaatctaactgcacttgaaatgaaactggaaattttatactaattaaatcctttatttaccttttcatattttatcaatggaaccttttaattgctccttctatatcactcttctccttgcttggctgatctcattacatgactttcgttacagacagtgtgagtgtactagatttgtttgctgctaatccgttattttaagtgttgtcagaaggaaataacttcttggtttgaccaagtaattttgcaaagtccttctctacctgataacacgtgaatgtatagcagtaaaggtgaaaattgcaggccttgttttgttcttcatacccccttcagttgtttatgggttaatgttatttgaaaactcttcctttttttaatgt

SEQ ID NO: 104926 - DNA, 2563 bp, Homo sapiens
ataatatttaagaagaatgaaatcagaatgtctcagtttaatcatcaggtaaattggaacatttcaccaccacaaaggcagctactgtttcagttaattcttattttgtgttagaatacataacagtgaagtagatgcacgacttgtgtatgtatagttaagccagcgtttttctgtgtattttggggaatagcaaaatctacatcacaaattttgacacattacagctgaaggaagaggatcaccttccaagacaaaacagtcttcatgggggaaaaatgacgcttgtccagcagtttgcttcttgtgattgaactgaacctgtaaggattcatggataaaatgaacaggaatagatctgaataaagcaaatctgcataaatggtaaccagtagctctacttttattttttatgttgcttaactgttttatttgaaggaaacctgtgtgatttaaaaagttatagcttttgcaactttattactggttatatacatttggccattatgatgtgcaagcaattggaaaaaaagtcaagtaaatgcttgtttttgtagtagtttgttcttgttaaaaatgtttatatgataatgtctgtaaacagcatcactttgattacaatagatgtagtgttgtaataaactgtttaatggggctgatgtgtaaagctgttcaagttatttgatgtttacacctcagggaaagtcttgtgttcagcaatatctaaagataatgttactatgacaacatttttactgtcctttaaagcattgcaatagcgtttttggatatgcctcaatctaatcttgcgttcagtgaattaaacatagtaattaagtgtcttttgcccttgattttgatattagaataggtgattacatggatatttaatatttctatattctgcttttctagctgtttttacctagttagcttgtgactttgctgaatggtatgtaaacttgtaaaaatagagatttgacagacatagcaatctagtcaatgtgtaaggggtcaaaaaaacagaggttttaacacataagtaaaaacccgtacatatttgatgtgtaatgcaggttaattacaacacagatgtaccgaaacacttaattgtgaaccgctaacattgaagaaattttgacaattccgatttgatgctgcaattacttgctgtttttattgatcttatggtttatttcttaagccatagtcagtgtaaatacagccctgcagcaggtaaatgtgagtaaagagagccttatattttccaattggtataaatttttgaaggatgtgatgttcattaacattcggttgtattccccagtatttgtaatgggaaattacagataaaccgtgtctgcacagtttaaggaatactatgtatattcatgcaccgtattgattcatgctatagttacttaatcaaagatttttttcaaacctgccttacatataggcccactttaaaagcacctgactagcatgtgttcttgattgcaaaattggcagaggcagggtgtcaacttgattaggtgtttttatgggaatgtaatttgaaatcactacttcagaaatttgacttaaaattcttgagcacgttaatatgtttttaagatctgattatctttgagagatcttctgttaatacacattggttgttaaagagtacccaaattctaggacaatgcttaaagtgttaaaataccctagatactgtgttatgtgcaactgtagaaaccctccagaaatttccactgctgttcttcactttcatcttgtctgctatcaaaccacttctgacaaaattagctgttttgaattacccatatcactgccagttttattttaaaatattttgtgtttgaagtatctgtgcatgggatcgttgatgtttatcagaactgttcactttcagaaatgattttttaaagcattttgttgaaaatgcggttgcttttttaacattattttagagttgtatcaaaattttcctgttttctgtatattgttgtgtcatttcttggctttttaatattttgactacaatgccctaatgcgaagaagtatggacatataaatattacaagagaaattagttaatagtaaagggttaaaaggtaagtaaaatgtccatgaaaataaaattttctttgaacagtttaaaaatggaatcacaaaaatctaactgcacttgaaatgaaactggaaattttatactaattaaatcctttatttaccttttcatattttatcaatggaaccttttaattgctccttctatatcactcttctccttgcttggctgatctcattacatgactttcgttacagacagtgtgagtgtactagatttgtttgctgctaatccgttattttaagtgttgtcagaaggaaataacttcttggtttgaccaagtaattttgcaaagtccttctctacctgataacacgtgaatgtatagcagtaaaggtgaaaattgcaggccttgttttgttcttcatacccccttcagttgtttatgggttaatgttatttgaaaactcttcctttttttaatgt

SEQ ID NO: 104927 - DNA, 366 bp, Homo sapiens
gatctcactgtgttgcccaggctggagtgcagtagtgtgattataggttactgtagcctcaaactcctgggctcaagcaatcctcgtgcctcaaccttctaagcagctgggattacaggcatgagccactgtgcccagctgttgttttagataaaagcagattaagacctttttacagaagaataacagtaataatattgatctctttttactttgtatcctcaccccttaaacactttttaggtttgcccttgttggtgttggatctgaagcatcttcaaaaaagttaatggatctgttacctaaaagagaacttcatggtcagaatcctgttgtaactccatgcaataaacagttcctgagtca

SEQ ID NO: 104928 - DNA, 3412 bp, Homo sapiens
  misc_feature (222)..(222): n is a, c, g, or t
ggtacggcaagactctgaaaggtgactcaggtttcactccttgtcactgggttttaaattgtaagtctggaagttactagaacaatcccagaattagctcacacactttcactctgtttttccctttcttcctggggttatatttacccagcattcctaggtgtttgtggtgggagatccgcccctacgttatcttaatttgttgccatatttctgaaccangaatcccatttaccacattgagttctggacatcaaggttctccgggcatcactttctatgctgtgtcatcagtgaagcccataaacttacccgttatcagaaaagcgaagatttcgagagtcttggccaagccaagactctcgaaatcgaccccttgtacagttccacctcgtccacccggtccacttgggccaccccttacactagctcctcctccgcatcttcctggaccacctccaggtgccccaccgccagctccgcatgtgaacccagctttctttcctccaccaactaacagtggcatgcctacatcagatagccgaggtccaccaccaacagatccatatgggcgacctccaccatatgataggggtgactatggcccccctggaagggaaatggatactgcaagaacgccattgagtgaagctgaatttgaagaaatcatgaatagaaatagggcaatctcaagcagtgctatttcgagagctgtgtctgatgccagtgctggtgattatgggagtgctattgagacactggtaactgcaatttctttaattaaacaatccaaagtatctgctgatgatcgttgcaaagttcttattagttctttgcaagattgccttcatggaattgagtccaagtcttatggttctggatcaagacgtgaacgatcaagagagagggaccatagtagatcacgagaaaagagtcgacgtcataaatcccgtagtagagaccgtcatgacgattattacagagagagaagcagagaacgagagaggcaccgggatcgtgaccgagaccgtgaccgagagcgtgaccgagagcgcgaatatcgtcatcgttagaagctgaaggaagaggatcaccttccaagacaaaacagtcttcatgggggaaaaatgacgcttgtccagcagtttgcttcttgtgattgaactgaacctgtaaggattcatggataaaatgaacaggaatagatctgaataaagcaaatctgcataaatggtaaccagtagctctacttttattttttatgttgcttaactgttttatttgaaggaaacctgtgtgatttaaaaagttatagcttttgcaactttattactggttatatacatttggccattatgatgtgcaagcaattggaaaaaaagtcaagtaaatgcttgtttttgtagtagtttgttcttgttaaaaatgtttatatgataatgtctgtaaacagcatcactttgattacaatagatgtagtgttgtaataaactgtttaatggggctgatgtgtaaagctgttcaagttatttgatgtttacacctcagggaaagtcttgtgttcagcaatatctaaagataatgttactatgacaacatttttactgtcctttaaagcattgcaatagcgtttttggatatgcctcaatctaatcttgcgttcagtgaattaaacatagtaattaagtgtcttttgcccttgattttgatattagaataggtgattacatggatatttaatatttctatattctgcttttctagctgtttttacctagttagcttgtgactttgctgaatggtatgtaaacttgtaaaaatagagatttgacagacatagcaatctagtcaatgtgtaaggggtcaaaaaaacagaggttttaacacataagtaaaaacccgtacatatttgatgtgtaatgcaggttaattacaacacagatgtaccgaaacacttaattgtgaaccgctaacattgaagaaattttgacaattccgatttgatgctgcaattacttgctgtttttattgatcttatggtttatttcttaagccatagtcagtgtaaatacagccctgcagcaggtaaatgtgagtaaagagagccttatattttccaattggtataaatttttgaaggatgtgatgttcattaacattcggttgtattccccagtatttgtaatgggaaattacagataaaccgtgtctgcacagtttaaggaatactatgtatattcatgcaccgtattgattcatgctatagttacttaatcaaagatttttttcaaacctgccttacatataggcccactttaaaagcacctgactagcatgtgttcttgattgcaaaattggcagaggcagggtgtcaacttgattaggtgtttttatgggaatgtaatttgaaatcactacttcagaaatttgacttaaaattcttgagcacgttaatatgtttttaagatctgattatctttgagagatcttctgttaatacacattggttgttaaagagtacccaaattctaggacaatgcttaaagtgttaaaataccctagatactgtgttatgtgcaactgtagaaaccctccagaaatttccactgctgttcttcactttcatcttgtctgctatcaaaccacttctgacaaaattagctgttttgaattacccatatcactgccagttttattttaaaatattttgtgtttgaagtatctgtgcatgggatcgttgatgtttatcagaactgttcactttcagaaatgattttttaaagcattttgttgaaaatgcggttgcttttttaacattattttagagttgtatcaaaattttcctgttttctgtatattgttgtgtcatttcttggctttttaatattttgactacaatgccctaatgcgaagaagtatggacatataaatattacaagagaaattagttaatagtaaagggttaaaaggtaagtaaaatgtccatgaaaataaaattttctttgaacagtttaaaaatggaatcacaaaaatctaactgcacttgaaatgaaactggaaattttatactaattaaatcctttatttaccttttcatattttatcaatggaaccttttaattgctccttctatatcactcttctccttgcttggctgatctcattacatgactttcgttacagacagtgtgagtgtactagatttgtttgctgctaatccgttattttaagtgttgtcagaaggaaataacttcttggtttgaccaagtaattttgcaaagtccttctctacctgataacacgtgaatgtatagcagtaaaggtgaaaattgcaggccttgttttgttcttcatacccccttcagttgtttatgggttaatgttatttgaaaactcttcctttttttaatgt

SEQ ID NO: 104929 - DNA, 1902 bp, Homo sapiens
accgccgctagatccgctgctgctgccgcggcgggcggacctgcaggaggcggcggcggcggcggcggccgaggctgaaggaagatggcggacggcgtggaccacatagacatttacgcggatgtcggcgaagagttcaaccaggaagctgaatatggtgggcatgatcagatagatttgtatgacgatgtcatatctccatctgcaaataatggagatgccccagaagaccgagattacatggatactctcccaccaactgttggtgatgatgtgggtaaaggagcagcaccaaatgttgtctatacatatactggaaagagaattgcattatatattggaaatctaacatggtggacaacagatgaagacttaactgaagcagttcattctttgggagtaaatgatattttggagataaaattttttgaaaatcgagcaaatggccagtcaaaggggtttgcccttgttggtgttggatctgaagcatcttcaaaaaagttaatggatctgttacctaaaagagaacttcatggtcagaatcctgttgtaactccatgcaataaacagttcctgagtcaatttgaaatgcagtccaggaaaactacacaatcaggacaaatgtctggggaaggtaaagctggtcctccaggaggcagttcccgtgcagcatttccacaaggtggtagaggacggggccgttttccaggggctgttcctggtggggacagatttcctgggccagcaggaccaggagggccacccccaccttttccagctggacagactccaccacgtccacccttaggtcctccaggcccacctggtccaccaggtcctccacctcctggtcaggttctgcctcctcctctagctgggcctcctaatcgaggagatcgccctccaccaccagttctttttcctggacaaccttttgggcagcctccattgggtccacttcctcctggccctccacctccagttccaggctacggcccccctcctggcccaccacctccacaacagggaccacctccacctccaggcccctttccacctcgtccacccggtccacttgggccaccccttacactagctcctcctccgcatcttcctggaccacctccaggtgccccaccgccagctccgcatgtgaacccagctttctttcctccaccaactaacagtggcatgcctacatcagatagccgaggtccaccaccaacagatccatatgggcgacctccaccatatgataggggtgactatggcccccctggaagggaaatggatactgcaagaacgccattgagtgaagctgaatttgaagaaatcatgaatagaaatagggcaatctcaagcagtgctatttcgagagctgtgtctgatgccagtgctggtgattatgggagtgctattgagacactggtaactgcaatttctttaattaaacaatccaaagtatctgctgatgatcgttgcaaagttcttattagttctttgcaagattgccttcatggaattgagtccaagtcttatggttctggatcaagacgtgaacgatcaagagagagggaccatagtagatcacgagaaaagagtcgacgtcataaatcccgtagtagagaccgtcatgacgattattacagagagagaagcagagaacgagagaggcaccgggatcgtgaccgagaccgtgaccgagagcgtgaccgagagcgcgaatatcgtcatcgttagaagctgaaggaagaggatcaccttccaagacaaaacagtcttcatgggggaaaaatgacgcttgtccagcagtttgcttcttgtgattgaactgaacctgtaaggattcatggataaaatgaacaggaatagatctgaataaagcaaatctgcataaatggt

SEQ ID NO: 104930 - DNA, 2581 bp, Homo sapiens
accgccgctagatccgctgctgctgccgcggcgggcggacctgcaggaggcggcggcggcggcggcggccgaggctgaaggaagatggcggacggcgtggaccacatagacatttacgcggatgtcggcgaagagttcaaccagattacagagagagaagcagagaacgagagaggcaccgggatcgtgaccgagaccgtgaccgagagcgtgaccgagagcgcgaatatcgtcatcgttagaagctgaaggaagaggatcaccttccaagacaaaacagtcttcatgggggaaaaatgacgcttgtccagcagtttgcttcttgtgattgaactgaacctgtaaggattcatggataaaatgaacaggaatagatctgaataaagcaaatctgcataaatggtaaccagtagctctacttttattttttatgttgcttaactgttttatttgaaggaaacctgtgtgatttaaaaagttatagcttttgcaactttattactggttatatacatttggccattatgatgtgcaagcaattggaaaaaaagtcaagtaaatgcttgtttttgtagtagtttgttcttgttaaaaatgtttatatgataatgtctgtaaacagcatcactttgattacaatagatgtagtgttgtaataaactgtttaatggggctgatgtgtaaagctgttcaagttatttgatgtttacacctcagggaaagtcttgtgttcagcaatatctaaagataatgttactatgacaacatttttactgtcctttaaagcattgcaatagcgtttttggatatgcctcaatctaatcttgcgttcagtgaattaaacatagtaattaagtgtcttttgcccttgattttgatattagaataggtgattacatggatatttaatatttctatattctgcttttctagctgtttttacctagttagcttgtgactttgctgaatggtatgtaaacttgtaaaaatagagatttgacagacatagcaatctagtcaatgtgtaaggggtcaaaaaaacagaggttttaacacataagtaaaaacccgtacatatttgatgtgtaatgcaggttaattacaacacagatgtaccgaaacacttaattgtgaaccgctaacattgaagaaattttgacaattccgatttgatgctgcaattacttgctgtttttattgatcttatggtttatttcttaagccatagtcagtgtaaatacagccctgcagcaggtaaatgtgagtaaagagagccttatattttccaattggtataaatttttgaaggatgtgatgttcattaacattcggttgtattccccagtatttgtaatgggaaattacagataaaccgtgtctgcacagtttaaggaatactatgtatattcatgcaccgtattgattcatgctatagttacttaatcaaagatttttttcaaacctgccttacatataggcccactttaaaagcacctgactagcatgtgttcttgattgcaaaattggcagaggcagggtgtcaacttgattaggtgtttttatgggaatgtaatttgaaatcactacttcagaaatttgacttaaaattcttgagcacgttaatatgtttttaagatctgattatctttgagagatcttctgttaatacacattggttgttaaagagtacccaaattctaggacaatgcttaaagtgttaaaataccctagatactgtgttatgtgcaactgtagaaaccctccagaaatttccactgctgttcttcactttcatcttgtctgctatcaaaccacttctgacaaaattagctgttttgaattacccatatcactgccagttttattttaaaatattttgtgtttgaagtatctgtgcatgggatcgttgatgtttatcagaactgttcactttcagaaatgattttttaaagcattttgttgaaaatgcggttgcttttttaacattattttagagttgtatcaaaattttcctgttttctgtatattgttgtgtcatttcttggctttttaatattttgactacaatgccctaatgcgaagaagtatggacatataaatattacaagagaaattagttaatagtaaagggttaaaaggtaagtaaaatgtccatgaaaataaaattttctttgaacagtttaaaaatggaatcacaaaaatctaactgcacttgaaatgaaactggaaattttatactaattaaatcctttatttaccttttcatattttatcaatggaaccttttaattgctccttctatatcactcttctccttgcttggctgatctcattacatgactttcgttacagacagtgtgagtgtactagatttgtttgctgctaatccgttattttaagtgttgtcagaaggaaataacttcttggtttgaccaagtaattttgcaaagtccttctctacctgataacacgtgaatgtatagcagtaaaggtgaaaattgcaggccttgttttgttcttcatacccccttcagttgtttatgggttaatgttatttgaaaactcttcctttttttaatgt

SEQ ID NO: 104931 - DNA, 413 bp, Homo sapiens
ttattttagtattttttggtctataataatagatatataaagagaaaaaaagaaacttactatcattcccagtgaccccttctgggtgccaactactgaggaggaatacttgcactttggggagaaggctgactctgagaaccaagcccggaagtacatgaacgcagtacgaaagcggaaggggctttatgtggaagaaaagattgtggagcatgcagaaaagcagaggacactcagcaaaaataagtagctacctactactggtggattcttttccttatagtgaatttaaaagtatcatcaagggtttaatattgggaaaatttctttttgccacattatctctgtttattcactttcaataaagttgatccatataaatattttaaagaggatgttagagaacgttttcc

SEQ ID NO: 104932 - DNA, 905 bp, Homo sapiens
agcaggctggtactggtctgggatgttaggatggcgcgcgggcgtgtcggacccgcagagctctcggactttcggaagctctcggtgtgggtgcgacccgagagaaggagcggggctggtggggctgctgcagccggtgagtgtgggctggcgctgggggctggaacctcctaggccagcctttgggcggtgccggaggaacccgctcgctgcggctctgaggcgggaacaggggctggggccgagcgcgggctgggagcttcggtccccggagtgccgcttcccgtctggggccggggcggtcgcctgtctgtgtggacccaggatcctcaaagagaacgaatctgggaccctgcagaaatgaagggcatgtagtgtagaggtttttcctttttatttagaaaggaatgaaagaccggcagtgcacctgcttggataataagcacgtgacccaaaactttgttcgggctccatgggcaggaataaagctgggtatttgacctcgcgcgaggacgagcgagaatgtcagaatgagggacttgggggaagactgaagagagaaagggagcatcttcttcagcattttctctccctcctggatgcaacccttcctgtacgtggtcattggcctggagatgtttactggagtactcctccaccggcagggttactggtgtcactgtgcacccagtcccctcgagctgcgtgattcatcgcagcctttggatccggaaggatgagcaaactccttaagtgtaatcgtggtaggatactgactttagtgctcgaactggacttaggccttggtggtctatctcatcaataaacattcactgggttcttggtttaaggggtttgagaagcttgccacctcccagcgtttattattatttttttcttttgcc

SEQ ID NO: 104933 - DNA, 3681 bp, Homo sapiens
agcaggctggtactggtctgggatgttaggatggcgcgcgggcgtgtcggacccgcagagctctcggactttcggaagctctcggtgtgggtgcgacccgagagaaggagcggggctggtggggctgctgcagccgtcacaggaaataagtaatcatggtgctcaacagtttggataagatgattcaactccagaaaaacactgccaacatcaggaatatttgtgttttggctcatgttgaccatggaaaaactactctggctgactgtcttatatctagcaatggaatcatctccagccgcctagcaggcaagttaaggtacatggacagcagagaagatgaacagatccgagggatcactatgaaatccagtgccatttccctacattatgcaacaggtaatgaggagtacctgatcaatctgatagactctccaggacacgtggacttttcctcagaagtatcaaccgctgttcgcatttgtgatggatgcatcattgtggtagatgctgtggaaggagtctgtccacagacacaggcagttctgcgacaagcttggcttgaaaacatccgtccggttttagtgattaataagattgatcgcttgatagtggaactgaaattcaccccacaagaggcctattctcacctcaagaatattttagaacagattaatgcgctcacagggactctttttacttctaaagtcctagaagaaagagcagagagggagactgaatcccaagtgaatccaaattctgaacaaggagagcaagtatatgactggagcactggcttggaggacacagatgattctcacctttacttctctccagaacagggaaatgtggtgtttaccagtgcaatagatgggtggggctttggaattgagcacttcgccagaatctacagtcaaaaaattggcatcaaaaaggaagttcttatgaaaaccttgtggggagattactatataaatatgaaggctaaaaagatcatgaagggtgatcaggccaaaggaaagaaacctttatttgtacagttgatcctggaaaatatatggagtttgtatgatgctgttttgaaaaaggacaaagacaaaattgataaaatagtgacttctttaggattaaaaattggagcccgggaggcacgacattcagaccctaaagttcagatcaacgccatttgcagtcagtggctacccatatcccatgctgttcttgctatggtgtgtcagaaacttcctagtccccttgatattacagctgagagagtggagagactgatgtgcacaggatcacaaacttttgactcttttccaccagaaactcaagcactgaaagcagcttttatgaaatgtggaagtgaggacactgctccagttattatatttgtttccaaaatgtttgcagttgatgctaaggccttgcctcagaataagccaaggcctctcactcaagaagaaattgctcagagacgtgagcgtgcaagacaaaggcatgcagagaagcttgcagcagcacagggacaggcacccttggagcccacccaagatgggagtgccattgaaacatgtccaaaaggagacgagccaagaggtgacgagcaacaggtggaaagtatgacccctaaacctgtgctccaggaagaaaacaaccaagagtcttttattgcatttgctcgggtgttcagtggtgtggctcgaagaggaaagaaaatttttgtcttggggcccaaatacagtcctcttgagtttttacgaagggtaccattaggcttctcagctccaccagatggcctcccccaagtcccccacatggcatactgtgctctggaaaacctgtatcttctgatgggaagggaactggaatatctagaggaggtacctccaggaaatgtgctaggaataggaggccttcaagattttgtgctgaaatctgcaacactgtgtagcctgccatcctgcccaccatttataccactcaacttcgaagccactcctattgtgagagttgctgttgaaccaaaacatccaagtgaaatgcctcagctcgtaaaaggaatgaaactgttaaaccaggctgatccctgtgtccagattttaattcaggaaacgggagagcacgttttagtcacagcaggagaagtccaccttcagcgatgcctggatgacttaaaagaaaggtttgcaaagattcatatcagtgtatctgaacctattattccattcagagaaacaatcacaaaacccccaaaagttgacatggtcaatgaagaaataggcaaacagcaaaaagttgcagtcatacaccaaatgaaagaagatcaaagcaaaatccctgaaggaatccaagttgactctgacgggctaatcaccataacaactcccaataaacttgccacgctcagtgttcgagccatgccccttccagaagaagtcacccagattctggaagaaaatagtgatttgattcgttctatggagcagttgacatcctctttgaatgagggcgaaaatactcacatgattcatcagaagacccaagagaaaatttgggaattcaaaggaaaactggagcaacacctaacagggagaagatggaggaacattgttgaccaaatctggtcatttggcccaagaaaatgtgggcccaacatactagtcaataaaagtgaagattttcagaactcagtatggacaggtccagctgacaaagcttcaaaagaagccagtagataccgagatttgggcaatagcattgtgagtggcttccaactagcaaccctctctggccccatgtgtgaggagcctctcatgggtgtctgttttgttctggaaaaatgggacctaagtaaatttgaggaacaaggagcaagtgatctggcaaaagagggacaggaggaaaatgaaacctgttctggtggaaatgaaaaccaagagctacaagatggctgctctgaggcctttgagaagaggacatcacagaaaggagaatctccactcactgactgctatggacctttctcaggacagctaattgccaccatgaaagaagcatgtcgctatgcactgcaagtgaaacctcagcgcctgatggcagctatgtacacatgtgacatcatggccactggtgatgttctcggtcgagtctatgctgtcttgtcaaagagagaaggtcgggtacttcaagaagaaatgaaagaagggacagacatgttcatcatcaaggctgtgctgcctgttgctgaaagctttggttttgctgatgaaatcaggaagaggacaagtggcctggccagcccacaactagtattcagccattgggagatcattcccagtgaccccttctgggtgccaactactgaggaggaatacttgcactttggggagaaggctgactctgagaaccaagcccggaagtacatgaacgcagtacgaaagcggaaggggctttatgtggaagaaaagattgtggagcatgcagaaaagcagaggacactcagcaaaaataagtagctacctactactggtggattcttttccttatagtgaatttaaaagtatcatcaagggtttaatattgggaaaatttctttttgccacattatctctgtttattcactttcaataaagttgatccatataaatattttaaagaggatgttagagaacgttttcc

SEQ ID NO: 104934 - DNA, 2860 bp, Homo sapiens
aaagctaggtacgagctgcgttcgaatcggccgaggagagaaggagcggggctggtggggctgctgcagccgtcacaggaaataagtaatcatggtgctcaacagtttggataagatgattcaactccagaaaaacactgccaacatcaggaatatttgtgttttggctcatgttgaccatggaaaaactactctggctgactgtcttatatctagcaatggaatcatctccagccgcctagcaggcaagttaaggtacatggacagcagagaagatgaacagatccgagggatcactatgaaatccagtgccatttccctacattatgcaacaggtaatgaggagtacctgatcaatctgatagactctccaggacacgtggacttttcctcagaagtatcaaccgctgttcgcatttgtgatggatgcatcattgtggtagatgctgtggaaggagtctgtccacagacacaggcagttctgcgacaagcttggcttgaaaacatccgtccggttttagtgattaataagattgatcgcttgatagtggaactgaaattcaccccacaagaggcctattctcacctcaagaatattttagaacagattaatgcgctcacagggactctttttacttctaaagtcctagaagaaagagcagagagggagactgaatcccaagtgaatccaaattctgaacaaggagagcaagtatatgactggagcactggcttggaggacacagatgattctcacctttacttctctccagaacagggaaatgtggtgtttaccagtgcaatagatgggtggggctttggaattgagcacttcgccagaatctacagtcaaaaaattggcatcaaaaaggaagttcttatgaaaaccttgtggggagattactatataaatatgaaggctaaaaagatcatgaagggtgatcaggccaaaggaaagaaacctttatttgtacagttgatcctggaaaatatatggagtttgtatgatgctgttttgaaaaaggacaaagacaaaattgataaaatagtgacttctttaggattaaaaattggagcccgggaggcacgacattcagaccctaaagttcagatcaacgccatttgcagtcagtggctacccatatcccatgctgttcttgctatggtgtgtcagaaacttcctagtccccttgatattacagctgagagagtggagagactgatgtgcacaggatcacaaacttttgactcttttccaccagaaactcaagcactgaaagcagcttttatgaaatgtggaagtgaggacactgctccagttattatatttgtttccaaaatgtttgcagttgatgctaaggccttgcctcagaataagccaaggcctctcactcaagaagaaattgctcagagacgtgagcgtgcaagacaaaggcatgcagagaagcttgcagcagcacagggacaggcacccttggagcccacccaagatgggagtgccattgaaacatgtccaaaaggagacgagccaagaggtgacgagcaacaggtggaaagtatgacccctaaacctgtgctccaggaagaaaacaaccaagagtcttttattgcatttgctcgggtgttcagtggtgtggctcgaagaggaaagaaaatttttgtcttggggcccaaatacagtcctcttgagtttttacgaagggtaccattaggcttctcagctccaccagatggcctcccccaagtcccccacatggcatactgtgctctggaaaacctgtatcttctgatgggaagggaactggaatatctagaggaggtacctccaggaaatgtgctaggaataggaggccttcaagattttgtgctgaaatctgcaacactgtgtagcctgccatcctgcccaccatttataccactcaacttcgaagccactcctattgtgagagttgctgttgaaccaaaacatccaagtgaaatgcctcagctcgtaaaaggaatgaaactgttaaaccaggctgatccctgtgtccagattttaattcaggaaacgggagagcacgttttagtcacagcaggagaagtccaccttcagcgatgcctggatgacttaaaagaaaggtttgcaaagattcatatcagtgtatctgaacctattattccattcagagaaacaatcacaaaacccccaaaagttgacatggtcaatgaagaaataggcaaacagcaaaaagttgcagtcatacaccaaatgaaagaagatcaaagcaaaatccctgaaggaatccaagttgactctgacgggctaatcaccataacaactcccaataaacttgccacgctcagtgttcgagccatgccccttccagaagaagtcacccagattctggaagaaaatagtgatttgattcgttctatggagcagttgacatcctctttgaatgagggcgaaaatactcacatgattcatcagaagacccaagagaaaatttgggaattcaaaggaaaactggagcaacacctaacagggagaagatggaggaacattgttgaccaaatctggtcatttggcccaagaaaatgtgggcccaacatactagtcaataaaagtgaagattttcagaactcagtatggacaggtccagctgacaaagcttcaaaagaagccagtagataccgagatttgggcaatagcattgtgagtggcttccaactagcaaccctctctggccccatgtgtgaggagcctctcatgggtgtctgttttgttctggaaaaatgggacctaagtaaatttgtttgagttcattatagattctggatattaggcctttgtcacatgagtagcctgttcgattaa

SEQ ID NO: 104935 - DNA, 2571 bp, Homo sapiens
aaagctaggtacgagctgcgttcgaatcggccgaggagagaaggagcggggctggtggggctgctgcagccgtcacaggaaataagtaatcatggtgctcaacagtttggataagatgattcaactccagaaaaacactgccaacatcaggaatatttgtgttttggctcatgttgaccatggaaaaactactctggctgactgtcttatatctagcaatggaatcatctccagccgcctagcaggcaagttaaggtacatggacagcagagaagatgaacagatccgagggatcactatgaaatccagtgccatttccctacattatgcaacaggtaatgaggagtacctgatcaatctgatagactctccaggacacgtggacttttcctcagaagtatcaaccgctgttcgcatttgtgatggatgcatcattgtggtagatgctgtggaaggagtctgtccacagacacaggcagttctgcgacaagcttggcttgaaaacatccgtccggttttagtgattaataagattgatcgcttgatagtggaactgaaattcaccccacaagaggcctattctcacctcaagaatattttagaacagattaatgcgctcacagggactctttttacttctaaagtcctagaagaaagagcagagagggagactgaatcccaagtgaatccaaattctgaacaaggagagcaagtatatgactggagcactggcttggaggacacagatgattctcacctttacttctctccagaacagggaaatgtggtgtttaccagtgcaatagatgggtggggctttggaattgagcacttcgccagaatctacagtcaaaaaattggcatcaaaaaggaagttcttatgaaaaccttgtggggagattactatataaatatgaaggctaaaaagatcatgaagggtgatcaggccaaaggaaagaaacctttatttgtacagttgatcctggaaaatatatggagtttgtatgatgctgttttgaaaaaggacaaagacaaaattgataaaatagtgacttctttaggattaaaaattggagcccgggaggcacgacattcagaccctaaagttcagatcaacgccatttgcagtcagtggctacccatatcccatgctgttcttgctatggtgtgtcagaaacttcctagtccccttgatattacagctgagagagtggagagactgatgtgcacaggatcacaaacttttgactcttttccaccagaaactcaagcactgaaagcagcttttatgaaatgtggaagtgaggacactgctccagttattatatttgtttccaaaatgtttgcagttgatgctaaggccttgcctcagaataagccaaggcctctcactcaagaagaaattgctcagagacgtgagcgtgcaagacaaaggcatgcagagaagcttgcagcagcacagggacaggcacccttggagcccacccaagatgggagtgccattgaaacatgtccaaaaggagacgagccaagaggtgacgagcaacaggtggaaagtatgacccctaaacctgtgctccaggaagaaaacaaccaagagtcttttattgcatttgctcgggtgttcagtggtgtggctcgaagaggaaagaaaatttttgtcttggggcccaaatacagtcctcttgagtttttacgaagggtaccattaggcttctcagctccaccagatggcctcccccaagtcccccacatggcatactgtgctctggaaaacctgtatcttctgatgggaagggaactggaatatctagaggaggtacctccaggaaatgtgctaggaataggaggccttcaagattttgtgctgaaatctgcaacactgtgtagcctgccatcctgcccaccatttataccactcaacttcgaagccactcctattgtgagagttgctgttgaaccaaaacatccaagtgaaatgcctcagctcgtaaaaggaatgaaactgttaaaccaggctgatccctgtgtccagattttaattcaggaaacgggagagcacgttttagtcacagcaggagaagtccaccttcagcgatgcctggatgacttaaaagaaaggttaggtgaaaatgatagcgatggagaaatgatagctctcaatcaatgggatgttttagtgtttcctaaaccagttgaacttagactgcggcttatttttggagaaaaatgaaatgccctcaattcagacatgaacagttattcgatggtagacttattttttaataactgaaaaatggcattcactgcctacacttgaataattttgcatttttagcttaagtcataaaatgtttttctgtgtatgtattttactttaagcatgtacacaaaacacacaaaataccaggacaacaaaacaagatattattttgtaaatgttggctatgtaattaggatagacttcttctcttattgatgtggtctttacaatgtaaaccttctggaaatctttatgtttttctataaagatgatatgtattataaaatgggcatcccaaatttttataa

SEQ ID NO: 104936 - DNA, 403 bp, Homo sapiens
  misc_feature (47)..(47): n is a, c, g, or t
accgaactgttcaagtgttagacgtccatagcacaacaaagagaatngcttatcattcccagtgaccccttctgggtgccaactactgaggaggaatacttgcactttggggagaaggctgactctgagaaccaagcccggaagtacatgaacgcagtacgaaagcggaaggggctttatgtggaagaaaagattgtggagcatgcagaaaagcagaggacactcagcaaaaataagtagctacctactactggtggattcttttccttatagtgaatttaaaagtatcatcaagggtttaatattgggaaaatttctttttgccacattatctctgtttattcactttcaataaagttgatccatataaatattttaaagaggatgttagagaacgttttcc

SEQ ID NO: 104937 - DNA, 3617 bp, Homo sapiens
aaagctaggtacgagctgcgttcgaatcggccgaggagagaaggagcggggctggtggggctgctgcagccgtcacaggaaataagtaatcatggtgctcaacagtttggataagatgattcaactccagaaaaacactgccaacatcaggaatatttgtgttttggctcatgttgaccatggaaaaactactctggctgactgtcttatatctagcaatggaatcatctccagccgcctagcaggcaagttaaggtacatggacagcagagaagatgaacagatccgagggatcactatgaaatccagtgccatttccctacattatgcaacaggtaatgaggagtacctgatcaatctgatagactctccaggacacgtggacttttcctcagaagtatcaaccgctgttcgcatttgtgatggatgcatcattgtggtagatgctgtggaaggagtctgtccacagacacaggcagttctgcgacaagcttggcttgaaaacatccgtccggttttagtgattaataagattgatcgcttgatagtggaactgaaattcaccccacaagaggcctattctcacctcaagaatattttagaacagattaatgcgctcacagggactctttttacttctaaagtcctagaagaaagagcagagagggagactgaatcccaagtgaatccaaattctgaacaaggagagcaagtatatgactggagcactggcttggaggacacagatgattctcacctttacttctctccagaacagggaaatgtggtgtttaccagtgcaatagatgggtggggctttggaattgagcacttcgccagaatctacagtcaaaaaattggcatcaaaaaggaagttcttatgaaaaccttgtggggagattactatataaatatgaaggctaaaaagatcatgaagggtgatcaggccaaaggaaagaaacctttatttgtacagttgatcctggaaaatatatggagtttgtatgatgctgttttgaaaaaggacaaagacaaaattgataaaatagtgacttctttaggattaaaaattggagcccgggaggcacgacattcagaccctaaagttcagatcaacgccatttgcagtcagtggctacccatatcccatgctgttcttgctatggtgtgtcagaaacttcctagtccccttgatattacagctgagagagtggagagactgatgtgcacaggatcacaaacttttgactcttttccaccagaaactcaagcactgaaagcagcttttatgaaatgtggaagtgaggacactgctccagttattatatttgtttccaaaatgtttgcagttgatgctaaggccttgcctcagaataagccaaggcctctcactcaagaagaaattgctcagagacgtgagcgtgcaagacaaaggcatgcagagaagcttgcagcagcacagggacaggcacccttggagcccacccaagatgggagtgccattgaaacatgtccaaaaggagacgagccaagaggtgacgagcaacaggtggaaagtatgacccctaaacctgtgctccaggaagaaaacaaccaagagtcttttattgcatttgctcgggtgttcagtggtgtggctcgaagaggaaagaaaatttttgtcttggggcccaaatacagtcctcttgagtttttacgaagggtaccattaggcttctcagctccaccagatggcctcccccaagtcccccacatggcatactgtgctctggaaaacctgtatcttctgatgggaagggaactggaatatctagaggaggtacctccaggaaatgtgctaggaataggaggccttcaagattttgtgctgaaatctgcaacactgtgtagcctgccatcctgcccaccatttataccactcaacttcgaagccactcctattgtgagagttgctgttgaaccaaaacatccaagtgaaatgcctcagctcgtaaaaggaatgaaactgttaaaccaggctgatccctgtgtccagattttaattcaggaaacgggagagcacgttttagtcacagcaggagaagtccaccttcagcgatgcctggatgacttaaaagaaaggtttgcaaagattcatatcagtgtatctgaacctattattccattcagagaaacaatcacaaaacccccaaaagttgacatggtcaatgaagaaataggcaaacagcaaaaagttgcagtcatacaccaaatgaaagaagatcaaagcaaaatccctgaaggaatccaagttgactctgacgggctaatcaccataacaactcccaataaacttgccacgctcagtgttcgagccatgccccttccagaagaagtcacccagattctggaagaaaatagtgatttgattcgttctatggagcagttgacatcctctttgaatgagggcgaaaatactcacatgattcatcagaagacccaagagaaaatttgggaattcaaaggaaaactggagcaacacctaacagggagaagatggaggaacattgttgaccaaatctggtcatttggcccaagaaaatgtgggcccaacatactagtcaataaaagtgaagattttcagaactcagtatggacaggtccagctgacaaagcttcaaaagaagccagtagataccgagatttgggcaatagcattgtgagtggcttccaactagcaaccctctctggccccatgtgtgaggagcctctcatgggtgtctgttttgttctggaaaaatgggacctaagtaaatttgaggaacaaggagcaagtgatctggcaaaagagggacaggaggaaaatgaaacctgttctggtggaaatgaaaaccaagagctacaagatggctgctctgaggcctttgagaagaggacatcacagaaaggagaatctccactcactgactgctatggacctttctcaggacagctaattgccaccatgaaagaagcatgtcgctatgcactgcaagtgaaacctcagcgcctgatggcagctatgtacacatgtgacatcatggccactggtgatgttctcggtcgagtctatgctgtcttgtcaaagagagaaggtcgggtacttcaagaagaaatgaaagaagggacagacatgttcatcatcaaggctgtgctgcctgttgctgaaagctttggttttgctgatgaaatcaggaagaggacaagtggcctggccagcccacaactagtattcagccattgggagatcattcccagtgaccccttctgggtgccaactactgaggaggaatacttgcactttggggagaaggctgactctgagaaccaagcccggaagtacatgaacgcagtacgaaagcggaaggggctttatgtggaagaaaagattgtggagcatgcagaaaagcagaggacactcagcaaaaataagtagctacctactactggtggattcttttccttatagtgaatttaaaagtatcatcaagggtttaatattgggaaaatttctttttgccacattatctctgtttattcactttcaataaagttgatccatataaatattttaaagaggatgttagagaacgttttcc

SEQ ID NO: 104938 - DNA, 2008 bp, Homo sapiens
ttcatagcattagggcagcaccccaggcctatgagcaccaaagattggttggttggttaattgaaatgccttctggatacttgcatttatatggtaccattaggcttctcagctccaccagatggcctcccccaagtcccccacatggcatactgtgctctggaaaacctgtatcttctgatgggaagggaactggaatatctagaggaggtacctccaggaaatgtgctaggaataggaggccttcaagattttgtgctgaaatctgcaacactgtgtagcctgccatcctgcccaccatttataccactcaacttcgaagccactcctattgtgagagttgctgttgaaccaaaacatccaagtgaaatgcctcagctcgtaaaaggaatgaaactgttaaaccaggctgatccctgtgtccagattttaattcaggaaacgggagagcacgttttagtcacagcaggagaagtccaccttcagcgatgcctggatgacttaaaagaaaggtttgcaaagattcatatcagtgtatctgaacctattattccattcagagaaacaatcacaaaacccccaaaagttgacatggtcaatgaagaaataggcaaacagcaaaaagttgcagtcatacaccaaatgaaagaagatcaaagcaaaatccctgaaggaatccaagttgactctgacgggctaatcaccataacaactcccaataaacttgccacgctcagtgttcgagccatgccccttccagaagaagtcacccagattctggaagaaaatagtgatttgattcgttctatggagcagttgacatcctctttgaatgagggcgaaaatactcacatgattcatcagaagacccaagagaaaatttgggaattcaaaggaaaactggagcaacacctaacagggagaagatggaggaacattgttgaccaaatctggtcatttggcccaagaaaatgtgggcccaacatactagtcaataaaagtgaagattttcagaactcagtatggacaggtccagctgacaaagcttcaaaagaagccagtagataccgagatttgggcaatagcattgtgagtggcttccaactagcaaccctctctggccccatgtgtgaggagcctctcatgggtgtctgttttgttctggaaaaatgggacctaagtaaatttgaggaacaaggagcaagtgatctggcaaaagagggacaggaggaaaatgaaacctgttctggtggaaatgaaaaccaagagctacaagatggctgctctgaggcctttgagaagaggacatcacagaaaggagaatctccactcactgactgctatggacctttctcaggacagctaattgccaccatgaaagaagcatgtcgctatgcactgcaagtgaaacctcagcgcctgatggcagctatgtacacatgtgacatcatggccactggtgatgttctcggtcgagtctatgctgtcttgtcaaagagagaaggtcgggtacttcaagaagaaatgaaagaagggacagacatgttcatcatcaaggctgtgctgcctgttgctgaaagctttggttttgctgatgaaatcaggaagaggacaagtggcctggccagcccacaactagtattcagccattgggagatcattcccagtgaccccttctgggtgccaactactgaggaggaatacttgcactttggggagaaggctgactctgagaaccaagcccggaagtacatgaacgcagtacgaaagcggaaggggctttatgtggaagaaaagattgtggagcatgcagaaaagcagaggacactcagcaaaaataagtagctacctactactggtggattcttttccttatagtgaatttaaaagtatcatcaagggtttaatattgggaaaatttctttttgccacattatctctgtttattcactttcaataaagttgatccatataaatattttaaagaggatgttagagaacgttttcc

SEQ ID NO: 104939 - DNA, 404 bp, Homo sapiens
cgcatcttaaatcagcagaagccaccgaaatgaactcacacaaaaaacgttaatcattcccagtgaccccttctgggtgccaactactgaggaggaatacttgcactttggggagaaggctgactctgagaaccaagcccggaagtacatgaacgcagtacgaaagcggaaggggctttatgtggaagaaaagattgtggagcatgcagaaaagcagaggacactcagcaaaaataagtagctacctactactggtggattcttttccttatagtgaatttaaaagtatcatcaagggtttaatattgggaaaatttctttttgccacattatctctgtttattcactttcaataaagttgatccatataaatattttaaagaggatgttagagaacgttttcc

SEQ ID NO: 104940 - DNA, 555 bp, Homo sapiens
actgagacattttaaaatacatgtttaatttctacatgtctagacatacagtgagtatttcctgggaaattgtaccaaaatttaagatactaaggtatttttcaagcttagcaagtagatcttaataaaacaagttcaggattaagtaggtaaaattacaaagctttaaggtatttctttcaatataaaagttttctcaaaactcattatcttacttggtaaagcatcatgtcagaacagaaggttttaaaacactaatttattaaacattttctccatattatttgccttttttttttcatatacctttcatgtaattgggatactaagccaaaatgggcagttccagaaattagatgacttttatagagcatagatttgctttactatccaggttttgtaacacatttttttttccctagccatcactttcacatttgactttatactttggaagactgtttgggttttttgctttctttttgtttctagtgagttcagtgtatgaaaacatgtctataaataaatatgtaagttccttttctgatttcttag

SEQ ID NO: 104941 - DNA, 2382 bp, Homo sapiens
ggagcccagtagggccccattgctgaatgtttatcacacttctggctagggcttatggatgagcagaccacgtaggagctaggatttactcagttccacctcactgacagcttttctaggtgccaagcaactgacttttcctgtgtaaggaagcccaagtacttgaccagtgatatatatggccatggcaaaagtataaatggatggatgtagaccatattcaacgcagaatacattttagatcggtatctggcattgtaatcattttgtcttttgaattaacatgccctgcttgtcttttctgaatggaagggtaggaaagtggaaggtactaaaaaggaaaatgtagttttagtttcttttctaagctaaagaactggctttactactgctatattttactaccacatagtagtgtagatgtagtataacttgcttaggaatgctttcaaaaaggttacctccatagtcaaaaaaagggggagtatacagctgattgttgcatttatgaaactgcatttcaatatgctatgctgttactgtgcttagacacttccttacgtttgagttccaaggagagagagtgagaagaggaactccttttgctgagctctggtccaaattaatgtgaatccccaaagtaaattgctgcatatgaacaacaggttttaggtttaaattgaagatacattcattttatatgtatttgttgtgaatgagagaaattgagtgatctgattggccattaaaattatggtgaatgggtcgggcgcagtggctcacgcctgtaatcccagcactttgggaggccgaggtgggtagatacctgaggtcaggagtttgagaccagcctgaccaacatggtgaaaccccatctctactaaaaataccaaaatcaccagggtgtggtggcccatgcctgtaatcctagctactcgggaggctgaggcaggagaatcggcttgaacccaggaggcagaggttgcagtgagctgagatcgcaccactgtagtccagcctgggtgtcagagcaagactctgtcacaaaaagaaaaattatggggaatggccgggcgcggtggctcacacctgtaatcccagcactttgggaggccgaggtgggtggatcacctgaagtcaggagctcaagaccagcctggccaacatggtgaaaccccacctcaacagaatatacaaaaaaattagctgggtgtggtggcgggtgcctgtaatctcagctactttgggatgctgaggcaggagaatagcttgaacccaggaggtggaggttgcagtgagtcgagattgcaccattgcactccagcctgggcaacaagagcaaaactctgtctcaaaaaaaaaaaaaatggtgaccatgcgttcaaccatataatttcttactgaaattgagctcctccttttgaataaccatgtacatatttttaaaagtattttatagccctatgtaaatagttgatgtctttttataaatgtttattgcatattcatcttgaatgtgaatttactgttgtaattcacatactggtgtcatgtttctgagtgagaataatgctagtcagtcagatcacagatttttctccatgaaggttttacttattgagagggacatctgaggcagtagtcttcgtctttaatttttgggggcagattggtgctttggttttaataaaaactaactttgatggatttttactgtcaatattttaccacaaggattttttaatagaaaaattactgaatgttacttcagcagagttctaactactttgagtctccattactactactgttgttcccctagctgtaacattgatccatataggggcaagctactagtccataaatagctgtaataggaaaacagttttttaaaattctaacacgtgtatttcaccagccttaaaagatttaaaaaaaaatctgacaggaaggaaagcgggtggtaagtatcttggattattctgcctcataccagccactcccaaagtaggaggaccaaagatgccatgaagacttctagttgtctggaagttatttggggaaggggggaaagacacagagtggggacctttggaagtcattttaaaaatttagctatgttaattccacttgtaaagtttgaaaggttttgattcttgtaatttctgagaattactatgttttaaatttactattggatatttaacagatctttcatggggccaacctatttgcttccttaattttcaaattaagtcctaatttgagtcctaaaaaaatctttccttgttagttgcaagttaaacatttaataaaattattttcccacgttttcacatgtggtatggaataaaggctgttttaacattccctgcgagatac

SEQ ID NO: 104942 - DNA, 450 bp, Homo sapiens
gtgttccccagaaccttaagagctgctctggctgttgctctgcaccccacatcttgaaataggacctttgtggacagcatgggatcagcacactcccccacagctcagtgtaactgtgagcatctgatgtcccagagaactggaactttataattcatcctgaagcctggttgtcaacatctctgaggatgtgtgcatagcattaagccaatttaccatcgggaattcctgctctcttttgctgttgttgctcatggattcgtcaggtgaggaaattctagtctctagtttttcccaaactggtgctgaaataattacgcttggttctctgttgcttcttacctctttgctcttctgtgccacaacaatgtattctaagttaggtgccagcagcagaaacttttcttccacctataactagagttttaggcgtgaggaagggctagcttt

SEQ ID NO: 104943 - DNA, 356 bp, Homo sapiens
  misc_feature (13)..(13): n is a, c, g, or t
ggcacgagctggngaaacatcatccattctctctccataccaccccccaaaaattttcaccaccccaacacttcaacactattttgttttatttttcttattaagaaggcaggaatgtcaggcctctgagcccaagccaagccatcgcatcccctatgacctgcacatatacgcccagatggcctgaagtaactgaagaatcacaaaagaagtgaatatgccctgccccaccttaactgatgacattccaccacgaaagaagtgaaaatggccggtccttgccttaagtgatgacattaccttgtgaaagtccttttcctggctcatcttggctcaaaaatcacccccactgagca

SEQ ID NO: 104944 - DNA, 763 bp, Homo sapiens
ttaaaggagtgtccatacaacatcgggaatccagaagtgcctgggactcagggcttatgtgtattgctgaactcagctgcctgagtttgggctttttcagggcctttggctgattgtagtgtgggatttgcaagagtgagttgtccgagtttcttgtaactaacctgatgctattttgcaggtgtgcagtaaagttttcccacattatgttaaagctggaggtagtaaaaacacagagaaaaatgaaacctccaagcatctgttgaagtggttctgtttggacgatgccacttctgttgtcattttataaaggttcattgtgctttacacctttgaatctgtatgagactcagaatgtttagtggcaaaaaaaaataagccaactccacctcccccatcaaggaagagaaaaacagagacaaaacccaaccatctggagcattgaaatttggtacagcacattacaagctggatcttcagctctcgggctaatttaccctgagtctcacgaggaacgtgtttttaaaatgttcctcaagtattataaatctccccaaataagtcattgttccagtggtttatgcctggtggttctgtcgtcaggagagataattggtttggaagcctttattgctggagatgaatggagggaagcccacccgtctggcaaggcactccctcagagtggcagtgtgattcctagcacaggctggatactgcggagcttcacagaatgtcagggaggagtgacagcatagaccag

SEQ ID NO: 104945 - DNA, 389 bp, Homo sapiens
aaaccatggcactgctggagaagagcagaagcacaggtgaagagcttggcatatttggagtcgaggataggagagaaccctttacagtgttacaggtttatcgatgacctccagccctactggaacaccaaaggtgatccttactgaaacagagaagggaggacccttaatcatgccacacacaggtgtgagccatgcaggagaaaccacactgggtcagacctgcattttggtcagacctatattctactgtcacctgcgatttgagagaacatgacataaagggccatggctgctatctgcctgccttctttgtccaaatcctttaggatctacttttatcttgtgtcagtatcttttgcaggtaacaagttccaaaagattatcat

SEQ ID NO: 104946 - DNA, 890 bp, Homo sapiens
aaataggttaaatcctgaaagatcaaaatccctcacatctaaaatctcaaaaatcacagtcccaaagtgatcgttcttgttgcccaggctgaagtgcaatggtgcgatctcagctcactgcaacctccgcctcccaggttcaagtgcttctcctgcctcagcctcacgagtagctgggattacaggtgtgcaccaccatgcctgacttattttttgtctttttagtagagacaggctttcaccctgttgctcaggctggtctcaaactccggacctcagaagatccacctacttcagcttcccaaattgctgggattataggcatgagcctgggtgacagagcgagattccgtctcaaaaaaaaaaaaaaaagcccacctgaaagcctgtctcttcccactttggtgggcccttccagggggattatcgagcatgtggtttttccatagtgccttttcccttattccaggggtggcttctgaggggtgtttttttttttacatgggttgggtttacaaaaccagtcaaggggcgcaaaagttttgcgccaattggtctcctactcggtgtaaattttttcccctcggggccgggggacccaggttaggagcaacgtgagcacccacgcccggtgttggtacaggcgggaggcagctaccccggcgtgtgattcataagccacgggaggctttagagccaccgggtttaaggggtttgtagacccctcgggggggttccgggactgtctctgcccaggtcgccctgtgtgatttttatgggccccggggacacagggacaggtttccgcgcggctatgccagttccatggatcggcttcacggcggtcggaacctgcccccgtctcggtgtggcccgcccttcctatttac

SEQ ID NO: 104947 - DNA, 298 bp, Homo sapiens
attatctatatagtaaaatatgcacgaagaaaaaacagaaacagacaataaatgttaatgtaattttttaaaatgaattaggggccaacatcatagaaactatgattatatttcacaagtgtctgggtttcattataagaacacaagtgatatccctcactaagtaggtctagtggaggggagaacaaaaagactaaaagaataagaacattcattaaaggaaaaaaccattagcattatttcagatatgaatacgcaacttatcaaatgaagtcaaagtccttcacggtatcttaac

SEQ ID NO: 104948 - DNA, 582 bp, Homo sapiens
tgcactggtaattacaatggaacagaacaggacagggattttcaccgtgtttttctttttctataaaatgtctgtaatctataggtaacataaccgattaggtcaggggttgatcattaactagcatgtcctgcctttaggcaaagaaagggaaggcagagtttttcttttatttgtttcttctcaatcgtcttcagctcaaaataatccttatgccaaagaagcatatgttagggtggcatattctggtgtaacatctttgtctcagcaggcagtgaaaaataatttaaaaagccaccttctctgcccgttgtcctgctgcacactgccccttggtggccatcattttaactgtctttggtaaaggtagcttttcttttttttgctttgagacggagtttcgctcttacggcccaggctggagtgcaatggcacatctcggctcactgcaacttccacctccccagttcaagcgattctcctgcctcagcttcccgagtagctgcaattacaggcgcctgccaccacacccagctaatttttgtatttttagcagacgggggtgtttcaccatgttggcca

SEQ ID NO: 104949 - DNA, 743 bp, Homo sapiens
ttctaggtgatggactatttatcaacttgctccataatccgtttagagttaaagaggaccacagaaactccacctccaggtgtcacaggttactaaacacaataactaaaacaaattaaaaaacttatctcagattccctcctggagtctactgccttgcttatacagttggacgacaaagtcagccactgcctgaattcatattctgcactatgtgattcaggaaacaacgttatgcttctcctatgttcccaatatgctggacatcaggtgtgggtaataacagtaccatgattttcctttggagactccaaatcctcagtccaaatgactttattccacttataactccatagaagccatgaaatccagacctcagtacagacggtgacttccatgaacttagctaaaatttttggacaaagtttactccctctggattctaaatggatagggtaatgttgctggctcagtgaagcaccttctgagcctactgaagcaggagccgatgctgaggcagaactgaaagatgcagaggcagagtccggataacactgtctgaacacctgaaaacacactgaacactgatgaattttactgttccgttttagcccaaggtcagtaagcatcttctgtaaagggctagattgcaaatattttaggttttatggaacataaggtttgggtgcaactattaagctccagtgtcggatatggctgtgttgcaattaaacttgatttac

SEQ ID NO: 104950 - DNA, 333 bp, Homo sapiens
gcctagaggatcccctcgcgagtatatccagcaagggctgctgcagacatctctaaaatgctttcaaggccggtttcccactgtcttggctttttgcactgggttcctttttatacaaataccctaagccttcttgaattttccctctcaaaatcggcttttctttttgaccacttagccaggctccacattttccaaactttagatctccacttgaagttccaacttgaagtcacttcttaggtcacccataagaacacaagctgttcaatgtaggcaggacacctcttgtgctatgctgcctagatgttcatttcaccagatacatcctaa

SEQ ID NO: 104951 - DNA, 308 bp, Homo sapiens
gaggccgaggcaggagaatggcttgaacccgggaggcagaagttgtagtgagccaagattgagccaaagcactccagccttggcgacaaagcgagcgagactccatctcaaaaaaaaaaaaaaaaaaaaaaaaaagattcccattatccttctctgctgtcctccgctatagggcgggaattctctgcaccagcacaatgaataggagcggttctttaaatatgttgcagtccagagtaggcaatatttttcagtggtgacggaggctctctacaacaaaactaactggcactgggaaagaaaaatgt

SEQ ID NO: 104952 - DNA, 596 bp, Homo sapiens
tgagacaaagtttcactcttgttgcccaggctggagggcagtggcgcgatctcagctcactgcaacctccgcctcccgggttcaagcaattctcctgcctcagccttccccagtagctgggattacaggcacccgccaccatgcccggctaattttgtatttttagtagagacggggtttctccacgttggtcaggctggtctggaactctcaacctcaggggatccgcctgcctcggcctcccatagtgctggaattacaggcgtaagcccaccgtgcccggccctgacaggtgtttttttttttaaagtcccaatatgagcaaatatctcaaaatgatcttcagacaaatacaaagaatgttaacaagattgccagaaaaatctaatgaaaaatttctaactattctttgaaggaccagcctcatgagtaaaggagccggcaggagcaagggagccccctgcttcacagcagctgttacagtcgagcacaatactaacatgtatatcagtgtttcactccaccagggcccagtcccatctctcagaatacctagacaatatgtcattattcaaaaagttaagtcttctctcctc

SEQ ID NO: 104953 - DNA, 154 bp, Homo sapiens
cacacacacacacacacacacacactctgaataaataagtaaattttagaattagccaagcgtgatggcgcacacctaaggaggaccacatgagcctggaaggtcaaggctgccatgagttcttttcacaccactgcaccccagcctgggcaac

SEQ ID NO: 104954 - DNA, 326 bp, Homo sapiens
cctttatgtaacagggctgtttccaggtcctggcagatggtccatagtaacagtgctttgctgatttggttggagctgagcctgtgaaatgaaaaatcctcagtagcagatgcctctcccaggccctggccatggaaaagtcctcctctccaaggaaagtactgtagcttgggtggtaactgtctctggtgggactaagtgtgagcaccctgaaagataatcttaaactgtgtcaagtttttacaaaaggtcacattggtgacttggaggttcttggcagttgagctgctagtagagggtgtttgtattctgggacctgagggaca

SEQ ID NO: 104955 - DNA, 292 bp, Homo sapiens
gaaaaagcattgaacagcagcatttttaatattaaccccatatctgaaagtttccatttccatcataagaaaacacagggctgacttcaaaaaaagttattacgtaatcaagaaagctgctaattatacaagttgggtatttcactgtgtttatcatactcagagaaaagtcgcttgaagttttcatttttttaatgtatccacatgtagaatatctagtagcttctaacatagtgtggtagctttccatgtagtctctctatcttttctttttaacctaaattcaccacat

SEQ ID NO: 104956 - DNA, 296 bp, Homo sapiens
ctaaaagaagcagagagtagaacagtggttaccagggttggagggaaggcatgggggaatggggagatgatagtcaaaggggaggaatttttttctttgagatatgttgcacagtatggtgaatatagtgactaataatgtactttatacttgctaagagtaacttttaaaagttttcactacaaaaaaaatttgaggtcatggatatgttaactagatttaattattccacattgtattcataaatcatcactttgtacctcataaatatataactatagtcagtttataattaa

SEQ ID NO: 104957 - DNA, 476 bp, Homo sapiens
ctcccaaagtgctggaattacaggcatgagccaccgtgccccggttctcatacgaccattctgttttttcactttcagtacagtattcaattacatgagatattcaaaattgtaacataagctctgtgttagatgatgttgcccgtaggctcatggaaatgttctggcacatttgcagtaggctatgctaagtaagttatggtgttcggcaggttacatatattacatgcgtttttgacttgtgacgttttcaacatatgatgggtttgtccttataagttgaggaacatttgtagccatttcatcgtctgtgaagaggcctgagtggattttgtgctggagaccggtgtgactcagctccagtgttgactgaccttctaaccatgggcttgtgactgaatgtcctgagccttcattttcttccctgtgaggattaaaatgaacctcaggaaatgctggcttgtcctctttctgtc

SEQ ID NO: 104958 - DNA, 138 bp, Homo sapiens
tttgcagtggagtaaagcaagaaggaactagtaggcgtatggagtagtttatgactctttcctgcctcctttcagaaggcaggtgaagtacttgcagctgcattctgaggaaggtggagtttccagtttctaccttct

SEQ ID NO: 104959 - DNA, 330 bp, Homo sapiens
gactctgttaataagatgaatggacaagctaaagactggcagaaaatatttgcaaaccacatatcagagaaaaagaataccgtctaaactatataaaaaactctaagaaatatacaagagaaaactcaaccaatctaattggaaaataggcaaaagacctgaacagacatttcaccaaagaggatagatagatggcatgtaaacacgtgaaaagatgttcaacatcattagccattaagaaaaattagattaaaaccacagtgaactatcactacacatctgtcagaatggttaaaaattaatattcacaaatagtgacaacatcagaca

SEQ ID NO: 104960 - DNA, 335 bp, Homo sapiens
tttttttttttctacagcatctttttattgtctttaccattactttaatgcattttaaaatttatctacattaattgggaactatttgcatttttttcatcctctctctctttttctttttctttttttggatttgtcttggccagagaggttctccaacacccgggtggacttggaatttttttatcagctgcaatctgaagacttgtctttactgtggaataggtgacattcctttaggacctcagaagctcaagtagtttaatgccaagtctttccagagcctcactctcttttattttttaaattagaattgtgatttattgaagccttac

SEQ ID NO: 104961 - DNA, 843 bp, Homo sapiens
agttgcagagatctttccagtagaaattatgtcaggaaggagggggtccacatcttgactggccttcccagcaagagcccctctggtccttgcacggctaattccaaaacacccgtgacttcagagataaggtcagcctgggactgtgcgtctgtgcgtcctcccaacttgaagcttcagttactgtttgactgctcagggcttcttcctgtgtgccattcagacctacagccactgagtgaaacccttctcttgcttttgtactgctttggaggcagctgcctccccacagatgaacagtgtgacctcgcaggccactcggcactgtgagctcctgtgctgctgtcccagccagaatcctgtccttgaaaggagggctccctgtgcctcctgtcaggtgatgggaggctctgtccctggccagagtccccgtggggatggagacctacaaaactcaaatgccctttgtagttactccctcttcttctgttcttgctcagtggcttttatttggttccctttgagttcccagcccctatttctcttcagaggttactgatgagccaagcctcagaacatatcagaagcagccagaggctgtctcctggtgaggctgcaatgcatttcaccaagcagacatcaccttgggcagcaggcccatttggttgtcatgacaacgtgggtagtttgtgtcgtggagtgtgctgtgccctcattctggcttcccaaggtcccttgccccagctttctttcccagaccctttcaacagactcccggcttcctggcgccacctccacattaactgttgttcaatttggagtagctttgtcttgatcagcaaa

SEQ ID NO: 104962 - DNA, 1442 bp, Homo sapiens
tgtggctgaacaccacagcctcagctgctcagagcctgggcccatgatcggctgtgactctggtcctgcacagcaggggaaccagtccccactgcccacactcaagtaagaggaaaagtctggcagtcctccccagggcaaacctgcccttgagccagccaaactgctgtgtaccttcccctgagcaggagagatccttgaaccactgagtggcttacataccctcaggctggtagagtggctatgtgtctgtgcccaggtcccgagaaacagcccactgggtgacttctggcagacacagccccaggctgaccgagcatctgtgtgtctgcatcccctgcctgagaaacagctccataggctgcccctggcaaatacatccccaggctgacctagcaactgtgcatccttgtcttaggtctgagaaacagccccatgggctgcccctaccaaatatcctcctaggctagccatcaatattctgggtctgagaaacaaccctgcaagccacctctggcagaaatgcccctaggccagctgagcagctgtgtgcacctgtcccaggcctgagaaatagccctgtgggctacctccagcagacacacacccaggccagctgagaagctgtgtagccatgtactggaccttagaaacagtccttggcaggtactcccccaggctggactagcagctgtgcacctatgcccccagccagaataacagactgcaaaccagaccctaagttggccaacttaccatgtgcatgtatgcaccctgacctgagaaacagcccagcaagcccacccatggcaaagttgcaccatcgctgccacatactctctcagccttggccaccgagctactcataaatgtcatgaatgtggattacaactgaagaaactgcatagagaaacactactgtgtccaactagaaacaaacccaatgcaccttcactaaactgacacccagggcccatctatatgagtaagtctcttcttatcctactccataaaattagaagaggtgactcttctaccagatgcatagaaatcaacatacggacacatcaaacatgaaaaagcaaggaaacgacacctttaaaggaatataataatacttcagtaatagactttaatcataaggaaatatacaaaatgccagaagtggaattcagaataataaggaaagtcagtgagatacaagagaatataggtagaaaattcaacaaaatcaggaaaataattcatgatatgaatgaggaatttaacagagagatggatataacccataaccaatcagaaatcttagagctgaagaatttaattaatgaaataaaaaatactatcaggagctgcaacaacagatttagaccatgcagaaaaaagaattctgcaacttgaagacaagccttttgaaatagcacagacaaaaataaataact

SEQ ID NO: 104963 - DNA, 126 bp, Homo sapiens
ggtgaacacccacaatgtcccttcatcagcacttcctaataattttactctgctcttgctaatcaccttatttgcccgttccattgatatgagttcattcactgattttttttttttttttttttt

SEQ ID NO: 104964 - DNA, 362 bp, Homo sapiens
tgaccagagaaacagccgtatcggaaatcgaggatgagccatatagattatttacagcatggttttgaaagtaaatccgcatgactctagtgtggtgatagaccatgtgaaatcacagttttggggacagttaacaaaccagttagtacaaacagtaaattaggtaactcccttatctcccccatgccccctgaaccaaatacattttcatggttacggtatcaatatattcaaatcagtggggggcctaatgcaccagcaatactcagaaaatgtaatgcaggccgggcgcggtggctcacgcctgtcatcccagcactttgggaggccgaggcgggcggatcatgaggtcaggagatcaa

SEQ ID NO: 104965 - DNA, 488 bp, Homo sapiens
tctccttcctctctacgtgctagacaccaagacagtcttctaagagaacagatctcaagttgataaatgaagagctgcttcatggttttaagcaaatatttgactccataatgttattgttaccttcaaaacttagacagatattctggaagggaattactacttgctttactcagaatcagaattgaaacgaagcagtttcctcccgttcatcaaaagacacttccgccgcagcttcagaacctctggaactggtttagtaacaattctttatcctagaaaaaaatcccccctaaaaagaaaaactcactcatgataaacttgagatgttttccaggatgaagggaggcagctttcctgttaccacctctgaagtgcttcctaacagtgtgggggccgtgaaacacacctcaaggggctgagacacagagcacggtttgccagcctgggtttgcatcagtgagctggacctgaagcttggtcctgcc

SEQ ID NO: 104966 - DNA, 782 bp, Homo sapiens
ggcagaagaggaattcaccatgttcacccaggcctaggccaggtcaagcaccagcctcagcaggaagtgctgaaggagagctcaggcccggccctctcgccttgtgaggatgactgggaagactgcacgagtgtaggggaggatctgcaaaccgggctgagaggggaaagcagcctacaaccatttaaggccaaaactggccagggggagagaatgaagggtggcaggtggtgccctccgcacctgagccaggtctagccagacctggaggaggtagtgggatggtcaggtgccaggcttggtcggcggcctctgtgacagccgagtccagggtccctttgctgctgccagtttctccaattgctccatccaggatgaccacgtccctatgcatgccctgtaagggagacagctagacttcaacacatttctgctgcacagtgactaatcatgcccctcccagccatggccccgccgctaactgggctctggttattcacgtatgccttgcattactgcttgcaaacagccatgaccgttgggctttaaagccctgcctccacgctgtctcagctttagacagctgacttcagagccactcatctgctgctcagcagctgggtaaacccaggtcagtcacccagcctttcagcttcagacttcaggccgcttgtctgaattagaaattgtgtgaagcactttgcctgcagaccaggcacgtaacgtgctcactaaagggaagccataaccatataatacccaagctggagaagggggttagg

SEQ ID NO: 104967 - DNA, 396 bp, Homo sapiens
gttttgctatatatcaaaacccaaaataagagttgcttaaaaatcaaattcctcttttcatgtgaaaaagggtctgcaagttgagcagtctggagctggtatggcagttccagtggagcagactttttctatcttgctgttcttccatcctcatctctcacctcactgaacaaagtggcttcttgagctctagccatcaagtcatactactgatagcaaggtggaaggagttgctaagaagagcacatcaccttcttttaaggaaactttacagaattcccatcccacctctgcttgcatttctttggtcagatttcagggatatgctgctcctagttacaagagtctggactcaaggccaccttgattaaaatcagtattttttttttttccact

SEQ ID NO: 104968 - DNA, 252 bp, Homo sapiens
ggcaggagaattgcttcagcccaggagttcaaggctgcagtgagctatgattgcaccactgcactctagcctaggtgagacagcaaacagcaagactccgtctcaaaaaaaaagaaagaaaaacatattctaagactgggtatagtggctcatacctataatcccagcaccttttgggaggctgaggcaggagtatcacttgaactcaaaagttcgagaccaatctagccagacccccattgctaccgaaaa

SEQ ID NO: 104969 - DNA, 647 bp, Homo sapiens
aaatttcccatttgcaaatagggctttattacttggatcatatgtgaatctaaggatggtaggcaaaaaagtatgaaaatgggaaagagttatacagatataaaggaggttattagatggtcagcaaagtgtgcagcttgagggcagtgcacagtcccctcccagcactcactgaccctctctctgtgagactgaaactcacatgctcaggtcctgtttcccaaaggccccacatcaacatccctgagattactgggaaagcactagaagttccattgttagtagaaatcaatagccctctttgcaataaacaagactcattagcaaatctgaaaaaaaactgtgggctactaggtaccaaagggtctagatgaccaagagtaggatacccagaagatgagtttggtggaaaaggagaagaaaggagaggaggccagagaaagaagagaacaaaagcatgagggccaattttgaggccctggggtagaactaaggtaggcagtgcccttagaggctgggacgggaaagagtgaggctggggcaggggactgctctccccaaggtcacttaacagagcaccttgggacaggacctgcctcccatcctgaggtgtgagacaaaaagactccctagagaactccagggat

SEQ ID NO: 104970 - DNA, 1074 bp, Homo sapiens
gggtacaaggacagttgtgttacatggatatattgcttagtgttgaaatctgggcttttagtgtacccatcaccgaaatagtgtacattgtacccaataggtggtatttcatccctcaaatataattttaaacacacactcgtgcccacatggacaaattatatcacatgactgaggaaacttagaaattccttttccctgaagatctgttaagaataggtctcatctcctgccctggttaggtgctatattatatggagaagggtattgagactttgggggtcatgtttgggctgtgataactggcttgaaccagtgaccatcctttctgcctcgccaaggtctcttataccagcttcttcacatatgctgcttcctcccagctttcccttctgacttcttgttactctgcaactatgtgtcaaggccttaccttttcctgatgttttcaaacctcctgcattactttgatcatcacttcttcagccatctcactgaagtccttggtgctagctgggcttttgtgacaactttcaccttctctgaactttttccttgctgggaagcatctgcgtgtgtgagggggctacggagggaagtgtgtgtgtgtgtaagagagaggcaaaaggatgcttcaaaagctataaacaactctagcaagcatcctaagtcctatgtgaggttttgcagttctagtgaatttctgttttagtaggtttcaattagcatttactgcctaaaggagaaaaaccatatccaaggaccttttagccatgcttgctattaccaagctggaccagtgtgatgtagatccaacatgtcttcagcttacagatgctctcagaacagttccaagaattgaagagagctaagtttttatgctgaagaggagaatggagcactagctagtcctaactattgctagaaatagaaatgtttattttctcctttattattgagaaattatctaatttaaggagtaaccattttcatttagggatttttttaatgactgcccatcactacagaaatatgttctttttataaaataaaactaatgtgaggttggtttgt

SEQ ID NO: 104971 - DNA, 145 bp, Homo sapiens
ccttccacagctatcccaaccctcttcctctctgaagtccttcctggctacagttgctgttttctccacgtcagaagtgagagtcttcaatgtgatggtcaaatgcaaattcagatgcagttcttcctggctccaaaatgaatgg

SEQ ID NO: 104972 - DNA, 284 bp, Homo sapiens
tggagcgggtgcgtgtgacatctcccccacccacatgcttgccaaccgtaatactcaaggagaactgtttcatgaaggacgcagaagggagccaaacaccgccagagactttttacagaaacaatttgagcatgcccttcctctcgggagtgcttggtccaaatacatttatcttgctaatattcctctgtcagactaaatttcagacacactggaatctccacagcatgtgtggctccaacagacatgtgtgctccacaattcccagctgtaactcacccgtg

SEQ ID NO: 104973 - DNA, 380 bp, Homo sapiens
gcacaatagaatcacctggaaagcttttcagaaataacaatgcctaggcccccgcccaaccaattgaatcagaatttctggggggtggaagttgagcatccatgttttccaagagatttctagatgattctaataggcagctggcatgaagaaccagtgctctcaatgaactgaataccatgtttcttgagaacctgaaacaggcgccgcatgcataaaacaagcccagggaactgagactcactcggctgactctaaacagtgctctgccactagcacaggactccaccctcaaggtggcgtccccgaaggtctcccagaaggcctcacccctttcccagcgccaccacccatacctcctcagaggaagtctcagcact

SEQ ID NO: 104974 - DNA, 847 bp, Homo sapiens
  misc_feature (257)..(257): n is a, c, g, or t
gtgagcaggctagattttatttttgaacttttgtacttcagggtcacaattaatatacattatgcgttaataggtgtctctcactttgtatatatatcaactttgggaatatgttcctaaacaaaattttaaatatataaaatgttatttttgttttgtttgagatggaatttcgctcttgttgcccaggctggatccggtctgccaaaccgccgcttccagtttttcaactggttaaggagagggctgtgggtcancgtggtaaccagttttggctatgccttaagtatgattccgttcgttaaacgccatgaagatcaggtaatgacgttcctgatgatcctgccaattgccttgttaaccgctggcttgttaggcacgctgtttgtggtgattaaaaaaaaatactgtaacgcctgacgattttccccgttcccggttgctggaccgggaacgtatttaattcccctgcatcgcccccattctttccgcatttttcccccggggtcacaccgaaagaacggtttaaactcacggggtaatgtgcgatgcgctttcatagccgacgcgcatccgttggtgcgctgggcttaatgccggcatggataataatcatccgcgccttatccagacggaatttttcaaatactgcaacgggaagggctggggaaccacttaaatttgggtggacccccagcccctttggtggcttttgccggcagtcgtcgaccgttaagtttttgggtgaatatttaaacccggtgaacacccgggtaataagattaaaagaagttgacgattgccgcgccctaacccggctgcggagggcgggccaccagtgtaaaag

SEQ ID NO: 104975 - DNA, 282 bp, Homo sapiens
ttctcagttatatgtgtgagagaaagagacagagacacaaacaaggtttcagtgtagtgtgtatttcttactttggattattgcaaaaggatttgaatgccattgtcttcataggtttagaccttagctctcttatatatgaaatagggataataacacagctcctatttaccttatagagttaacgtaaatatcagcattacttatgtgaggttattcaggaaacttcagcaaagtgctttaaagtgttgttgaaagtaaggatgagtcatgtgttttaca

SEQ ID NO: 104976 - DNA, 455 bp, Homo sapiens
agagcagactcatcttcatttaccagtagttaagttttgtttctccaagtagcacattatcaatcatgcagtaagtgtgcaactaatgcaggtaatttggttgcctcttgaacaccagggatgcattttgcaaaacttacatagatcatgaaatcaaggaaccatgtcagattattttgcaaaatagagattattgatatctgtttcaaagtaagcttcacatccattactactagccctctgtattagctttcggattctaaataacttatcgcacccaaagttccaaccgccaatacaagaaaaaagagctttaggaaattcttaggaaagtaggctggcatggtgactcacacctttaatcccaacactttgggaggccaaggaggatggatcacctgaggttgggagtttgagaccagcctgaccaatatggtgaaacaccatctctacta

SEQ ID NO: 104977 - DNA, 426 bp, Homo sapiens
catgtgatctctttgcacacacccacttcgcttccactttctgccatgagtggaagcagactgaagccctcaccagatgcagctgcccgtcctggactttccagccaccagaatcgtgagcaatttctttatatattacccagtcgcaggtgttctgttgcaaaacacaaaatggactaagaaaattgtcttgctaagattaatctatgaaaaataatatatataactcatctttttaaatagaggtatttttaaaaatttttatttgccatatttactaacaattccctaacaaatgaattgttttggaagatcttgaaatgactgagttcattattcacatgctcataaaaatgcttttacaggccaggcacggtggctcacgcctgtaatcccagctacttgggaggctgaggcagggagatc

SEQ ID NO: 104978 - DNA, 239 bp, Homo sapiens
aaaaaaaaaaagaaaagaaaagaaaatagaggccaaccacaagtcttagtttaggttggcagggacagtccaaggcaaagtgatagaggggcatccatcaggtagggagtgggaatccagggcctcagaggctggcactgacatttttcagcagacactatttgcaaggaatactactggagtgtctggctagggttctaggtccagagaaggaaaatccatacatgtaagtcagggtt

SEQ ID NO: 104979 - DNA, 729 bp, Homo sapiens
aacaagatcaaggttctatcagtgataaataagggaggctaaggtattgaggaaccatataatgttatttacactacctactttctaatctgcctcatctactcaccttcctctttctcttcctgtaatcttattgcatggaagaaatttttggtgaagacaagttgtctgtttttcttaaaatcatttttttagctagtggtatgtctcgaacactttcctaatagttcattgagataaagtcataacattttttttttctttcttcgctaccctcactcattgccccattggaattgactgcaaattgcaattttctagagaaagaatcagtaatcctttctacacagtggccttggtgatttcaaaactttaagaatatttaaaatattcaagttctttctccaaaaactggtgactttctgctgctgagctcctgaaagtttttgagaagaaagttgaaaggttgaaaatggtgctgtgtttatttgaatatctgaagggtaaactccaagctacttatctgaaaacaaatattctctgaaacctgcagagtaaagaagtataacttgacatttcttctgcaagaaaaaaacaagaagatggtgactttcaagacctcagtcaatgactaaagttctgtgaccacagtgagcatattactgcggtaaccagggcagtaatgtcaagacaaaggtcagggttggctttaagaaagaagcctgagaa

SEQ ID NO: 104980 - DNA, 383 bp, Homo sapiens
ccctacaaaggacatgaactcgtcattttttatggctgcatagtattccatggtgtatatgtgccacattttcttaatccagtctatcgctgttagacatttaggttggttccaagtctttgctattgtgaatagtgccgctataaacatacgacacactgaatatttgtaagtctccccccaaacacttttttttggttggcttcttgtcactcttctttccccatttctgtccaaaatatcttcacacccaccaaagaggcccacgtttataaccaatttgtattcatttgcttttttactagcatcatataattttatgaggcatatatacgcatacacacatataagaaaatcttttgaacattgttttaacaaaaatg

SEQ ID NO: 104981 - DNA, 588 bp, Homo sapiens
cattaaggcaggaattattcatctacagaattttttttttcctgaagaggttaaatgagcagtattttcaggtaatgaagaataagttaaaatcttgggcttcaacaaagaaaaatttttggcctctgatgttgtgtaatgttacttactatcattccagtattgatgaaaatattattgaatggttttagcctgcaaacttctgttgactcatactctcaagagtggtggggctgtgaaaatgaagaaaatgtacctcaaacacagtgcaaacactcagatggtgagtagagcgataattttatgtcagcactaacctcactttaaatgtgtgagagagaagtttgtctacaggagtagaaacagttctgtttctaaagaaatgtgatgtaaccaatgtaaccatggatgatctatatctgcctttacacatttcatctctgttttaaaatatttttatgataatcatatttaaaattgtttttagattataaggaagctgcatgttaaaaattgagctgtataagaaagaggaaatatagtgaaaactttggggttttaatctgtgcatgtgagagagagtgagaa

SEQ ID NO: 104982 - DNA, 457 bp, Homo sapiens
ttaaaatacccatttacacagcactaatttgagaatcataaaggggctgtccgaaataggattggggctgtctgaaataggattggggttcacgagatcaagccattgcattccagtctggacaacaagagcaaaaactctgtcccaaacaaaaaaacaaaacacaactacaaatggggggaccaggtatggtgactcacacctgtaatcccagcactttgggaggccggggtggatgcatcacctgagttcagaagtttgagaccagcctgggcaacaaggtaagaccccatctctacaaaaaataacctgggtgtgtggtagcatgtatctgtggttccatccaccatggagactgaggtgggaggatcacctgagcctgcgaagtcaaggctgtgtgagctgagatcacgccacagcactccagcctgaatgacaaagcaagaactggtctcaa

SEQ ID NO: 104983 - DNA, 1245 bp, Homo sapiens
gtgcctgtggcgggcaccaggctgggctggggcagccaaagatgagggccaggcccctcactgccaatgctcagcctccaggaacccaagacaggcccagagtggtcggatgggctctttgccaaatgactgccggagagtgtctaggcgcacggtggcccaggcttgtccagggccctccttgtgcacctactgtgtgctggggcaggggtcacagcagatctgggtcccaccctcttgaggctcccagtccagcgcgggatcaactgggagtagccgtcgggggtcagtgctgcatgggatggccagcgctgcgggatgcaggagccccattacagggatccatggtacacagcacctcagctcacgggagttacgaggagcacaaggaaggcattcctggataagcagtgtgggaaacagcctgagtacctgaccggaggtctcaggcaattaacgcctctgcgtgaatcccacagcgctgcacggacaagggcacgtcggaccaacaggaacagcggaagcacgcgcttggccagacagccatccagcggctccgcgttcactagcctgaccaatccctcaggaacccagaagtaacaacacgcaacacgaacacatgaccagcaaccggcaacacgactgcaaccaagccactggaccccaaaggtacaaatggcaaccaccggagaggacacacacagagagaacacacagaccaggatcaaccgacaaagagagcaacgcgaaccgcagacacacaggccggaatccctatggaacccgagcatgcgatccgcacaaggacactcacctgggacggcaaccgcaaatgtgaaccccaactacacggaaccagtacaacgccaaccatggcgcccccccacaggccaattcctaagcccacgtgtccaccacactcaccggcaacaagccagcgcgcactgcaccgcgtcctaccagcgcagacgacaatatcatacttcttcgcctcatgaatctgctcggagccacactgtctccgacccttcacctcccccaccagtcccagcaccaacacataccaacctcaccctccactatccactaacttccctacttcttctcacatgctacacgacaatcaacctcgctccatgcaccctaccacaatacaacaagacgccaccactacccccgagtaatattagtccaaccaaatactcaaacacactaattcatctcatcatcctaccatctatccct

SEQ ID NO: 104984 - DNA, 234 bp, Homo sapiens
cagtcctggctgcttctgtggctgtcagcagaactgtctgcaggtgtaaccatcacctgctctgtttctcctactctagcccttcttctttgtgcctgagaaaggggggttgttaattatagctcagcaaactcctcttatctttgctgatgccatagttgggatttagatttggacaactggcaggatggatggtaatttttattccccagcttccctacttcctgctgggag

SEQ ID NO: 104985 - DNA, 803 bp, Homo sapiens
cccatagcacttggcatttggtattacaccctacgtatggtactgtgaaaaccttctctaatgccatgtaaaaattttacagatgatactagagtctgagtagtaaattactttcccttttctaagttgattttatgctgcttgatattgagatggggatgtagtacaaatatttacttgtttcttggagttaaattttaaaaaatcccatattgcaggtctaagaccataaatttgtcttttactgctttcaaatggtcgtgagttggaattttccaattagtatttttagagacttctctaggtgaatgtttatggtagcctacaagctaccatacaaaattacaaaaattagctgggcatggtggcacgtgcctgtaatcccagccactcaggaggctgagacaggagaatcgcttgaacccaggagttagaggttgcagtgagccgagatcgtgtcactgccttccagcctgggtgacagagcaagactccatctcaaaaaaaaaaatgagtttctagactggacgtggtgactcacatctgtaatcccagcactttgggaggccaaggtgggtggattgcttgaggtcaggtgttcgagaccagcctggccaacatggtgaaacaccgtctctactaaaagtacaaaaattagctgggcttggtggcgcttgcctgtaatcccagctgctcagaaggctgaggcacgagaaatacttgaacccaggaggcaaatgttgcagtgagcaaagatcgcgccactgtactgcagcctgggtgacagagcgagactctgtctg

SEQ ID NO: 104986 - DNA, 180 bp, Homo sapiens
gtttctgcttgctgttatgcaatattagctttggaataatctggtaattcttacttaacaccaattaataaggaattagagtaataattttagatgtgaataaattgcttcaaattataacatgttttgtagtttatataaattgttattagtgatgggaaaataatcaacaaggcatgc

SEQ ID NO: 104987 - DNA, 581 bp, Homo sapiens
ctttctgattgatacagatttgtttggttttaattttttatttattccttttactggtttcgaagtgatgatccttttattattcttttagcgcttaccttcaaattttaaatggacattattgaggcttgtcaacgtctacaaaagtgtactggaattttgattgggattatgttgaatcactggatcaatttttggagaactgacaactcaacaatattgagtgtgtaggtttatatatgtgatatagctctccatgtatttagatttttagtttccctccacaatcttttatagttttaattaaacaaattgcacacatattttaaaaaatgtatccctaggtattttatttttgatgctattgtaaatgctattgggctttttaaaaaatcgtttcaattttctgttgtttttgttaaatataaaaatgcaaataatttgtgttcatagaccttatatctggaaacgttgctaaatgtatttttttattccattagctcttttgcttattccttactattttctttgtgggcagtcatgtcatctacaaataaacagttttactccttttcaaccta

SEQ ID NO: 104988 - DNA, 781 bp, Homo sapiens
ctttctgattgatacagatttgtttggttttaattttttatttattccttttactggtttcgaagtgatgatccttttattattcttttagcgcttaccttcaaattttaaatggacattattgaggcttgtcaacgtctacaaaagtgtactggaattttgattgggattatgttgaatcactggatcaatttttggagaactgacaactcaacaatattgagtgtgtaggtttatatatgtgatatagctctccatgtatttagatttttagtttccctccacaatcttttatagttttaattaaacaaattgcacacatattttaaaaaatgtatccctaggtattttatttttgatgctattgtaaatgctattgggctttttaaaaaatcgtttcaattttctgttgtttttgttaaatataaaaatgcaaataatttgtgttcatagaccttatatctggaaacgttgctaaatgtatttttttattccattagctcttttgcttattccttactattttctttgtgggcagtcatgtcatctacaaataaacagttttactccttttcaacctatataattttatttctttttcttgccttattgcacaggttaggacctctatttctatgttgaataaaattaggaaaaatggacactcttgtcttgttggtgatattaagggaaagcattctgtctttcaccattaaatatgatgttaagtgtaaggttttttctctattgactttatcaggttgataaagttcccttttat

SEQ ID NO: 104989 - DNA, 446 bp, Homo sapiens
ctttctgattgatacagatttgtttggttttaattttttatttattccttttactggtttcgaagtgatgatccttttattattcttttagcgcttaccttcaaattttaaatggacattattgaggcttgtcaacgtctacaaaagtgtactggaattttgattgggattatgttgaatcactggatcaatttttggagaactgacaactcaacaatattgagtgtgtaggtttatatatgtgatatagctctccatgtatttagatttttagtttccctccacaatcttttatagttttaattaaacaaattgcacacatattttaaaaaatgtatccctaggtattttatttttgatgctattgtaaatgctattgggctttttaaaaaatcgtttcaattttctgttgtttttgttaaatataaaaatgcaaataatttgtg

SEQ ID NO: 104990 - DNA, 412 bp, Homo sapiens
tgcataaccaaaaaacataatcccacaattatggcaaaaacatatatggtcattgctatagtttggatatttgaccctccaaacctcatgttgaaatctgatctttaatgtaacaggaggcatctgggttgtgggggtggatccctcctagatggtttggtgcctcctcgcagtaatgagtgagtcttgctctattagttcctgcaggagtttccctgagagctgattgttaaaagagcctggcaactgttccacctctctcttccttcctctcctgccatatgatctcggtgtggccagctccccttcaccttccactgagggaagcaggctgaagctttaccagaagcagatgctggcgccatgctcttgtacagtgtgcaaaaccgtgagccaaataaacctcttttct

SEQ ID NO: 104991 - DNA, 1676 bp, Homo sapiens
cactctaacctgggcaatagaatgagactctgtctccaaaaaaaaaaagttgctatgtctgaagaggtaaacaggtgataaatcatgaagagatttgtgtctgaaactgtaattgaaggatttcaaacaggaaaaagataatcacatttatacttaagattagagaggtatgatactggaggcagagagacctgttagaaaatttatactaattcaggcaagatgatgaagggcagaactaaagcaatgaaaatagggaaagcaagtacagaagaacaaaacttaaagatttagagagcagcactgacccagctgggacaagttctagttgtccattctattgccagtgctgcagagtccagaggcagcacagtgcatcatttggtgagggagttcacaagggagaaccaaactagcttttataacagacccatttgtggtaactaacccagtcccttgataataaccattaatccatgcatagattaatccatttatggggacatagatagccttcatgacccaatcaccacttaaaggccctacctcttcgtactgatacattggggatcaagtttagcacaagtttcagtgggggcaaacattcaaatcatagcagtgtctattaggctgcaggaggtgtctctacccaaatgtcggtaagtatgtgataagtgggatagttgagctagtttaacgatgtctaggttggttgggttggacttttcctcgtgtcacctccctgcttagctctagctgcttattggaatgcagccgtgctttcctgggtttacttaggaaatgctgagatgcactctgaagcattcttgaggttttccctttggttcatttgtcccatactctctccgttataccagtcttctcagatcttcacaacacaagtaaatctgttggaagcaaggtcttgtagatgtagacatatgggaaagatagagcctgctctcctgatggatgctgttgttgagataggttgggttggcctaggtaagaggaggaccagaagagatttatgatttcttggaaggctatgagttgctgctggccccatcataatcttttttgtttagcagaagtcaggaaacgaatactggtacacttacatttcttggaagagcagcagaaaccttgggatatccttgtgggtcaaggaggcaactctcctcacggattccctgatttgataacaacatactcatggaaacaccaatccaagttttcacaagtttctcttaaagttaacttaagacttcctagaccaagaattcctaccacgcaaggcctgtgaaaatattgtaaacttaatatccgacagggagatattcaaagatgccaaagtacctgtttttataaatattaccacatggtttaagatttgacttctcacataaaatgagtaaaaataacaatgatttttctgcagtaccttaatgatgctgtaattatgaagcagggttttaaaattctgccatgtagtgccttatttttatagtaatgttttctatgaaccttctaatttaatgtgtattaagagatttaaagagtatgtaattaaaaaatatctttccacaaagtcaccttgagatttaatgctttctaattggcttgatcatttgatggcaagataactagttgggtaactgaacatagactctaca

SEQ ID NO: 104992 - DNA, 912 bp, Homo sapiens
cctaagtgctgggattatagaagtgagccactgcacccagccggattttttattttttgagacgagacatcattgtgtcccatgctggtctgaaactccttggctcaagcggtcctcctgccttggcctcccaaagtgctgggattacaggcctgagctcactgtgcccagcctgaattaaagttatttttaaatgctggcacatctttactgagggctattatttgtataaattgttttgttaacagtggtaaagtatacagagattggaaagccaaggtgcttactgtatgttatattcgtcttatgttgtttgtatctaccaggatgaattgcactttatattagcttaaggtagtggctgtcaaccctgacagcatgttagaatcacctgaggaagcttttaaactgatgcccaagccctaccccagactagtacatcagaatttctgcaggtggaacccatatgtcaatatagttaaatcttcccaggtgattctaatgtgtagccaaggtccagaaccactgatttaaggcaaaagataatttgttggcttacctctttgacaatcctactctttgtctttatctttagtattcacctcagtgcctgagaccaaatgaattgttttgtggtttgttttgagtgaatgaacaaattgttaaacacaaagagctgaactttttaaaagacaacataactcagaattcagtgatgtctaggtatttgcttagggaagaaaattaaggatctgctgtatgggagtctgtctcatgttacctcatgggttcttaaaacagtcctagatatgagtaggttttataatcacaaatgaagaaactaagacccaagcaatttagcagtaaagctggcatgtgaaactgtatctgactcccagtgattttgaggaa

SEQ ID NO: 104993 - DNA, 646 bp, Homo sapiens
cctaagtgctgggattatagaagtgagccactgcacccagccggattttttattttttgagacgagacatcattgtgtcccatgctggtctgaaactccttggctcaagcggtcctcctgccttggcctcccaaagtgctgggattacaggcctgagctcactgtgcccagcctgaattaaagttatttttaaatgctggcacatctttactgagggctattatttgtataaattgttttgttaacagtggtaaagtatacagagattggaaagccaaggtgcttactgtatgttatattcgtcttatgttgtttgtatctaccaggatgaattgcactttatattagcttaaggtagtggctgtcaaccctgacagcatgttagaatcacctgaggaagcttttaaactgatgcccaagccctaccccagactagtacatcagaatttctgcaggtggaacccatatgtcaatatagttaaatcttcccaggtgattctaatgtgtagccaaggtccagaaccactgatttaaggcaaaagataatttgttggcttacctctttgacaatcctactctttgtctttatctttagtattcacctcagtgcctgaggccccgtctccaccgggatcctctagacgac

SEQ ID NO: 104994 - DNA, 2368 bp, Homo sapiens
tggcacggagcatttccagcctcacgcgctttaattttctcagctttaattttctgtggggtcggccaagccatcttccttgtttagcggaggaagccaggctcagagagggagaggagttggcccaagggcacacagcagccaagtggccaaggccggaaggtgcacccgcaaggagaagggggcagcggagccctctccctggctgttgttactgggacactagagccgcgccttccccaggcctccgccgaggctgctggagcgggtcccgcggtgccagggcctgttccccgcgctccgccagggatgctggggcctccgagggctccggaggcggtttagggggcgggggcgcggaggcgcggctccgagcagggggcgggggctggatgccggagaggccactcacccccgcccacccccagtccccctcccttcgcaagcacgctgtcccccttctcccacacggctgcggagcctgggctgggcgcgggggaggcggagggcatcgcggaggggatcccgccccctcccccggccgctcggtgcccccacacccacgtgagcgcagggccggcccggatccctcccgcagcatagcgcgtcccggctccgcgccggtgcctccacggtccggtccccgcgccggtgctgcacagtccctggcgggtccccgcggccccggccgggcgcttcgccgggctccggctcctgcatccgggcgcagcgcgcaggccgaggcgcgggcaggccgcccccgccgctccggacgccgatagaccatgagcagccatggcaacagcctgttccttcgggagagcggccagcggctgggccgggtgggctggctgcagcggctgcaggaaagcctgcagcagagagcactgcgcacgcgcctgcgcctgcagaccatgaccctcgagcacgtgctgcgcttcctgcgccgaaacgccttcattctgctgacggtcagcgccgtggtcattggggtcagcctggcctttgccctgcgcccatatcagctcacctaccgccagatcaagtacttctcttttcctggagagcttctgatgaggatgctgcagatgctggtgttacctctcattgtctccagcctggtcacaggtatggcatccctggacaacaaggccacggggcggatggggatgcgggcagctgtgtactacatggtgaccaccatcatcgcggtcttcatcggcatcctcatggtcaccatcatccatcccgggaagggctccaaggaggggctgcaccgggagggccggatcgagaccatccccacagctgatgccttcatggacctgatcagaaatatgtttccaccaaaccttgtggaggcctgcttcaaacagttcaagacgcagtacagcacgagggtggtaaccaggaccatggtgaggacagagaacgggtctgagccgggtgcctccatgcctcctccattctcagtggagaacggaaccagcttcctggaaaatgtcactcgggccttgggtaccctgcaggagatgctgagctttgaggagactgtacccgtgcctggctccgccaatggcatcaacgccctgggcctcgtggtcttctctgtggcctttgggctggtcattggtggcatgaaacacaagggcagagtcctcagggacttcttcgacagcctcaatgaggctattatgaggctggtgggcatcattatctggtatgcacctgtgggcatcctgttcctgattgctgggaagattctggagatggaagacatggccgtcctggggggtcagctgggcatgtacaccctgaccgtcatcgtgggcctgttcctccatgccggcattgtccttcccctcatctacttcctcgtcactcaccggaaccccttccccttcattgggggcatgctacaagccctcatcaccatggtcattgtgcttacgtcggtcggcttgcccacggaagacatcacgctcatcattgccgtggactggttccttgaccggcttcgcacaatgaccaacgtactgggggactcaattggagcggccgtcatcgagcacttgtctcagcgggagctggagcttcaggaagctgagcttaccctccccagcctggggaaaccctacaagtccctcatggcacaggagaagggggcatcccggggacggggaggcaacgagagtgctatgtgaggggcctccagctctgcccccccagagaggagggaagggggctggggaggggagtcctggtgacacatctgttgcccaactgaccgtgggctgaacacacgttctgcttgactcatttaggggggagggaaaagtgaaataaaggagcaggaatgaaaggtaaa

SEQ ID NO: 104995 - DNA, 431 bp, Homo sapiens
ctgagctgagatcgcaccattgcactccagtctgggcgaaggagagtccgtctcaaaaaaaaaatagttaggttatggtgcaaaacaagagaaaacaagactcaatagaggatggggtgaaagtgtggaaaaggtggcttggagtagagggaaggcagtaggatagtggagtgctgcttgggataagggttgggatggcgtgtgagggtgtgtatttggaaaattagaagtagaaagatggtggtgcgggtgaatgggtaatgggtgggttttggggtgggctataggaaaagggatgcttggtgggtcggctgttgagttggtgatatggggagggtggaacggatgctaggagagctggcgttgggtatgcatggagctgcgggggccacatcatctgtccttcaggtatggcatccctggacaacaag

SEQ ID NO: 104996 - DNA, 2644 bp, Homo sapiens
tggcacggagcatttccagcctcacgcgctttaattttctcagctttaattttctgtggggtcggccaagccatcttccttgtttagcggaggaagccaggctcagagagggagaggagttggcccaagggcacacagcagccaagtggccaaggccggaaggtgcacccgcaaggagaagggggcagcggagccctctccctggctgttgttactgggacactagagccgcgccttccccaggcctccgccgaggctgctggagcgggtcccgcggtgccagggcctgttccccgcgctccgccagggatgctggggcctccgagggctccggaggcggtttagggggcgggggcgcggaggcgcggctccgagcagggggcgggggctggatgccggagaggccactcacccccgcccacccccagtccccctcccttcgcaagcacgctgtcccccttctcccacacggctgcggagcctgggctgggcgcgggggaggcggagggcatcgcggaggggatcccgccccctcccccggccgctcggtgcccccacacccacgtgagcgcagggccggcccggatccctcccgcagcatagcgcgtcccggctccgcgccggtgcctccacggtccggtccccgcgccggtgctgcacagtccctggcgggtccccgcggccccggccgggcgcttcgccgggctccggctcctgcatccgggcgcagcgcgcaggccgaggcgcgggcaggccgcccccgccgctccggacgccgatagaccatgagcagccatggcaacagcctgttccttcgggagagcggccagcggctgggccgggtgggctggctgcagcggctgcaggaaagcctgcagcagagagcactgcgcacgcgcctgcgcctgcagaccatgaccctcgagcacgtgctgcgcttcctgcgccgaaacgccttcattctgctgacggtcagcgccgtggtcattggggtcagcctggcctttgccctgcgcccatatcagctcacctaccgccagatcaagtacttctcttttcctggagagcttctgatgaggatgctgcagatgctggtgttacctctcattgtctccagcctggtcacaggtatggcatccctggacaacaaggccacggggcggatggggatgcgggcagctgtgtactacatggtgaccaccatcatcgcggtcttcatcggcatcctcatggtcaccatcatccatcccgggaagggctccaaggaggggctgcaccgggagggccggatcgagaccatccccacagctgatgccttcatggacctgatcagaaatatgtttccaccaaaccttgtggaggcctgcttcaaacagttcaagacgcagtacagcacgagggtggtaaccaggaccatggtgaggacagagaacgggtctgagccgggtgcctccatgcctcctccattctcagtggagaacggaaccagcttcctggaaaatgtcactcgggccttgggtaccctgcaggagatgctgagctttgaggagactgtacccgtgcctggctccgccaatggcatcaacgccctgggcctcgtggtcttctctgtggcctttgggctggtcattggtggcatgaaacacaagggcagagtcctcagggacttcttcgacagcctcaatgaggctattatgaggctggtgggcatcattatctggtatgcacctgtgggcatcctgttcctgattgctgggaagattctggagatggaagacatggccgtcctggggggtcagctgggcatgtacaccctgaccgtcatcgtgggcctgttcctccatgccggcattgtccttcccctcatctacttcctcgtcactcaccggaaccccttccccttcattgggggcatgctacaagccctcatcaccgctatgggcacgtcttccagctcggcaacgctgcccatcaccttccgctgcctggaggagggcctgggtgtggaccgccgcatcaccaggttcgtcctgcccgtgggcgccacggtcaacatggatggcactgccctctacgaggccctggctgccatcttcattgctcaagttaacaactacgagctcaacctgggtcagatcacaaccatcagcatcacggccacagcagccagtgttggggctgctggcatcccccaggcgggtctggtcaccatggtcattgtgcttacgtcggtcggcttgcccacggaagacatcacgctcatcattgccgtggactggttccttgaccggcttcgcacaatgaccaacgtactgggggactcaattggagcggccgtcatcgagcacttgtctcagcgggagctggagcttcaggaagctgagcttaccctccccagcctggggaaaccctacaagtccctcatggcacaggagaagggggcatcccggggacggggaggcaacgagagtgctatgtgaggggcctccagctctgcccccccagagaggagggaagggggctggggaggggagtcctggtgacacatctgttgcccaactgaccgtgggctgaacacacgttctgcttgactcatttaggggggagggaaaagtgaaataaaggagcaggaatgaaaggtaaa

SEQ ID NO: 104997 - DNA, 1336 bp, Homo sapiens
tggcacggagcatttccagcctcacgcgctttaattttctcagctttaattttctgtggggtcggccaagccatcttccttgtttagcggaggaagccaggctcagagagggagaggagttggcccaagggcacacagcagccaagtggccaaggccggaaggtgcacccgcaaggagaagggggcagcggagccctctccctggctgttgttactgggacactagagccgcgccttccccaggcctccgccgaggctgctggagcgggtcccgcggtgccagggcctgttccccgcgctccgccagggatgctggggcctccgagggctccggaggcggtttagggggcgggggcgcggaggcgcggctccgagcagggggcgggggctggatgccggagaggccactcacccccgcccacccccagtccccctcccttcgcaagcacgctgtcccccttctcccacacggctgcggagcctgggctgggcgcgggggaggcggagggcatcgcggaggggatcccgccccctcccccggccgctcggtgcccccacacccacgtgagcgcagggccggcccggatccctcccgcagcatagcgcgtcccggctccgcgccggtgcctccacggtccggtccccgcgccggtgctgcacagtccctggcgggtccccgcggccccggccgggcgcttcgccgggctccggctcctgcatccgggcgcagcgcgcaggccgaggcgcgggcaggccgcccccgccgctccggacgccgggatgtaagaggctccgagaagcagcccacacatctcatcagatctaagtgtctagaggtcgggagaaccaagtgggaaagacccaccctcacccctcaccctgtagaaactgggaacactagaagggacattttctgagcaggaaacccaagagacagggttttacgctgtcacccaagttggagtgcagtggtacgatcatagctcattgcagcctcaaactcctgggttcaagcgatcctcctgctttagcctcttgagtggctaggactacaggcacaggccaccgtgcctggctaatttttaatttttaaaaaagagacagggtctggctatgttgcccaggctggccatgaactcctgggctcaagcggttctccagccttcacctcccaaagtgttgggattgcaggcatgagccactgcgtctggcccacagatgctaagtgctgtctgctcttctccaggggtcagcaaattttttcagcaaatggcccaagagtaaacattttgagctttgtggcccgtacaatctctgtcccaacaactcaactcag

SEQ ID NO: 104998 - DNA, 251 bp, Homo sapiens
aaatgtaaatatgtgtgcatatttatatacatgtatgtataaatgtgtggataaatatgaattgttgaccacggtttatggaaaaaaaggtgtaaacatgtgtaaatatgtgcaaatatgtgcatatttatatacgtacatatttggacttataggtgtaaatatgtgtgcatatttatatacatgtatgtgtaaatgtgtggataagtatgaaattttgagttatatggagttaaataaaatatataatc

SEQ ID NO: 104999 - DNA, 241 bp, Homo sapiens
tcctctctctgagcccctgagtccctagttctatgtcagtgatgttttctgttcctgtcccatgtcatgtcaccatgtcaccaagtcagtgagtgaattgacagaagtcctattcaagatgctgtgcctttagcttttcccttctagtctcataaatttgtagcctcaagacccacccaggccctagcatcaagcagtgaactggccttctttgcatgcagtaatgcgacccaggccaaac

SEQ ID NO: 105000 - DNA, 461 bp, Homo sapiens
tttttccctttgtgccggaggatgtaccaaagcttcccaggaggatctttgttaatttagagcatttctgtctctgccctagcatggaaggttctatcgtgtatctgtcccagatcacaggacttgaagtgcttttgcaacttacaatatcatgaaaaataaaacagttagggctaaaacaaaagagttcatctacagcagtggccctctatatgtggtccgcaaccattggtggcagcatctcctgggagcttggcaaaaatgcacgttctcagcccacccaataccgactgaatcagaaactctggggtaggagtctagcaatctgtgttttaacaaatccttcagaggattctgatgttcactcaactttctgttcctctgccctaaaggaacagaaagaggagacacctcggtctttgacttgaagtgggtattgaacaagaggtctcaaagacttc

SEQ ID NO: 105001 - DNA, 372 bp, Homo sapiens
catcagtctgtctcaaaaacaaatgcaaactaaacccccaaactggcctgagaacctaaacaaagctctaattcatcctcacagctatccatatagggagtgtcagcagagaatacttgcttccatttctgtgtagacctattattccttcagccctagggacagccgtttgctcaagcaaaatgtgaggcactctcagacattcacattacttctaaggaccccattctctccatgcccatcccctccttcccagaagctccagagagaggcgcccgatttcctgctcaagactgattcttccacctggtctcctcatcatctccaggtccaggatctgcctctaatactcattccctaacactttttttt

SEQ ID NO: 105002 - DNA, 161 bp, Homo sapiens
cctacgaaagggttttgagcagaggagtgacatgatctgaatcaggctttgaaaggatcaccctgcaactgaattgagaagactggaagagatatgagggttgaagcaaggaaccagttagaagcatgttgcattttgcaagctatgcatctgacaaaggt

SEQ ID NO: 105003 - DNA, 154 bp, Homo sapiens
cttgatttcttcaaataatgaaggaaattcattagttcaagataaaacaatctgatgcactgcaagatgagaacaaaaatagagagggaccttgcagatggtttttcagggttcaaggcaattctcaaatatcagaactttgtgacttcacttt

SEQ ID NO: 105004 - DNA, 433 bp, Homo sapiens
gtgtgagggagaaaactgcaaagccagccagggctacgcttcttatggaatgatccctggagtaaaagggatttatagtcgaggagttatgtttagaaaggacccactcagaacaggaatgagcttagaaacttcataccaactaaagcttcatccctggccagctgagtacccccttctcccctctatcaccctacgaatccattcaccatctttgcttggattttttttttttaaactctcagatttcccagcccccaaactcttgcctctccagtatcttcaaaactggggtccaagatggtgagccccttaacgaaaaggctaggtattaatatcctgtgttacctctacacccagcacagtaaaataaatttgaagcgaatgaataaagaagcaaaccaatgaatgtatgtcccttgggcagctccac

SEQ ID NO: 105005 - DNA, 415 bp, Homo sapiens
ggggtgccccttcctgtagctcaacatcattgcttagatctcagaaacagcagagaagtgcagacaggttttttagttcagtttgattgtgttttgtttatttgttttcttaagcattttataagcttgtttcagagcccatctgctccttgcagttccccgagcagtccctgtgtgttcacaccacggtgcctttgttgaggctgtgtcatctgcttgcaagactttcaccacttcacacacccccgtctttcagggaggccagttctttgctcacctttccctgcgtcaccaggcagaaggaagagtcccctcctttgcagtccctttctcttgggatatttcccacagcctgtgagttccatgtcttattcattgctctatcacccagcactgtggagcttctccttggctg

SEQ ID NO: 105006 - DNA, 581 bp, Homo sapiens
atgtttatttgcacggtgttacatgaaattgcaatccacttttaagagaacaaggcaatcaatcactctttcaaatctctctcacacatgtgggcacacacacacctcaactatctaatttcctgggaacaccagggactcagtattttagattaattacacacatgtgcagtctataatactgtcctcaatttaatgacttgcttattccaaaagttcacttccaagttgcttggactggagaactccaaagcataaaatacttaaatggaactctattactcttaagcatcaacctctacctctaccactgtctccactaagaccagcagaaggctattagatcttggtgcaggtaagaaattgatcggcctctgttacagttatctattgctgcctaacaaccactcaaatagttagtggcctaaaataacaataatcatactgttcacaaatctgattggaggagggctcagcagggaaacctggtctctgctccacatgaaataagctggggctgctcaacttggctagaagatagtcttccaagatggcaagttggtgtttactgttagctggga

SEQ ID NO: 105007 - DNA, 212 bp, Homo sapiens
tcatgttttatgtagtaatttagaatcagaattgttacttaaaatatttaaataaaaataatggcttttaatatttttccctaatttttgttctaaaatcttttggatttatcttttggatttgctatactctgacatttggtgagagattttcttttctttgaaagtggaatattcagcactttgggaggccgaggcgggcggatcatgag

SEQ ID NO: 105008 - DNA, 626 bp, Homo sapiens
taacaaattaatgtcctatgtatttgtttggagtgtaagagggagccaaaaataaaggtacaaatgaaggttcacttctgaaggcaagctatgcttagttacatgaactgcaacatgcccaaaggggaagcatacagagttctgtctttttaaccatctgttcactgataatgtttagtgaagtccctggggtcagatagatatttaatgtttaaaatgaatatgtctttaaacttaatttcaggggaaatactgttgaaattgggaagattaaaagaagccagtgaagtgttcaaaaacttgattgatcgaaatgcagaaaattggtgttattatgaaggcttggaaaaagctctacaaattagtatgtaatgatttttctcctctttctcataactactgattgaagtataataaaatgtaaagttgtaataatacttgggaacaaataattttagcattagtactcatttttccatttagtaaaattataggttaaacatgggagtaaaaatgaattcaaatagttacacttaagtgtaagtgattgcagatatgttaggttccttgacccttacctgtgatagtattggaaggtgaggcaaaaataaaacaaagccaaacca

SEQ ID NO: 105009 - DNA, 404 bp, Homo sapiens
tatctcctgacctcgtgatctgcccgccttgacctcccaaagtgctgggataataggcatgagccaccgcagccggccgccccactaaatcttttaaagaacacttttgagcctttatcttctaaatagtaaactatgcaatttcagagagattattccagccccaacgttttcatattatgagttggtttttcccaataggaaagacttgtctgttccatttttcctaaacccagttctccaacaccaaccgggtgtcccacaattcaattaaattctgataccacctggcatttagtgcagactccacaggttaaatactcaatcccacaagactgaccccacttcagatgccagccgcaaatggggtccccaggctaactgcacttctgcctagggactac

SEQ ID NO: 105010 - DNA, 468 bp, Homo sapiens
gaagaatgtcttaggtattttgatatggattgtgttgaagctatagattgcttttggtattattaatatttttacaatattcttccaatctatgaacaagggatgtctccccccggcccacactcttttttttttttttttttaatttttcagtttccttcaccagtgttttacagtttcccttgtagagctctttcatatccttggttgaatttattcctaggtattttttttgtagctattgtaaatggaattactttcttgatttttttccactagtttgttattgggatgtagagatgctactaatttatttatttcttattttatttttattttttgagacagagtctcgctctgtcgcccaggctggagtgcagtggcgtgatctcggctcactgcaacctctgcctcccagattcaagcaattctcctgcctatctccccttttatactaataatcttata

SEQ ID NO: 105011 - DNA, 697 bp, Homo sapiens
ataccacttgatgtatagaataaaaacactacacatctaaatacttacattcatagcatataccgtatctattcttcatttctttgtgtacatctatttttctggctgggcgcagtggctcacgcctgtaatcccagcactttgggaggctgaggtgggcagatcacaaggtcagaagttcgagaccagcctggccaacatggtgaaaccccgtctctactaaaaatacaaaaattagccatgcatggtggcctgcacctgtaatcccagctacttgagagactgaggcaggagaatcactagaatccaggaggtggaggtgcagtgagccaagatcactgctctccagcctgagtgacagagagagactccgtctgcaaaaacatatgtatatttttccatctggcatcattttacttctgctaaaactacctttaatcttttagtgcagatctgctggtgacaaattcattcagcttttaaattctacattttaccttcgcttttgaaaggtatttttactaggtatagaatgctagatagactttttctgtagttaaaggattttgtttcactgtcttctggtttgcattacttttgccgagaaatgttatttcatctttatctttgtacttccgtacatatgtgtcttttctctatgactacttttaagattttctcatttttactttttttt

SEQ ID NO: 105012 - DNA, 765 bp, Homo sapiens
ggcaaattcaggctccccagagggcagttgggcattcacccagaggcctgtgggtaaaccttttcttttttagcagattggaggtaacaatagccagaacacctagaaaactctctttcaattgtctggcttccagggaatctggctggcttttgtgggaaagtttcactcaccctgagcaagggtcacccctggcctgaggtggggatatttgacctagacttaggcttgtgttagtcttggggttcttcagcagaactgggcagctggccaggctgagacttaggccgcagtcaaaagagagggaaacaggaggaaaaagtggggaagtgagtagagagcaggaacacacaatgagtgccttccaccgcattgactgcttcagttgccttctgtgggccagaaccaccttggggagctcacgggtttccagattcggttccttgacccttctgcccctgaccagcatcaagccagaagctcaatgtcccggaattttaccagtctaaagaaacacatgtgccacttgagtcagcttttccatttgagagtggccgttggctcgacaggggcctggatcctagcactattctctgtcactaaatcagtctgtgacgtgagccaagtcacttcctctctgtgagtctctgtttccccttttgtgaaacgaaagggctggattaggtgatctttaagggcgtttccagctctaacattgtatggtgcttatgtttcctttttctccagcctcatttcttttaggtc

SEQ ID NO: 105013 - DNA, 306 bp, Homo sapiens
gagaatcagttaaaattactctaataactattcccagagagcatggggaattgggctttatattccaccaggtttgaaattaaatggcaataactgcaagtgtaccaggtctagaattaatgtggaaagaagtgtggtacttttacctggggcttttacatggaacgcctcatgagcctccatacacagcaaaatcgtataggaaaaattcattcttcctatccctttttttttgaaatggagtctcactctgtcatccaggctggagtgcaggggcacgattctcggctcactgcaacctccgcc

SEQ ID NO: 105014 - DNA, 357 bp, Homo sapiens
cctctgctgagctccccgctagcaactgccaccagctgccaaccatgcaagtaagccgtcttagacactgagtcttcagatggctttagccactgctgccatttgatagcctgagataccgtgcaaaaactgcttagttcaacccaggcagcccacagaaccatgagagataataattgctacttaaagccactgaggtttggggtggtttattacacatcagttgataactggaacagataataaagactgttaggaatatatattaacatggttaagatcatcattaaaagaacaggtgtagagatgataacttctgatctatagagggaaaaatggaatgagaaatttaaaatg

SEQ ID NO: 105015 - DNA, 420 bp, Homo sapiens
gtggtaaaaacaaaacaaaaaaactggtaaatgaatgaacctgtcctcaaagtccatcctccaggatggaagccatcgtccacgctggactgagttggcctggagatagggatgacaattataacttgaccacttctgggccaggcacagtggcgcacacctgtaatcccagcactttgggaggctgaggcgggcagatcacttgaggtcaggagttccagaccagcctggccaacatgatgaaaccccatctgtactaaaaatacaaaaattagctgggtgtggtggtgcacgcttgtaaccccagctactcaggtggctgaggcaggagaattgcttgaaccggggaggtggcggttgcagcgagcagagattgcgccactgcattccagcctgggcgacagagtgagactctgcctc

SEQ ID NO: 105016 - DNA, 452 bp, Homo sapiens
gaccgttatgagagtgaacacgctaaactcgctgtccgagaggatacctgtaagaggttctcagtgctctatctacgcattaaagtgctctatacccatgctggaaggaaatgtactgtgatttaatagtgttaacacctatcaactagttaggctagtcaaccttgcagtatccaacaaatatccaaatctcactagctaacttctatttcttgtctcattttaagtccctgtggatgggcaggactctcctctaacctgtgatgccggcatctcaacatgtggctttcaggactattatggcagaacaagagcgggagggcctcacaatggctcttcgatgctttagttcggcagtgacacaaatcatttctgctcagagcccactggtcagaactactcacgtggctccgaaacaagggggcttggaaatgtggaggtacagcaggcta

SEQ ID NO: 105017 - DNA, 801 bp, Homo sapiens
  misc_feature (775)..(775): n is a, c, g, or t
tttagttacctctcccgtgcaacgttgaaacatacttacacaaaaatattatttattgcttctctgaatcaaatttaactattttatctagctgcctgagtgtagagcttcaagacttttaaccactgatctgatgcgagaaacaaaggcaaaaagaagtcacagaagtctttagggttttaagcttgagtcattgggaatccagggagtccatactactaattaagaaaaggaagtcaggatattttgtggagtggataaaagtttaattggaaatgtatggtgggtgagatgattaacaagttatcttacaatagcagttctcaatcaggggtgattttgcctcccagtggacattgggcagtgtctggagacgtttttggttgtcacagcacaggggagggattgccactggtgtctagtggataaaggctgagatgttgctaaacagctcacggccttatgacaaagaattatcccatccaaaatgtcaacagtggtgaggctgagaaacccagtattacagtatggggtgaaaaaagatacttttaggatgtttatattaagtccgcattggactttaataatctaagtttactctctgtttagcaagtatttaatcagcatccaatatgtagcaggctgtttaccaggaacacgaagaggaataagatatagtatgagctttctaaaaactcagcctatcaggggaaatgaatgcgtaaaagtttctgaataaaagcttgcggccaggcgcggtggctcacgcctgctngtgcgaatcctgcagaccgggggatc

SEQ ID NO: 105018 - DNA, 747 bp, Homo sapiens
  misc_feature (721)..(721): n is a, c, g, or t
tttagttacctctcccgtgcaacgttgaaacatacttacacaaaaatattatttattgcttctctgaatcaaatttaactattttatctagctgcctgagtgtagagcttcaagacttttaaccactgatctgatgcgagaaacaaaggcaaaaagaagtcacagaagtctttagggttttaagcttgagtcattgggaatccagggagtccatattggaaatgtatggtgggtgagatgattaacaagttatcttacaatagcagttctcaatcaggggtgattttgcctcccagtggacattgggcagtgtctggagacgtttttggttgtcacagcacaggggagggattgccactggtgtctagtggataaaggctgagatgttgctaaacagctcacggccttatgacaaagaattatcccatccaaaatgtcaacagtggtgaggctgagaaacccagtattacagtatggggtgaaaaaagatacttttaggatgtttatattaagtccgcattggactttaataatctaagtttactctctgtttagcaagtatttaatcagcatccaatatgtagcaggctgtttaccaggaacacgaagaggaataagatatagtatgagctttctaaaaactcagcctatcaggggaaatgaatgcgtaaaagtttctgaataaaagcttgcggccaggcgcggtggctcacgcctgctngtgcgaatcctgcagaccgggggatc

SEQ ID NO: 105019 - DNA, 461 bp, Homo sapiens
tattaaaattgcagtgtttttttttcacagtaatcaaaaatacaattctaaaatttacatgaaactaaaataaactttgactagccaaagcaatcatgaggaaaaagaacaaagcagaaggatatcatacttaaaatttcaaactatacatttcaagactatatagtaataaaacagaaaaatgaacaaaaaaatggaacagaaactaatactttcacacacacatttaagacctgatgcaaaaagagaacttaaagagttttagtttctcaaaatcatgcagatacttgtgtgtccccaaaacaatggaaaaacagccagattgtgcagtctcttatctgtcatgaagaggactttggctctcagtgtgaacttgaaggaagctcaccgaaagaaaaatagaattcttagagaattgaaaagcataagacagaagatgcctctttgtgagagcaaaatta

SEQ ID NO: 105020 - DNA, 571 bp, Homo sapiens
acagcaaccaattgcaacaaaacaaaatgttaagaaatgatctttttatgaggcaattggaaatttgaacactgatcaactataggatgattggaattattaattttgtaaaggtgtgataagatactgcacttggctgggcacagtggcacatgcctgtaatcccagctacttggcaggctgaggtgggagaatcgcttgagctcaggagttcgagaccagcctgggcaatgtggcgaaatccccgtctttacaaaaacaaacaaacaaacaaaaaagatattgcagttgtgttgtaagcgtccttatctttcagagctacatagtggaatgtttatggaatatttaggataaatgatatacgcatttgggatttgctgcaaaatgacccagagtcaggggtcagggggagaggtagagatgagacaagaggtagaggggagaggtagaggtagccacgagctgataattacagacaagagatgcggagtatgtgggggctcattatcctgcatagtctatctttgtatatctttgaacttttcaagaataaaaaagcttaaaaagtata

SEQ ID NO: 105021 - DNA, 390 bp, Homo sapiens
acagcaaccaattgcaacaaaacaaaatgttaagaaatgatctttttatgaggcaattggaaatttgaacactgatcaactataggatgattggaattattaattttgtaaaggtgtgataagatactgcacttggctgggcacagtggcacatgcctgtaatcccagctacttggcaggctgaggtgggagaatcgcttgagctcctgacctcaggtgatctgaccgccttggcttccgaaagtgctgagattacagttgcgagccactgtgcatggccagaactttataataattaaaagagacttgaagctgggtgtgacggtgcacacctctagtcccagctactcgggaggccaaggcagaaggatcaccttgaggccaggagtt

SEQ ID NO: 105022 - DNA, 805 bp, Homo sapiens
ggcctaggactagttttggctaatggatgaaagcaacatcagtctgggctggagcatttaattactgatgggaaactctgcagtctgtttccctttctggcacagtgaccagccacattcaagatgatgtcagttacatgagcctgggtccttgagtaactgagcagagccctcttgccaacctgttatggttgagagagaaataaaaacattgattgtttaagccactgagatttgggagttgattgttaaccatcacacagtataaccaaccctttcctcatggttacaatggtgagtaaactaagttggttaagatctggtggaaattataaggaaaaagagttttttggctgcatgttctaaagagctaacattctgaagaaacaagcccaagaaacccccagattgaaacgattccagtaaggcagagatcagagagattgtgagtttggtgctaaactaccacaacagagtaaatacagcaataggcaaatcacaaagattttttggtttcccagtgcatataaaagatatgtttagtctccctgcagtggctcacacctgtaatcctaacatcttgggagcccaacgtgtgaggactgcttcaggccaggagttcaagatcagcctgggcaacagagcaagaccctgtctctacaaaaaaatttaaagattagcccagtgtggtggcatgcatctgtagtcctagctactcagaaggctgaggtgggaggatcacctgaatctaggagtttgaggttacagtgagattgatcacaccactgcatttcagccagggtga

SEQ ID NO: 105023 - DNA, 997 bp, Homo sapiens
  misc_feature (996)..(996): n is a, c, g, or t
tctgagctgtgctgcatggtagggtgaccgcagtgggctgccctgggtgccccatgaaggactgagcagtggggtgacccttcatctagcagacgttcatcagggacctgctgtgggccaggctggggtcacactcagaactgactgcagccaggtggagaccccacctcgagagctcctccttcctagctgtgtagcccacaccccctggggagccgtagcagtgtgggggcagctctgatggaggggtgtgtacctggccacagctgtctctgggctgtggtcatcacccacaggtccttttcagatgcggtgcccacctgggtgtgtggacatgacccttgcctaagggagggagagaggaaggcctggtaccaggcagtgtcctctgcctgtgcccctgctggggaggacgtgagggcctgtggcttttaggaaccttgaggaggtgggggtggtcttctgacgccggcggggctcctgaaggtgcaggaaggcacagtttgtgcggagtccccttcggaggaagcaacgcctgtccctggcggggccgctgagccaaaggccgtgtctcagtggcaccctctcccagccgaggatgtcggcaccatttgggcccgtggacttcctccagtctctgggtggtggtgagtggggcctgctgccggctctgggagccgctagctgtccaagccccgattaccagtgtgaagatggaccttgaatccggcaacagtgaacacggctatggctgcaggtccgcacatgacgagggtatcgggtgacaattcaatggaggggggcccgagcccatggggtccggcgttggcataggtgatctcactcgcttcctctcatagctcaagcgccacgcctgagagacataggggcaacacacaatagcgttcagacacagcagaggcacaacgaaagcagacgcgcgaaaacagaagacacgcatcagctctcttcgagtagctggcggcgtctcgtgcnc

SEQ ID NO: 105024 - DNA, 1094 bp, Homo sapiens
gggctggtcttgtttcctggcctcaaatgatcctcccacctcagcctcccagagttctgagatcacaggcatgaatgactatgcccagcccacattatttaaaaaaaaaaagagagaaagaattatttggggaaaataggtattctcaagattcagcactattcttgagttgaaagagatataattacaggtagttaaaggaggggagaaaaaaacaaaactctagaaaaacaaaaaaacttcacaagaaaggaatgattttcttagtatactatatggatttactaaaagtagttagtaaacgtattagtaaatacttttaacagaatcctgacactgtaaacactatgtagttataacatttagaatcaatttatatacaaagcataggagacaattttattagccttgacgatgtaaaacggaaagtatagaagataaagtttgggagatgaaaagggacaggacctctgaaaatagcagggctggtgtaacatccttatcttccaaaatggggagtcaagagatactgtctatagatgatggaaatacacttcttttaggaagagaagaggtgggggattggcctaagtaaattcttatctagcatagcagaaagcaatagataatgtctacagttgataaatccaaggaaatccataataaaagcctatttctttagagatgtttatggtgacttctagaagaatgagttaaaaattattctaggatactggagaacacaagtagtggtggagagtggagtcagtagaagactttctttttatcaaaaatctagcacaaggccaggcgcagcggctcacgcctatcatcccaacactttgggagaccgatgcaggtggatcacctgaggtcaggtgttcaagaccagcctcaccattatggtgcaaccctgtctctactaaaaatacaaaaattagccaggcctggtggcaggcacctataatcccagctacttgggaggctgaggctggagaattgcttgagcctgggaggcagaggttacagtgagccaagatcgcgccactgcattccagcctgggtgacagaccaagactccatctcaaaaaaaa

SEQ ID NO: 105025 - DNA, 274 bp, Homo sapiens
cctccctcagaacttcaatacattcccagagaactttcctcagaacctaatgcgttcccagggaacttccatcagaacctaatgcattcccagataacctccctcagaacctgaatgcgttcccaaagaacctccctcagaacctaatgtgttcccggagaacctcactcaggacctcaatgcgttcccagagaactcccttctgaaccaaatgcgttcccagagaatctccctcagaacctaatgggttcccatagaacctccctcagaatct

SEQ ID NO: 105026 - DNA, 371 bp, Homo sapiens
cgcttgagaccaggagttcaagaacaacatgacaaaaccccgtctctactacaaaaaaacaacaacaaaaaaatctgggcatggtggtgtgtgcctataatcccagctactccagaggctgaggcaggataattgcttgaactttggaggtggaggctgcagtgagccaagatcgcaccactgcactccagcctgggcgacagagtgagactccatctcaagaaaaaaaaccacatggaggccctgagctgaggcagaggtcaggccctatgtcccacctcccatcctggccctacctaccaggcaggtggggctccctcctggtccctagaggaacatggactctgtcacagggtcacaaagcagccagg

SEQ ID NO: 105027 - DNA, 378 bp, Homo sapiens
caccctactgttgtggctacctattcttctaagtaatacttttaggtagtatgtccctcccaagtagccataaaatcttgagagaaatgtacattcacttttgccctaacagactatgaaagtgcagtccatttctaagcagatcactttggctctaacttttagaatatatttactcatgaaccccataccaattactgtgtcctcaaattctagggagcatctgtcttgctctttgattgtttctgtcaatatatgtccctggctgggattaaaatgagagtagcattagcgccacatctagatggagacgagaaacatcatgattctccaattttctctttaaagaaatactgtacttcttttcttcatctttat

SEQ ID NO: 105028 - DNA, 309 bp, Homo sapiens
gtgacaccctgaattatttcctgcatgagatccaagaacctgctcttggggtctcagacaagacctcttttctagcgacagtcttctttaaacatgccactatagcttggatttgagccatgattgtaccaactaaaatgcacaataattactgccatcatattctcctacctaggtaatatcacttcctttcttgtactctttacatacgtgtaagccacccacattttaaatttaatttttattttgtcaaagaaatatgtggacataatttcaaaagtctgttagttctttaaagctaataaaggg

SEQ ID NO: 105029 - DNA, 229 bp, Homo sapiens
ccagtttcaggtcatgcagggccttattggccgtgatagagaagttggcctttatttttaggtgcaatacaaagacattgtagagttttaagccagaaagtgttatgatctggtttgcaattttaaaagatcactgtggctgttgtgtggaaaatggactgtggggagcaagaatagagataggggagtcctttcaggaactgtaataattgtccatcctctcttaatt

SEQ ID NO: 105030 - DNA, 585 bp, Homo sapiens
acacagtcaaaatttggtaattgatagcacaaaagatgataagaaaatagaaaacacaaattacccatatcaggaatgttcctacagccattaaaagatcaataagggactatcataaatcactttgtaacaataaatttgacagcttaggtgaaatggacaaattccttaagaaacatacattaccaaaaacaaaaacaaataaatgcgtgagtgaaagaaagaagcaaaatataaattagccctatatatactaaggaagttgaattatcaacccttccaacttagaattcctgttccagaagagtttactgatgaattctatgaaacatttttgcaagtgacagtgtcaatcttgcataaatttattcagaaaatagagggatattgaatgccctccaattaattttgtgaagcaagcaaagccctgataccaaaaccaagcaacgacataaaaaaaaataaaaaaacttcaggtggggccccgttccccaattggcccttatggggatgtcggattacaattaaatggtcccgactttttaaaaccgtctgaaacttggaaaaaaccctgggcgttatccc

SEQ ID NO: 105031 - DNA, 828 bp, Homo sapiens
tagagtcgataactctttctcagagtggctagaaaggatggtttggtaaatggaaagaaatcacagcctcaattcttctcttgcagccttagtaggtgtactcgttctcgttgggtgttgtgtcataccatgcatccgtgggctagtataaagacttatagaagcaacacttactaaaacttcccttagctctcctccaccttattcagatcagttttttcttttataggattaaattgaacaacaaagccaagacctgttagaaaagtttgaagagaaactactatgaaaattgaaaagggggaaattgtaggataataataataaattcctgtccaaaggttttagcctgtaaattgttaagtataaagttctgagatcctctccaaagaaccaatgtatcagtatgttcagctcccctgttctttgttctacattataaagtttaacttcctcattctttatgtctccttgcacctagtttcagtaaacaaccccctcctagcctctatcacctgctctgaccttagtcacccttcgtcacctactctgttcttagtcatcctgagtcacctgttctgtaaccatcattcccaccaaactgctcaccctgcctctctggctcatacccttgctgtctttaaaatagccagtcagaattagcttagactgtgtggtccaaccatagccaatgggggaatgacacagcagtaggggctacctgcatcagggataagaacccctttccctcacttgttcaggtgtgctctcaccattgctccatccaggagatgcacccttctatagaagtaaaattgccttgctgag

SEQ ID NO: 105032 - DNA, 325 bp, Homo sapiens
tgcactgctcctactcctaaccactccacctaaacacggggagctcctccctcccaggctggctctgccctctgtgcactgcatctgtgggtcccgctcacaccccccgagtccctgtgccattttcgagcacactggctcctgagtgttttcacctctggcagccagcgcctatgtctcccagatggaagaagtccccaggccacgggcccgctgtgcctgttcagggaagggcagaagtgcctgggaatgtgtgtggcccagggcctggcccttactcaggactgacgggtgtgggtggccttgctcctacgcggaattaact

SEQ ID NO: 105033 - DNA, 190 bp, Homo sapiens
ggttgcgatcagagcatacccctttctacttatagttccatgcagcatggatgtgggaaaaagtctcctctgcaaagggggttaatgcaggtcactctacgtatgtgcacgaggtcgttataaagctcgaaaatatgggctcaccaaccaggtgatttttttagttatccaaccagaagacataacatat

SEQ ID NO: 105034 - DNA, 462 bp, Homo sapiens
agtgcattcctagtgcttatcttatagtagaatttcatgaggttaattcacttaataactctagagaattttccatgttgtatatactgttcttggctcgggaagttccttattcatctcccacgtgtgataagactttggtgaataaatgcaccattttattccgtggatatttatttagttgtgtttcctaatttttgccaagaaatggaaacagcagcaatgaaattggtttttatttttttggatccttaagaaataggtgctttttgaagaatcaggggagaagtaacgcaagaccccagaagtatgccaacatataaaaccccaagtcaaaaggtcaaaccacgcatttgatccctcaagtcccctgcttgaccctcttccaagtgtactttccttcctttcattcctgctctaaagctttttaatactttcactcctgctcaaaagaaaaaaaaa

SEQ ID NO: 105035 - DNA, 703 bp, Homo sapiens
gccaaccataaattccaataagggttaataccccaaatatctccaaaactcatattacttagtaaccaaaaagtaacctacaagtaaaagtgggcaaaaggacctggatagacatttttccaaagaaagtatagtaatggtcaacaggtatatgacacactgcttagtagaactaatcagggaatttcaaatcaaatccatcatgaaatatcacctcatatcttaggatggctttattagtcagttttcatactgctgataaagacatacccaagactgggaaatttagaaagaggtttaattgactcacagtactacatggctggaaggcctctggaaacttagaatcatggcagaaggtgagggaaagcaaggcacttcttcacaaggcggcaggagaattgtcaagcagagacggaagagcccaataaaatcattagatcttgtgagaactcactatcacaagaacagcatggaggaaaccacccccatgcacctggtctcccttgacacgtgggtatttgtggagattacaattgaagatgagatttgggtgggggcacaaagcctaactacatcagtggatgttaatcaaaaagttaaaagtgatactgaggatgtggagaaaagagaacaaaccatacagtcctggtgggggatataaattggtacagccattatggaaaacagatgaaggttactt

SEQ ID NO: 105036 - DNA, 326 bp, Homo sapiens
gtttatggagcacttgctctgtgcagggtactgcgacaggctctgggaacacagagaccagtgagtcacagtctctgtcctcgaggagcctgagacagcacaaggagtggagttcaggccagcaggggcagggacagttgggccacccctggaaggagttggtctttgcctgtcctacgtgttgaaggacagaggtactgtgagaggagagtagggagttgtggggacttgcctggggtgtcagaggggacggggtaggaggtggagggaagagatggatgggacagcacacaccgccctgtcatctcccatcctgggctgccgct

SEQ ID NO: 105037 - DNA, 412 bp, Homo sapiens
gtcaggctcgtcttgaactcctgacctcaggtgatctgcccgtctcagcctcccaaagtgctgggattacaggcatgagcctccatgccgggcttcgtgtcattttagtggggtttcaggaaaaagcacggggcaaatgcgtgtgtgcaatctgctaccatctataactggaaatcttccacactaatattgatttgcccttttcacttatttagggttcctaagactttggaatttcttggtattcattcctcatccttagggaatgcagaattctaacaaacttctgtgggatagatatgccatcactcacacactggtctttactaatttagacccttagtgttatacatggctcatatgaagagtaaaggggagcctgtcggtagctaggcccacatgtgtgcatgcc

SEQ ID NO: 105038 - DNA, 341 bp, Homo sapiens
cagagtgaagaagcaggggctgtgggaggctggctttgtagtatcagcagggtggagcttcctctagtgcctgtgggaggatgtgactgtctcgtttgaataatgctatggggtggcaggcaactgaaccccactactcagagataagcaggaaccgtgactggttcctgtgataaggaggatggcttggctagggtaccttatctgtggaaaaagagtggggatgggaacttgcagttagggcatttgaggccctcacagtttttcccagatgtcaaagcatgcataatattggatcttaattttaggccttataccaccgtatctccaccttcccgctt

SEQ ID NO: 105039 - DNA, 746 bp, Homo sapiens
aggtggtaaaagcaaaatttctaaaattgaaatcaagcaaaaacaaatgggcctaatgtttttcaaatgtatagcatcagcacctacagaaaaaagaattcaagtaacttttaagcactcgaactatatacccatagtgagtatattctaaggataaaccaccaaagaaatcaaacttaataggtttgttgttgtgagtggtgttggcattgtaattctgaaacagttttgaatatcaaggccattgggaactggaaaaagaaagatataaatatggaatgggggagataagaactttatggtattagatttcagttggggatgtcaatatgaactcatgatttttaaacagcatttaggttgaaccacatgaaattgccagtttttaggccacaaatagtcaaatattaacaatttcatgtgattcaacccaacattttctaactctgctagctgaaagggcctggaggcaatgagcatatcttatgccccatcctggtttctaaatgccattcccaccagaaggaatttgggctccttagggaagtcggtaattataaacctggggcagggattgtacagcttgtgagacttgccacagggatatagaggctcacttgaaagggctcccaccagcctaatttgggaaaatttatgtatcaaaaagaatagtagtggtagtcgtggtaatggattataacacagtgaatttttttaaaaaatcaatgaatttgtaatgacactaa

SEQ ID NO: 105040 - DNA, 157 bp, Homo sapiens
cccctcctcctccagccaagccctcactcacatctcctcttcacaccaagcttcttgataaagctgtccacatcctccacccttactttgtcatctcacactcactttgcaaccctctgcaactggcttctgtccctggctttgaaattggtgacag

SEQ ID NO: 105041 - DNA, 127 bp, Homo sapiens
atgtgaaaaccgaggcagagccaggactcaaatccagacagtctgcatgctggtagccatgcagtactgcccgggcaatccagtatatcgagatggagagtgtctggagtgactgggagtctgacag

SEQ ID NO: 105042 - DNA, 994 bp, Homo sapiens
ctgtatctaaatcacaaaggcaggtgtgtcctcactttagcacagtccaagattctgagttccttggaggacagaggcttatctctgtatccctcagtacatggcacagtgctgggcacacaatcactatttggtgaaataaatttgaggaaggacagaggagctcaagagttaatacctaaagcgcacaactactcattggagtgcagggccactggtgaggaacaaacagcagggcatgctagattagggagaggccatgctctccggtgctttccatttctcccggagataagagaggttagctaggggacactaacaataaactcaatcaagtgaaaagtccaacccccaagctaataaagcctaagaagaattttttttagaaactgagaaggcctagagtctttgggacttcaggatggttaagataggtcactgcattacctgttttcagatggccttgattttaatgcttgactggtaataaaatttctatgcagtgaaatcttatgtaaattaaatctgagttttaaaaaattcaagagggctggctgacaggatgctgggagagggcatcagcattccacagaggcaggctaacactaaggagatgggcactcagctgcacaactgcgcggcaggtccccgcacctatctccatggggttcacccacagcctggagcctgttaaaaaagcatgcaaagagggcaacaggcaacagaataccttgagatggtacctccagatacatttacttatggttttgttcttcctcaaaatgcctttgttgcttaaaacatctcagaccagtacactgcctagaatgatcccttcaggaactaccaaaaagctgactagacagggggaagtaagcaccatcaatacttcctgccccaccaaatgctctccagttgcacctacccaggttgattataacaggacagatgacacttgatataacctttctgttagagggattcaaaagaaaca

SEQ ID NO: 105043 - DNA, 940 bp, Homo sapiens
ctgtatctaaatcacaaaggcaggtgtgtcctcactttagcacagtccaagattctgagttccttggaggacagaggcttatctctgtatccctcagtacatggcacagtgctgggcacacaatcactatttggtgaaataaatttgaggaaggacagaggagctcaagagttaatacctaaagcgcacaactactcattggagtgcagggccactggtgaggaacaaacagcagggcatgctagattagggagaggccatgctctccggtgctttccatttctcccggagataagagaggttagctaggggacactaacaataaattttagaaactgagaaggcctagagtctttgggacttcaggatggttaagataggtcactgcattacctgttttcagatggccttgattttaatgcttgactggtaataaaatttctatgcagtgaaatcttatgtaaattaaatctgagttttaaaaaattcaagagggctggctgacaggatgctgggagagggcatcagcattccacagaggcaggctaacactaaggagatgggcactcagctgcacaactgcgcggcaggtccccgcacctatctccatggggttcacccacagcctggagcctgttaaaaaagcatgcaaagagggcaacaggcaacagaataccttgagatggtacctccagatacatttacttatggttttgttcttcctcaaaatgcctttgttgcttaaaacatctcagaccagtacactgcctagaatgatcccttcaggaactaccaaaaagctgactagacagggggaagtaagcaccatcaatacttcctgccccaccaaatgctctccagttgcacctacccaggttgattataacaggacagatgacacttgatataacctttctgttagagggattcaaaagaaaca

SEQ ID NO: 105044 - DNA, 432 bp, Homo sapiens
gactggatataacataattgttaaaacttgtctgggttcaaatcttggcttaaccatttgttagccatgtggtcttgggtaagctatttaacctctcagtgtccttgcctataacaggaataatactagtatccacctcatgttgtcatgacgaaataagaaaatattaaatagtagatactgttaaagtatactagttttattaactacaaatgattttttctttttattttagtttttattgttattttttgagaaagagtcttgctgtgttgcccagactagtgtgcagtgtcatgatctcgtctcactgcagcctccacctcccagattcaagtgattcttgtgccttagcctcctgagtagttgggactacaggtgtgcgccaccacacccggctaagttttgtacttttagtaaagatggggtttt

SEQ ID NO: 105045 - DNA, 470 bp, Homo sapiens
gcctagttccccactctgccctcctcctcttctctcagtctgctcctggaacacctgcctcagtttccatgctctctccagtgccctccccggtgaagcaggtaggtgttcaggccaccacagagacaatctctgtgggagattgtcttgcaatctcccacagatttcaatcaggattttgttatttcctactttgagctttaaagggaaatgggcctcatgggtggggaaaggatggtgggtccttccagcccaatttagtgatgcccagggcagatattatcctcagttcccaagagcaatcatacttttccacacataccgtgtgtctcatgttaggtaaatgtatttttacaatgagcaccacttctgtggaaaaagttccctgcacggggaggtccagcttccagactgctccatcgcataaggacttccccattcccctaaatgctgctctgtcagaacctgcc

SEQ ID NO: 105046 - DNA, 381 bp, Homo sapiens
gtgtatgatgcacattccaaagtggcaagtgtcattgtagatcaattccctggtgagaaaactgaggtccttggagatcaccaacataacttgcttgaggtcacttagctagttcctggcaaagccagagatcaaatccatgcatctatgaagcaacaatgaaggttgtgcatctgaggagtgtttgtgcaaggcggccaagggaaggtgactggcactgtagcagagagaaatgaacatgttctggagtcaccaaagtggaggaggtggggagaggtgaaagaggtgtcatcaataagggtgaatttacacaatgacagatttaggtgaggaaaggaaagaacaaggagaccagcctcaatgaaactgcagcctgggcag

SEQ ID NO: 105047 - DNA, 1104 bp, Homo sapiens
  misc_feature (498)..(498): n is a, c, g, or t
gaagaagtgcctttcatatcctgccatgattctgaggcctccccagacatgtggaactagtgatgcagagatgtgacccaacgggtctacctaccagggaggaggtgtggtttttactggaatattctggcaggcaaaagatctctccttttggctttctccctgcttctgaaacacatccctttccaggaatgcatgctttctgaggcagacaaaagaagagttgttcaaggagaagaagacttagagacacagacacacagagggaagaaggccatagaaagacaaaggcaaagattggagttgtactgccacaagcccaagaatgaggaaaccaccaggagctagaagaaacaagcaaggattcgtccctggattggtctttcaaagggagcatggccctgctgacactttaatttcagacttctaggctgcagaaccattaaagaataaatttcctttgtttcaaaaaaaaaaaaaaaaaaaaaaaaaaactcnggggctccaattccggggtcgcggagaaaaccgcggtgtatcgacgacatgtgggccacgtgcgccatagtctggtcctcctggaccacagctttctgggcacccagtggggccaaattcgccgggtcccccattataggagagctcgatatacatcgcgatacgcgccaggggctacccccgcggcttaacgagccgacgcgacaacagccctcacgcccgacactaccgcacagcagcgcccagccgccacacaccccgacgccacgaccacgcaccgaggaccaaccaccccaactctagagcaccaccacacacacgcgcggagcaaagcagcggaagaaacacacggactaataccacaccagatgagcgcgaaagagaaaacacagcaccacttgaccgacaacccagcgcaagagacgagcagaagcgccacaagcacacgcgcacgcgacgcgaccgccgcgggaacacccaaagccgaccagaagagagacgacgagcagccaagcaagcggcgaagacgaacgaacggaaacaacaaggaggagagaaggcgacgagccagaacacccacaacacagacgacagcacaccagcaag

SEQ ID NO: 105048 - DNA, 1020 bp, Homo sapiens
  misc_feature (498)..(498): n is a, c, g, or t
gaagaagtgcctttcatatcctgccatgattctgaggcctccccagacatgtggaactagtgatgcagagatgtgacccaacgggtctacctaccagggaggaggtgtggtttttactggaatattctggcaggcaaaagatctctccttttggctttctccctgcttctgaaacacatccctttccaggaatgcatgctttctgaggcagacaaaagaagagttgttcaaggagaagaagacttagagacacagacacacagagggaagaaggccatagaaagacaaaggcaaagattggagttgtactgccacaagcccaagaatgaggaaaccaccaggagctagaagaaacaagcaaggattcgtccctggattggtctttcaaagggagcatggccctgctgacactttaatttcagacttctaggctgcagaaccattaaagaataaatttcctttgtttcaaaaaaaaaaaaaaaaaaaaaaaaaaactcngggggattaaggggggggggggaaaaaggggcgtatgagaaggggccgggcgccaataggtgctcccggacccagttttttggcatacagggggaaaactcgcgagggtccccaataaagggaggcggaatataaattcggaaaacgccggggtaaccctgcttatgtctctcccgaaaaaacgtgcacagacacgagagagaacagacggagcagagacatgtaaaacgaaggggggctttcaacaagttggtggtccaaaaaaagcgggggttcagaagaacagacttgaaacaactgtacaaagtaaagagaatcttatccgagcacaaacaaagaaagagaagcgaacggcaccacgaaaaacagaaaaaaaaacaaacccaagaacgaaaagaacaacgaaaccaacagaagagaggggaaccaagacgcagaaggacaacggaggcgcaaggagagaagacaggaggaaagaacaagagagagaggagagaagctaagaaggaagagagcgcgaaa

SEQ ID NO: 105049 - DNA, 469 bp, Homo sapiens
gaagaagtgcctttcatatcctgccatgattctgaggcctccccagacatgtggaactagtgatgcagagatgtgacccaacgggtctacctaccagggaggaggtgtggtttttactggaatattctggcaggcaaaagatctctccttttggctttctccctgcttctgaaacacatccctttccaggaatgcatgctttctgaggcagacaaaagaagagttgttcaaggagaagaagacttagagacacagacacacagagggaagaaggccatagaaagacaaaggcaaagattggagttgtactgccacaagcccaagaatgaggaaaccaccaggagctagaagaaacaagcaaggattcgtccctggattggtctttcaaagggagcatggccctgctgacactttaatttcagacttctaggctgcagaaccattaaagaataaatttcctttgtttcaa

SEQ ID NO: 105050 - DNA, 273 bp, Homo sapiens
gaaattttatcgtacactacgggatggcggctttaggcgcaccagcattagcatctcagacacacagagggaagaaggccatagaaagacaaaggcaaagattggagttgtactgccacaagcccaagaatgaggaaaccaccaggagctagaagaaacaagcaaggattcgtccctggattggtctttcaaagggagcatggccctgctgacactttaatttcagacttctaggctgcagaaccattaaagaataaatttcctttgtttcaa

SEQ ID NO: 105051 - DNA, 210 bp, Homo sapiens
tccaacttttatcttttggtgtggctaacacatcaaaggggaaacaaagatcatgcagaattccagcaatattacccgtagaaaagagtcttacttttccaaggcaagttctgtaatcatctcgctttcacagacatgcagacatctactagagctcaactgtgcaaagcagcctgtggaattaagtgcatttcttggctttccactcac

SEQ ID NO: 105052 - DNA, 698 bp, Homo sapiens
ctcagccaggccgctcactgcgcgatggcagctgtgcttccccctcccagagaagaagatggtccttcaatttgaaaacaaacagaaacttaaaagacgtatttatagccccattatcctgaaatacgcatttttggctttatttgttattgttgtttttgggccagggtcttgctctgtcacctagggtggagtgcagtggcatgatcatggctcactgcaggctcgacctcctgtgctcaagtgatcctcccaccttaggctcctgagtagctgggcagccatgcaccactatacccagctaagttttaaacattgttttgtagagacagagccttactatgttgtccgggctggtatcaaactcctagcctcaagtgatcctcctgccttgggcttccaaaatgctaggattacaggtgtgagtcactgtgcctggcttatggaaatgtttttttttcttgattgagattgatgatttatgagagtatacacttatcaaaactcactgaaactgtacactcaaaatgtgtgctttttattgtatgcaaattatacttcaaagttgattaaaaagtactctccaggtcaatactctgtggactaaacaaaaaacgtttgcgtgccaaatttgattgaggtagccagttcttaacagctaatctacactgccacacatgtgtgtactgtaagagtgc

SEQ ID NO: 105053 - DNA, 394 bp, Homo sapiens
ttctaagaaaatatttggcaaataccctaggttggataactatagcttatctgtcattgtgataagcagaaaaacatgcactaccacctctaacaccccaaagatgtattcacttcccaatccctgggacctgtgcatgttaccttttaaggcccaagaagtgatgaagttaaggatcttgaggaaaggggcttatcctggattagccaggtgggtcctaaatccaatgacaagtcccttataagagaggcagaaagagatttgagacacacagaagaggagaagacacagagacacaaagacgagaagatcatgtgaagacggaggcagagactgaagtgatgcagccacaagacaaggaccgccaaagcatgcccatcaccaccagaagcca

SEQ ID NO: 105054 - DNA, 311 bp, Homo sapiens
aaggcccagtccccgaggactgtaggcagccggggcccctcttagggaccctgtccctgggcctctcctcagcccctctctttgtctccgtggccatggcaacctggctgggtgcttggcacttcccggcccagcccccagcctgaccagccggcctcctcctctgcagaggctgccctggcaggctccagcctggctgggaagccacccccaccacccactgatgggggctcctgggcagtactggtgctgccctgcagtgtgggaaggaccccaagcaaaggctcctgctgggcctcctctctgcctcc

SEQ ID NO: 105055 - DNA, 255 bp, Homo sapiens
tcatatataccacatattcttgtctatttatctgatgataaacaggttgctgttgtgtcttagttattgtgaataatgctgcaataaatatgggagtatgcatactttgggcagagtgattttaattcctttggatatgtacccaaaactagcattgctggatcatatggttgttatattttggttttctgagtatgatttcactacatgtaaaatctaaaaacactgaactcataaaagtacagaatagaatag

SEQ ID NO: 105056 - DNA, 544 bp, Homo sapiens
ctccacactgctttccacagtggctgaactaatttacatttccaccaacagtgtgtgagtgttcccttttctctgcaacctggccaacatctgttatttttttgactttttaataatagccatcgtgactggtgtgagatggtgtcttgttgcagttttgacttacatttctcaaatgattagtgatgttgagcattttttcatatacctgttggccacatgtatgtcttcttttgagaagtatctgttcatgtcctttacccattttttttttctttcagagcaggaatgaaagtttattgaaaagctttacagttgggcatggtggatcacttgaggtcaggagttcgagaccagccttgtcaacatggtgaaaccccgtctctactaaaaatacaaaaaattagctgggtgtggtgacaacgcctgtaatcccagctactcaggaggctgaggcacaagaatagcttcaacacgggaggcggaggttgcagtgggccgagatcgcaccactgcactccagcctgggtgaaaatccgtctca

SEQ ID NO: 105057 - DNA, 113 bp, Homo sapiens
agtgtccttataagaagaggaagagaccagagctcgctccttccccaccatgtaaggacacagtgagaagacagctgcctgcaaacaggaggaggagcctccagaactgtgag

SEQ ID NO: 105058 - DNA, 483 bp, Homo sapiens
gagctcaggagttcaagaccagcctgggccacatggtgaaatcccgtcatgcctgtaatcctagcactttgggaggccaaggcaggtggattgcctgtgctcaggagttcgagaccagcctgggcaacatggtaaaactccgtctctactaaaaaaaaaatacaaaaaattagcctggcgtggcagcgtgtgcctgtagtcccagctacttaagaggctgaagcaggagaattgctagaacctgggaggtgaggttgcagtgagccaagataatgccactgcattccagcctgggtgacagagtgagactccatctccaaaaaaaagaaaaaagaaattataagaaatctatttaaaaaatctattagattttagtagtaataagtgaatttagcaatgtcacaggatgccatgtcagtatagaaaaatcatttgtattcctgtataccagcaacaaactagaaaataaatttttaaaaattt

SEQ ID NO: 105059 - DNA, 244 bp, Homo sapiens
cagccctgcagggccgtctcccccaagaggcttgaatccacccaggaacccccggcagaaaaggctgggcaggagctcaggcccaacatcccccatatcttcactttgcgtcccctccccagccggccctcccctgcccacgcctcccagagctgcagtcgtagccaatgcagggaggtctcagttaccctgcagcaatgctgacagcttagttggttgattcagtcttcattttcatggtttt

SEQ ID NO: 105060 - DNA, 345 bp, Homo sapiens
tcttgagaaatataggtaaaacaaggtgtacttggggcagggtgagtgaggagagaggggaattttgtcccatactttttccaatactcgataaacaattccatggtgaaaaagatacatttacaatattaattgagaaataaaattcagggaaaaagagatcaggatggaaacaagcaaaatgaaaatttaaaagacagaaaactgtctgcgtgaggtggctcaagcctataatcccagcaccttgggaggccgaggtgggaggatcatgaggtcaggagttcaagaccagcctgaccaatattatggtgaaaccccatctctactgaaaataacaaattggcc

SEQ ID NO: 105061 - DNA, 136 bp, Homo sapiens
gctctgatctaggacgacagtttctatgatgtgcccatctagagaaatactcaaattgcaactttaggaagagaaaaagagggccctgcaaaaggcatctacaggccccatgtgctgttcacctttcttatttatg

SEQ ID NO: 105062 - DNA, 871 bp, Homo sapiens
ggctgcaggtcccgagccctgccctgccctgcagggaggcagctaaggcccagcgagaaattgagcacagcagctgctggcccaggtgctaagcccctcactgcccggggccagcagagccggtcggctggccgctctgagtgcagggcctgccgagcccacgcccacccggaactcttgctggcctgcaagcctgcccacatccctggttcccacccgcgtctgtctctccatccacacctccctgcaagctgagggagccggctctggccttggccagcccagaaaggggctcccacagtgcagcggcgggctgaagggctcctcaagggcagccagagtgggtgccaaggccaaggaggtgccgagagcaagcgagggctgagagggctgccagcacactgtcacctctcactaccagacccgagcagagctgtggacaacacagtatgggaattaagcaggtgagatgaccagagtcctcactggcactagaagatggcagcccaggagaaagctaccagccagagcgaggcctgccagagatagccacatctcctctcagagaatgggggtgatgaggccctgcaggccaatctgccctgtgctgtggggcagaggaagctgtgggactggacaactccaacattcacagttgtggcaccagctgcaggtgagaaatgtgaggagggaccctgccccctcaacctctgaggggccctggcagactgggggctgtcgccacctgagggttcccagccttcctacaaggcagtgtgcatggtgatgactgaagtctcggggtaatctcccagcaagaggtcaggtcctggttgtgcgtcccagggtgtcagtgaaattggctgctccc

SEQ ID NO: 105063 - DNA, 654 bp, Homo sapiens
tgtagttaatcttcccttcttcaacgcatcttcactccaagctatcctctactccactggtcaaataatgatggtgcagggtcaaatctggcctgctgcttttggtatataaagcatctgcccactcctttatgtattatcaatgactgcttttgtgtttcagtggtgaaagagactgtacagtccataaaacctgaaatatttactacctggtccttcagagaaagtttgtccaacccactactgccaggatgattctgatcaaaaatacaaatctgatcacgttgcttccatgcttaaaagactttggtagttacattaggtggtgaggtaccaatctgtgactgccaaatgcagcacttctggccacactaaataaacccctgatcttgaaggtgccttgtacattgatgtcaactttgtccttctgtgctgttgcatatgctgtgcattttgtataccatgcccttgatgtgaataattcattttcatcctcccagattcagttcaaatgtcatcaccatgtaagccttccttgactcctctcaacagtgagatcctccctacataccttatttccatatactttgtacatttgtctattttgcatttatcactatttcattcattcattcttctatttacacatctggt

SEQ ID NO: 105064 - DNA, 435 bp, Homo sapiens
tgatcaagatatcaggccttggtctaactgtctagcttagacttcagttacacatgctaattcaattttagtaaatgcatagtaacagtatgaagtcatgtaaaactgcctttgtgagaaaaagatagattgtttaaatgggttttctgtgaatgctgacatttcattttctattgtgaattaattatatgtacttgtacctggggtgtgatctattctgttatgtcccttgctctttgaagacagagattttatcaaatcatctttggagttcttactacacctcgtcaagcattttgaccattctaagcattaaaaaaaagtgtgctaactttgttttcctcgtgctagcattcagctattcatttattcaaaataaacacctacaatctgaaataagtataatgggaaaacttgaacgttctatttttctcc

SEQ ID NO: 105065 - DNA, 473 bp, Homo sapiens
gttaatatgtataaagaactcctgaaatctatacagagaaccccaatatgcaaataagcagtcatagttattcccaaaatacctattatattcccaaaatacctattatattccagatgctttgttcattctctcatttaattttttcaataatcatgcaatgtcttgattgttattctagtcttgccgctgagaaaattgtagcttagcaagattaactcacccaagcttagttagtggcagaggcatcttttaaatgggactccaaggtctgtattttgtctgccatgtcattccatgtaattgaaagcatgaagatcacgaacagactctatatagcttctgtactatattatcctcaaatataacctgagtaaattaaagcaacttgcaggtaaatgttaagcattctaaaatatctttagatttaatgataacacaaatattgatataggtttgataatggaaggaag

SEQ ID NO: 105066 - DNA, 4764 bp, Homo sapiens
aagcagtgagcggggttggggcgggttgttgggctgggggttccaattacaggcagggcagccagggagacctcagccagaggggatgcctgagggtgggagtgtctgctgggcctggtctctgaggcaggcatgtgtctgcccagcaaggcagcagcagcttctgaccgcagcgcccagtgctgtaggtggggctttggataccgtcctgtgggctatggctctgccttatgtgtgggagttctgaaaggaggaccggctggtggcagctcgggacaggcagggctctggtgatcacctggcagcagcaggagatggtggcaatggggacagagaagtgccaggatcctggatatttactttttaggcagagacaaccggcctcgctgctgaattggttgtagttacaaaaagatgagccatcagtaagcgtgtctcgagttatggaacggaaggagactgtcctgggtcttctcctttctgtctctgcgcccccaagcccctgccagagctgtaccccaggctcgggaggaaaacgtccttcctgagctgggcagaagccgcccttggccgtgaggcggtgttggttctgatgcggcttcccatggctttggtgtctccacaggcagttcttatggagcttcaggctgcccggggaggcgcagaagattgatcgcatgatggaggctttcgcttctcgctactgcctgtgcaaccccggggtcttccagtccacaggtcagtgcagagcccacagcctggccccttgccaggcacagcctccagctctggagggggcggcccctgtgggcacagcccagcgtgtgttcctggggacctgccttccctgagcgaggacgacctgtgggccgggcacctcttgcaggcgggcccccagcacgcggggtcccactgtccactggaggttctggctgagcccagcaccccggactcgttgcagacacgtgctacgtgctgtcattcgccatcatcatgctcaacaccagcctccacaaccacaacgtgcgtgacaagcccacggcagaacggttcatcgccatgaaccgcggcatcaacgagggcggggacctccctgaggagctgctgaggaatttgtatgagagcattaagaacgagccatttaagatcccggaggacgacgggaacgacctgacccacaccttcttcaaccccgaccgcgagggctggctcctgaagctgggagggcgtgtgaagacctggaagcgccggtggttcatcctgaccgataactgcctctattactttgaatacacaacagataaggagcccaggggaatcatcccgttggaaaacctcagcatcagggaggtggaggacccccggaaacccaactgttttgagctctacaatcccagccacaaagggcaggtcatcaaggcctgtaagacggaggccgacggccgcgtggtagaggggaaccatgtggtgtaccggatctcagccccgagcccggaggagaaggaggagtggatgaaatccatcaaagccagtatcagcagagatcccttctatgacatgttggcaacgaggaaacgaaggattgccaataaaaaatagctttcctggctaaaagacccaggtaaaagacccaaccccagcagaaagacaccgcgggcggcccctccgcggaaggcgtggcagggaggcagtcgccctgcggtgcaagctgctgctccagagcataccgtggcccaggtggtatccccaaggcctcgtgccgtggctggggtcctgggaggtggtcgccctgcagtgcaagctgctgctccagagcgtaccgtggcccagactgatcctcgaggcctcctgccgtggctggggtcatggtcggctgcgcatgtccagaagcatttccttcctgcgaccatcccggcgcccctagggggagaagccaggacagcagcttccgctgtctccacagcagacacgggacggattccacagacgggagcctcattcgtaccatgccaaacgcattcactcggggcagtattaaccgttctagaaagccactgttttatagcaaaacaggaaaggaaaagctaccagttttttattcagaatttttctcagatatataggattatagcttttatatgcctttttatattctgaaattataacaaaagatactttctaacagtagtatttttagaatggcagctataaagttaactcctggacacaagtatatactgtgcactgaaaaaatatccatctacacagcacccaaggggagggctgggggcaccggcacgggggcagcgtgcagccctgccctgtcaggctgtcagacaagccccggggggcagcaggtgggctcgggacgggctgggggagggacggccatggcacttgggggctccagggtgactcccatgaggcctcccttcaaccaggctttttggccccacaaatactttaagcaaatcattaaaattataacagttaatggtttgggggtgtttaggctgtaactgctaactcctaggaaacagccttttccctggacacagatggtccatacgctgagccacgtgaaactgctgatgttttgtttagatgcacacacatggcagcgtttcatacaggtcagcaggttagaccggcttttgaccatattcatcgctatttaaaacctgtggcaaaatgaacgcttattttacagactttctaatttgaccagatttcttaatgaatagacacagaattaactaaaaacagtctcaccccatgtagtgcgccgtgtcctgagagaggtgccctccctacgaggagggaagaacaggccctggggtgcagaggcccggcacgtagagaacccagatagacgccggtggtggaactggtcaaactccacgcccgcctgggaggttgtcaggttgctgtggatgtaaggataggaggtgcccagtgctccgctcaaggaaggctggatctgggccccacctacagagagggctcagggctggaccgggggcattgtgtgcttgggccgacccgggccggtggcagacgctgttctctgtcgggagatttgcgtccccaggaccctgttacacagtgggctgttgggttggtggctggcttttcctctatggacttcctcttcctgccccacctgcataggcacacacaccttgaatctgcaccctctggagggcatctgtactcctgtgcaaaatgcccagtccagagacaaaacctcagactttgtgcacctaggtttccttctcagcagcggagactgttctttgagttgccttgaagtggaggccgagcggctgcgggcccttcgcctccctgcggctgaccttgatgtagctttaagtcacactagactgcagaggggtccgaggccagaaacccctgtcctgcatcagactttcattcccacgttcttaggctttgttactgatacctcaaatcggaagttttagttctgagaaaggcaagtcagcgttcttgaaatgcctgactggtagatatgcaactctggcctccagtcttccatgaaaataaatgctgcctggacccccacccagaccacacactgacggccggctccggcggtgcccacccctcaggctggcccggcacccaagactggccacagccagctctgtcagcatgttgtgctcggacaagctgtttccttcttctgaccaacccaggtgtgacctggggatgcagagctttctgttttgggtgttgggagaagcagcaggaaggagtcgccagatgatcaagctccccctttgctgtcatctgtgaatgagcttcgccaggtggtgggcacctgggagccatgcagaggctgtggtgctgagttagactccaggtactttgtggtcaaaggaaatcgcctagctccaggctgtgttaggacagtattagcatgaaggctgtgcgaccatcatgcctgctgatccttgaggcaggcctggtccagaaaactctgggtcagtgactgcgcagggccagccgctaccaggacggccctgaaacaggacacatctgttttttgtccctcaccctgggcaggccgcgtcacaatcacagtcctcctcctccccaccctgacgtctgagcgcagggcttgaattgttagtcccaactctggccaaagatacttttttccagagacagaggccaggaggcagtgaggggagccccgcggggaggcggcggcgactgccacagcccttccagcctgtcttgctggccgccctggttcatatttgagtttaattgtactgaccctggacccagataagcagcaactttgtgtctttggggtcacagaacattttggggcagtttaatgtggtaccaaactgaaaataggagctatttatagatggagcagcacttagtgcttcatagaaagcaatgcctatttttaaagttacaaacgcagatatctacatagatatgctttgctgagaagttaggtctgtggtagaccagaaaccacaaattgactttttttcttagaaaatatttctatttgcggtaaatatagtaatatgtaaataatgtacatctgttgatttctggagtgtctgttattcaatgatgtatatactcccacagctcgcatgaaggaacagcctctattgatacttggttgtaaagtgaagtaagattggagggtggatggctgtcagagctcttgcagatactgtgttcactaaataaaaatcacatgtattgttaaaa

SEQ ID NO: 105067 - DNA, 4784 bp, Homo sapiens
agcggaggaggcccggccgcgacccgggccgcgcgctgaggagccgcccggtcgcctgcgcgctcactccggcggcgtccccagcccgcggcccctctgctgccggcccccggctcgccggctgcgggagtggcctcaagatggatgaagacggcggcggcgagggtggtggcgtgcctgaagacctctcattagaagagagagaagaacttctagacattcgtcgaagaaaaaaggaacttattgatgacattgagaggctgaaatatgaaattgcagaggtgatgacagagatcgacaatctaacttccgtagaggagagcaaaacgactcagaggaacaaacagatagccatgggaagaaagaaattcaacatggatcccaaaaagggaattcagtttctaatagaaaatgacctgctacagagttccccagaagacgtcgcccagttcctttataaaggagaaggcctaaataagaccgtcattggggactacctgggtgaaagggatgaatttaatattaaagttcttcaagcctttgttgaactccatgagtttgctgatctcaaccttgtacaagccttaaggcagttcttatggagcttcaggctgcccggggaggcgcagaagattgatcgcatgatggaggctttcgcttctcgctactgcctgtgcaaccccggggtcttccagtccacagacacgtgctacgtgctgtcattcgccatcatcatgctcaacaccagcctccacaaccacaacgtgcgtgacaagcccacggcagaacggttcatcgccatgaaccgcggcatcaacgagggcggggacctccctgaggagctgctgaggaatttgtatgagagcattaagaacgagccatttaagatcccggaggacgacgggaacgacctgacccacaccttcttcaaccccgaccgcgagggctggctcctgaagctgggagggcgtgtgaagacctggaagcgccggtggttcatcctgaccgataactgcctctattactttgaatacacaacagataaggagcccaggggaatcatcccgttggaaaacctcagcatcagggaggtggaggacccccggaaacccaactgttttgagctctacaatcccagccacaaagggcaggtcatcaaggcctgtaagacggaggccgacggccgcgtggtagaggggaaccatgtggtgtaccggatctcagccccgagcccggaggagaaggaggagtggatgaaatccatcaaagccagtatcagcagagatcccttctatgacatgttggcaacgaggaaacgaaggattgccaataaaaaatagctttcctggctaaaagacccaggtaaaagacccaaccccagcagaaagacaccgcgggcggcccctccgcggaaggcgtggcagggaggcagtcgccctgcggtgcaagctgctgctccagagcataccgtggcccaggtggtatccccaaggcctcgtgccgtggctggggtcctgggaggtggtcgccctgcagtgcaagctgctgctccagagcgtaccgtggcccagactgatcctcgaggcctcctgccgtggctggggtcatggtcggctgcgcatgtccagaagcatttccttcctgcgaccatcccggcgcccctagggggagaagccaggacagcagcttccgctgtctccacagcagacacgggacggattccacagacgggagcctcattcgtaccatgccaaacgcattcactcggggcagtattaaccgttctagaaagccactgttttatagcaaaacaggaaaggaaaagctaccagttttttattcagaatttttctcagatatataggattatagcttttatatgcctttttatattctgaaattataacaaaagatactttctaacagtagtatttttagaatggcagctataaagttaactcctggacacaagtatatactgtgcactgaaaaaatatccatctacacagcacccaaggggagggctgggggcaccggcacgggggcagcgtgcagccctgccctgtcaggctgtcagacaagccccggggggcagcaggtgggctcgggacgggctgggggagggacggccatggcacttgggggctccagggtgactcccatgaggcctcccttcaaccaggctttttggccccacaaatactttaagcaaatcattaaaattataacagttaatggtttgggggtgtttaggctgtaactgctaactcctaggaaacagccttttccctggacacagatggtccatacgctgagccacgtgaaactgctgatgttttgtttagatgcacacacatggcagcgtttcatacaggtcagcaggttagaccggcttttgaccatattcatcgctatttaaaacctgtggcaaaatgaacgcttattttacagactttctaatttgaccagatttcttaatgaatagacacagaattaactaaaaacagtctcaccccatgtagtgcgccgtgtcctgagagaggtgccctccctacgaggagggaagaacaggccctggggtgcagaggcccggcacgtagagaacccagatagacgccggtggtggaactggtcaaactccacgcccgcctgggaggttgtcaggttgctgtggatgtaaggataggaggtgcccagtgctccgctcaaggaaggctggatctgggccccacctacagagagggctcagggctggaccgggggcattgtgtgcttgggccgacccgggccggtggcagacgctgttctctgtcgggagatttgcgtccccaggaccctgttacacagtgggctgttgggttggtggctggcttttcctctatggacttcctcttcctgccccacctgcataggcacacacaccttgaatctgcaccctctggagggcatctgtactcctgtgcaaaatgcccagtccagagacaaaacctcagactttgtgcacctaggtttccttctcagcagcggagactgttctttgagttgccttgaagtggaggccgagcggctgcgggcccttcgcctccctgcggctgaccttgatgtagctttaagtcacactagactgcagaggggtccgaggccagaaacccctgtcctgcatcagactttcattcccacgttcttaggctttgttactgatacctcaaatcggaagttttagttctgagaaaggcaagtcagcgttcttgaaatgcctgactggtagatatgcaactctggcctccagtcttccatgaaaataaatgctgcctggacccccacccagaccacacactgacggccggctccggcggtgcccacccctcaggctggcccggcacccaagactggccacagccagctctgtcagcatgttgtgctcggacaagctgtttccttcttctgaccaacccaggtgtgacctggggatgcagagctttctgttttgggtgttgggagaagcagcaggaaggagtcgccagatgatcaagctccccctttgctgtcatctgtgaatgagcttcgccaggtggtgggcacctgggagccatgcagaggctgtggtgctgagttagactccaggtactttgtggtcaaaggaaatcgcctagctccaggctgtgttaggacagtattagcatgaaggctgtgcgaccatcatgcctgctgatccttgaggcaggcctggtccagaaaactctgggtcagtgactgcgcagggccagccgctaccaggacggccctgaaacaggacacatctgttttttgtccctcaccctgggcaggccgcgtcacaatcacagtcctcctcctccccaccctgacgtctgagcgcagggcttgaattgttagtcccaactctggccaaagatacttttttccagagacagaggccaggaggcagtgaggggagccccgcggggaggcggcggcgactgccacagcccttccagcctgtcttgctggccgccctggttcatatttgagtttaattgtactgaccctggacccagataagcagcaactttgtgtctttggggtcacagaacattttggggcagtttaatgtggtaccaaactgaaaataggagctatttatagatggagcagcacttagtgcttcatagaaagcaatgcctatttttaaagttacaaacgcagatatctacatagatatgctttgctgagaagttaggtctgtggtagaccagaaaccacaaattgactttttttcttagaaaatatttctatttgcggtaaatatagtaatatgtaaataatgtacatctgttgatttctggagtgtctgttattcaatgatgtatatactcccacagctcgcatgaaggaacagcctctattgatacttggttgtaaagtgaagtaagattggagggtggatggctgtcagagctcttgcagatactgtgttcactaaataaaaatcacatgtattgttaaaaaaaaaaaaaaaaaaaaaaaaaaaaaaaaaaaaaaaaaaaaataaaaaaaaaaaaaaaaaaaaaaaaaaaaaaaccttgtataccacttaacccaaaaccaattttagattaaaacaccctttatgaacgatccctaaattagggctcattggtccaattccccctatggggcgtgcaattccatttaacgggaccccctttaaaaacgccgtaacttggcaaatccctggggttccccaatttcgcttttgcatccccttttccccttggcgcatatcc

SEQ ID NO: 105068 - DNA, 187 bp, Homo sapiens
tattggtttttccatccctgtgatgctccggtgagaccgcagggaagcttgtcacaagagaactaaaatttctgagtctcaggggaggaaggttaagacccactccccacctcgaaattcttcttttttgacagaggctgaaatatgaaattgcagaggtgatgacagagatcgacaatctaacttc

SEQ ID NO: 105069 - DNA, 4505 bp, Homo sapiens
agcggaggaggcccggccgcgacccgggccgcgcgctgaggagccgcccggtcgcctgcgcgctcactccggcggcgtccccagcccgcggcccctctgctgccggcccccggctcgccggctgcgggagtggcctcaagatggatgaagacggcggcggcgagggtggtggcgtgcctgaagacctctcattagaagagagagaagaacttctagacattcgtcgaagaaaaaaggaacttattgatgacattgagaggctgaaatatgaaattgcagaggtgatgacagagatcgacaatctaacttccgtagaggagagcaaaacgactcagaggaacaaacagatagccatgggaagaaagaaattcaacatggatcccaaaaagggaattcagtttctaatagaaaatgacctgctacagagttccccagaagacgtcgcccagttcctttataaaggagaaggcctaaataagaccgtcattggggactacctgggtgaaagggatgaatttaatattaaagttcttcaagcctttgttgaactccatgagtttgctgatctcaaccttgtacaagccttaaggcagttcttatggagcttcaggctgcccggggaggcgcagaagattgatcgcatgatggaggctttcgcttctcgctactgcctgtgcaaccccggggtcttccagtccacagacacgtgctacgtgctgtcattcgccatcatcatgctcaacaccagcctccacaaccacaacgtgcgtgacaagcccacggcagaacggttcatcgccatgaaccgcggcatcaacgagggcggggacctccctgaggagctgctgaggaatttgtatgagagcattaagaacgagccatttaagatcccggaggacgacgggaacgacctgacccacaccttcttcaaccccgaccgcgagggctggctcctgaagctgggagggcgtgtgaagacctggaagcgccggtggttcatcctgaccgataactgcctctattactttgaatacacaacagataaggagcccaggggaatcatcccgttggaaaacctcagcatcagggaggtggaggacccccggaaacccaactgttttgagctctacaatcccagccacaaagggcaggtcatcaaggcctgtaagacggaggccgacggccgcgtggtagaggggaaccatgtggtgtaccggatctcagccccgagcccggaggagaaggaggagtggatgaaatccatcaaagccagtatcagcagagatcccttctatgacatgttggcaacgaggaaacgaaggattgccaataaaaaatagctttcctggctaaaagacccaggtaaaagacccaaccccagcagaaagacaccgcgggcggcccctccgcggaaggcgtggcagggaggcagtcgccctgcggtgcaagctgctgctccagagcataccgtggcccaggtggtatccccaaggcctcgtgccgtggctggggtcctgggaggtggtcgccctgcagtgcaagctgctgctccagagcgtaccgtggcccagactgatcctcgaggcctcctgccgtggctggggtcatggtcggctgcgcatgtccagaagcatttccttcctgcgaccatcccggcgcccctagggggagaagccaggacagcagcttccgctgtctccacagcagacacgggacggattccacagacgggagcctcattcgtaccatgccaaacgcattcactcggggcagtattaaccgttctagaaagccactgttttatagcaaaacaggaaaggaaaagctaccagttttttattcagaatttttctcagatatataggattatagcttttatatgcctttttatattctgaaattataacaaaagatactttctaacagtagtatttttagaatggcagctataaagttaactcctggacacaagtatatactgtgcactgaaaaaatatccatctacacagcacccaaggggagggctgggggcaccggcacgggggcagcgtgcagccctgccctgtcaggctgtcagacaagccccggggggcagcaggtgggctcgggacgggctgggggagggacggccatggcacttgggggctccagggtgactcccatgaggcctcccttcaaccaggctttttggccccacaaatactttaagcaaatcattaaaattataacagttaatggtttgggggtgtttaggctgtaactgctaactcctaggaaacagccttttccctggacacagatggtccatacgctgagccacgtgaaactgctgatgttttgtttagatgcacacacatggcagcgtttcatacaggtcagcaggttagaccggcttttgaccatattcatcgctatttaaaacctgtggcaaaatgaacgcttattttacagactttctaatttgaccagatttcttaatgaatagacacagaattaactaaaaacagtctcaccccatgtagtgcgccgtgtcctgagagaggtgccctccctacgaggagggaagaacaggccctggggtgcagaggcccggcacgtagagaacccagatagacgccggtggtggaactggtcaaactccacgcccgcctgggaggttgtcaggttgctgtggatgtaaggataggaggtgcccagtgctccgctcaaggaaggctggatctgggccccacctacagagagggctcagggctggaccgggggcattgtgtgcttgggccgacccgggccggtggcagacgctgttctctgtcgggagatttgcgtccccaggaccctgttacacagtgggctgttgggttggtggctggcttttcctctatggacttcctcttcctgccccacctgcataggcacacacaccttgaatctgcaccctctggagggcatctgtactcctgtgcaaaatgcccagtccagagacaaaacctcagactttgtgcacctaggtttccttctcagcagcggagactgttctttgagttgccttgaagtggaggccgagcggctgcgggcccttcgcctccctgcggctgaccttgatgtagctttaagtcacactagactgcagaggggtccgaggccagaaacccctgtcctgcatcagactttcattcccacgttcttaggctttgttactgatacctcaaatcggaagttttagttctgagaaaggcaagtcagcgttcttgaaatgcctgactggtagatatgcaactctggcctccagtcttccatgaaaataaatgctgcctggacccccacccagaccacacactgacggccggctccggcggtgcccacccctcaggctggcccggcacccaagactggccacagccagctctgtcagcatgttgtgctcggacaagctgtttccttcttctgaccaacccaggtgtgacctggggatgcagagctttctgttttgggtgttgggagaagcagcaggaaggagtcgccagatgatcaagctccccctttgctgtcatctgtgaatgagcttcgccaggtggtgggcacctgggagccatgcagaggctgtggtgctgagttagactccaggtactttgtggtcaaaggaaatcgcctagctccaggctgtgttaggacagtattagcatgaaggctgtgcgaccatcatgcctgctgatccttgaggcaggcctggtccagaaaactctgggtcagtgactgcgcagggccagccgctaccaggacggccctgaaacaggacacatctgttttttgtccctcaccctgggcaggccgcgtcacaatcacagtcctcctcctccccaccctgacgtctgagcgcagggcttgaattgttagtcccaactctggccaaagatacttttttccagagacagaggccaggaggcagtgaggggagccccgcggggaggcggcggcgactgccacagcccttccagcctgtcttgctggccgccctggttcatatttgagtttaattgtactgaccctggacccagataagcagcaactttgtgtctttggggtcacagaacattttggggcagtttaatgtggtaccaaactgaaaataggagctatttatagatggagcagcacttagtgcttcatagaaagcaatgcctatttttaaagttacaaacgcagatatctacatagatatgctttgctgagaagttaggtctgtggtagaccagaaaccacaaattgactttttttcttagaaaatatttctatttgcggtaaatatagtaatatgtaaataatgtacatctgttgatttctggagtgtctgttattcaatgatgtatatactcccacagctcgcatgaaggaacagcctctattgatacttggttgtaaagtgaagtaagattggagggtggatggctgtcagagctcttgcagatactgtgttcactaaataaaaatcacatgtattgttaaaa

SEQ ID NO: 105070 - DNA, 4566 bp, Homo sapiens
ctactttatgaatgtaccgcaatttattcgtgttcttactgatgaatatttaggctgtttcctggttataaagagcgctcctatgagtgtctcagatacagtctcaatgggagcatttctttaggataaatacctgcgtatggaattgctgggtggcagcatgtacccacctcaaccttgctggatgttgccaatgtgttctccaaagtagttaattatttttttcttctttcagtgcctgaagacctctcattagaagagagagaagaacttctagacattcgtcgaagaaaaaaggaacttattgatgacattgagaggctgaaatatgaaattgcagaggtgatgacagagatcgacaatctaacttccgtagaggagagcaaaacgactcagaggaacaaacagatagccatgggaagaaagaaattcaacatggatcccaaaaagggaattcagtttctaatagaaaatgacctgctacagagttccccagaagacgtcgcccagttcctttataaaggagaaggcctaaataagaccgtcattggggactacctgggtgaaagggatgaatttaatattaaagttcttcaagcctttgttgaactccatgagtttgctgatctcaaccttgtacaagccttaaggcagttcttatggagcttcaggctgcccggggaggcgcagaagattgatcgcatgatggaggctttcgcttctcgctactgcctgtgcaaccccggggtcttccagtccacagacacgtgctacgtgctgtcattcgccatcatcatgctcaacaccagcctccacaaccacaacgtgcgtgacaagcccacggcagaacggttcatcgccatgaaccgcggcatcaacgagggcggggacctccctgaggagctgctgaggaatttgtatgagagcattaagaacgagccatttaagatcccggaggacgacgggaacgacctgacccacaccttcttcaaccccgaccgcgagggctggctcctgaagctgggagggcgtgtgaagacctggaagcgccggtggttcatcctgaccgataactgcctctattactttgaatacacaacagataaggagcccaggggaatcatcccgttggaaaacctcagcatcagggaggtggaggacccccggaaacccaactgttttgagctctacaatcccagccacaaagggcaggtcatcaaggcctgtaagacggaggccgacggccgcgtggtagaggggaaccatgtggtgtaccggatctcagccccgagcccggaggagaaggaggagtggatgaaatccatcaaagccagtatcagcagagatcccttctatgacatgttggcaacgaggaaacgaaggattgccaataaaaaatagctttcctggctaaaagacccaggtaaaagacccaaccccagcagaaagacaccgcgggcggcccctccgcggaaggcgtggcagggaggcagtcgccctgcggtgcaagctgctgctccagagcataccgtggcccaggtggtatccccaaggcctcgtgccgtggctggggtcctgggaggtggtcgccctgcagtgcaagctgctgctccagagcgtaccgtggcccagactgatcctcgaggcctcctgccgtggctggggtcatggtcggctgcgcatgtccagaagcatttccttcctgcgaccatcccggcgcccctagggggagaagccaggacagcagcttccgctgtctccacagcagacacgggacggattccacagacgggagcctcattcgtaccatgccaaacgcattcactcggggcagtattaaccgttctagaaagccactgttttatagcaaaacaggaaaggaaaagctaccagttttttattcagaatttttctcagatatataggattatagcttttatatgcctttttatattctgaaattataacaaaagatactttctaacagtagtatttttagaatggcagctataaagttaactcctggacacaagtatatactgtgcactgaaaaaatatccatctacacagcacccaaggggagggctgggggcaccggcacgggggcagcgtgcagccctgccctgtcaggctgtcagacaagccccggggggcagcaggtgggctcgggacgggctgggggagggacggccatggcacttgggggctccagggtgactcccatgaggcctcccttcaaccaggctttttggccccacaaatactttaagcaaatcattaaaattataacagttaatggtttgggggtgtttaggctgtaactgctaactcctaggaaacagccttttccctggacacagatggtccatacgctgagccacgtgaaactgctgatgttttgtttagatgcacacacatggcagcgtttcatacaggtcagcaggttagaccggcttttgaccatattcatcgctatttaaaacctgtggcaaaatgaacgcttattttacagactttctaatttgaccagatttcttaatgaatagacacagaattaactaaaaacagtctcaccccatgtagtgcgccgtgtcctgagagaggtgccctccctacgaggagggaagaacaggccctggggtgcagaggcccggcacgtagagaacccagatagacgccggtggtggaactggtcaaactccacgcccgcctgggaggttgtcaggttgctgtggatgtaaggataggaggtgcccagtgctccgctcaaggaaggctggatctgggccccacctacagagagggctcagggctggaccgggggcattgtgtgcttgggccgacccgggccggtggcagacgctgttctctgtcgggagatttgcgtccccaggaccctgttacacagtgggctgttgggttggtggctggcttttcctctatggacttcctcttcctgccccacctgcataggcacacacaccttgaatctgcaccctctggagggcatctgtactcctgtgcaaaatgcccagtccagagacaaaacctcagactttgtgcacctaggtttccttctcagcagcggagactgttctttgagttgccttgaagtggaggccgagcggctgcgggcccttcgcctccctgcggctgaccttgatgtagctttaagtcacactagactgcagaggggtccgaggccagaaacccctgtcctgcatcagactttcattcccacgttcttaggctttgttactgatacctcaaatcggaagttttagttctgagaaaggcaagtcagcgttcttgaaatgcctgactggtagatatgcaactctggcctccagtcttccatgaaaataaatgctgcctggacccccacccagaccacacactgacggccggctccggcggtgcccacccctcaggctggcccggcacccaagactggccacagccagctctgtcagcatgttgtgctcggacaagctgtttccttcttctgaccaacccaggtgtgacctggggatgcagagctttctgttttgggtgttgggagaagcagcaggaaggagtcgccagatgatcaagctccccctttgctgtcatctgtgaatgagcttcgccaggtggtgggcacctgggagccatgcagaggctgtggtgctgagttagactccaggtactttgtggtcaaaggaaatcgcctagctccaggctgtgttaggacagtattagcatgaaggctgtgcgaccatcatgcctgctgatccttgaggcaggcctggtccagaaaactctgggtcagtgactgcgcagggccagccgctaccaggacggccctgaaacaggacacatctgttttttgtccctcaccctgggcaggccgcgtcacaatcacagtcctcctcctccccaccctgacgtctgagcgcagggcttgaattgttagtcccaactctggccaaagatacttttttccagagacagaggccaggaggcagtgaggggagccccgcggggaggcggcggcgactgccacagcccttccagcctgtcttgctggccgccctggttcatatttgagtttaattgtactgaccctggacccagataagcagcaactttgtgtctttggggtcacagaacattttggggcagtttaatgtggtaccaaactgaaaataggagctatttatagatggagcagcacttagtgcttcatagaaagcaatgcctatttttaaagttacaaacgcagatatctacatagatatgctttgctgagaagttaggtctgtggtagaccagaaaccacaaattgactttttttcttagaaaatatttctatttgcggtaaatatagtaatatgtaaataatgtacatctgttgatttctggagtgtctgttattcaatgatgtatatactcccacagctcgcatgaaggaacagcctctattgatacttggttgtaaagtgaagtaagattggagggtggatggctgtcagagctcttgcagatactgtgttcactaaataaaaatcacatgtattgttaaaa

SEQ ID NO: 105071 - DNA, 1726 bp, Homo sapiens
gcctgaatcttcaggacccctatctattccatcctatccattttgctgattgagtcgatatgtattgcagcctcttacataggagcataagatgacttttggattgttaatactgatttaaatagctgaagttctcctaataaagcattcccaaggagagagaaagtttgtctactgggggtaaaaatatcagatggtgcacattaaaagggagatgagatttgtcggagacagatttcagaatccttttagatgatccaattcaagaaaaccctctataaaatttaataaactgtataagttaactataatattttatactttctttttggtgtcttaaaaatttaaagaagcgaggaacatgccatttggtgagtaccgttggaagctattttaatttctaggaaaagccccaaatatcactccaaatagattttgtttgcagatctcagttcagaatgcacacacacacacacacacacacacacacacacacacacacacacagagatgtatttatctttccaaattggattctggtttcagagatagagagttggtataaataattgaaaggataaatctaaaaccccctgacagtccgccaaattcaagaacagaagtggttgccaactctctaacaacaatgtttgggaagctgattccaaagtagctgaggatgaggtcataagcatactgtgaaacccaagattcttcttccctggtagaattacaatagttactcttgataaatataagtattccatgtcttgccctctttcctcactctctgcttatccttttagacctaagtttcattggaaatagcctgaattagaagaaagcccatccgaatctttattagccccctctaatgattagtttccaggctgcgttcatacctttgacctctcagtgtcaaagtcctacctaggcctccccacaacagagagggccgtaacagcaatccctgcccctcctttacctcccagcctcttgcagaggagcccagtgataacacatgtgaagttctttggctgtcctcttgtagaaggtgctgcagtgcaaagtattaatacggtcttagacaaaataactgtcatgatttgggaccagtttggttgagcttgtcagaagacatttcatttgtttcatttctgcacttctctatgaatttgggatactatatttctgtgaaggacttattgtatagacaactcaaaaaggaaagaaactttccagtattaccacttcttcctggaatatagctgtagtatttctcactagtattattagatacctgtgtacagaaagtatgcagttattcaggttaatgtttcatattaaagaatgtatttgtaaaatgtaacatgatcagtagttaccttttttcaagctctgaagaagttcagattacgtgttagacttaagttacagtgaaaactgttttaatactacttttgtggctagcaaaggttgtgcatctatttaaaattatttacaggatgctctaaataaggggcattaaagataggtttagctcttaattttagaaattgtgacactactgatgtctgtcatacagttattcttcagaagttctctgagatgtcaaatataatttttgtttaattcagagataagtaacacctgctctattgattcactattacaacaaaccctaattttgtcattaaatattttaactctgtgaaaaaaaaaaaat

SEQ ID NO: 105072 - DNA, 1712 bp, Homo sapiens
gcctgaatcttcaggacccctatctattccatcctatccattttgctgattgagtcgatatgtattgcagcctcttacataggagcataagatgacttttggattgttaatactgatttaaatagctgaagttctcctaataaagcattcccaaggagagagaaagtttgtctactgggggtaaaaatatcagatggtgcacattaaaagggagatgagatttgtcggagacagatttcagaatccttttagatgatccaattcaagaaaaccctctataaaatttaataaactgtataagttaactataatattttatactttctttttggtgtcttaaaaatttaaagaagcgaggaacatgccatttggtgagtaccgttggaagctattttaatttctaggaaaagccccaaatatcactccaaatagattttgtttgcagatctcagttcagaatgcacacacacacacacacacacacacacacacagagatgtatttatctttccaaattggattctggtttcagagatagagagttggtataaataattgaaaggataaatctaaaaccccctgacagtccgccaaattcaagaacagaagtggttgccaactctctaacaacaatgtttgggaagctgattccaaagtagctgaggatgaggtcataagcatactgtgaaacccaagattcttcttccctggtagaattacaatagttactcttgataaatataagtattccatgtcttgccctctttcctcactctctgcttatccttttagacctaagtttcattggaaatagcctgaattagaagaaagcccatccgaatctttattagccccctctaatgattagtttccaggctgcgttcatacctttgacctctcagtgtcaaagtcctacctaggcctccccacaacagagagggccgtaacagcaatccctgcccctcctttacctcccagcctcttgcagaggagcccagtgataacacatgtgaagttctttggctgtcctcttgtagaaggtgctgcagtgcaaagtattaatacggtcttagacaaaataactgtcatgatttgggaccagtttggttgagcttgtcagaagacatttcatttgtttcatttctgcacttctctatgaatttgggatactatatttctgtgaaggacttattgtatagacaactcaaaaaggaaagaaactttccagtattaccacttcttcctggaatatagctgtagtatttctcactagtattattagatacctgtgtacagaaagtatgcagttattcaggttaatgtttcatattaaagaatgtatttgtaaaatgtaacatgatcagtagttaccttttttcaagctctgaagaagttcagattacgtgttagacttaagttacagtgaaaactgttttaatactacttttgtggctagcaaaggttgtgcatctatttaaaattatttacaggatgctctaaataaggggcattaaagataggtttagctcttaattttagaaattgtgacactactgatgtctgtcatacagttattcttcagaagttctctgagatgtcaaatataatttttgtttaattcagagataagtaacacctgctctattgattcactattacaacaaaccctaattttgtcattaaatattttaactctgtgaaaaaaaaaaaat

SEQ ID NO: 105073 - DNA, 201 bp, Homo sapiens
ccaggcatccaggatgtgtggccacttcagtgcccaggacatgcagcaggcctcaagcgggctgggagtgcaggtctcccaggtccaggcccacaccgagcacttccagaggtccagtggagcagttcagaggcagcagctgggtgcaaggatcccaggttgaggtctcaccacaagccaggtatctcccagtctgtcatc

SEQ ID NO: 105074 - DNA, 474 bp, Homo sapiens
ggaaagtgccaggcacggagagagggcgaattccatccactggggagctctggggggccctgtctgtggaggccctgtcatgtgaaagccgcaggaatacttgttacgttgtgtcacgtgaatggttaccctgggtgaggcggtgggggagaggaaggatgctagttacatgctggcaatgtcccacccgcgaaaagcccctgcaccgtacgcttaggcacgacgcacccactctttctaagtgtgtgggtatttcagtaaaatgtttaagaagtcagccaggtgggcagaggccacaggggcgttcctgcaggctgaggggaagagtgagatttccttctaagtgaaactggaagactgcagggttttgagctgggaagtgatttcgcatcatttatattttcaaagcatcaccttggcctttccagcatgttagaaagcacgtcccacagtcggcacgttagaaagcatgcc

SEQ ID NO: 105075 - DNA, 368 bp, Homo sapiens
gaatcaggcggtcacacctgtgttctccgcacactttctgcacttggctttcaggacaccgggggatcctggttcacctccaacctcacttgccccttcagtcgtcctgccaagtctcatggaattccgttcccgagccgacaaccctcatgttcgcatctctgggcatcccttccctcccaaacatcacatgtgtatccacgctcacttgacttcccatttggatgttgaccaattgtctcccacttgccctaaacagaactttgggtcccctcttcccaccccctcattctccatcaatctgttcctcctcccacagtcctcccctcccaggggatggtgcctgccacccacagaggtcacagcct

SEQ ID NO: 105076 - DNA, 361 bp, Homo sapiens
ttgaccccatgtaattaattccaaattaactaggtatacacatttctgaagaactcttactggatgacaaatttgggcctggttctccctggcttgcactttacttccactgcctttgttttgttgtgcttccctttcccaacccttcatgtttccttcaacccagtgagtctttgccagagattgagttcatcaaggcacgcatccaagtcaagtttaagtcccatggtgcatatttcttgtagaatgtaagaggggatgaccaatgactgccactggtactgcatgtctctaggtggagaatgtgaccttctctggaagcaacagatgaaggtgaaacattgtcaccttcaccgtccgg

SEQ ID NO: 105077 - DNA, 398 bp, Homo sapiens
gattccatgtgacctctttccagaggcaaccaggcatcattcacatattccaaaaacatctgttctctggtacactgcccagggccctctatcatggtgaatcctccagggtcacataaataaaaccagcacagcaccttgcccaacagaggaagccaccagcatttgcatgagggacaaagtgaggaaatgtctaagggaggcaagggcagaaacaccctctatctgcccactgagagaacacctgaagccacactttgcacatcacaacaggaaaggtgccaacctcagagagggaagcaacacgctgcatatgaacatattactaagctgtctttttaaaaatgtccccatacagtaagtctgtttccatttgcctaaaagttaatttggggcag

SEQ ID NO: 105078 - DNA, 676 bp, Homo sapiens
cagaccctctgttcctcagcatcctctccccagcctccacctggagcctctgggctcctttctgggtgactccctctattttttgagacggagtcttgctctgtctcccaggctggagtccagtggtgtgatctcagctcactgcagcctccgcctcctgggttcaagtgattctcgtgcctcagcctcccgagcagctgagactacaggctaattaccacactggctaatttttgtatttttagtagagacggggtttcaccatgttggccaggctggtctcaaactcctgagctcaggtgatcctcccacctcagcctcccaaagtgctgggattacaggcgtgagccattgcaccctgcctgggcgactctcctttgcctgcctcttcccttcctgtgccccactcctcagcctcttctcctcacaccatgccttcctctcctcaggcaccaggtgcactgcttagtccctgcccccacccaggtctccattctgagctccagtcacccacacacgcttccccgggcatccccaggctcctcgaatgcgtgtgtccagacataatgctcccccgacacgctgccccagccggtacgaggctgccccagctgctgtctccctcaggaagggtcgcccacccccagccttcccaagcccctccgtgcccctgtct

SEQ ID NO: 105079 - DNA, 274 bp, Homo sapiens
cagggaggaattgaggagatctgctatcttattcacctctagcagataagtgctctcagagagctacaaaggcaaaatccccaaggaacctacaataaagacacctgggtcatcttgtggagcgatgccagctgaaacccagaggctgtttctgtgaatatataaaatgacctggagaatccaacttcactctgaacacactgatcactttttccaaatgtcaaatgaaaacctgaaatttcaaggtaaagatctggaaccttctatctcttag

SEQ ID NO: 105080 - DNA, 262 bp, Homo sapiens
ggagacagagtgagactccatttcaaaaataaatgaataaaaatgaaaataaggccaggaggccaggtggggtggctcacgcctgtaatcccagcaatttgggaggctgaggcgggcagatcacaaggtcaagagatcgagaccattccggccaacatggtgaaaccccgtctgtactaaatatacagaaattagctgggcacggtggtgtgcgcctgtagtcccagctactcgggaggctgaggcaggagaatggcttgaa

SEQ ID NO: 105081 - DNA, 538 bp, Homo sapiens
gtggttgcctacttgggggtggggaatccctctccacgggctcagctgtccaatctcaggggatctctaggacaggagctgatgtaaacagtcgccctattccttgctgtctttggccctggagaaggaggagggagctggggagggtctccacttcccagacaatctctaagcagccaggacatgggtgagatgagtgagatactgacttctgggacagaatttgagagggtgccaaaaaactcagtaatcaagataaataggccgggcgcagtggctcacgtctgtaatcccagcactttgggaggccggatcacttgaggtcaagagttcgagaccagcctggccaagatggtgaaaccccatctctactaaaaatacaaaaattagcccagtgtggtggcgctagcctgtaatcccagccactcaggaggctgaggcaagagaattgcttgacccaggaggcagaggttgcagtgagccgagatcatgccactgtactccagcctggacaacagagggagactatctcaaaaaa

SEQ ID NO: 105082 - DNA, 378 bp, Homo sapiens
ccgagtagctaggattacaggagcacagcaccatacccagctaatttttgtatttttagtagagacggggtttcaccatattggccaggctggtctcaaaggcctgacctcagatgatccacccacattggcctcccaaagtgctgggattacaggaatgagacactgtgcccagccaggaaggatagacttttaacaaatggtgctggaacaattggttaatcacattttctctaaagtagagttggactcctacttggtactggacacaaaaatcaagtctggatgggacttaaatgtgaaaggcaaaattatgaaacatttagaagataacacagtctgctttttgatcttggagtagggaaggatttctcaaat

SEQ ID NO: 105083 - DNA, 157 bp, Homo sapiens
aaatgaaaagggagcttaggggtgggagaggtatcggcaggggcagcgctgccgccggggcctggggctgacccgtctgacttcccgtccgtgccgagcccactcgagccgcagccatgtctggggacgagatgatttttgatcctactatgagcaa

SEQ ID NO: 105084 - DNA, 822 bp, Homo sapiens
agtggtggtttcccctgttctcgctctttcctgctgccttgtgaggaaggtacttgcttctcctttgccttgtgccgtgattgtaagtttcctgaggcctccccaaccatgcagaactgagcagacaattgagaggcctggctcatggatgggtttgaaccacctcaggactgaagatgagcggctcagtttcactaacaacaagaacagtgacaaattccctgcccggcccaagctctgtggtccttatgcaggtagagtcctcatgctgaatgtttgcaagctgactcttcaataagaccgtgagctccttgagaaaggaattgggtctctgtgcagtgtatcacatctacctcaatgctctgcttagaggaagtgtttgaaaattttttgtgtgataaataataatactaatccagttaagatatactgccctcggtatgaaaaactctatcccaaggtggagcagctttgaaaatgtggttggacgaaaatgaaatttcagatgtgtgtgtctcagcattgatttttctatttgtaataacacaccctggcatatctcctttgatatcaagaggataaaatgtccctaacagcatgctcttcattctgggatgccagtggcacccctgtcccagatgtgacaaccaaaaatgatgtcagacattgctgaattgtcccctggaggaggagaaaaatcaacccctttgagaactgctgggcagctctaaaggtcatccctaagttcagggtgaggagatgacctacccttctgccccgcaacgccatcctacatctgaaattcttcttaagggcatggtg

SEQ ID NO: 105085 - DNA, 316 bp, Homo sapiens
ctcgggactagcagacaagcataaccatttgccactgggagcagggcctggcacctgcctggagcggagagatctgagagtcatgaagttcagccctgcttcatgtacagatgagaaactgaggccctgagaagtaagcaggcccttttgtccagcttccattcatctttatagagggttatcttttatcttacaaagatcctttttgatatcctcaagatggttaatggagaacccctagctctcactgtttaatcattcaatttcttaatgtttgttttaattgaattgccaccaacttgactaacttttattg

SEQ ID NO: 105086 - DNA, 296 bp, Homo sapiens
ctgcatcatggtgggaaccttagaactccagccacagggaagtaaattctgccaacgggtgagcttggaagagaaccctaaacctcagatgagaccacagccctgacaataccttatctcaacttcacgagatcctgagtagaggacccagttattggactcttggctacagaaattgtgagatactcaggaagaatagttttaaactgctgaatttgggggtaatgtgttactcagcaacagaaaattaatacatttgaaacctcacttacctttcaaatctcaccagaggagat

SEQ ID NO: 105087 - DNA, 315 bp, Homo sapiens
gggacgatcaccttgactaaaacaaaaggtccaaaaagtcagcaagtcaagtgtctagtgattttctgtatctctgtctctctctcgttctctctctggaagtcttttgacttttgaatgtttctgggaagccataaacagttacctttgttttgcagattaggaaaaggggtaaagaaatggatgagtggccaggcacggaggctcatgcctgtaatcttggcactttgggaagctgaggaaggaggatctcttgagccccagagttcaccaccagcctgggcaacagagtgggaccttgtctctacaaaaatt

SEQ ID NO: 105088 - DNA, 351 bp, Homo sapiens
ctagaaaatcaaagatgaataagacagtttcccatatgaggaactagagtctctacaaggccataggctatagtagaaaagagggaaggtaatagtcattgtgcctggacatgtgtgatgccaagggtagtcatctaatccatcctgagggtcatggaggttttgaagagctgactagagataacatgtcctctaggggtatgttatagttttcttgataaataaaagtagaaatcatgatcagacagaggaaaggtcttatgccaaggcctgagatggtaaagaatatacctacagacttattcagagggcatgtgatattaagacacacacaaactattttcaagttct

SEQ ID NO: 105089 - DNA, 90 bp, Homo sapiens
gtgtcctccgcctggactttcccaaagtgtccccaggcggcatctctgaaggctttggggctgtcaggcttgcggtcaccacctccccag

SEQ ID NO: 105090 - DNA, 831 bp, Homo sapiens
agtgagccaagattgtgccactgcactccagcctgggtgatagagtgagactctgtctcaaaaaaaaaaaaaaaattctgataattaaggcaacttaaagtaaggatcattttcataaatggtctccaagttgcttttaaagaggatgttaccaaaatgttttcagcactggcaccaacttaattagaaatatacaatttctctagatgactacttcgaaaaggatatccttcaactggacatggaaattttgtcatgtttattaaaaattcctttattatttcctttattattttcatatagtcattcatatactgcaaatctagttataattattataataagccacacttttattaaagtgctcaataatacatctacaaaatcacctacaaagctgatatgctgaattttagcttcattagatacgtaacaagcatgctgatgaaattgttaggatttttacctaaaaccctaaaactctatatgtacatttaaaattaactggtgataccttagatgtaataaaaacatgttgttgttctcctttaaaaaacaaaaaacaaccaacaaaacacaaacaagacacaaacaaaacaaagacaacagaccaacatccgaccccacaacaacacaacacaaccgaggcggcggggccgacaaaatcaccgaggggccacaaaccagcaccccctctgaaagaaagcccacaaaaacgataacgagaagacgcgcgcccaaaccacctgagaaaaccctcgcgtgggagaccccctgccgggatgggcccacacactgcccgcacaactggtggaccgctcgcacgcgata

SEQ ID NO: 105091 - DNA, 719 bp, Homo sapiens
gtccaccactttgttaggtgtgtgatcctgggcaaatcacttaccttccttgtatcttattcctccatctataaaatggagctacctcatagggttgtgaagaatacattattgtaacaatactgggcacacagtgcacagtttcccaattattattatacttacagttttgttttctgtttttttttttgacaaggtctccctctgttgctcaggctggagtgtagtgatgtgaccataggtcacctcagccttgaactcctgggctcaagagatgctcctgcctcaacctcccctatagttaggaatacaggcatgtgccaccatgcccgactaagtttttatttttattttttgtaaacatggggtttcactattttgctcaggctggtcttgcggtcctggcctcaagcgatcatcctgcctcagcttctctaagtgctgggaatacaggtgtgagccaccatgcctggcctatacttaaaaagtttttattaggattggttgctatattatatcaagtttaaaaactccatcattgtaattttatgagttatggttttttctttttgtaattcattttcttgacaagtttgcaaatatttgcaatttccttgtacttttcaagtaaaatctatttgttcatagtgaatttttattaagtacagaagtagattcaatttggtaatgctttgctagctttgcaaaagaatttggaa

SEQ ID NO: 105092 - DNA, 137 bp, Homo sapiens
ctcaacaatcacaggacttacacaatatcaaacaattccagctcatgaaccatcagacagtgatggactcccctgctctgccagccatggctacagctttgactggtcaagaggctgattgcagtaactttcttctg

SEQ ID NO: 105093 - DNA, 1227 bp, Homo sapiens
agcggagtccagtcccaagatggcggccaccatgaagaaggcggctgcagaagatgtcaatgttactttcgaagatcaacaaaagataaacaaatttgcacggaatacaagtagaatcacagagctgaaggaagaaatagaagtaaaaaagaaacaactccaaaacctagaagatgcttgtgatgacatcatgcttgcagatgatgattgcttaatgataccttatcaaattggtgatgtcttcattagccattctcaagaagaaacgcaagaaatgttagaagaagcaaagaaaaatttgcaagaagaaattgacgccttagaatccagagtggaatcaattcagcgagtgttagcagatttgaaagttcagttgtatgcaaaattcgggagcaacataaaccttgaagctgatgaaagttaaacattttataatactttttttatttgtttaataaacttgaatattgtttaaaatgataattttccttcttcaaatgacatggaaagcaaaactttcttttttaaaaattttcatttatttaatggaaacttgcccattttcacatgtctgcttatttattttatatttttaaaagaagacagtattcacctatgtattttgcataacgattatatcaagtctaggggcttcatgtcatgttattaaaatcagttaagcaatcttttatgtttctatattatttagaatatttgttgttgcaattttcacataagaaaatttaacagttgtgtcatgttgtttctgtctgattttaattgctgtctaatgacggggaaagcacgatgaaaagatgtacaatcctgcatccttgcttatttcacaactaaagctttgtcatagacttcaaaatatatatgtatatattttatttaaatatatgttacatattatatttaaacatacatatttaacattttttacatatctatcaatatcagagatttgggtaaaagaatgggtaatgtttaaacatgtggaggcatgtggagctttatacaaacagggcagaaccacagaagaacgttttagaaaccaagagatgtgcagaaagaaatgtttagtgttttttcgttttaaattttagattttattttagtgctttgtaattaattggggtttatattgataaagatgtggaagttaaacagctatgtatgtaaaagtaaggcttatttcttaaataaaggatgcatttcttccca

SEQ ID NO: 105094 - DNA, 477 bp, Homo sapiens
agcggagtccagtcccaagatggcggccaccatgaagaaggcggctgcagaagatgtcaatgttactttcgaagatcaacaaaagataaacaaatttgcacggaatacaagtagaatcacagagctgaaggaagaaatagaagtaaaaaagaaacaactccaaaacctagaagatgcttgtgatgacatcatgcttgcagatgatgattgcttaatgataccttatcaaattggtgatgtcttcattagccattctcaagaagaaacgcaagaaatgttagaagaagcaaagaaaaatttgcaagaagaaattgacgccttagaatccagagtggaatcaattcagcgagtgttagcagatttgaaagttcagttgtatgcaaaattcgggagcaacataaaccttgaagctgatgaaagttaaacattttataatactttttttatttgtttaataaacttgaatattgtttaaaa

SEQ ID NO: 105095 - DNA, 708 bp, Homo sapiens
agcggagtccagtcccaagatggcggccaccatgaagaaggcggctgcagaagatgtcaatgttactttcgaagatcaacaaaagataaacaaatttgcacggaatacaagtagaatcacagagctgaaggaagaaatagaagtaaaaaagaaacaactccaaaacctagaagatgcttgtgatgacatcatgcttgcagatgatgattgcttaatgataccttatcaaattggtgatgtcttcattagccattctcaagaagaaacgcaagaaatgttagaagaagcaaagaaaaatttgcaagaagaaattgacgccttagaatccagagtggaatcaattcagcgagtgttagcagatttgaaagttcagttgtatgcaaaattcgggagcaacataaaccttgaagctgatgaaagttaaacattttataatactttttttatttgtttaataaacttgaatattgtttaaaatgataattttccttcttcaaatgacatggaaagcaaaactttcttttttaaaaattttcatttatttaatggaaacttgcccattttcacatgtctgcttatttattttatatttttaaaagaagacagtattcacctatgtattttgcataacgattatatcaagtctaggggcttcatgtcatgttattaaaatcagttaagcatcaaaaaaaaaaaatctcaagcgct

SEQ ID NO: 105096 - DNA, 1230 bp, Homo sapiens
  misc_feature (811)..(811): n is a, c, g, or t
cgccctgagcgttagcggctcggcacctggccagccgaggcggggcgccggggctggggccgggagcctcgaaggacgcaggtccgcctcccgcgatgccgagggtgcccccggggagtctgaggaacctgcagccccggcctcgcccctgaggtgtgggaagccgaaggtcccgttgagtgtggttggccttgactcgggcgttgcaccggcatgatcgcattagcctcactggttatgggtagctgctgctgggagcgtggttacgggtagagaaacttagacacagagcagttagaggccctaaagtgactcagctagtaagaagcagagctggagttcaaactcaggctgcagaagatgtcaatgttactttcgaagatcaacaaaagataaacaaatttgcacggaatacaagtagaatcacagagctgaaggaagaaatagaagtaaaaaagaaacaactccaaaacctagaagatgcttgtgatgacatcatgcttgcagatgatgattgcttaatgataccttatcaaattggtgatgtcttcattagccattctcaagaagaaacgcaagaaatgttagaagaagcaaagaaaaatttgcaagaagaaattgacgccttagaatccagagtggaatcaattcagcgagtgttagcagatttgaaagttcagttgtatgcaaaattcgggagcaacataaaccttgaagctgatgaaagttaaacattttataatactttttttatttgtttaataaacttgaatattgtttaaaaaaaaaaaaaaaaaaaaaaaaaaaaaanagaaaaaaaaaaaagaaaaaaaaaaaaaaaaaaaaaaaaaaggggggggggggaaaaaaaaaccccgggggggggcccattcgcccccgctttttttggaaaaaggggggcccccaaatgggggggggggaaaaaaaagacagagggaggggggaggcttaaacaagggtgtgtggggagaaaaaagcgcggcgtgtggtctctttgggggaagagcccccaacttgtgcgcgtgccgatatggcgaccaccacccaaggattaagaggcccgggagaataaaaacttggggggttgatgggggacccacggctattgtggggggaggattggtctggtatttatacggttcgtagtatgaaacataagaatgtagtagtatagagcgcgaggagaagagaacgtgttgagaagatgtc

SEQ ID NO: 105097 - DNA, 756 bp, Homo sapiens
tatcacctcaaatacttagaaaatatctgagttttcactgggcaaagctgctctttcttacaaatgaggcactttttaccactcttttccaaagtttagctccagaggcctcaaagttagtgaaaatttctgccagatttggatcataagttgttcttcttaattattggtggttggtggtgtgagtttctatcatttcctgtagtctcatagttatttttgttgttggaaaaagctgggttagaagccagcaggcccaggataaactatttatagaagtctttgtatttggttctttgttaggaaataatttagacagtaattttttactattttttagatcagcagaaactgagaaaacaaacttgatttattctgtgataagcagatatggaccatgaattaaaaatgcccacattcagacatttagatctaattatcagtgttacttagctgcctgtccaagtttagaaggttcttgacctaaaattcttcccaaatattatttcagacacagatgctcagaaatcatcctattgaatagaattaatttaaaatattttttttccagaaaaatttgcaagaagaaattgacgccttagaatccagagtggaatcaattcagcgagtgttagcagatttgaaagttcagttgtatgcaaaattcgggagcaacataaaccttgaagctgatgaaagttaaacattttataatactttttttatttgtttaataaacttgaatattgtttaaaa

SEQ ID NO: 105098 - DNA, 1534 bp, Homo sapiens
cgccctgagcgttagcggctcggcacctggccagccgaggcggggcgccggggctggggccgggagcctcgaaggacgcaggtccgcctcccgcgatgccgagggtgcccccggggagtctgaggaacctgcagccccggcctcgcccctgaggtgtgggaagccgaaggtcccgttgagtgtggttggccttgactcgggcgttgcaccggcatgatcgcattagcctcactggttatgggtagctgctgctgggagcgtggttacgggtagagaaacttagacacagagcagttagaggccctaaagtgactcagctagtaagaagcagagctggagttcaaactcaggctgcagaagatgtcaatgttactttcgaagatcaacaaaagataaacaaatttgcacggaatacaagtagaatcacagagctgaaggaagaaatagaagtaaaaaagaaacaactccaaaacctagaagatgcttgtgatgacatcatgcttgcagatgatgattgcttaatgataccttatcaaattggtgatgtcttcattagccattctcaagaagaaacgcaagaaatgttagaagaagcaaagaaaaatttgcaagaagaaattgacgccttagaatccagagtggaatcaattcagcgagtgttagcagatttgaaagttcagttgtatgcaaaattcgggagcaacataaaccttgaagctgatgaaagttaaacattttataatactttttttatttgtttaataaacttgaatattgtttaaaatgataattttccttcttcaaatgacatggaaagcaaaactttcttttttaaaaattttcatttatttaatggaaacttgcccattttcacatgtctgcttatttattttatatttttaaaagaagacagtattcacctatgtattttgcataacgattatatcaagtctaggggcttcatgtcatgttattaaaatcagttaagcaatcttttatgtttctatattatttagaatatttgttgttgcaattttcacataagaaaatttaacagttgtgtcatgttgtttctgtctgattttaattgctgtctaatgacggggaaagcacgatgaaaagatgtacaatcctgcatccttgcttatttcacaactaaagctttgtcatagacttcaaaatatatatgtatatattttatttaaatatatgttacatattatatttaaacatacatatttaacattttttacatatctatcaatatcagagatttgggtaaaagaatgggtaatgtttaaacatgtggaggcatgtggagctttatacaaacagggcagaaccacagaagaacgttttagaaaccaagagatgtgcagaaagaaatgtttagtgttttttcgttttaaattttagattttattttagtgctttgtaattaattggggtttatattgataaagatgtggaagttaaacagctatgtatgtaaaagtaaggcttatttcttaaataaaggatgcatttcttccca

SEQ ID NO: 105099 - DNA, 1337 bp, Homo sapiens
cgccctgagcgttagcggctcggcacctggccagccgaggcggggcgccggggctggggccgggagcctcgaaggacgcaggtccgcctcccgcgatgccgagggtgcccccggggagtctgaggaacctgcagccccggcctcgcccctgaggctgcagaagatgtcaatgttactttcgaagatcaacaaaagataaacaaatttgcacggaatacaagtagaatcacagagctgaaggaagaaatagaagtaaaaaagaaacaactccaaaacctagaagatgcttgtgatgacatcatgcttgcagatgatgattgcttaatgataccttatcaaattggtgatgtcttcattagccattctcaagaagaaacgcaagaaatgttagaagaagcaaagaaaaatttgcaagaagaaattgacgccttagaatccagagtggaatcaattcagcgagtgttagcagatttgaaagttcagttgtatgcaaaattcgggagcaacataaaccttgaagctgatgaaagttaaacattttataatactttttttatttgtttaataaacttgaatattgtttaaaatgataattttccttcttcaaatgacatggaaagcaaaactttcttttttaaaaattttcatttatttaatggaaacttgcccattttcacatgtctgcttatttattttatatttttaaaagaagacagtattcacctatgtattttgcataacgattatatcaagtctaggggcttcatgtcatgttattaaaatcagttaagcaatcttttatgtttctatattatttagaatatttgttgttgcaattttcacataagaaaatttaacagttgtgtcatgttgtttctgtctgattttaattgctgtctaatgacggggaaagcacgatgaaaagatgtacaatcctgcatccttgcttatttcacaactaaagctttgtcatagacttcaaaatatatatgtatatattttatttaaatatatgttacatattatatttaaacatacatatttaacattttttacatatctatcaatatcagagatttgggtaaaagaatgggtaatgtttaaacatgtggaggcatgtggagctttatacaaacagggcagaaccacagaagaacgttttagaaaccaagagatgtgcagaaagaaatgtttagtgttttttcgttttaaattttagattttattttagtgctttgtaattaattggggtttatattgataaagatgtggaagttaaacagctatgtatgtaaaagtaaggcttatttcttaaataaaggatgcatttcttccca

SEQ ID NO: 105100 - DNA, 1453 bp, Homo sapiens
cgccctgagcgttagcggctcggcacctggccagccgaggcggggcgccggggctggggccgggagcctcgaaggacgcaggtccgcctcccgcgatgccgagggtgcccccggggagtctgaggaacctgcagccccggcctcgcccctgaggtgtgggaagccgaaggtcccgttgagtgtggttggccttgactcgggcgttgcaccggcatgatcgcattagcctcactggttatgggtagctgctgctgggagcgtggttacgggctgcagaagatgtcaatgttactttcgaagatcaacaaaagataaacaaatttgcacggaatacaagtagaatcacagagctgaaggaagaaatagaagtaaaaaagaaacaactccaaaacctagaagatgcttgtgatgacatcatgcttgcagatgatgattgcttaatgataccttatcaaattggtgatgtcttcattagccattctcaagaagaaacgcaagaaatgttagaagaagcaaagaaaaatttgcaagaagaaattgacgccttagaatccagagtggaatcaattcagcgagtgttagcagatttgaaagttcagttgtatgcaaaattcgggagcaacataaaccttgaagctgatgaaagttaaacattttataatactttttttatttgtttaataaacttgaatattgtttaaaatgataattttccttcttcaaatgacatggaaagcaaaactttcttttttaaaaattttcatttatttaatggaaacttgcccattttcacatgtctgcttatttattttatatttttaaaagaagacagtattcacctatgtattttgcataacgattatatcaagtctaggggcttcatgtcatgttattaaaatcagttaagcaatcttttatgtttctatattatttagaatatttgttgttgcaattttcacataagaaaatttaacagttgtgtcatgttgtttctgtctgattttaattgctgtctaatgacggggaaagcacgatgaaaagatgtacaatcctgcatccttgcttatttcacaactaaagctttgtcatagacttcaaaatatatatgtatatattttatttaaatatatgttacatattatatttaaacatacatatttaacattttttacatatctatcaatatcagagatttgggtaaaagaatgggtaatgtttaaacatgtggaggcatgtggagctttatacaaacagggcagaaccacagaagaacgttttagaaaccaagagatgtgcagaaagaaatgtttagtgttttttcgttttaaattttagattttattttagtgctttgtaattaattggggtttatattgataaagatgtggaagttaaacagctatgtatgtaaaagtaaggcttatttcttaaataaaggatgcatttcttccca

SEQ ID NO: 105101 - DNA, 1506 bp, Homo sapiens
tatcacctcaaatacttagaaaatatctgagttttcactgggcaaagctgctctttcttacaaatgaggcactttttaccactcttttccaaagtttagctccagaggcctcaaagttagtgaaaatttctgccagatttggatcataagttgttcttcttaattattggtggttggtggtgtgagtttctatcatttcctgtagtctcatagttatttttgttgttggaaaaagctgggttagaagccagcaggcccaggataaactatttatagaagtctttgtatttggttctttgttaggaaataatttagacagtaattttttactattttttagatcagcagaaactgagaaaacaaacttgatttattctgtgataagcagatatggaccatgaattaaaaatgcccacattcagacatttagatctaattatcagtgttacttagctgcctgtccaagtttagaaggttcttgacctaaaattcttcccaaatattatttcagacacagatgctcagaaatcatcctattgaatagaattaatttaaaatattttttttccagaaaaatttgcaagaagaaattgacgccttagaatccagagtggaatcaattcagcgagtgttagcagatttgaaagttcagttgtatgcaaaattcgggagcaacataaaccttgaagctgatgaaagttaaacattttataatactttttttatttgtttaataaacttgaatattgtttaaaatgataattttccttcttcaaatgacatggaaagcaaaactttcttttttaaaaattttcatttatttaatggaaacttgcccattttcacatgtctgcttatttattttatatttttaaaagaagacagtattcacctatgtattttgcataacgattatatcaagtctaggggcttcatgtcatgttattaaaatcagttaagcaatcttttatgtttctatattatttagaatatttgttgttgcaattttcacataagaaaatttaacagttgtgtcatgttgtttctgtctgattttaattgctgtctaatgacggggaaagcacgatgaaaagatgtacaatcctgcatccttgcttatttcacaactaaagctttgtcatagacttcaaaatatatatgtatatattttatttaaatatatgttacatattatatttaaacatacatatttaacattttttacatatctatcaatatcagagatttgggtaaaagaatgggtaatgtttaaacatgtggaggcatgtggagctttatacaaacagggcagaaccacagaagaacgttttagaaaccaagagatgtgcagaaagaaatgtttagtgttttttcgttttaaattttagattttattttagtgctttgtaattaattggggtttatattgataaagatgtggaagttaaacagctatgtatgtaaaagtaaggcttatttcttaaataaaggatgcatttcttccca

SEQ ID NO: 105102 - DNA, 1115 bp, Homo sapiens
agcggagtccagtcccaagatggcggccaccatgaagaaggcggctgcagaagatgtcaatgttactttcgaagatcaacaaaagataaacaaatttgcacggaatacaagtagaatcacagagctgaaggaagaaatagaagtaaaaaagaaacgcaagaaatgttagaagaagcaaagaaaaatttgcaagaagaaattgacgccttagaatccagagtggaatcaattcagcgagtgttagcagatttgaaagttcagttgtatgcaaaattcgggagcaacataaaccttgaagctgatgaaagttaaacattttataatactttttttatttgtttaataaacttgaatattgtttaaaatgataattttccttcttcaaatgacatggaaagcaaaactttcttttttaaaaattttcatttatttaatggaaacttgcccattttcacatgtctgcttatttattttatatttttaaaagaagacagtattcacctatgtattttgcataacgattatatcaagtctaggggcttcatgtcatgttattaaaatcagttaagcaatcttttatgtttctatattatttagaatatttgttgttgcaattttcacataagaaaatttaacagttgtgtcatgttgtttctgtctgattttaattgctgtctaatgacggggaaagcacgatgaaaagatgtacaatcctgcatccttgcttatttcacaactaaagctttgtcatagacttcaaaatatatatgtatatattttatttaaatatatgttacatattatatttaaacatacatatttaacattttttacatatctatcaatatcagagatttgggtaaaagaatgggtaatgtttaaacatgtggaggcatgtggagctttatacaaacagggcagaaccacagaagaacgttttagaaaccaagagatgtgcagaaagaaatgtttagtgttttttcgttttaaattttagattttattttagtgctttgtaattaattggggtttatattgataaagatgtggaagttaaacagctatgtatgtaaaagtaaggcttatttcttaaataaaggatgcatttcttccca

SEQ ID NO: 105103 - DNA, 811 bp, Homo sapiens
  misc_feature (392)..(392): n is a, c, g, or t
agcggagtccagtcccaagatggcggccaccatgaagaaggcggctgcagaagatgtcaatgttactttcgaagatcaacaaaagataaacaaatttgcacggaatacaagtagaatcacagagctgaaggaagaaatagaagtaaaaaagaaacgcaagaaatgttagaagaagcaaagaaaaatttgcaagaagaaattgacgccttagaatccagagtggaatcaattcagcgagtgttagcagatttgaaagttcagttgtatgcaaaattcgggagcaacataaaccttgaagctgatgaaagttaaacattttataatactttttttatttgtttaataaacttgaatattgtttaaaaaaaaaaaaaaaaaaaaaaaaaaaaaanagaaaaaaaaaaaagaaaaaaaaaaaaaaaaaaaaaaaaaaggggggggggggaaaaaaaaaccccgggggggggcccattcgcccccgctttttttggaaaaaggggggcccccaaatgggggggggggaaaaaaaagacagagggaggggggaggcttaaacaagggtgtgtggggagaaaaaagcgcggcgtgtggtctctttgggggaagagcccccaacttgtgcgcgtgccgatatggcgaccaccacccaaggattaagaggcccgggagaataaaaacttggggggttgatgggggacccacggctattgtggggggaggattggtctggtatttatacggttcgtagtatgaaacataagaatgtagtagtatagagcgcgaggagaagagaacgtgttgagaagatgtc

SEQ ID NO: 105104 - DNA, 1278 bp, Homo sapiens
tattcagctactatacagaaaaaggatgaacaaattaatttatttctaattgagccagttagacataatgcatataacgtgatatttggttcatgaaagagttgttttcatgtggttattgtagggagtatatataattgtggaaggggtatgggaagagttgtgtatagttagttgttatctctacaagtttgaaagttttcccatcaaacattatcaatataccaatgttttaaaaattgagtgagggttattatttgtatttgatgaaagaaaatccaaataaagcccacctagaaatagatattttattatatatgtgctatagatatacctatatagtacaaatagacatgtgtgatgcatatatacaatgttatatatgtgtatatgtctgtatacacactgagtctgtaatatgtatacactaaatttgtgttatgctaacatcttcagggtctgcactgtgaactcccctggagataagtaagtccactttagaataaagaagttcttttgagacttcagttactaacgtgctttaagaggtatctactttataactgaattctatgtcgttcatacgtagagttacagtaagggtctagtatgtccaaatcttaataataaagaagaaaagtaaaggcttcaagctagcaatgtattcgaattacagttttcagattgtggctccaggccttgtgtttctcatttaagtagcaccttttaataaaaaccgtttctttgtgtaggcaaaagcacaagtgtttcaaatgtaaatagcaggaaaaaaaaagagtttacagagatagcattgctgcacagaataattgctactgagtatttcttatagaatttgtggaactgaaagatgaggtttattctgtcaagttcaagttcattctgttcaacactgttttcttattgtttgtgtatagcaaccgggtattattgttttatcatttgtaaaattgtaaaataaattaatccctttttttcactgtttctcttatctcatatatccaagcccttggttatactttgtatgtcaatgttaggtgatcatttttaacaagctttggcttgtgctttgcttttccactccccttagccctagtggttggcaattaggcaaaccatttatttttaagtgtatacatgggaatatgaacaatgtcaaaaaccccatgaatattaggaaatccttaacgatattttgtgtagcacattctgtttgcggttgagggaataaagtatttcacaagtgaaagtcattta

SEQ ID NO: 105105 - DNA, 615 bp, Homo sapiens
acacacggggtaagtttgtgccccaagtgtacaaacacacactctacactgttctcccaggcctgctcctcggagcatctctgctatcttcagcccgtccatctgcccccaagactggagtcccagtccgggagccagggctggcatctctgaggggaccagattccccccccaacagttgatcatttccgcgtgtcacccttgtgttagtttccagctggtagcttgctataaccttgtttctcacagtccctgctgagcccccacagatacaaaccaccccttgggcacctcatagaggggcctctgctgagctcaggggggtctttgccccccgcggtgttcctactgcatttcagcacatggaagagagatccaggctggtgtttcagcttcccgcggtggagcggcagtgccgacccttccaccagtgctgtgatattgctgtgccctttctaatggaatcacaaagagaaaccacccagggcttggaaaccagggctgtgggaatgaggagtgcatctgtttcctgcactcggagtggtttctctggtggagtatttgactagtaatggatttcctattagggaaagaatctatgacctgctgatttcc

SEQ ID NO: 105106 - DNA, 492 bp, Homo sapiens
cccataatcccagcactttgggaggctgaggcagaaggattgcttgagtttgggagttcaagaccagcctggctaacatagcaagactccagctattgggatggctgaggtgagtagattgtttgagcctgggaggttgaggctgtagtgagccatgattgcaccactgcactccagcctgggtgcagagggagaccctgtctccaaaaagaaaaaatgaaaaaaaaacacatacaaataaaaacaaacaaaagaaataaaaaattcccagagtaacaaagcaggaaataataattctataatccaaaaaacactgggtgatccttcagttggagagaggaggagtcagttaagtagctcacacagtagatatggacaaaccagagttgaggttggttgatgtggcttctaggagttaagttctccacctaaggcaattaagggataattaattgttcttgagggataattagtcatcttgaaaaaaggaaa

SEQ ID NO: 105107 - DNA, 658 bp, Homo sapiens
cgtccaaatatcccaattttaagaattaaggaaagtaaaatagactggatgtataggcaatcaagcttaagcttgattgcctacagtacagaaacaattactgggtcatttcaacaacgcctgactgactgccaaatttcaacacctgaaactaggagtttactgaagagtaagacctgggtcctaccctgaaggatctcaccacttactggcaaggattggttaaaacagaaaacgagggttgaatgtgaagttctctaatggaacatggaagcccccctggggattccaggtagggacacgttcctggaaagaaaacagaacagaaactgggcatcatgggcaatcaagcttaagcttgattgccctccaaaaagaaaaaatgaaaaaaaaacacatacaaataaaaacaaacaaaagaaataaaaaattcccagagtaacaaagcaggaaataataattctataatccaaaaaacactgggtgatccttcagttggagagaggaggagtcagttaagtagctcacacagtagatatggacaaaccagagttgaggttggttgatgtggcttctaggagttaagttctccacctaaggcaattaagggataattaattgttcttgagggataattagtcatcttgaaaaaaggaaa

SEQ ID NO: 105108 - DNA, 264 bp, Homo sapiens
gggaggatcgcctgagcccgggatacccaggctgcagtgagctgtgatggcaccattacactgcagcctagacaacagagccaggcactgtctcaaaaaaaaacaaacaattgtaacaatgcttagcgtgagatctgccctcttaagaagcatctgaggttcagtacagcattcaccacgggcccagtggtgggcagcagggctctgcggcccgctcacccgtcctgtataactgacacttcacacgtgctaagcagcagctcc

SEQ ID NO: 105109 - DNA, 338 bp, Homo sapiens
ctaaaactatgtgaaaagaactggtagtttcttctgaaatgtactatatatttcttaaaaagaccagagggcaaacataaactgaggaagagttgccgcattttttttttttaagatggaatcttactctgttgctcaggctggagtgcagtggtgcaatctcggctcactgcaatctccacctcccaggttcaagtgattctcctgcctcagcctcctgagtagctgagattacaggcacctgccaccatgtccggctaattttttgtatttttagtagagacagggtttcaccatgttggccaggctggtctaaaactcctgatctcaagcaatcc

SEQ ID NO: 105110 - DNA, 657 bp, Homo sapiens
tcgactatagccaggcattattccatgtgctgtgccaatggcggtgaacagaacagattatatctctgtctgcatggagcttatgttctagtagatggagacagacagcaaagcaaattaactattgcttaagtaaatagtgatcagcaaatatgaagaaaagaaagctggaaatggcatggagagtgactgaaagggaaccaattggcctggtacagttaggggagacctctctcaggaggagagctgaaacctgaaagatgagaaggagtcagctaggtaaagatctagaggatgagcattccagagaaggaatggatgcaaagactgtgatgtgagaatagacttgccacagttgaggaatggaaagaagcctggggtggctgaggcatagtcaagaagtctggggaggaatggtacgacttcagagagttgggcaaattcctgttggggccattctctgggatgactgaacaggggaaggggagcagatgtggggctgggcgagatgaaggaaaggatgtgttcacttaggatatgactttgaaggtacgtgtgggaccacagaaaatggctggtaaagagatggaggtaagcatcttctgtgcacaaggccctagggtctgaggataaacaggagtctgtactcatggagcg

SEQ ID NO: 105111 - DNA, 130 bp, Homo sapiens
gtttctaagtgtctgagaccccaaggaatgctccactagtgccccatagatgtttctggctatctcaagcagcctgcctctccactcctgccatggaaaaacccatgcactgctgaacctcatggcacag

SEQ ID NO: 105112 - DNA, 220 bp, Homo sapiens
agacggataagtaaataaacaaattagtaattctggaacttttagtgatactaagaagaaaaaatgttaaagggtaatacaatgagagtgacctgaaggggactgtgtgattcggtggtcaagaaaagcctcaggggaggtgattttttttttctttttttttaactgagacagagtcttgctctgttggcaggctggagtgccctggcacgatcttggc

SEQ ID NO: 105113 - DNA, 376 bp, Homo sapiens
cttcgggctgtgagaagtccctaacagagcaaatctggggacaagggctcaggaaaggttggccacggccccctaggaatgggggctctgcaagatccctggccttagaggctgtgagagggaacaggggtccatccccaagtaagggacacggtctttgaggaaatcccaggccagggcctgaagggcactgtcaggaacacaggctgtttcagtctgttgagattcaccggggcgctgctcactgtgagcacggactcctcaggccaatgtggcagaagagcccacctttgaaagcgagcgggtgggggtggcggggctggtgctggtgcgtgcttctgcacagccacctgggaaggtatgccgctggttgacc

SEQ ID NO: 105114 - DNA, 747 bp, Homo sapiens
tcaacagccgtacttgccaacaccaaatactctaaacctcaacctcacagtaaattctagttcatccttctgaaataccttcttgatgaagattttcttgacacccatatctaaaaattattcccatcactttgttcttctttttgctgcaaataccacatgtgattcaattgctctatggggaagaactgtgccttaatcctctctgtattcccatctacacatgtaaatggcacactgtgtagatgggaaattattcaaaaaaataattttgttgaaaaaaaatggattagaggtgaagatctcctcttttcttggtaccaacaaccaagatgctaaatacagcaatagctatcatcatcaaattgcctgcactgacaaaggccatcacggaagaagtactaagtataacaaaagtctgggggcagaggaaaagtaaatgatcatgctatcaagcagcacatatgtcagtcaatactatttaaaagcaaacatgaaacaacccactagacactacgagagaaatagaggaatgtgaaggaagctgggatgaaggacattcttctgacaaagtctcattactctagtatgtgttactttttctaggtcaatgcaatctgggtaaacatgggttatacaaatagttttaatgaagttccaataaccaaactaaatcctcaataataaattgtcatgtctaactacattgaagataatgatttagattagaaattaataaaacatatg

SEQ ID NO: 105115 - DNA, 797 bp, Homo sapiens
agttgatgactcccatatacctcacaagcatttacctcaaaagtgtagtttgtaccatcagagaatatataaacacctctatgtgaataaactagaaaatccagaagaaattgataaattcctgtatacatacaccttcccaacactaaaccaggaagaagtcgaatcccttaatagaccaatatcaagttctgaaattcaggcagtaattaatagcctacaaaccaaaaaacaacccatgaccagatggaattacaggtgaatcctagcagaggtacaaagaggagctggtaccattccttcagaaactattccaggcaatataaaaagagggactcctccctaactcattttatgaggccagcatcatcctgggaccaaaacctggcagagacacaacaaaaacagaaaatttcaggccaatatccctgatgaacatcgatgcgaaaattctcaataaaatactggcaaactgagtccagcagcacatcaaaaagcttatccaccatgatcaagtgggcttcatccctgggatgcaaggctggttcaacatatgcaaatcaataaacttaatcacataaacagaaccaatgacaataaccacatgattatctcaacagatgcagaaaagtccttcaataaatattaacatccttcatgctaaaaactctccataaattaggtattgatgcaacgtatctcaaaataataagagctatttatgtcaaacccacagccaatatcatactgaatgggcaaaagctggaagcattccctttgaaaactagtacaagaca

SEQ ID NO: 105116 - DNA, 356 bp, Homo sapiens
gcccctctcccccgacccagaatttccttctggggctgaactgtaccatgcgacctgctcctagtggttctgtctgcttgtcactccagcacccagaggtttaaggaagcagggtaagttgtacattcacaccaccttgttatgaacagaggctcctttgaggaaaggaggtggcctaaaagtgactttccctaggagaaatactagatgtactaagtaacccaggcaggatccctgtcctcactctcccaagcccacctccagagctgtttatttttaattaagatgctcctggcagccagtttgcagctgataacgttggcacagccatcactactggcaaagcaatattgcct

SEQ ID NO: 105117 - DNA, 421 bp, Homo sapiens
attaggaggtgaggtctttgggaggtgattatatcataagggcagaaccctcatgagtggtattagttcccttataaaagagaacccagagaggtgccttgccttccctaccatgtgaggacacagcaagaaggcacaatctgtgagaaagtaggccctcgccagacaccaccagtgctttgatcttggatttcccagcctccagaactgtgaaaaatgattttctgttgtaaattacctagtgtttggcattttgttatagtggcttgactggactaagacaggcccctttgtaaaacactgagagagggatggacttcataccctttaggggatccttctctgtagaattctttttttcagaagattttttttttcttttattaataagctttttatttttgaatacttttttattggt

SEQ ID NO: 105118 - DNA, 299 bp, Homo sapiens
tattattccaccctgtatgtcatgtgtacccattgtttagctcccagttataactagagatatgttggaagtaaaatgcaacgggcttgatgaccttgcaggaagtcagcgaggagtgatcagcgctgatagaggcttatatctttggagtttgtgtgaccatgctaacttttaaacaggaggaatgatacaaaataagatgcaggtttggggttcttttccaaggtcttgcctttacctattggatgtcaactatcttcttgggtcattgaacaggagctcttcctcttggcttgtgg

SEQ ID NO: 105119 - DNA, 176 bp, Homo sapiens
ggcagacaaaagccagaaacagagacaggagcccaggccaaaatagaggatgggacccagagcctccgaaagttcccaggatgtatgtttgacagaccatcccccaggtctctggagttgggcaggcctctggagttggacaggcctctggagttggtcaggcctctggagttggg

SEQ ID NO: 105120 - DNA, 224 bp, Homo sapiens
agaaggagtgtttctctggtaccaaccctaggtattctccatgggtttggaataaactgggtctgagcagtcaaggtgggtttcatgtcattccaaatcagctatttaaactcactgtcccagaagcttgaatctttaagagaccacaaagatactgagccattcccaaggtggcctgaagaagaagctgtccgttagttccaggtttacttctgggtggcaaa

SEQ ID NO: 105121 - DNA, 184 bp, Homo sapiens
ctgactgcccactatatccagctttggtgcaggaaaatgatgggacctaagcctttggacagtgactcctgatctggccaagcaaggggcctccctcacttcagttttggccctaggtttgcctactgccatacttcattaatatctgacaattaccccatcctggtaaaagctggttcatatt

SEQ ID NO: 105122 - DNA, 773 bp, Homo sapiens
agtcctcccaccacagcctcccaaggtgttgggattacaggcatgagccactgaacctggcccaagtctatctctctactgattgtttttttctgcttgttctaccagttacttacagaggtgtatttaaatatctcactatgatttggatttgaccatttttctttttagttctgttcagttttactttatatattttggaggctatgttatttgatgtatacaaatttagaattgttatgcttccctcctggattgatccctttctcactgtgtccctctttatccctggggatgcttcctaccttcaaatccattttatctgctattagtacaactataccacttcgattttggttagtatttacatgagaagtaatagatcatgcctcctgaaattcatattaaccaaaggaaaaaaaaaccactaagcacagttagacacaagaaatagactacagcaaaacagatttttaaaattcaaagaaaatacatgttgagctcatggccagagactttaaagtgaagacaacgtcatgctattttgaccaggctggtcttgaaatcctgggctacaagcagtcctcccaccacagcgttccaatgtggagggattacaggcatgagccactgaacctggcccaagtctatctctctactgattgtttttttctgcttgttctaccagtacttacagaggtgtatttaaatatctcactagatttggatttgaccatttctctcagtagttcctgcttcagtaaggagagaca

SEQ ID NO: 105123 - DNA, 251 bp, Homo sapiens
gatgtaggcctggtagttcctcatacggatagggtgaggccctagtcactgtctactgttaaccaaaagaggtgggcaggaacccctggcctacacacctttgccattgtaggaaatatagcataggcattacatctaaagcaagctttcctaatattactaccctgttcctaactaccaatggttcttttttttttttttttttttttgagatggagtctctctgttgcccaggctggagtgcagtggcc

SEQ ID NO: 105124 - DNA, 437 bp, Homo sapiens
ctctctcacctcatctcttgccattctcccccaactcagccatactgtcatttttcatgcttcctttggtctcaggtcctctcatatgctgttctctcagcttcttctcacctccccagcccctgactcacatctagggaacttatatgtattcttcagaccccaggtcaagcattttctcaggacaatttcccaggctcctcaaactgttgtgcccctgtactactcccacgcaacactgatcacagcttgttattatatattggcgtgactatcagaagaatgtttatcaatcccatgagaactataagcttcgtgagggagaaactgtttgcggtgctcaccatcatatcctagcacctggcatagtgcttaacacatactggactctcagatactcaatgaatacagaatgaaagattggaactggagctaga

SEQ ID NO: 105125 - DNA, 660 bp, Homo sapiens
  misc_feature (305)..(306): n is a, c, g, or t
  misc_feature (318)..(318): n is a, c, g, or t
  misc_feature (320)..(320): n is a, c, g, or t
  misc_feature (342)..(342): n is a, c, g, or t
  misc_feature (396)..(396): n is a, c, g, or t
actcaaccagaggtgattcctgtgccccttcctgacactgtacttctacccggagcctcagtgcagatgtcaatggtggttacgtgggcctgatgaataaggtgtccatgaaagttaagctgtttgtctgttactattgaagaagtgtcatccaaagctggccataaaagtacgggcacagaagtatcaatagacacacgtggcaacttattctgtaccaggtcggtctttaacagtgtacgcggccgactgtccctgcagaagtatattctcttgaaaaatgaagaaaggcagaaggaggcaanntatgcctagtcncnttgtggatgtggaaaataccanataactagtgaacgcaggcgttaaagcgaattccacgatagtgcaaagtatcanagtacgtagcaaaacactgggaagttacacgaaatctgtaagatctttctggaaaacaaagataccaaacttgccagtagggagaagggaaagttttgctttaaggcaataagatgtgagaaagaagaagcggccacacagtcctctgaaaaatatacctttgcagatatcatctttggaaatgaacagataataagttcagcaagcccatgtgcagacttcttttatcgaagtttatcttctgaattgaaaaaaccacaagct

SEQ ID NO: 105126 - DNA, 428 bp, Homo sapiens
tgccatttgtatattttctttggagaaatgtctatgcaggtcttttgcccatttttaaattgggtcattttgttattgacccaacttaatttgcaggagttattgcaggagttctctatatattccagatattgatcccttatccaatatatggtttgcaaatattttctcatattctgtaggttagcttttcactctgttgactatttcctttactatgactttttaattaatttttgcttattaaaatgccttttaatttaaatccttcatagtgtaagttcttatagtatgtgttatttatagttatagttaacaaaaattgctgagcaaattgccccttctacctagatttccaggctattcccagatcatgataccatacggcagtgttcctcaaggtattgtttaacagccacttgcattga

SEQ ID NO: 105127 - DNA, 221 bp, Homo sapiens
gagtgacaagacatggcacaaagggcctgcctgggctctcctctgcccccgagttcttagttgacctacacatacggttaaagacaaaaccaacccaaaagtgacaacccagacaaataaatgccctccctatctggccactaatgccaaattgatgtgagctgcacacagaaaaagagattacgtgtactcatgaacaaggaataaacaactgagcgatg

SEQ ID NO: 105128 - DNA, 445 bp, Homo sapiens
gggagatgttggtcaaaggacatatacttacagttagatagaaggaataataaattgtctagaataggcaaatacagaaagacagaaagtaggtaagtgattgcctcctggagatgagggtggcagggaaggggaaagaatagggtgggagagtgtgaaatggggagtaactactaatggttatggagtttctttttaggtaataaaaatgttttaaaatggattgtggtgatggttgcacaactatgtgaagaaactaaaaatcactggattttacactgtaattgggtgaactgtatgttatgtgaatcacatctcaataaagctgtcttttaaaaaatttctttatgtcaagcattatttattcttgtttgcaaattttataaatgcacatcaataacatatttttcctattatctaaaactggtatgaattctcctatgac

SEQ ID NO: 105129 - DNA, 881 bp, Homo sapiens
ccatattgaaactcagctaagcagccatcagaggatttgaaccaggtctctctgaagctttaggccaggcatgctattttcattaggccacactgaaagaaatcgcccaagtatgatgttttcgccatcttatctttccgttttcatttgtacttttcctgagtggtaccaacagcaggtttgtaaaatgattttatgaaggaatgctgagttggaagggtgtctgctgcttgtctggtttggatttgtgtgaatgtgtgcagtcccacaatatgtgattgataacactttgacttcttgaactttttctgttttaacttgaaaaaacaagtttgcacagggccttaaaaaggtgactgaaataaactgcagcttatcttccctgatttatcccaccacagtctgctctgagcacttcttagtctccttttcttcttagctttgtgtatgtgtgtgtgtgtgtaggattgggaataaccaccaccttcctatgtaccctaaaactctgctttagcttcttttgagggggccccacaatatttgcataactctgttgaaaaatttcacgttttcattcagcaaacttgtgttgagcaggccctggctgagtgtagactagggcctgctcaacagaaggccctattctgtgctcaaggagctccaagtattggagggaaatagaatatctgtaatcacagcccattgtaatgatgctgaaattgttaggtagcccaggtttctgagttggagggcagtgtgggaagaccttggggaagatgaggatcattggaggatttgaagcacatcatagaattggcagtgccttcttgatctggaagtcagaggaccctcagagtagggagtctgggatgtctcctaag

SEQ ID NO: 105130 - DNA, 312 bp, Homo sapiens
catatttggtagctgaatgcccctaggccagcagcaatttaacacttttgggcttcactttatttactctttgcaaaatggggaagagggcaatgatctctaaggctccatatatctagaatgttatgaattatttttagccaattcaatattcatagcccctttgaggtaagtcaagctcaagtaaaaattgttcacggagaaaaaaagagtaaagcacaatggaaggatgagagaacagggtccatacccagtaaataaggggtgtcaagtactacctgacctcaaggcaactcactgcacactagacca

SEQ ID NO: 105131 - DNA, 1986 bp, Homo sapiens
gcgccctcgccgcggacaccggagctgcggccgctccccgctgtcccccagagatggcagatcctgaggtagttgtgtgtagctgcagctctcatgaagaggaaaatcgctgcaattttaaccagcaaacatctccatctgaggagcttctattagaagaccagatgaggcgaaaactcaaattttttttcatgaatccctgtgagaagttctgggctcgaggtagaaaaccatggaaacttgccatacaaattctaaaaattgcaatggtgactatccagtacttgcagctatacaatgtctccgttgggaatcatgcttatgagaacaaaggtaccaagcaatctgctatggcaatctgtcagcacttctacaagcgaggaaacatctaccctggaaatgatacctttgacatcgatccagaaattgaaactgagtgtttctttgtggagccagatgaaccttttcacattgggacaccagcagaaaataaactgaacttaacactggacttccacagactcctaacagtggagcttcagtttaaactgaaagccattaatctgcagacagttcgtcatcaagaactccctgactgttatgactttactctgactataacatttgacaacaaggcccatagtggaagaattaaaataagtttagataatgacatttccatcagagaatgtaaagactggcatgtatctggatcaattcagaagaacactcattacatgatgatctttgatgcctttgtcattctgacttgcttggtttcattaatcctctgcattagatctgtgattagaggacttcagcttcagcaggagtttgtcaattttttcctcctccattataagaaggaagtttctgtttctgatcaaatggaatttgtcaatggatggtacattatgattattattagtgacatattgacaatcattggatcaattctaaaaatggaaatccaagctaagagtctaactagttatgatgtctgtagcatacttcttgggacttctaccatgctcgtgtggcttggagtcatccgatacctcggtttctttgcaaagtacaacctcctcattttgacccttcaggcagcgctgcccaatgtcatcaggttctgctgctgtgcagctatgatttacttaggttactgcttctgtggatggatcgtgctggggccttaccatgacaagtttcgttctctgaacatggtctctgagtgccttttctctctgataaatggagatgatatgtttgccacgtttgcaaaaatgcagcaaaaaagttacttagtctggctgtttagtagaatttacctctactcattcatcagcctctttatatatatgattttaagtcttttcattgcactgatcactgatacatacgaaacaattaagcaataccaacaagatggcttcccagagactgaacttcgtacatttatatcagaatgcaaagatctacccaactctggaaaatacagattagaagatgaccctccagtatctttattctgctgttgtaaaaagtagctatcaggtttatctgtactttagaggaaaatataatgtgtagctgagttggaacactgtggatattctgagatcagatgtagtatgtttgaagactgttattttgagctaattgagacctataattcaccaataactgtttatatttttaaaagcaatatttaatgtctttgcaactttatgctgggattgtttttaaaaaaactttaatgaggaaagctattggattattattatttcttgtttattttgccatggctttagaatgtattctgtatgcctctcttttgctctgatactgttgctcctgctattctgattgtgcagactgtgtaattagtggaaaacaatccttggtctgactgtgactttggacaactcagtaaccctggcttggaccactctcaggagtccatccttgagagagtgggtgtagtta

SEQ ID NO: 105132 - DNA, 2175 bp, Homo sapiens
cttctaagagcatgcctgatagatacttcggtagcctctccggatggccccttcgtcgggtagcctctcctgatggggtccttcgcccaccctgcctcccgcgccggcgctccgggtgaatgtcaagggtggctggctgcgaatacctccttcagctgctggggttcccgacagtttgcagtttttaaaagtgcaccctcggaagggcttttcagactgggtaaacctgacttttccaagagatggcagatcctgaggtagttgtgtgtagctgcagctctcatgaagaggaaaatcgctgcaattttaaccagcaaacatctccatctgaggagcttctattagaagaccagatgaggcgaaaactcaaattttttttcatgaatccctgtgagaagttctgggctcgaggtagaaaaccatggaaacttgccatacaaattctaaaaattgcaatggtgactatccagtacttgcagctatacaatgtctccgttgggaatcatgcttatgagaacaaaggtaccaagcaatctgctatggcaatctgtcagcacttctacaagcgaggaaacatctaccctggaaatgatacctttgacatcgatccagaaattgaaactgagtgtttctttgtggagccagatgaaccttttcacattgggacaccagcagaaaataaactgaacttaacactggacttccacagactcctaacagtggagcttcagtttaaactgaaagccattaatctgcagacagttcgtcatcaagaactccctgactgttatgactttactctgactataacatttgacaacaaggcccatagtggaagaattaaaataagtttagataatgacatttccatcagagaatgtaaagactggcatgtatctggatcaattcagaagaacactcattacatgatgatctttgatgcctttgtcattctgacttgcttggtttcattaatcctctgcattagatctgtgattagaggacttcagcttcagcaggagtttgtcaattttttcctcctccattataagaaggaagtttctgtttctgatcaaatggaatttgtcaatggatggtacattatgattattattagtgacatattgacaatcattggatcaattctaaaaatggaaatccaagctaagagtctaactagttatgatgtctgtagcatacttcttgggacttctaccatgctcgtgtggcttggagtcatccgatacctcggtttctttgcaaagtacaacctcctcattttgacccttcaggcagcgctgcccaatgtcatcaggttctgctgctgtgcagctatgatttacttaggttactgcttctgtggatggatcgtgctggggccttaccatgacaagtttcgttctctgaacatggtctctgagtgccttttctctctgataaatggagatgatatgtttgccacgtttgcaaaaatgcagcaaaaaagttacttagtctggctgtttagtagaatttacctctactcattcatcagcctctttatatatatgattttaagtcttttcattgcactgatcactgatacatacgaaacaattaagcaataccaacaagatggcttcccagagactgaacttcgtacatttatatcagaatgcaaagatctacccaactctggaaaatacagattagaagatgaccctccagtatctttattctgctgttgtaaaaagtagctatcaggtttatctgtactttagaggaaaatataatgtgtagctgagttggaacactgtggatattctgagatcagatgtagtatgtttgaagactgttattttgagctaattgagacctataattcaccaataactgtttatatttttaaaagcaatatttaatgtctttgcaactttatgctgggattgtttttaaaaaaactttaatgaggaaagctattggattattattatttcttgtttattttgccatggctttagaatgtattctgtatgcctctcttttgctctgatactgttgctcctgctattctgattgtgcagactgtgtaattagtggaaaacaatccttggtctgactgtgactttggacaactcagtaaccctggcttggaccactctcaggagtccatccttgagagagtgggtgtagtta

SEQ ID NO: 105133 - DNA, 356 bp, Homo sapiens
ttccttatcccctcctctgaattttctcttcagcaattatcagcagcaagtgtcccaaagtttctattaacttatttctgttgtctctttcttccctccactagaatgtaagctttatgagagcagagacttttgtttgttcactgctttatccttagcacctaaaacagtgccttactcatacttacctcaatatttattgccaaatgaatttctgctttataatctgattatatttttccactctctcttagagtctaactagttatgatgtctgtagcatacttcttgggacttctaccatgctcgtgtggcttggagtcatccgatacctcggtttctttgcaaagtacaac

SEQ ID NO: 105134 - DNA, 644 bp, Homo sapiens
cttctaagagcatgcctgatagatacttcggtagcctctccggatggccccttcgtcgggtagcctctcctgatggggtccttcgcccaccctgcctcccgcgccggcgctccgggtgaatgtcaagggtggctggctgcgaatacctccttcagctgctggggttcccgacagtttgcagtttttaaaagtgcaccctcggaagggcttttcagactgggtaaacctgacttttccaagagatggcagatcctgaggtagttgtgtgtagctgcagctctcatgaagaggaaaatcgctgcaattttaaccagcaaacatctccatctgaggagcttctattagaagaccagatgaggcgaaaactcaaattttttttcatgaatccctgtgagaagttctgggctcgaggtagaaaaccatggaaacttgccatacaaattctaaaaattgcaatggtgactatccagctggtcttatttgggctaagtaaccagatggtggtagctttcaaggaagagaatactatagcattcaaacaccttttcctaaaaggatatatggaccgaatggatgacacatatgcagtgtacacacaaagtgacgtgtatgatcagttaatcttcgcagtaaaccaggtaaat

SEQ ID NO: 105135 - DNA, 302 bp, Homo sapiens
aaaaactaaatgtaacatatgatcctggattggatattagagaaattttattttattttttgccataaaggccattatttggttaattggtgaagtttgaataagggttgagattagataatagtataggatgaatgttaatttcctgattttgataattataccgtggaaacacaaggactgtccttgttttctaggaaatactaagtatttcagggtaaagaaatgtccattacagagggagaatgataaagaaaatgtaaagcatttgagtaatctgggtgaagggtaattagtagttt

SEQ ID NO: 105136 - DNA, 297 bp, Homo sapiens
atcattacctaaggatagttaataaaggccagtaattccactgtaggtcaagttttttgacaatgactgtgagtcatgaaattggcctgtttggttagtgataagcgaagccgcttctgttcatcaacttcctgaacgtcagccaggctcctcgctgggcttggacaacgccggcttgtcccctgtgcgctgtacagctgccttctttttatttcctgtgcagtctcgcccacagcactgcaggctccgggggaccttttagggcagattatggcacccttgggatggctaccttgg

SEQ ID NO: 105137 - DNA, 335 bp, Homo sapiens
taagccctctgaagtcctaagttaaaaataaagcaacttgtttgataatttttcatcaagaatgtatctgagtctctgagtaattattagtaggaatattccattatcacaattacacagtataagctatttagtctaactttaccaaaaaagggagctacttcaacactgtgtgagacttttaatgggtttgcattgggtatgcactattagcaagataacctattttacagcagtgttttttaacctttccatttatttgaaaggcagctaagatatagtagttaatataatggtttgatgcatttatattacatgtagataatggagataca

SEQ ID NO: 105138 - DNA, 693 bp, Homo sapiens
gtatattcttaatagcctagataaatactaaaatatcatattccatttttctggacaatttcataataaacatcaagtggcaaaacagcatgatgtttcaagatgattggctgtgacttctaggttgtaagttactaggaagttttcattatattgcaatgataggttttagctaacaaaataatttaattagattactgtgaagaccatctggaggaggaaagagtgtgggttatggttttgtgaacactgctgggtttgtgctcattttaggcagtacgaaataacttgtgttgcacaaagctacttaagggacttgaaatacttcttttgtatccagcctctctctagctgtgcatttctgaagagccagcatatccatcatgtctacgtgaagaattggttttaaatcctgatgacacatggctcagaacaaggactagtttcattcaggtacagtcaaacctaggtcaaacccatggttcatgaaccaaataactttttggcagagatgaaaatacaagacttattaattatgttgtttaaaacatgtggcccaggagagaataaaataacacattcataaaacacagtcactgggccagttcctggttttttaaagggcaccagttaaagctaccttgaagatgttttatttaaatagaagatatcaatcatagtctctagctatca

SEQ ID NO: 105139 - DNA, 379 bp, Homo sapiens
tctgcaagctcccacacaccgacacccacaacccacaccccactacacacatacacccacactccaacacatcccctccaaacatacacccacacaccttccccccccacacaaacacatacatacacactcacacacacacacacgtgtacactataagacatcaattcagtcttcaaacacgtgttaaggaaatgggaagaggctaccatcatgggatggattaaaggaagtttccagaagctgggaacaactgtgacctggagcatgggaggcagacacttatcactccatcatgacgtaagttcttgagacccctagtatccacacagggattccccacatccacaatggctacttcttagctttgtgcagatgt

SEQ ID NO: 105140 - DNA, 203 bp, Homo sapiens
gcaaaggggaggaggctggcgggtggaggtgcccagggaggcctggggccgggtcccaccaggctctggaggggcctgtgggacaagggtggagaagcagcctccacaggaggactgggagccgagggcctggcccgggcctagcggttccccccagtgccctgtgccttcttgtctcccggggtgagaagcctcccttctgg

SEQ ID NO: 105141 - DNA, 183 bp, Homo sapiens
taaattggtctctttctcatcatgctgcagaactctggggagtgaaaggtcagattcctgtaaagagcaaggctatggcagtgtagcaaaagaaaagggtaaagccatggacattgttagaatgagcaaaaggaaacacatgagtctcagaagaatacagtgctgctggggtgggagaagctg

SEQ ID NO: 105142 - DNA, 757 bp, Homo sapiens
tggggatggggtgttaacttgcattctttggggttcaggtctcaaatggctcttgtagccctgggatctgaggagcgagaccaggactcagctatctccaccccggaagaaccttccctgctcttccacatccagcccaggcctcggcttcctcgtctgcaaaacgagggtgctgagaagatgggagcaggggtccagcgttttcatcagcagggctgttgagatgtaattcccatgccatagtgcccactggttgaaagtctatacagttcagtggtttctagtgtattttcagatatatgcagccatcactgtggtggactttagaacatctctgtcaccccaaagagcaaccctgtttccattggtgtcactcccggggctccgcattcccagcccagcagcctaggacaagttttctgcctctgcaggaggcccccaagtttcagatcttgatgtctcctttctgtggggagtccagcaggcatctccaccttagggacagcttagtggacagtgctgtgtcaccatcaagggcctgaatccccgctctgtcacctactacctcttttaccttgggcaaattcttcaccctttgccttggtttccttaggtgaaaatgggatcatcgtgctgacctcaagggcagctgtaggattcgatgttcctcatgtcacggtctctaaccgtgtggcacattctgggtgcccatggttacgatgatgggtttgggggctggagggatcagtgactttct

SEQ ID NO: 105143 - DNA, 336 bp, Homo sapiens
atattttatcaatgatacaagaaaaataatatttaagaaaaagctttcagaagttaaaaatattacagcaaaaatacaaaaattcaacaggagtagaagataagttcttaagtctcaaagtaggactaaaaaagagatgataggatattcatttaagagattcaatatcgaataataaaatttcaggaaggaaaaatgcaaaaatttatttttaaaaaagtaatacaaaggaaattttttccgtaatagtagagcacaggtgtccagatatgaagaaataatataatacttagtaaatgaaaaaaaaatcataccaaatacttcataaagttctag

SEQ ID NO: 105144 - DNA, 726 bp, Homo sapiens
tacatttctcctgttatctattttaattaaatgtttgtgtgtaattgagggataatatttttggaggaagcaaatctagttaataatatctaatgactgggtatattgggaaagctatttttaaccacctctgaacactaatcatccagaatcatccagacagttgatagatactgtctgctatttaatttttatgtacatatccaatatgtgaaaaaatatcacaaggcttagtgaccaattattagtaattctgtaaaagataacttttaagtcaaaattgtgcagcaggtacctgaacagcgatttcagtggcaataaaaagccaatagctttcacaagtcttgactatgttggtagtttactgtctagtaaatatcaaaagataaggcctagcaattgttaagtgtctttattgaatgcttctgccaggcactttctcataagagctctgcaaggtaggtattttcctcaagttttggacgaggaatctaggtttggagggatgtaagttatcaccctagatcacacaacttggtggagctgtattgaactcatgctcaatttttttacacttagccactttgcttcccttgtagtagaaaattgaatcaagcattaaatcaactgagttgttctttgtgtttgtaactgtccaaagaattcaaaattggagtccaccatatatgttcttttctttgcaagtacatattttgaatgaaggaa

SEQ ID NO: 105145 - DNA, 358 bp, Homo sapiens
gaggctggaagagagaaagaagtagttagattaccggctagtcaaaggtgcattccatctctccaactttctctgccttggaggaccaataccccaaattattagacatctctcctccccattatctgccaagatatgcaatagctaacagactttggattggtgtagagacttaagcctcttcccttgctcctctgcacacacatcttcagctctcatcttgcagagatgagatacagttaacacatactgtaacacaatcaaatcagtatgtctaggattctgggcaattagtgcttttcacaggattaaatacacataggccttctcttccacccctttagcagttcctagacat

SEQ ID NO: 105146 - DNA, 4779 bp, Homo sapiens
  misc_feature (2105)..(2105): n is a, c, g, or t
  misc_feature (2152)..(2152): n is a, c, g, or t
cgtgtaaaggttagcatgatcgcccagaaggagactcctgtgctgaccagaatagaaaaacaaaagcgcaaagaggaggaagaagagcgtcagattcttctagcagtgcagaagaaggagcaggagcagatgctaaaggaagagaggaaacgcgagttggaggagaaggtcaaggcagtggaagtagatcgagcgaagaggagaaagctcagggaagaaagggcatggctgctggctcaaggaaaggagctccctccagaactttcccatctggaccccaattcccccatgagagaggaaaaaaagactaaagacctctttgagttggatgatgatttcactgctatgtataaagttctagacgtggtaaaggctcacaaggattcctggcccttcttggaacctgtggatgaatcttatgcccctaactattatcagattattaaggcccccatggatatttccagcatggagaagaaactgaatggaggtttatactgtaccaaggaggaatttgtaaatgacatgaagaccatgttcaggaattgtcgaaagtataatggggaaagtagtgagtataccaagatgtctgataatttagagaggtgtttccatcgggcaatgatgaaacattttcctggagaagatggagacacagatgaagaattttggattcgagaggatgaaaagcgggagaaaagacggagtcgggctgggcgaagtggtgggagccatgtttggacccgctccagggacccagaagggtccagcaggaaacagcagcccatggagaatggaggaaagtcgttgccccccacacgccgagcgccctcttctggggacgatcagagcagcagctccacacagcccccgcgggaggtgggcacttccaatggccgaggtttttctcatcccctgcattgtggtgggacacccagccaggcaccctttttaaaccagatgaggccagcagtaccaggaacatttggccctctgcgaggatcagatcctgccaccttgtatggctcctctggagtcctggagccacaccccggggagcctgtgcagcagcgtcagcctttcaccatgcagcctccagttggaattaacagcctccgaggacccaggctaggcacaccagaggagaagcaaatgtgcggggggctgacacacctttctaacatgggcccacaccctggatccttgcagcttgggcagataagtggcccaagtcaggatggaagcatgtatgctccagctcagttccagccaggattcattcctccccggcatgggggggctccagcccggccaccagactttcctgaaagctcagaaattcctcccagccatatgtatcgatcgtacaagtacctgaatcgagtacactctgccgtctggaatgggaaccatggtgctacgaaccaaggacccttgggcccagatgagaagccccacctggggccaggaccctctcaccagcctcgcactctcggtcacgtgatggattcccgagtcatgagaccacctgtcccccccaaccagtggactgaacaatcaggcttcctacctcatggagttccttcctcagggtacatgcgaccgccctgcaagtctgccggacatcggttacagccacctccagtgccagcacccagttctttgtttggagcacctgcccaggctcttcggggggtgcagggaggggactccatgatggacagcccagagatgattgcgatgcagcagctctcctcccgcgtctgccccccaggtgtgccttaccacccccaccagcctgcacacccccgtttacctggcccttttccgcaggtagctcacccaatgtcagtcactgtgtcagcccccaagcctgccctgggcaaccctgggagggcaccggagaacagtgaagcacaagagcctgagaatgaccaagcagagccgttgcctggccttgaagagaaaccaccaggtgttggtacttcagagggggtctacctcacacaactacctcaccccacacctcccctgcagactgactgcaccaggcagagctcaccacaagaaagggaaacagtgggcccggagctcaaaagcagctnctccgaatctgcggacaactgtaaagcaatgaagggcaagaatcccnggccctcggatagcagctaccccggcccagccgcccaagggtgcgtgagagacctctccacggtggcagacaggggcgctctatccgagaacggagtcattggggaagcatctccttgtggatcggaggggaagggccttggtagcagtggttccgaaaagctgctctgccccagaggcagaacgttgcaggaaaccatgccatgcacgggacagaacgcagcgacaccgcccagcacagaccccggtttgacgggaggcactgtgagccagtttcccccgctgtatatgcctggcctagagtacccgaattcagctgcccattaccacatcagtccaggcctgcagggtgtgggccctgtgatgggagggaagtccccagcatcccatccccagcattttcccccaaggggctttcagtctaaccacccacattctggaggctttccccggtatcgccccccacaaggaatgaggtattcctaccacccaccgccacagccttcctaccaccactatcagcgaactccttactatgcctgtccacagagcttttctgactggcagagacctctccatccccagggaagcccaagcggacccccagccagtcagcctcccccaccaaggtccctcttctcagataagaatgccatggccagtctgcaaggctgtgagacactgaatgctgccttaacttctccaacccgtatggatgcagtggctgctaaagtcccaaatgacgggcagaatcctggtccagaggaagagaagctggatgaatctatggagaggccagagagtcccaaagaatttttagacctggacaaccataacgcagctaccaagcggcagagctcgttgtcagccagcgagtatctctatggaactcctccgcctctgagttcaggaatgggatttggttcatctgcatttccaccccacagtgtgatgctgcagacggggcctccctatacccctcagcggccggccagtcactttcagcccagggcttactcttcccctgtggctgccctcccacctcaccacccaggggccacccagcccaacggcctctctcaggagggtcccatctatcgctgccaggaagaaggcctgggtcactttcaagctgtgatgatggaacaaattggcactagaagtggaataagaggacctttccaggaaatgtacagaccatcaggaatgcagatgcacccggtccagtcgcaggcctcgttcccaaagacccccacagcagcaacatcacaggaggaggtgccgcctcataagcctccaacacttcccctggatcagagctagtccaaggaggaaatgagccccaagcaatggaaagctgcacacgaagactggaatgtggagaactggggagtgccctgtcagctctattcccatcacctgctccaccccttcacggcgacccactcgtgccatacttgagctggagccagtcacgggccctaaaaggacactccttagatgactgacacacagattgcaaaggtcctcggccagggatctcttgcacagctgatgtagacagtcaggcaaaactaatgaacgtggagttaatgatgacttttccaaatcctgagacacttttcagggaaaatcactttaaacttgggggagggggtatactcaagaatggagtggtgcttttaaactttgatgagcagctaaactcaggtatatatttggggaagggactactcttagtattaatggttttggagctgggtccagtttacagaattttcatgttgccttttaaaataatttttgttggtggtgaatgtattgtacataaagtgggaagggtgggtggggatgcggaagaaatgggggtcctaactggtgggcacacagcactggagtgatttttatctgtttacaatcatgtcacactgaatacttatgggagccggagatgagggtaggaaaggtttgatcttgtaatatgtcactgtgtttccttagtggccagccagccttcagaatagctaaaggccttccttccttccagtcagcctgagagagaacacctgtcccctaagcacctggtgtctccattggaggcagactgctctcaggagactactagaagcttcagcccggaagacaggctgctctctcatgctggtggcccaaattgagaaagtggtgtcccttcctgattttgccaccagccctaccgaatagttgtaaaccagtatcaggaattgggatcgctagagtgtttcacgtattagaagatgaatcgtcctcatcacagacctccctgtcaggactgtgatctagaaggcatcacacacagctttctggcacgaatcacattttgtggaagtgactactcaggtttgtatattttagtatcaataaagaattgcacaggtttgaataggaaaaatgtattctatagatttacagtttgaatttaggaatatttcagtatatatagtttttattcgttttaagtgaatcatagtaaaatcagtcatggtgatttaaaatagctatcaagaacaagttcttggaattatctgttgtatctgtgataggaaaccattttacagtattaaattactttattacagttgtagagtt

SEQ ID NO: 105147 - DNA, 936 bp, Homo sapiens
ttatgggcacattataaaaaaatcattgtgtaatttagcacggtctttgctgaggactcaaggacttcagtagcagtgagaaggccagtacaggtcagcccccgaggtaaattgggagccctgtcactggaactcagctggagtgagaggtcacaggaggttatgccggaactgccacagaggatcccatggggcaaagcttgccccgtgcctgatccacccggttgtacttgtctttcttttcgtgtgtgctcacataaaacaaccgctcccagccaaatctgtaaactgttcatcaggattgctgttggattctctcttttttgaaaagggaacaatggtggggatagggagcattgtaatatttccatctcttgttcctcaaagtaggtaccaccttcccattatatccgtgtttcttatgctgattgaaaattacataagatacttggacatttttatttatttatttatttatttattgtttgagacagagtctctctctgtcgcccaggctggagtgcagtggcatgatcttggctcactgcgacctccacctcccaggttcaagcgattctcctgcctcagcctcccgagtagctgggattacaggcgcgcgccaccacgcccagctgattttttgtatttttagtagaggtggggtttcaccatgttggccaggctggtcttgaactcctgaccccatgatttgcccgcctcagcctcccaaagtgctgggattacaggcgtgagccaccacgcccagcgatacttgggcatttttagatttgagttatgcttacgtgtaaatttggaatcctcgttctggttttttcctggtgcgttttgttccccatttccccaaaccccttttccgtgctctgtgtagggcctggatgcagacagtctccgtgtggagccattgggtgaagacaa

SEQ ID NO: 105148 - DNA, 374 bp, Homo sapiens
cgagaacggcagctctacaagctcctcagtgaggacttcctgcctgagatctgcaacatgatcgcccagaaggtgcgccacactctctgctctgtcctcctcagtgttaggcctgatgctgcattatttaaggattattcatgagaccttccccatacaccccactgtcctggaaatagtgcagtcttccatcctgtctgaactccagtgttagaatgggacctcatgccaccccctctccttcactgtgggtcctatcatgttctccttcccccagaaagtcctcagtgtctaccacccaccaatagtgacggtggcttttcacagcctggaaccaactttccttctcccatacactcctcaggaaacattcc

SEQ ID NO: 105149 - DNA, 6179 bp, Homo sapiens
  misc_feature (175)..(176): n is a, c, g, or t
  misc_feature (3505)..(3505): n is a, c, g, or t
  misc_feature (3552)..(3552): n is a, c, g, or t
cgggggttgttgttgtggcgcgggcagccccgccccctcctcgtgggcggcccctcccccaggccccgcgtccggcccctccgcccctagccccatctgtttctccggcggggactcgattatattgtaggggactgggggcggccgccgccgcagccgcgggatggggcgagcnngcggaccccgcgggcagccgcagccgcagccgcctcagtagttcgggcccccgcgccgccgccccccgcccggcgcccgccctcggctcctgcactcgccgagcggcggcagcagcgggaggagcgccccgccgcccccgccgaggaccgcgcggaggctgcggcgctgccgcggcgggagtcccaggtcggcgggcagagcgcgggcagcgaggggccgccgcctgtgccgcagcggggagatgtgcccagaggagggcggcgcggccgggctgggcgagctccgctcctggtgggaggtcccggccatcgcgcacttctgctcgctctttcgcaccgcgttccgcctgcccgacttcgagatcgaggagttagaagccgctcttcacagagatgacgtggagtttatcagtgacctgattgcctgcctgcttcagggctgctatcaacgaagagatatcacgcctcagacattccacagctacctagaggacatcatcaactaccgctgggagctcgaagaagggaagcccaaccctctgagggaagccagtttccaggacctgcctcttcgcacacgggtggagatcctgcaccgactctgtgattaccggctggatgcagacgatgtcttcgatcttctaaagggcctggatgcagacagtctccgtgtggagccattgggtgaagacaattctggggcactatattggtatttctatggaacacgaatgtacaaagaggacccggtgcaaggaaaatccaatggagaactctctttgagcagggaaagtgaaggacaaaaaaatgtctcaagtattcctggaaaaacgggaaaaagaagaggaagacccccaaaacggaagaaactgcaggaggagattctgttgagtgaaaagcaggaagaaaattccttggcatccgagccacagacaagacatgggtcccaagggccaggccaaggtacttggtggctcctgtgccagacagaagaggaatggagacaggtcaccgagagttttcgcgagaggacctcccttcgagaacggcagctctacaagctcctcagtgaggacttcctgcctgagatctgcaacatgatcgcccagaagggaaaacgtccacagcgcacaaaggcagagttgcatcctaggtggatgtctgaccacctgtccatcaaacccgtcaagcaagagaggagactcctgtgctgaccagaatagaaaaacaaaagcgcaaagaggaggaagaagagcgtcagattcttctagcagtgcagaagaaggagcaggagcagatgctaaaggaagagaggaaacgcgagttggaggagaaggtcaaggcagtggaaggtatgtgcagtgtccgcgtggtctggagaggtgcatgtctgtcgaccagccgtccttagatcgagcgaagaggagaaagctcagggaagaaagggcatggctgctggctcaaggaaaggagctccctccagaactttcccatctggaccccaattcccccatgagagaggaaaaaaagactaaagacctctttgagttggatgatgatttcactgctatgtataaagttctagacgtggtaaaggctcacaaggattcctggcccttcttggaacctgtggatgaatcttatgcccctaactattatcagattattaaggcccccatggatatttccagcatggagaagaaactgaatggaggtttatactgtaccaaggaggaatttgtaaatgacatgaagaccatgttcaggaattgtcgaaagtataatggggaaagtagtgagtataccaagatgtctgataatttagagaggtgtttccatcgggcaatgatgaaacattttcctggagaagatggagacacagatgaagaattttggattcgagaggatgaaaagcgggagaaaagacggagtcgggctgggcgaagtggtgggagccatgtttggacccgctccagggacccagaagggtccagcaggaaacagcagcccatggagaatggaggaaagtcgttgccccccacacgccgagcgccctcttctggggacgatcagagcagcagctccacacagcccccgcgggaggtgggcacttccaatggccgaggtttttctcatcccctgcattgtggtgggacacccagccaggcaccctttttaaaccagatgaggccagcagtaccaggaacatttggccctctgcgaggatcagatcctgccaccttgtatggctcctctggagtcctggagccacaccccggggagcctgtgcagcagcgtcagcctttcaccatgcagcctccagttggaattaacagcctccgaggacccaggctaggcacaccagaggagaagcaaatgtgcggggggctgacacacctttctaacatgggcccacaccctggatccttgcagcttgggcagataagtggcccaagtcaggatggaagcatgtatgctccagctcagttccagccaggattcattcctccccggcatgggggggctccagcccggccaccagactttcctgaaagctcagaaattcctcccagccatatgtatcgatcgtacaagtacctgaatcgagtacactctgccgtctggaatgggaaccatggtgctacgaaccaaggacccttgggcccagatgagaagccccacctggggccaggaccctctcaccagcctcgcactctcggtcacgtgatggattcccgagtcatgagaccacctgtcccccccaaccagtggactgaacaatcaggcttcctacctcatggagttccttcctcagggtacatgcgaccgccctgcaagtctgccggacatcggttacagccacctccagtgccagcacccagttctttgtttggagcacctgcccaggctcttcggggggtgcagggaggggactccatgatggacagcccagagatgattgcgatgcagcagctctcctcccgcgtctgccccccaggtgtgccttaccacccccaccagcctgcacacccccgtttacctggcccttttccgcaggtagctcacccaatgtcagtcactgtgtcagcccccaagcctgccctgggcaaccctgggagggcaccggagaacagtgaagcacaagagcctgagaatgaccaagcagagccgttgcctggccttgaagagaaaccaccaggtgttggtacttcagagggggtctacctcacacaactacctcaccccacacctcccctgcagactgactgcaccaggcagagctcaccacaagaaagggaaacagtgggcccggagctcaaaagcagctnctccgaatctgcggacaactgtaaagcaatgaagggcaagaatcccnggccctcggatagcagctaccccggcccagccgcccaagggtgcgtgagagacctctccacggtggcagacaggggcgctctatccgagaacggagtcattggggaagcatctccttgtggatcggaggggaagggccttggtagcagtggttccgaaaagctgctctgccccagaggcagaacgttgcaggaaaccatgccatgcacgggacagaacgcagcgacaccgcccagcacagaccccggtttgacgggaggcactgtgagccagtttcccccgctgtatatgcctggcctagagtacccgaattcagctgcccattaccacatcagtccaggcctgcagggtgtgggccctgtgatgggagggaagtccccagcatcccatccccagcattttcccccaaggggctttcagtctaaccacccacattctggaggctttccccggtatcgccccccacaaggaatgaggtattcctaccacccaccgccacagccttcctaccaccactatcagcgaactccttactatgcctgtccacagagcttttctgactggcagagacctctccatccccagggaagcccaagcggacccccagccagtcagcctcccccaccaaggtccctcttctcagataagaatgccatggccagtctgcaaggctgtgagacactgaatgctgccttaacttctccaacccgtatggatgcagtggctgctaaagtcccaaatgacgggcagaatcctggtccagaggaagagaagctggatgaatctatggagaggccagagagtcccaaagaatttttagacctggacaaccataacgcagctaccaagcggcagagctcgttgtcagccagcgagtatctctatggaactcctccgcctctgagttcaggaatgggatttggttcatctgcatttccaccccacagtgtgatgctgcagacggggcctccctatacccctcagcggccggccagtcactttcagcccagggcttactcttcccctgtggctgccctcccacctcaccacccaggggccacccagcccaacggcctctctcaggagggtcccatctatcgctgccaggaagaaggcctgggtcactttcaagctgtgatgatggaacaaattggcactagaagtggaataagaggacctttccaggaaatgtacagaccatcaggaatgcagatgcacccggtccagtcgcaggcctcgttcccaaagacccccacagcagcaacatcacaggaggaggtgccgcctcataagcctccaacacttcccctggatcagagctagtccaaggaggaaatgagccccaagcaatggaaagctgcacacgaagactggaatgtggagaactggggagtgccctgtcagctctattcccatcacctgctccaccccttcacggcgacccactcgtgccatacttgagctggagccagtcacgggccctaaaaggacactccttagatgactgacacacagattgcaaaggtcctcggccagggatctcttgcacagctgatgtagacagtcaggcaaaactaatgaacgtggagttaatgatgacttttccaaatcctgagacacttttcagggaaaatcactttaaacttgggggagggggtatactcaagaatggagtggtgcttttaaactttgatgagcagctaaactcaggtatatatttggggaagggactactcttagtattaatggttttggagctgggtccagtttacagaattttcatgttgccttttaaaataatttttgttggtggtgaatgtattgtacataaagtgggaagggtgggtggggatgcggaagaaatgggggtcctaactggtgggcacacagcactggagtgatttttatctgtttacaatcatgtcacactgaatacttatgggagccggagatgagggtaggaaaggtttgatcttgtaatatgtcactgtgtttccttagtggccagccagccttcagaatagctaaaggccttccttccttccagtcagcctgagagagaacacctgtcccctaagcacctggtgtctccattggaggcagactgctctcaggagactactagaagcttcagcccggaagacaggctgctctctcatgctggtggcccaaattgagaaagtggtgtcccttcctgattttgccaccagccctaccgaatagttgtaaaccagtatcaggaattgggatcgctagagtgtttcacgtattagaagatgaatcgtcctcatcacagacctccctgtcaggactgtgatctagaaggcatcacacacagctttctggcacgaatcacattttgtggaagtgactactcaggtttgtatattttagtatcaataaagaattgcacaggtttgaataggaaaaatgtattctatagatttacagtttgaatttaggaatatttcagtatatatagtttttattcgttttaagtgaatcatagtaaaatcagtcatggtgatttaaaatagctatcaagaacaagttcttggaattatctgttgtatctgtgataggaaaccattttacagtattaaattactttattacagttgtagagtt

SEQ ID NO: 105150 - DNA, 2357 bp, Homo sapiens
  misc_feature (175)..(176): n is a, c, g, or t
cgggggttgttgttgtggcgcgggcagccccgccccctcctcgtgggcggcccctcccccaggccccgcgtccggcccctccgcccctagccccatctgtttctccggcggggactcgattatattgtaggggactgggggcggccgccgccgcagccgcgggatggggcgagcnngcggaccccgcgggcagccgcagccgcagccgcctcagtagttcgggcccccgcgccgccgccccccgcccggcgcccgccctcggctcctgcactcgccgagcggcggcagcagcgggaggagcgccccgccgcccccgccgaggaccgcgcggaggctgcggcgctgccgcggcgggagtcccaggtcggcgggcagagcgcgggcagcgaggggccgccgcctgtgccgcagcggggagatgtgcccagaggagggcggcgcggccgggctgggcgagctccgctcctggtgggaggtcccggccatcgcgcacttctgctcgctctttcgcaccgcgttccgcctgcccgacttcgagatcgaggagttagaagccgctcttcacagagatgacgtggagtttatcagtgacctgattgcctgcctgcttcagggctgctatcaacgaagagatatcacgcctcagacattccacagctacctagaggacatcatcaactaccgctgggagctcgaagaagggaagcccaaccctctgagggaagccagtttccaggacctgcctcttcgcacacgggtggagatcctgcaccgactctgtgattaccggctggatgcagacgatgtcttcgatcttctaaagggcctggatgcagacagtctccgtgtggagccattgggtgaagacaattctggggcactatattggtatttctatggaacacgaatgtacaaagaggacccggtgcaaggaaaatccaatggagaactctctttgagcagggaaagtgaaggacaaaaaaatgtctcaagtattcctggaaaaacgggaaaaagaagaggaagacccccaaaacggaagaaactgcaggaggagattctgttgagtgaaaagcaggaagaaaattccttggcatccgagccacagacaagacatgggtcccaagggccaggccaaggtacttggtggctcctgtgccagacagaagaggaatggagacaggtcaccgagagttttcgcgagaggacctcccttcgagaacggcagctctacaagctcctcagtgaggacttcctgcctgagatctgcaacatgatcgcccagaagaggagactcctgtgctgaccagaatagaaaaacaaaagcgcaaagaggaggaagaagagcgtcagattcttctagcagtgcagaagaaggagcaggagcagatgctaaaggaagagaggaaacgcgagttggaggagaaggtcaaggcagtggaaggtatgtgcagtgtccgcgtggtctggagaggtgcatgtctgtcgaccagccgtccttagatcgagcgaagaggagaaagctcagggaagaaagggcatggctgctggctcaaggaaaggagctccctccagaactttcccatctggaccccaattcccccatgagagaggaaaaaaagactaaagacctctttgagttggatgatgatttcactgctatgtataaagttctagacgtggtaaaggctcacaaggattcctggcccttcttggaacctgtggatgaatcttatgcccctaactattatcagattattaaggcccccatggatatttccagcatggagaagaaactgaatggaggtttatactgtaccaaggaggaatttgtaaatgacatgaagaccatgttcaggaattgtcgaaagtataatggggaaagtagtggtaagcagggaaggagtttgtgctagatacatatctgtaatcaagaataaaatgccttctcttttacaaatacacatcctagtgccttttctgtaggacagtgaacagaatgtgtatgaaaagtcatgggattgaccattccagccacttatacagtgtctgccagggattctctcctgccccacaggacaatagagtgcagctggcagctaactggctcatcctggagaccagtctgggtctggattatactgtgtgtgcctctttaaccaccgaggggactgaccctacatagagctgactcttcaaccatctggggaagctggcgtagtagatctgcaatatcaaagtagaaatggctctttctgaacatcacactccggggcctgttgtgaggtgggggaagaggggagggatagcattaggagatacatatacctaatgtaaatgacgagttaatgggtgca

SEQ ID NO: 105151 - DNA, 109 bp, Homo sapiens
caaaggttttgcatctgtgagaaggagctgcattattttaggaagaatcttttggagtctgatgacttgagttcagatttgggctctgacacaaactacgtgagcttag

SEQ ID NO: 105152 - DNA, 1018 bp, Homo sapiens
agtcagtaatactgaatttgagaagtttgtgaactcaactggctatttgacagaggctgagaagtttggcgactcctttgtctttgaaggcatgttgagtgagcaagtgaagaccaatattcaacaggcaggttgctttgaggttgcagctgctccctggtggttacctgtgaaaggcgctaactggagacacccagaagggcctgactctactattctgcacaggccggatcatccagttctccatgtgtcctggaatgatgcggttgcctactgcacttgggcagggaagcggctgcccacggaagctgagtgggaatacagctgtcgaggaggcctgcataatagacttttcccctggggcaacaaactgcagcccaaaggccagcattatgccaacatttggcagggcgagtttccggtgaccaacactggtgaggatggcttccaaggaactgcgcctgttgatgccttccctcccaatggttatggcttatacaacatagtggggaacgcatgggaatggacttcagactggtggactgttcatcattctgttgaagaaacgcttaacccaaaaggtcccccttctgggaaagaccgagtgaagaaaggtggatcctacatgtgccataggtcccaagagtactatgatccctattttcaagatgtggcatctgagatgttgagaagacacacagccagcaggtggaaggccttctcatctctagaaccatgctgctcaatacgtaggcatcagcaatatgcagctattgaacgtttgacatgtggcaagtttgaattgagatgtgctgtaagtacaaaatacacactgaattttgaagacttagtatgaaataaataatgtaaaaaaccccacaaacatttttatattgattacatgttgaaataatattttgaacatattgtgttaaagtatattattaaaattactatcattgttttttactttttaaaatgtggctcaaatttaaaatgtaaatttttgaaactttga

SEQ ID NO: 105153 - DNA, 899 bp, Homo sapiens
agtcagtaatactgaatttgagaagtttgtgaactcaactggctatttgacagaggctgagaagtttggcgactcctttgtctttgaaggcatgttgagtgagcaagtgaagaccaatattcaacaggcaggttgctttgaggttgcagctgctccctggtggttacctgtgaaaggcgctaactggagacacccagaagggcctgactctactattctgcacaggccggatcatccagttctccatgtgtcctggaatgatgcggttgcctactgcacttgggcagggaagcggctgcccacggaagctgagtgggaatacagctgtcgaggaggcctgcataatagacttttcccctggggcaacaaactgcagcccaaaggccagcattatgccaacatttggcagggcgagtttccggtgaccaacactggtgaggatggcttccaaggaactgcgcctgttgatgccttccctcccaatggttatggcttatacaacatagtggggaacgcatgggaatggacttcagactggtggactgttcatcattctgttgaagaaacgcttaacccaaaaggtcccccttctgggaaagaccgagtgaagaaaggtggatcctacatgtgccataggtcttattgttacaggtatcgctgtgctgctcggagccagaacacacctgatagctctgcttcgaatctgggattccgctgtgcagccgaccgcctgcccactatggactgacaaccaaggaaagtcttccccagtccaaggagcagtcgtgtctgacctacattgggctttctcagaactttgaacgatcccatgcaaagaattcccaccctgaggtgggttacatacctgcccaatggccaaaggaaccgccttgtgagac

SEQ ID NO: 105154 - DNA, 391 bp, Homo sapiens
tatttgataacaacagtttttccaacttagatacttctttctccattccaaatagattctgacctaccacagtgtagaatgtcactacatttttcttattatttgagcttttctgagcaaggtgattctgcaacagatctttaaacagctttccaacagtgcaattaaacaatcttaccaaaaaaaaaaaaaaaaaaaaggtaagtgtataagataatggacaggttaatttgcttggtttaccttcccacaatatatgcatattttaaaacatcatgttgtacaccataaatatatacagcttttaatatatacagcttttatttgtcagttaaaaaaccccaaaaacaataaaagtaataataatcacttcaagtgattttcttttctt

SEQ ID NO: 105155 - DNA, 768 bp, Homo sapiens
tcaaatatactctatatttaattataaaaaaattactattatgaataaagctgctataaatactcatgtacaggtctttgtgtagacctatgtttttatttctcttgagtaaatacctagaggtgaaatgatgaggttgtatgggaaatgtgtgctaacttttggcaaattattttccaaagtggccgttccttgttggattcctaatgtataacagttacagttgctccatatcttcaccaatacttaatattgtggtcttttaaattttagcccttctaataggtgtgaagtggcatctcattacggttttaatttgcatttccccaatggctagtgatgttttgcacctctttatgtgcttattggcctaaggaagtacttgttcaaatattttgcctcttaaaattcagtcatctacttcttttgatataggttttttattgggaaataattgtagattacaggaagactcaaaggcacaggagggaggtccaggtccagagcactcttcagctgggcttcccagtgttaacatcttgcataactgtagtacattattgaaaccaggaaattgacattagcacaatccatagagctgattcagatttcattagttatacagatactcatttgtgtgtgtgtgtttgtgtatagctgtatgcaatgttatcatgagtagctttgtatacaccaccaccacaatctagaatgcctaactgtaccggcacctcaagactccttatgctacccctttatagataccca

SEQ ID NO: 105156 - DNA, 784 bp, Homo sapiens
ggtaatgtatgtaatacttctctaaaatggatttgtataaatacataataatctcatgttgctagacaacctaatttggttttcctgctatctttaaccttttccatttaacaaacattcactcataaattctttagttttcccaaactcaattttcacccagtctgtaaatggaataaacaacatagcatcaagaacatcttgttggccaggcgcggtggctcacgcctgtaatcccagcactttaggaggccgagacggacggatcacgaggtaaggagattgagaccatcctggcgaacacggtgaaaccctgtctctactaaaaaaatacaaaaaattagccgggcgtggtggcaggcgcctgtagtcccagctactcgggaggctgaggcaggagaatggcgtgaacccagaaggcggagcttgcagtgtgagccgaaatcgcgccactgcactccagcctgggcgacagagcgagactctctctcaaaacaaaacaaaaaaaaagaacatcttgttgggctttgttgctgcttacgtgggtgtgctcttaacagcatttgaataccaatgatatgctggatcctaattataatgagatacccttatagcatttctaaccgagtcttttgagtggacattacatgttagttaactgtgccagtgctcagattacaatggtgaacatttctgacatggttcctgctcttttggagcacacaccttgagggtgatataggtaaataggtgactacaatccaggtgtgttagaggaagccca

SEQ ID NO: 105157 - DNA, 450 bp, Homo sapiens
agggaaggcctctcaggaagtgacttttaagctgaaaactaagggatgagaaggagccagctataatgtagagcaaagagtatgtgtgtggaatgttctggaaagagggaacagtggatgcaaaggccctaaagtgggaatgagcttggcacattagaaaaaaaaataaccaaggcctgggcggctctggtgtagcaggcatggggaaagagtagtaagggtggaagctaggccagatacatactgagcgcagtggctcaatcttgtaatcccagcactctggggggccgaggcgggtggatcacttgaggtcaggagtttgagaccagcctggccaacatggtgaaaccccggctccactaaaaatacaaaaattagctgggcatggtgatgtgtgcctctaattccagctacttgggaggctgaggcatgacagtcacttgaacccac

SEQ ID NO: 105158 - DNA, 787 bp, Homo sapiens
actttatgtattaaatactaatcataccatatttttcaattctaacatttatataaacatttgtgttgaaatttggttaatttctctgatgtctactctgatcatctggcaagctaatcagtagctattacatttttacattttaagtaaataagaacaaaacccactaaaatatgagttagcagacctttaagcagtttagaaaataaaaaattgctatagatgacatacatttattttgcagcaaagtcatatattgatgggactatttccaaatgtaaattttcaaaatattctctcagaactaataatttctttagagaagctatactgtctttatcattcttgaacacttcctctacttggagggacagattattaattttttcaaaaatatattcttgataagatacctttgacagccacttgtcaccattgaacaggtcagcaaaattgaactcttctcctttttgtatatttaattcatctttaaggttaaactctttgggtattttgctgtgagataccttgttaacctttatgtggttaaaaaagattttcaggccaggtgtggtggctcatgcctgaattcccagcattttgggaggtcaaggtgggcagatcacctgaagtcaggagtttgagaccagcctggccaacacggtgaaaccccgtctctactaaaaatacaaaaaaaaattaggccgggcgtggtggcggatgcctgtaatctgagctacaggggaggctgaggcaggggaatcacttgaacttgggaggcggaggt

SEQ ID NO: 105159 - DNA, 373 bp, Homo sapiens
aaagatgttctgttgtggggctgttcccaggctcagcttcctcacactgaggcagtgcatccagtactgaaataaggaacattgcaatgatgcctggggtcagcaagtggccttgctgacatcacaacatgtgcatttctcactgttcttggttatttaattctggtctggtccattggattagagccagattaaacatcaataaattttgagtttactattaacaaagagcagagtcctgctaccttactgttactttgctaggtgctaagagagaaatcagaaaatttaaggcatggattttggtcacagggagcaaaatctagtcttcattggctaagaagccttaaaaaccatgtaactgtcacatagt

SEQ ID NO: 105160 - DNA, 646 bp, Homo sapiens
tgaaatatttgcagaagtattatactcattgttttttcatctcaactgtttcctcctcttctgaaaactgctcttgtcttgttactcatttcctattctgcctccttcaccttccctacctttatagtgttccttctagtcagtgacaagcaaagtaccaaaaactgtaatacaattacaatagtagttctaagactttatataacctattctctctaatagcatcaggtcccttaattttactatggacttttagattatttaatgtgaatgagggtcttcacttactgagatcatactgttaatttcatatatactgtggtaactgcatttttttttaaagagatagcatcttccagctgggtgcggtggctcacgcctgtaatcccagaactttgggaggccaaggtgggcggatcatgaggtcaggagatcgaaaccatcctggctaacacggtgaaaccccatctctactaaaaaatacaaaaaaaattagccgggcatggtggcaggtgcctgtattcccagctactcgggaggctgaggcaggagaatggcgtgaacccgggaggcagagcttgcagtgagccgagattgcgccactgcactccagcctgggagacagtgagactccatctcaaaaaaa

SEQ ID NO: 105161 - DNA, 465 bp, Homo sapiens
ttgttaagaagtgattcatgatgactgcagagcagagaacaactgagagcacagagaagcactggacccttccaagcaagggactctgtgtgactgcacaggttgcctgtctataaagctggcatagctagaggtgctagtagtaagttggagatgtagactatgaagaaagaagaattgagatttgtaagctttctacttgagggcttaggtgatattgacgcaaccaacagaaatagaggctataagatggagaatggtcccattgtggtggctcaaacctgtgattccagcagtttgggaaagcctaagcgggaggaccttttaaggccaggagtttgagaccaatagctgggcatggaggtgtgagccagtggtccctgctactctggaggctgagctgctaggaatccttgagcccatcaggaggttgaaggacaatagagcaagaccttgtcttgacaa

SEQ ID NO: 105162 - DNA, 298 bp, Homo sapiens
ccacaagaaatgaaaacttaggttcacatacagaatatacacaaatattcatagccaaatgaaaacttaggttcacatacagaatatacacaaatattcatagcccaaatctggaaacaacataaacgtccccaacaggtgaatctacaaacaaattgtggtatatctacacaatgggatactactgagcaatataaagtaaatgaactatcaatatatacaacaacatgaataagtctcaaaattattctcaaacagtagggtttctaggcaatttaagggtgttgtttctctgtag

SEQ ID NO: 105163 - DNA, 522 bp, Homo sapiens
actttttagagacaggatcttgcgttattgctcactgaaggctcgaacacctgggcacaagtgatcatcttgccttagctcctcatgtagctgagactacaggcacacaccaccatgcttgtttctgctttatgtatatgtataaaattttttcgcagaaccgtttgaaaggacgttacagaccagacactgcttctaaagaccagcgtgtgtcttctaagaacaaaggtgttctacaggccggcatggtggctcacgcctgtaatcccagcactttgggaggccaaggcgggtggatctcttaagcccagaacttcaagatcagcctaggcaacatggcgaaaccttctctctgcaaaaaatacaaaaattagctgggcatgatggcacacacctgtagtcccagctactcaggagactgagactggaggatctcttgagcctgggaggttgagactgcagtgagctgtgattgtgctgctgcactcctccagcctgggtgacagagtgagaccctgtctc

SEQ ID NO: 105164 - DNA, 2034 bp, Homo sapiens
atggtagaaccctattggaaaagtggtaatgggaatagaaggagcagttacctttgtatccgcattgttaaaataggcttttatgctgtgctgtgctttcaagaaaccttgtttgacctctggcattttactgatcagtggaccgttgcactggattataatgggattctactatatacaaatccacattgttcttctccctccagccagatttgcagatgtaatctgggctttccaagtccctctgagtttccttcacttttactgatttttttcttctaaatatggtcaagatagcttctgtcacatgttaagtaaataagctgaagaaatttggtcccggctttgttttaatgtacaaaccggtatgtgatcacttcagtgagcatccctctatagatgggctttagtaaagactgtcccaaagagcccctacttctctaatgccccccccttttttttttaggaaaagaacatgcagttttactcatcacttcttcatgacaccaaatccattgctaggtttagctcctggtcccttttcagcaagattcatgttatccgtcttacaactttgattttggaaagtattatgtcctaaaaatgcactgcttaacacagtggggtttttttcccccgaggtgtctttaactggggaagtaccacaaacatagagcagagactttaatttctatattctacaatagaccatcaccaaacatcttatcatgttgttgctttctgagtaataggtgctacgcaggtaggcgggctttctctaggactaggtgtacgtttattttgtaataacagggctatctacaaggcctctcagccttactcctggcttcataggacacaggtagcatccctctagtcattggcaatggctctttcagctcggaggaagcttggaggaaactcagattacttggtatcttttcctgttgctgcattgcttagtgtttccttgttgctgggtcctactctctagtagatactaaactgctgtgaagtacaccatacacatttcactaagattccagagccaccttggtgacataacagaaacaaaatcatgttggttacaaaacaaattaaatctctattgttaacttttaagcatttcacaaacaacattgtaaatgtgcgatgttacgttttaaatcagaccacagtggtccccaaatattatgtacatatggcaatttcataggtaatcgaacctatgctccaatgttaaattatttgtgtatatgtaaaatacacaagctttaagctatgtgtgtatgaatatgaaagttaatgcaaccatatcaattgtaaaaatggattataattatttttgatggtattaggttatgtagtttcaaactctttgctgtattttgttttgcacctgccattcatttgctaatttttgtggcgtggagattcttttttattaatttgagctcacagcacaagtgtatcactgtttaatgttacccaacaagagttagtgttaagtgatgatcaagttcccatttcacctgctctacttttgctgcattaattaatgacacccggatgaggagacgtgcgctaacttcattgctcatctgggatagtgcatgagcccattgaattagagctgctcctactagataactgagcagtacacataagtgcatgttatgaaacatgaatcacatagagcagtggagttttaccaagtggtgtgtgtggtttttgttttttactatgcaaagatgggaaatgcacaaacttttcaaagactagtgtctgaagaactttacaaacaatacttgaaccctttctttaaagttatcccatcatgttttatagtcattgttgcttccattgttagtttccattttcaagtgctttgtaattttttaagtgcactacctgaaattttgtttgaaattaataaattcattcgtatcttgttggctgcctatgaatggagattcagtagtcattgtatgcatctttaagtcaaatgtgtattaaaactttcgttaacgtaga

SEQ ID NO: 105165 - DNA, 2065 bp, Homo sapiens
atggtagaaccctattggaaaagtggtaatgggaatagaaggagcagttacctttgtatccgcattgttaaaataggcttttatgctgtgctgtgctttcaagaaaccttgtttgacctctggcattttactgatcagtggaccgttgcactggattataatgggattctactatatacaaatccacattgttcttctccctccagccagatttgcagatgtaatctgggctttccaagtccctctgagtttccttcacttttactgatttttttcttctaaatatggtcaagatagcttctgtcacatgttaagtaaataagctgaagaaatttggtcccggctttgttttaatgtacaaaccggtatgtgatcacttcagtgagcatccctctatagatgggctttagtaaagactgtcccaaagagcccctacttctctaatgccccccccttttttttttaggaaaagaacatgcagttttactcatcacttcttcatgacaccaaatccattgctaggtttagctcctggtcccttttcagcaagattcatgttatccgtcttacaactttgattttggaaagtattatgtcctaaaaatgcactgcttaacacagtggggtttttttcccccgaggtgtctttaactggggaagtaccacaaacatagagcagagactttaatttctatattctacaatagaccatcaccaaacatcttatcatgttgttgctttctgagtaataggtgctacgcaggtaggcgggctttctctaggactaggtgtacgtttattttgtaataacagggctatctacaaggcctctcagccttactcctggcttcataggacacaggtagcatccctctagtcattggcaatggctctttcagctcggaggaagcttggaggaaactcagattacttggtatcttttcctgttgctgcattgcttagtgtttccttgttgctgggtcctactctctagtagatactaaactgctgtgaagtacaccatacacatttcactaagattccagagccaccttggtgacataacagaaacaaaatcatgttggttacaaaacaaattaaatctctattgttaacttttaagcatttcacaaacaacattgtaaatgtgcgatgttacgttttaaatcagaccacagtggtccccaaatattatgtacatatggcaaatgtcagtgtaactttttgttacactggcaatttcataggtaatcgaacctatgctccaatgttaaattatttgtgtatatgtaaaatacacaagctttaagctatgtgtgtatgaatatgaaagttaatgcaaccatatcaattgtaaaaatggattataattatttttgatggtattaggttatgtagtttcaaactctttgctgtattttgttttgcacctgccattcatttgctaatttttgtggcgtggagattcttttttattaatttgagctcacagcacaagtgtatcactgtttaatgttacccaacaagagttagtgttaagtgatgatcaagttcccatttcacctgctctacttttgctgcattaattaatgacacccggatgaggagacgtgcgctaacttcattgctcatctgggatagtgcatgagcccattgaattagagctgctcctactagataactgagcagtacacataagtgcatgttatgaaacatgaatcacatagagcagtggagttttaccaagtggtgtgtgtggtttttgttttttactatgcaaagatgggaaatgcacaaacttttcaaagactagtgtctgaagaactttacaaacaatacttgaaccctttctttaaagttatcccatcatgttttatagtcattgttgcttccattgttagtttccattttcaagtgctttgtaattttttaagtgcactacctgaaattttgtttgaaattaataaattcattcgtatcttgttggctgcctatgaatggagattcagtagtcattgtatgcatctttaagtcaaatgtgtattaaaactttcgttaacgtaga

SEQ ID NO: 105166 - DNA, 2237 bp, Homo sapiens
atggtagaaccctattggaaaagtggtaatgggaatagaaggagcagttacctttgtatccgcattgttaaaataggcttttatgctgtgctgtgctttcaagaaaccttgtttgacctctggcattttactgatcagtggaccgttgcactggattataatgggattctactatatacaaatccacattgttcttctccctccagccagatttgcagatgtaatctgggctttccaagtccctctgagtttccttcacttttactgatttttttcttctaaatatggtcaagatagcttctgtcacatgttaagtaaataagctgaagaaatttggtcccggctttgttttaatgtacaaaccggtatgtgatcacttcagtgagcatccctctatagatgggctttagtaaagactgtcccaaagagcccctacttctctaatgccccccccttttttttttaggaaaagaacatgcagttttactcatcacttcttcatgacaccaaatccattgctaggtttagctcctggtcccttttcagcaagattcatgttatccgtcttacaactttgattttggaaagtattatgtcctaaaaatgcactgcttaacacagtggggtttttttcccccgaggtgtctttaactggggaagtaccacaaacatagagcagagactttaatttctatattctacaatagaccatcaccaaacatcttatcatgttgttgctttctgagtaataggtgctacgcaggtaggcgggctttctctaggactaggtgtacgtttattttgtaataacagggctatctacaaggcctctcagccttactcctggcttcataggacacaggtagcatccctctagtcattggcaatggctctttcagctcggaggaagcttggaggaaactcagattacttggtatcttttcctgttgctgcattgcttagtgtttccttgttgctgggtcctactctctagtagatactaaactgctgtgaagtacaccatacacatttcactaagattccagagccaccttggtgacataacagaaacaaaatcatgttggttacaaaacaaattaaatctctattgttaacttttaagcatttcacaaacaacattgtaaatgtgcgatgttacgttttaaatcagaccacagtggtccccaaatattatgtacatatggcaaatgtcagtgtaactttttgttacactggcaatttcataggtaatcgaacctatgctccaatgttaaattatttgtgtatatgtaaaatacacaagctttaagctatgtgtgtatgaatatgaaagttaatgcaaccatatcaattgtaaaaatggattataattatttttgatggtattaggttatgtagtttcaaactctttgctgtattttgttttgcacctgccattcatttgctaatttttgtggcgtggagattcttttttattaatttgagctcacagcacaagtgtatcactgtttaatgttacccaacaagagttagtgttaagtgatgatcaagttcccatttcacctgctctacttttgctgcattaattaatgacacccggatgaggagacgtgcgctaacttcattgctcatctgggatagtgcatgagcccattgaattagagctgctcctactagataactgagcagtacacataagtgcatgttatgaaacatgaatcacatagagcagtggagttttaccaagtggtgtgtgtggtttttgttttttactatgcaaagatgggaaatgcacaaacttttcaaagactagtgtctgaagaactttacaaacaatacttgaaccctttctttaaagttatcccatcatgttttatagtcattgttgcttccattgttagtttccattttcaagtgctttgtaattttttaagtgcactacctgaaattttgtttgaaattaataaattcattcgtatcttgttggctgcctatgaatggagattcagtagtcattgtatgcatctttaagtcaaatgtgtattaaaactttcgttaacgtagaatgttgtagctttatgctttaatcatttcttttaaacccccttttctgtttcctcttgtagtgctgattaaatggccatgtgcctgatatcatcagagttttagcatggatccaaaggcttactgaaaatttaagcagtcagtggcacaaaataaaatctctgattaatgat

SEQ ID NO: 105167 - DNA, 964 bp, Homo sapiens
agaccagcctggccaatgtggcaaaaccccatctgtactaaaaatacaaaaattagccagatgtggtgatgcatgcctgtaatcccagctattcaggaggctgaggcagaagaattacttgaacccaggaggcggaggttgcagtgagccaagatggcgcagtgtactccagcctgggtgacagagtgaaactccgtctcaaaaaaacaaaaattagccaggcatggtggcacacacctgtagtcccagctattcaggaggttgaggcatgagaattgcttgaacccaggaggtggtggttgcagtgagccaagatggtaccactgcactccagcctgggtgacagagtcagactctgtctggaaaaaaagaaaaaatatgttattatttactaccactaatctgagtgaattaatttggatattatatctattctaagaacatatctactgttctctagtcctacattttaaacctattttttgtctagatagcctcttttaccagacagaattgatttgtgtttttaaaagtagatattataaattctccaaactagagttcttgtatttcagtcccacgtatgactgcatttggacaaagggtttgctaccaaatgttgtggtactgctgtgatgttgctctgacaaagaagaacataaggaagagcagaagaggaccctgtgtgtcactagggggacttgggggaggcagcagagtatagatagcatttgagccaaagcttaaaggagaaattggaatttttagggcagacaggctcaggaaatacattccaggaagagcgaagagtgcgggtaatgacatggagtcaaaaggctatattccagccaggcacagtgactataatctcagcttctcggcaggttgaggcagggagatcgcttaagtctaggagtttgagactagcctgggcttagcaagaccctgtggcaaaaaaaaaaaa

SEQ ID NO: 105168 - DNA, 287 bp, Homo sapiens
aagaagcaaatagatgataaaataaatacaagaagctatactactatttaagaagttaagttagaagagaaagcagggttgagtagggcaaaagagtggagacattttagcatgtttatgtgctgagagaaatcagcatctaaacatgctcaaatgggagaagggagaaaaatacatggggagaaaagaggttaattaatgaagcaattctgggagacaagagtaaaggtgatagatagatcactcttacataggagagggcactacttcctttggagaggagataa

SEQ ID NO: 105169 - DNA, 379 bp, Homo sapiens
aactttggtatttccatccctagatttatatacagcaggttaggttccgtacataggcaggttctgaataataaaaaccaacagtgatatagcactcactttgtgccatgcactgttctaagcgatttacatacacttaatttttaaaattgtagtaaaatacacataagtttaccatttgaaccattttaaagtgtacaatcggtagcatttaatgcattcaaaatgatgcacacccatcaccattatgtagctccagaacattttcatcactccaaaaggaaacctcttacccattagcagccacttccaattcctccagcccctggaaaccactaatttgttttctacctctacagatttacccattttagatatt

SEQ ID NO: 105170 - DNA, 413 bp, Homo sapiens
gcacgagcctctgaccctggagacagtgtcgccggggcttctggtgccttgtaataagctctacatccctattcctcttctgattttaacaagattcccgagcaggtgaagaaggctcgatcagggcagtggatcatgccgtgatcggtggcgtcgtggcggtggtggtgttcgccatgctgtgcttgctcatcattctggggcgctattttgccagacataaaggtacatacttcactcatgaagccaaaggagccgatgacgcagcagacgcagacacagctataatcaatgcagaaggaggacagaacaactccgaagaaaagaaagagtacttcatctagatcagcctttttgtttcaatgaggtgtccaactggccctatttagatgataaagagacagtgatattgg

SEQ ID NO: 105171 - DNA, 458 bp, Homo sapiens
tcgacagctaacaatcaggctgtattgattttctgtttgcatgctgttatgaatgagtgattttaagcattcaccttcatgtttcatgtcctttgaacagtggagactgaggaatctttctgcctcgattgcgtattaagaacaaaattacataattgaagaaatgtacttatggattaatacattcatgctatcaaaaacatagatagcaagagatttggctcatgtttttaaagaaattcatcctcagttcttaagtgttttgtttatgtccctcgaggaatgaaaagaaaaacgatttgtttttacttgtaaggccttactcagttgcccaattccgcagaagaactggacagtgaggacctctcaggtaagggctagtcattaggtaaggcactgcagtgtccaacctgtgggtgctctatccacttctacaaaatggccgtttggtttctaca

SEQ ID NO: 105172 - DNA, 4861 bp, Homo sapiens
cgccgaacgccagcgccagggggcggggtgggggagggagcgaggccctccgagagccgggttgggctcgcggcgctgtgattggtctgcccggactccgcctccagcgcatgtcattagcatctcattagctgtccgctcgggctccggaggcagccaacgccgccagtctgaggcaggtgcccgacatggcgagtgtagtgctgccgagcggatcccagtgtgcggcggcagcggcggcggcggcgcctcccgggctccggctccggcttctgctgttgctcttctccgccgcggcactgatccccacaggtgatgggcagaatctgtttacgaaagacgtgacagtgatcgagggagaggttgcgaccatcagttgccaagtcaataagagtgacgactctgtgattcagctactgaatcccaacaggcagaccatttatttcagggacttcaggcctttgaaggacagcaggtttcagttgctgaatttttctagcagtgaactcaaagtatcattgacaaacgtctcaatttctgatgaaggaagatacttttgccagctctataccgatcccccacaggaaagttacaccaccatcacagtcctggtcccaccacgtaatctgatgatcgatatccagaaagacactgcggtggaaggtgaggagattgaagtcaactgcactgctatggccagcaagccagccacgactatcaggtggttcaaagggaacacagagctaaaaggcaaatcggaggtggaagagtggtcagacatgtacactgtgaccagtcagctgatgctgaaggtgcacaaggaggacgatggggtcccagtgatctgccaggtggagcaccctgcggtcactggaaacctgcagacccagcggtatctagaagtacagtataagcctcaagtgcacattcagatgacttatcctctacaaggcttaacccgggaaggggacgcgcttgagttaacatgtgaagccatcgggaagccccagcctgtgatggtaacttgggtgagagtcgatgatgaaatgcctcaacacgccgtactgtctgggcccaacctgttcatcaataacctaaacaaaacagataatggtacataccgctgtgaagcttcaaacatagtggggaaagctcactcggattatatgctgtatgtatacgatccccccacaactatccctcctcccacaacaaccaccaccaccaccaccaccaccaccaccaccatccttaccatcatcacagacacaacggcgacgacagaaccagcagttcacgagattcccgagcaggtgaagaaggctcgatcagggcagtggatcatgccgtgatcggtggcgtcgtggcggtggtggtgttcgccatgctgtgcttgctcatcattctggggcgctattttgccagacataaaggtacatacttcactcatgaagccaaaggagccgatgacgcagcagacgcagacacagctataatcaatgcagaaggaggacagaacaactccgaagaaaagaaagagtacttcatctagatcagcctttttgtttcaatgaggtgtccaactggccctatttagatgataaagagacagtgatattggaacttgcgagaaattcgtgtgtttttttatgaatgggtggaaaggtgtgagactgggaaggcttgggatttgctgtgtaaaaaaaaaaaaaaatgttctttggaaagtacactctgctgtttgacacctcttttttcgtttgtttgtttgtttaatttttatttcttcctaccaagtcaaacttggatacttggatttagtttcagtagattgcagaaaattctgtgccttgttttttgtttgtttgttgcgttcctttcttttccccctttgtgcacatttatttcctccctctaccccaatttcggattttttccaaaatctcccattttggaatttgcctgctgggattccttagactcttttccttcccttttctgttctagttttttacttttgtttatttttatggtaactgctttctgttccaaattcagtttcataaaaggagaaccagcacagcttaggatttcatagttcagaatttagtgtatccataatgcattcttctctgttgtcgtaaagatttgggtgaacaaacaatgaaaactctttgctgctgcccatgtttcaaatacttagagcagtgaagactagaaaattagactgtgattcagaaaatgttctgtttgctgtggaactacattactgtacagggttatctgcaagtgaggtgtgtcacaatgagattgaatttcactgtctttaattctgtatctgtagacggctcagtatagataccctacgctgtccagaaaggtttggggcagaaaggactcctcctttttccatgccctaaacagacctgacaggtgaggtctgttccttttatataagtggacaaattttgagttgccacaggaggggaagtagggaggggggaaatacagttctgctctggttgtttctgttccaaatgattccatccacctttcccaatcggccttacttctcactaatttgtaggaaaaagcaagttcgtctgttgtgcgaatgactgaatgggacagagttgattttttttttttttttcctttgtgcttagttaggaaggcagtaggatgtggcctgcatgtactgtatattacagatatttgtcatgctgggatttccaactcgaatctgtgtgaaactttcattccttcagatttggcttgacaaaggcaggaggtacaaaagaagggctggtattgttctcacactggtctgctgtcgctctcagttctcgataggtcagagcagaggtggaaaaacagcatgtacggattttcagttacttaatcaaaactcaaatgtgagtgtttttatctttttacctttcatacactagccttggcctctttcctcagccttaagaaccatctgccaaaaattactgatcctcgcatgatggcagccatagtgcatagctactaaaatcagtgaccttgaacatatcttagatggggagcctcgggaaaaggtagaggagtcacgttaccatttacatgttttaaagaaagaagtgtggggattttcactgaaacgtctaggaaatctagaagtagtcctgaaggacagaaactaaactcttaccatatgtttggtaagactccagactccagctaacagtccctatggaaagatggcatcaaaaaagatagatctatatatatatataaatatatattctattacattttcagtgagtaattttggattttgcaaggtgcatttttactattgttacattatgtggaaaacttatgctgatttatttaagggggaaaaagtgtcaactctttgttatttgaaaacatgtttatttttcttgtctttattttaacctttgatagaaccattgcaatatgggggccttttgggaacggactggtatgtaaaagaaaatccgttatcgagcagcattttatttacccctcccctatccctaggcacttaaccaagacaaaaagccacaatgaacatccctttttcaatgaattttataatctgcagctctattccgagcccttagcacccattccgaccatagtataatcatatcaaagggtgagaatcatttagcatgttgttgaaaggttttttttcagttgttctttttagaaaaaaagaaaaacaaaaacaaaaacaaaaaaaaaaaatcacaccattgctcacagaattggcatctcatttttgggacctcccatctttctgttttgaaaagtgtacagtagtgcagtgttcctgatgtaactttatggcttacaatgttgacatgtctcaggttcatgtgtttcgattggtgttttccgtctcaggtagattgcaaagtgtaggccccacacattggaaaaaataataataaaacaaagcaaaaacaggaaattatggattttagttgtatattggtttatgtattttttcttaagtatacagtgcactgtttgaaatgtattgttgagtattactttgtacaggttgatcactttttttagagtgaagaaagaacaaacttgttttttgtgttttttaaaggaatataaaataatgaaggatgtataattgatgccaaataagcttgttctttagtcacaccgacgtcttatttttccctttaggccagttctgtttttaaggtgtacatggacaatgttacagtgtaagaaactccatatccatatgttcccattcgcattttgtattggttcatgtataccatttttacaaaaaaaaaaagaaaaaaaagaagtactataaaatatctgtcttcttaataaaaaaaaattaggttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaataacaggagggggacgcgactataatcatgcgcgggtacactttacgcctccgagtaacgcgagacccctgtgaatagagagaagagcgggaagtgagacagcacaaacaacagaaaggcagagggacgacaaagacggtcagcgcgggtgtgaatatccaggcaagagcacacaccattcgggggtgggagacaacaaagagagacaacaaaacacaaaaccgagaacaacagcactcgaccgagaggaaaaaaacaaaaggagagatgtagacgataacccgagaagtccccgtaagacgaccgcacgacagagagtcacacacacc

SEQ ID NO: 105173 - DNA, 3736 bp, Homo sapiens
cgccgaacgccagcgccagggggcggggtgggggagggagcgaggccctccgagagccgggttgggctcgcggcgctgtgattggtctgcccggactccgcctccagcgcatgtcattagcatctcattagctgtccgctcgggctccggaggcagccaacgccgccagtctgaggcaggtgcccgacatggcgagtgtagtgctgccgagcggatcccagtgtgcggcggcagcggcggcggcggcgcctcccgggctccggctccggcttctgctgttgctcttctccgccgcggcactgatccccacaggtgatgggcagaatctgtttacgaaagacgtgacagtgatcgagggagaggttgcgaccatcagttgccaagtcaataagagtgacgactctgtgattcagctactgaatcccaacaggcagaccatttatttcagggacttcaggcctttgaaggacagcaggtttcagttgctgaatttttctagcagtgaactcaaagtatcattgacaaacgtctcaatttctgatgaaggaagatacttttgccagctctataccgatcccccacaggaaagttacaccaccatcacagtcctggtcccaccacgtaatctgatgatcgatatccagaaagacactgcggtggaaggtgaggagattgaagtcaactgcactgctatggccagcaagccagccacgactatcaggtggttcaaagggaacacagagctaaaaggcaaatcggaggtggaagagtggtcagacatgtacactgtgaccagtcagctgatgctgaaggtgcacaaggaggacgatggggtcccagtgatctgccaggtggagcaccctgcggtcactggaaacctgcagacccagcggtatctagaagtacagtataagcctcaagtgcacattcagatgacttatcctctacaaggcttaacccgggaaggggacgcgcttgagttaacatgtgaagccatcgggaagccccagcctgtgatggtaacttgggtgagagtcgatgatgaaatgcctcaacacgccgtactgtctgggcccaacctgttcatcaataacctaaacaaaacagataatggtacataccgctgtgaagcttcaaacatagtggggaaagctcactcggattatatgctgtatgtatacgatccccccacaactatccctcctcccacaacaaccaccaccaccaccaccaccaccaccaccaccatccttaccatcatcacagattcccgagcaggtgaagaaggctcgatcagggcagtggatcatgccgtgatcggtggcgtcgtggcggtggtggtgttcgccatgctgtgcttgctcatcattctggggcgctattttgccagacataaaggtacatacttcactcatgaagccaaaggagccgatgacgcagcagacgcagacacagctataatcaatgcagaaggaggacagaacaactccgaagaaaagaaagagtacttcatctagatcagcctttttgtttcaatgaggtgtccaactggccctatttagatgataaagagacagtgatattggaacttgcgagaaattcgtgtgtttttttatgaatgggtggaaaggtgtgagactgggaaggcttgggatttgctgtgtaaaaaaaaaaaaaaatgttctttggaaagtacactctgctgtttgacacctcttttttcgtttgtttgtttgtttaatttttatttcttcctaccaagtcaaacttggatacttggatttagtttcagtagattgcagaaaattctgtgccttgttttttgtttgtttgttgcgttcctttcttttccccctttgtgcacatttatttcctccctctaccccaatttcggattttttccaaaatctcccattttggaatttgcctgctgggattccttagactcttttccttcccttttctgttctagttttttacttttgtttatttttatggtaactgctttctgttccaaattcagtttcataaaaggagaaccagcacagcttaggatttcatagttcagaatttagtgtatccataatgcattcttctctgttgtcgtaaagatttgggtgaacaaacaatgaaaactctttgctgctgcccatgtttcaaatacttagagcagtgaagactagaaaattagactgtgattcagaaaatgttctgtttgctgtggaactacattactgtacagggttatctgcaagtgaggtgtgtcacaatgagattgaatttcactgtctttaattctgtatctgtagacggctcagtatagataccctacgctgtccagaaaggtttggggcagaaaggactcctcctttttccatgccctaaacagacctgacaggtgaggtctgttccttttatataagtggacaaattttgagttgccacaggaggggaagtagggaggggggaaatacagttctgctctggttgtttctgttccaaatgattccatccacctttcccaatcggccttacttctcactaatttgtaggaaaaagcaagttcgtctgttgtgcgaatgactgaatgggacagagttgattttttttttttttttcctttgtgcttagttaggaaggcagtaggatgtggcctgcatgtactgtatattacagatatttgtcatgctgggatttccaactcgaatctgtgtgaaactttcattccttcagatttggcttgacaaaggcaggaggtacaaaagaagggctggtattgttctcacactggtctgctgtcgctctcagttctcgataggtcagagcagaggtggaaaaacagcatgtacggattttcagttacttaatcaaaactcaaatgtgagtgtttttatctttttacctttcatacactagccttggcctctttcctcagccttaagaaccatctgccaaaaattactgatcctcgcatgatggcagccatagtgcatagctactaaaatcagtgaccttgaacatatcttagatggggagcctcgggaaaaggtagaggagtcacgttaccatttacatgttttaaagaaagaagtgtggggattttcactgaaacgtctaggaaatctagaagtagtcctgaaggacagaaactaaactcttaccatatgtttggtaagactccagactccagctaacagtccctatggaaagatggcatcaaaaaagatagatctatatatatatataaatatatattctattacattttcagtgagtaattttggattttgcaaggtgcatttttactattgttacattatgtggaaaacttatgctgatttatttaagggggaaaaagtgtcaactctttgttatttgaaaacatgtttatttttcttgtctttattttaacctttgatagaaccattgcaatatgggggccttttgggaacggactggtatgtaaaagaaaatccgttatcgagcagcattttatttacccctcccctatccctaggcacttaaccaagacaaaaagccacaatgaacatccctttttcaatgaattttataatctgcagctctattccgagcccttagcacccattccgaccatagtataatcatatcaaagggtgagaatcatttagcatgttgttgaaaggttttttttcagttgttcttttttttttttttttttttttttttttttttttttggtgttggggggggtggg

SEQ ID NO: 105174 - DNA, 4712 bp, Homo sapiens
ctctgaaccctaagccttcccaggatttcatcgagatcccaaagagtcactcactcacacacgatgaactgcctatacattgggactgtcaacatcaactaacaagacgagattatttattgaaccctcctacctacttctattaagtggctccttgagtttctgtgaggctgaccaaatagcttagctcaagggcaggtgatgggcagaatctgtttacgaaagacgtgacagtgatcgagggagaggttgcgaccatcagttgccaagtcaataagagtgacgactctgtgattcagctactgaatcccaacaggcagaccatttatttcagggacttcaggcctttgaaggacagcaggtttcagttgctgaatttttctagcagtgaactcaaagtatcattgacaaacgtctcaatttctgatgaaggaagatacttttgccagctctataccgatcccccacaggaaagttacaccaccatcacagtcctggtcccaccacgtaatctgatgatcgatatccagaaagacactgcggtggaaggtgaggagattgaagtcaactgcactgctatggccagcaagccagccacgactatcaggtggttcaaagggaacacagagctaaaaggcaaatcggaggtggaagagtggtcagacatgtacactgtgaccagtcagctgatgctgaaggtgcacaaggaggacgatggggtcccagtgatctgccaggtggagcaccctgcggtcactggaaacctgcagacccagcggtatctagaagtacagtataagcctcaagtgcacattcagatgacttatcctctacaaggcttaacccgggaaggggacgcgcttgagttaacatgtgaagccatcgggaagccccagcctgtgatggtaacttgggtgagagtcgatgatgaaatgcctcaacacgccgtactgtctgggcccaacctgttcatcaataacctaaacaaaacagataatggtacataccgctgtgaagcttcaaacatagtggggaaagctcactcggattatatgctgtatgtatacgatccccccacaactatccctcctcccacaacaaccaccaccaccaccaccaccaccaccaccaccatccttaccatcatcacagattcccgagcaggtgaagaaggctcgatcagggcagtggatcatgccgtgatcggtggcgtcgtggcggtggtggtgttcgccatgctgtgcttgctcatcattctggggcgctattttgccagacataaaggtacatacttcactcatgaagccaaaggagccgatgacgcagcagacgcagacacagctataatcaatgcagaaggaggacagaacaactccgaagaaaagaaagagtacttcatctagatcagcctttttgtttcaatgaggtgtccaactggccctatttagatgataaagagacagtgatattggaacttgcgagaaattcgtgtgtttttttatgaatgggtggaaaggtgtgagactgggaaggcttgggatttgctgtgtaaaaaaaaaaaaaaatgttctttggaaagtacactctgctgtttgacacctcttttttcgtttgtttgtttgtttaatttttatttcttcctaccaagtcaaacttggatacttggatttagtttcagtagattgcagaaaattctgtgccttgttttttgtttgtttgttgcgttcctttcttttccccctttgtgcacatttatttcctccctctaccccaatttcggattttttccaaaatctcccattttggaatttgcctgctgggattccttagactcttttccttcccttttctgttctagttttttacttttgtttatttttatggtaactgctttctgttccaaattcagtttcataaaaggagaaccagcacagcttaggatttcatagttcagaatttagtgtatccataatgcattcttctctgttgtcgtaaagatttgggtgaacaaacaatgaaaactctttgctgctgcccatgtttcaaatacttagagcagtgaagactagaaaattagactgtgattcagaaaatgttctgtttgctgtggaactacattactgtacagggttatctgcaagtgaggtgtgtcacaatgagattgaatttcactgtctttaattctgtatctgtagacggctcagtatagataccctacgctgtccagaaaggtttggggcagaaaggactcctcctttttccatgccctaaacagacctgacaggtgaggtctgttccttttatataagtggacaaattttgagttgccacaggaggggaagtagggaggggggaaatacagttctgctctggttgtttctgttccaaatgattccatccacctttcccaatcggccttacttctcactaatttgtaggaaaaagcaagttcgtctgttgtgcgaatgactgaatgggacagagttgattttttttttttttttcctttgtgcttagttaggaaggcagtaggatgtggcctgcatgtactgtatattacagatatttgtcatgctgggatttccaactcgaatctgtgtgaaactttcattccttcagatttggcttgacaaaggcaggaggtacaaaagaagggctggtattgttctcacactggtctgctgtcgctctcagttctcgataggtcagagcagaggtggaaaaacagcatgtacggattttcagttacttaatcaaaactcaaatgtgagtgtttttatctttttacctttcatacactagccttggcctctttcctcagccttaagaaccatctgccaaaaattactgatcctcgcatgatggcagccatagtgcatagctactaaaatcagtgaccttgaacatatcttagatggggagcctcgggaaaaggtagaggagtcacgttaccatttacatgttttaaagaaagaagtgtggggattttcactgaaacgtctaggaaatctagaagtagtcctgaaggacagaaactaaactcttaccatatgtttggtaagactccagactccagctaacagtccctatggaaagatggcatcaaaaaagatagatctatatatatatataaatatatattctattacattttcagtgagtaattttggattttgcaaggtgcatttttactattgttacattatgtggaaaacttatgctgatttatttaagggggaaaaagtgtcaactctttgttatttgaaaacatgtttatttttcttgtctttattttaacctttgatagaaccattgcaatatgggggccttttgggaacggactggtatgtaaaagaaaatccgttatcgagcagcattttatttacccctcccctatccctaggcacttaaccaagacaaaaagccacaatgaacatccctttttcaatgaattttataatctgcagctctattccgagcccttagcacccattccgaccatagtataatcatatcaaagggtgagaatcatttagcatgttgttgaaaggttttttttcagttgttctttttagaaaaaaagaaaaacaaaaacaaaaacaaaaaaaaaaaatcacaccattgctcacagaattggcatctcatttttgggacctcccatctttctgttttgaaaagtgtacagtagtgcagtgttcctgatgtaactttatggcttacaatgttgacatgtctcaggttcatgtgtttcgattggtgttttccgtctcaggtagattgcaaagtgtaggccccacacattggaaaaaataataataaaacaaagcaaaaacaggaaattatggattttagttgtatattggtttatgtattttttcttaagtatacagtgcactgtttgaaatgtattgttgagtattactttgtacaggttgatcactttttttagagtgaagaaagaacaaacttgttttttgtgttttttaaaggaatataaaataatgaaggatgtataattgatgccaaataagcttgttctttagtcacaccgacgtcttatttttccctttaggccagttctgtttttaaggtgtacatggacaatgttacagtgtaagaaactccatatccatatgttcccattcgcattttgtattggttcatgtataccatttttacaaaaaaaaaaagaaaaaaaagaagtactataaaatatctgtcttcttaataaaaaaaaattaggttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaataacaggagggggacgcgactataatcatgcgcgggtacactttacgcctccgagtaacgcgagacccctgtgaatagagagaagagcgggaagtgagacagcacaaacaacagaaaggcagagggacgacaaagacggtcagcgcgggtgtgaatatccaggcaagagcacacaccattcgggggtgggagacaacaaagagagacaacaaaacacaaaaccgagaacaacagcactcgaccgagaggaaaaaaacaaaaggagagatgtagacgataacccgagaagtccccgtaagacgaccgcacgacagagagtcacacacacc

SEQ ID NO: 105175 - DNA, 4460 bp, Homo sapiens
gagagagagagagagagagagagagagagagagagtctgtgattcagctactgaatcccaacaggcagaccatttatttcagggacttcaggcctttgaaggacagcaggtttcagttgctgaatttttctagcagtgaactcaaagtatcattgacaaacgtctcaatttctgatgaaggaagatacttttgccagctctataccgatcccccacaggaaagttacaccaccatcacagtcctggtcccaccacgtaatctgatgatcgatatccagaaagacactgcggtggaaggtgaggagattgaagtcaactgcactgctatggccagcaagccagccacgactatcaggtggttcaaagggaacacagagctaaaaggcaaatcggaggtggaagagtggtcagacatgtacactgtgaccagtcagctgatgctgaaggtgcacaaggaggacgatggggtcccagtgatctgccaggtggagcaccctgcggtcactggaaacctgcagacccagcggtatctagaagtacagtataagcctcaagtgcacattcagatgacttatcctctacaaggcttaacccgggaaggggacgcgcttgagttaacatgtgaagccatcgggaagccccagcctgtgatggtaacttgggtgagagtcgatgatgaaatgcctcaacacgccgtactgtctgggcccaacctgttcatcaataacctaaacaaaacagataatggtacataccgctgtgaagcttcaaacatagtggggaaagctcactcggattatatgctgtatgtatacgatccccccacaactatccctcctcccacaacaaccaccaccaccaccaccaccaccaccaccaccatccttaccatcatcacagattcccgagcaggtgaagaaggctcgatcagggcagtggatcatgccgtgatcggtggcgtcgtggcggtggtggtgttcgccatgctgtgcttgctcatcattctggggcgctattttgccagacataaaggtacatacttcactcatgaagccaaaggagccgatgacgcagcagacgcagacacagctataatcaatgcagaaggaggacagaacaactccgaagaaaagaaagagtacttcatctagatcagcctttttgtttcaatgaggtgtccaactggccctatttagatgataaagagacagtgatattggaacttgcgagaaattcgtgtgtttttttatgaatgggtggaaaggtgtgagactgggaaggcttgggatttgctgtgtaaaaaaaaaaaaaaatgttctttggaaagtacactctgctgtttgacacctcttttttcgtttgtttgtttgtttaatttttatttcttcctaccaagtcaaacttggatacttggatttagtttcagtagattgcagaaaattctgtgccttgttttttgtttgtttgttgcgttcctttcttttccccctttgtgcacatttatttcctccctctaccccaatttcggattttttccaaaatctcccattttggaatttgcctgctgggattccttagactcttttccttcccttttctgttctagttttttacttttgtttatttttatggtaactgctttctgttccaaattcagtttcataaaaggagaaccagcacagcttaggatttcatagttcagaatttagtgtatccataatgcattcttctctgttgtcgtaaagatttgggtgaacaaacaatgaaaactctttgctgctgcccatgtttcaaatacttagagcagtgaagactagaaaattagactgtgattcagaaaatgttctgtttgctgtggaactacattactgtacagggttatctgcaagtgaggtgtgtcacaatgagattgaatttcactgtctttaattctgtatctgtagacggctcagtatagataccctacgctgtccagaaaggtttggggcagaaaggactcctcctttttccatgccctaaacagacctgacaggtgaggtctgttccttttatataagtggacaaattttgagttgccacaggaggggaagtagggaggggggaaatacagttctgctctggttgtttctgttccaaatgattccatccacctttcccaatcggccttacttctcactaatttgtaggaaaaagcaagttcgtctgttgtgcgaatgactgaatgggacagagttgattttttttttttttttcctttgtgcttagttaggaaggcagtaggatgtggcctgcatgtactgtatattacagatatttgtcatgctgggatttccaactcgaatctgtgtgaaactttcattccttcagatttggcttgacaaaggcaggaggtacaaaagaagggctggtattgttctcacactggtctgctgtcgctctcagttctcgataggtcagagcagaggtggaaaaacagcatgtacggattttcagttacttaatcaaaactcaaatgtgagtgtttttatctttttacctttcatacactagccttggcctctttcctcagccttaagaaccatctgccaaaaattactgatcctcgcatgatggcagccatagtgcatagctactaaaatcagtgaccttgaacatatcttagatggggagcctcgggaaaaggtagaggagtcacgttaccatttacatgttttaaagaaagaagtgtggggattttcactgaaacgtctaggaaatctagaagtagtcctgaaggacagaaactaaactcttaccatatgtttggtaagactccagactccagctaacagtccctatggaaagatggcatcaaaaaagatagatctatatatatatataaatatatattctattacattttcagtgagtaattttggattttgcaaggtgcatttttactattgttacattatgtggaaaacttatgctgatttatttaagggggaaaaagtgtcaactctttgttatttgaaaacatgtttatttttcttgtctttattttaacctttgatagaaccattgcaatatgggggccttttgggaacggactggtatgtaaaagaaaatccgttatcgagcagcattttatttacccctcccctatccctaggcacttaaccaagacaaaaagccacaatgaacatccctttttcaatgaattttataatctgcagctctattccgagcccttagcacccattccgaccatagtataatcatatcaaagggtgagaatcatttagcatgttgttgaaaggttttttttcagttgttctttttagaaaaaaagaaaaacaaaaacaaaaacaaaaaaaaaaaatcacaccattgctcacagaattggcatctcatttttgggacctcccatctttctgttttgaaaagtgtacagtagtgcagtgttcctgatgtaactttatggcttacaatgttgacatgtctcaggttcatgtgtttcgattggtgttttccgtctcaggtagattgcaaagtgtaggccccacacattggaaaaaataataataaaacaaagcaaaaacaggaaattatggattttagttgtatattggtttatgtattttttcttaagtatacagtgcactgtttgaaatgtattgttgagtattactttgtacaggttgatcactttttttagagtgaagaaagaacaaacttgttttttgtgttttttaaaggaatataaaataatgaaggatgtataattgatgccaaataagcttgttctttagtcacaccgacgtcttatttttccctttaggccagttctgtttttaaggtgtacatggacaatgttacagtgtaagaaactccatatccatatgttcccattcgcattttgtattggttcatgtataccatttttacaaaaaaaaaaagaaaaaaaagaagtactataaaatatctgtcttcttaataaaaaaaaattaggttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaataacaggagggggacgcgactataatcatgcgcgggtacactttacgcctccgagtaacgcgagacccctgtgaatagagagaagagcgggaagtgagacagcacaaacaacagaaaggcagagggacgacaaagacggtcagcgcgggtgtgaatatccaggcaagagcacacaccattcgggggtgggagacaacaaagagagacaacaaaacacaaaaccgagaacaacagcactcgaccgagaggaaaaaaacaaaaggagagatgtagacgataacccgagaagtccccgtaagacgaccgcacgacagagagtcacacacacc

SEQ ID NO: 105176 - DNA, 1967 bp, Homo sapiens
  misc_feature (1938)..(1939): n is a, c, g, or t
cgccgaacgccagcgccagggggcggggtgggggagggagcgaggccctccgagagccgggttgggctcgcggcgctgtgattggtctgcccggactccgcctccagcgcatgtcattagcatctcattagctgtccgctcgggctccggaggcagccaacgccgccagtctgaggcaggtgcccgacatggcgagtgtagtgctgccgagcggatcccagtgtgcggcggcagcggcggcggcggcgcctcccgggctccggctccggcttctgctgttgctcttctccgccgcggcactgatccccacaggtgatgggcagaatctgtttacgaaagacgtgacagtgatcgagggagaggttgcgaccatcagttgccaagtcaataagagtgacgactctgtgattcagctactgaatcccaacaggcagaccatttatttcagggacttcaggcctttgaaggacagcaggtttcagttgctgaatttttctagcagtgaactcaaagtatcattgacaaacgtctcaatttctgatgaaggaagatacttttgccagctctataccgatcccccacaggaaagttacaccaccatcacagtcctggtcccaccacgtaatctgatgatcgatatccagaaagacactgcggtggaaggtgaggagattgaagtcaactgcactgctatggccagcaagccagccacgactatcaggtggttcaaagggaacacagagctaaaaggcaaatcggaggtggaagagtggtcagacatgtacactgtgaccagtcagctgatgctgaaggtgcacaaggaggacgatggggtcccagtgatctgccaggtggagcaccctgcggtcactggaaacctgcagacccagcggtatctagaagtacagtataagcctcaagtgcacattcagatgacttatcctctacaaggcttaacccgggaaggggacgcgcttgagttaacatgtgaagccatcgggaagccccagcctgtgatggtaacttgggtgagagtcgatgatgaaatgcctcaacacgccgtactgtctgggcccaacctgttcatcaataacctaaacaaaacagataatggtacataccgctgtgaagcttcaaacatagtggggaaagctcactcggattatatgctgtatgtatacgatccccccacaactatccctcctcccacaacaaccaccaccaccaccaccaccaccaccaccaccatccttaccatcatcacagattcccgagcaggtgaagaaggctcgatcagggcagtggatcatgccgtgatcggtggcgtcgtggcggtggtggtgttcgccatgctgtgcttgctcatcattctggggcgctattttgccagacataaaggtacatacttcactcatgaagccaaaggagccgatgacgcagcagacgcagacacagctataatcaatgcagaaggaggacagaacaactccgaagaaaagaaagagtacttcatctagatcagcctttttgtttcaatgaggtgtccaactggccctatttagatgataaagagacagtgatattggaacttgcgagaaattcgtgtgtttttttatgaatgggtggaaaggtgtgagactgggaaggcttgggatttgctgtgtaaaaaaaaaaaaaaatgttctttggaaagtacactctgctgtttgacacctcttttttcgtttgtttgtttgtttaatttttatttcttcctaccaagtcaaacttggatacttggatttagtttcagtagattgcagaaaattctgtgccttgttttttgtttgtttgttgcgttcctttcttttccccctttgtgcacatttatttcctccctctaccccaatttcggattttttccaaaatctcccattttggaatttgcctgctgggatnngaggaataatttgggtcgcaatatcccc

SEQ ID NO: 105177 - DNA, 1252 bp, Homo sapiens
cgccgaacgccagcgccagggggcggggtgggggagggagcgaggccctccgagagccgggttgggctcgcggcgctgtgattggtctgcccggactccgcctccagcgcatgtcattagcatctcattagctgtccgctcgggctccggaggcagccaacgccgccagtctgaggcaggtgcccgacatggcgagtgtagtgctgccgagcggatcccagtgtgcggcggcagcggcggcggcggcgcctcccgggctccggctccggcttctgctgttgctcttctccgccgcggcactgatccccacaggtgatgggcagaatctgtttacgaaagacgtgacagtgatcgagggagaggttgcgaccatcagttgccaagtcaataagagtgacgactctgtgattcagctactgaatcccaacaggcagaccatttatttcagggacttcaggcctttgaaggacagcaggtttcagttgctgaatttttctagcagtgaactcaaagtatcattgacaaacgtctcaatttctgatgaaggaagatacttttgccagctctataccgatcccccacaggaaagttacaccaccatcacagtcctggtcccaccacgtaatctgatgatcgatatccagaaagacactgcggtggaaggtgaggagattgaagtcaactgcactgctatggccagcaagccagccacgactatcaggtggttcaaagggaacacagagctaaaaggcaaatcggaggtggaagagtggtcagacatgtacactgtgaccagtcagctgatgctgaaggtgcacaaggaggacgatggggtcccagtgatctgccaggtggagcaccctgcggtcactggaaacctgcagacccagcggtatctagaagtacagtataagcctcaagtgcacattcagatgacttatcctctacaaggcttaacccgggaaggggacgcgcttgagttaacatgtgaagccatcgggaagccccagcctgtgatggtaacttgggtgagagtcgatgatgaaatgcctcaacacgccgtactgtctgggcccaacctgttcatcaataacctaaacaaaacagataatggtacataccgctgtgaagcttcaaacatagtggggaaagctcactcggattatatgctgtatgtatacgatccccccacaactatccctgcttggtgcctctggcctcttggtgcctctggcctccttggtgtctctgg

SEQ ID NO: 105178 - DNA, 1576 bp, Homo sapiens
cgccgaacgccagcgccagggggcggggtgggggagggagcgaggccctccgagagccgggttgggctcgcggcgctgtgattggtctgcccggactccgcctccagcgcatgtcattagcatctcattagctgtccgctcgggctccggaggcagccaacgccgccagtctgaggcaggtgcccgacatggcgagtgtagtgctgccgagcggatcccagtgtgcggcggcagcggcggcggcggcgcctcccgggctccggctccggcttctgctgttgctcttctccgccgcggcactgatccccacaggtgatgggcagaatctgtttacgaaagacgtgacagtgatcgagggagaggttgcgaccatcagttgccaagtcaataagagtgacgactctgtgattcagctactgaatcccaacaggcagaccatttatttcagggacttcaggcctttgaaggacagcaggtttcagttgctgaatttttctagcagtgaactcaaagtatcattgacaaacgtctcaatttctgatgaaggaagatacttttgccagctctataccgatcccccacaggaaagttacaccaccatcacagtcctggtcccaccacgtaatctgatgatcgatatccagaaagacactgcggtggaaggtgaggagattgaagtcaactgcactgctatggccagcaagccagccacgactatcaggtggttcaaagggaacacagagctaaaaggcaaatcggaggtggaagagtggtcagacatgtacactgtgaccagtcagctgatgctgaaggtgcacaaggaggacgatggggtcccagtgatctgccaggtggagcaccctgcggtcactggaaacctgcagacccagcggtatctagaagtacagtataagcctcaagtgcacattcagatgacttatcctctacaaggcttaacccgggaaggggacgcgcttgagttaacatgtgaagccatcgggaagccccagcctgtgatggtaacttgggtgagagtcgatgatgaaatgcctcaacacgccgtactgtctgggcccaacctgttcatcaataacctaaacaaaacagataatggtacataccgctgtgaagcttcaaacatagtggggaaagctcactcggattatatgctgtatgtatacgatccccccacaactatccctcctcccacaacaaccaccaccaccaccaccaccaccaccaccaccatccttaccatcatcacagacacaacggcgacgacagaaccagcagttcacgagattcccgagcaggtgaagaaggctcgatcagggcagtggatcatgccgtgatcggtggcgtcgtggcggtggtggtgttcgccatgctgtgcttgctcatcattctggggcgctattttgccagacataaaggtacatacttcactctgagaccaccggagccacagacacagagccatgaacggtgaccaagccccttctgctgctccatgccctgctcgccgcagtgtcccagtcaccaggcctgaaataaatgctggcacgcttgactgtta

SEQ ID NO: 105179 - DNA, 4826 bp, Homo sapiens
cgccgaacgccagcgccagggggcggggtgggggagggagcgaggccctccgagagccgggttgggctcgcggcgctgtgattggtctgcccggactccgcctccagcgcatgtcattagcatctcattagctgtccgctcgggctccggaggcagccaacgccgccagtctgaggcaggtgcccgacatggcgagtgtagtgctgccgagcggatcccagtgtgcggcggcagcggcggcggcggcgcctcccgggctccggctccggcttctgctgttgctcttctccgccgcggcactgatccccacaggtgatgggcagaatctgtttacgaaagacgtgacagtgatcgagggagaggttgcgaccatcagttgccaagtcaataagagtgacgactctgtgattcagctactgaatcccaacaggcagaccatttatttcagggacttcaggcctttgaaggacagcaggtttcagttgctgaatttttctagcagtgaactcaaagtatcattgacaaacgtctcaatttctgatgaaggaagatacttttgccagctctataccgatcccccacaggaaagttacaccaccatcacagtcctggtcccaccacgtaatctgatgatcgatatccagaaagacactgcggtggaaggtgaggagattgaagtcaactgcactgctatggccagcaagccagccacgactatcaggtggttcaaagggaacacagagctaaaaggcaaatcggaggtggaagagtggtcagacatgtacactgtgaccagtcagctgatgctgaaggtgcacaaggaggacgatggggtcccagtgatctgccaggtggagcaccctgcggtcactggaaacctgcagacccagcggtatctagaagtacagtataagcctcaagtgcacattcagatgacttatcctctacaaggcttaacccgggaaggggacgcgcttgagttaacatgtgaagccatcgggaagccccagcctgtgatggtaacttgggtgagagtcgatgatgaaatgcctcaacacgccgtactgtctgggcccaacctgttcatcaataacctaaacaaaacagataatggtacataccgctgtgaagcttcaaacatagtggggaaagctcactcggattatatgctgtatgtatacgatccccccacaactatccctcctcccacaacaaccaccaccaccaccaccaccaccaccaccaccatccttaccatcatcacagattcccgagcaggtgaagaaggctcgatcagggcagtggatcatgccgtgatcggtggcgtcgtggcggtggtggtgttcgccatgctgtgcttgctcatcattctggggcgctattttgccagacataaaggtacatacttcactcatgaagccaaaggagccgatgacgcagcagacgcagacacagctataatcaatgcagaaggaggacagaacaactccgaagaaaagaaagagtacttcatctagatcagcctttttgtttcaatgaggtgtccaactggccctatttagatgataaagagacagtgatattggaacttgcgagaaattcgtgtgtttttttatgaatgggtggaaaggtgtgagactgggaaggcttgggatttgctgtgtaaaaaaaaaaaaaaatgttctttggaaagtacactctgctgtttgacacctcttttttcgtttgtttgtttgtttaatttttatttcttcctaccaagtcaaacttggatacttggatttagtttcagtagattgcagaaaattctgtgccttgttttttgtttgtttgttgcgttcctttcttttccccctttgtgcacatttatttcctccctctaccccaatttcggattttttccaaaatctcccattttggaatttgcctgctgggattccttagactcttttccttcccttttctgttctagttttttacttttgtttatttttatggtaactgctttctgttccaaattcagtttcataaaaggagaaccagcacagcttaggatttcatagttcagaatttagtgtatccataatgcattcttctctgttgtcgtaaagatttgggtgaacaaacaatgaaaactctttgctgctgcccatgtttcaaatacttagagcagtgaagactagaaaattagactgtgattcagaaaatgttctgtttgctgtggaactacattactgtacagggttatctgcaagtgaggtgtgtcacaatgagattgaatttcactgtctttaattctgtatctgtagacggctcagtatagataccctacgctgtccagaaaggtttggggcagaaaggactcctcctttttccatgccctaaacagacctgacaggtgaggtctgttccttttatataagtggacaaattttgagttgccacaggaggggaagtagggaggggggaaatacagttctgctctggttgtttctgttccaaatgattccatccacctttcccaatcggccttacttctcactaatttgtaggaaaaagcaagttcgtctgttgtgcgaatgactgaatgggacagagttgattttttttttttttttcctttgtgcttagttaggaaggcagtaggatgtggcctgcatgtactgtatattacagatatttgtcatgctgggatttccaactcgaatctgtgtgaaactttcattccttcagatttggcttgacaaaggcaggaggtacaaaagaagggctggtattgttctcacactggtctgctgtcgctctcagttctcgataggtcagagcagaggtggaaaaacagcatgtacggattttcagttacttaatcaaaactcaaatgtgagtgtttttatctttttacctttcatacactagccttggcctctttcctcagccttaagaaccatctgccaaaaattactgatcctcgcatgatggcagccatagtgcatagctactaaaatcagtgaccttgaacatatcttagatggggagcctcgggaaaaggtagaggagtcacgttaccatttacatgttttaaagaaagaagtgtggggattttcactgaaacgtctaggaaatctagaagtagtcctgaaggacagaaactaaactcttaccatatgtttggtaagactccagactccagctaacagtccctatggaaagatggcatcaaaaaagatagatctatatatatatataaatatatattctattacattttcagtgagtaattttggattttgcaaggtgcatttttactattgttacattatgtggaaaacttatgctgatttatttaagggggaaaaagtgtcaactctttgttatttgaaaacatgtttatttttcttgtctttattttaacctttgatagaaccattgcaatatgggggccttttgggaacggactggtatgtaaaagaaaatccgttatcgagcagcattttatttacccctcccctatccctaggcacttaaccaagacaaaaagccacaatgaacatccctttttcaatgaattttataatctgcagctctattccgagcccttagcacccattccgaccatagtataatcatatcaaagggtgagaatcatttagcatgttgttgaaaggttttttttcagttgttctttttagaaaaaaagaaaaacaaaaacaaaaacaaaaaaaaaaaatcacaccattgctcacagaattggcatctcatttttgggacctcccatctttctgttttgaaaagtgtacagtagtgcagtgttcctgatgtaactttatggcttacaatgttgacatgtctcaggttcatgtgtttcgattggtgttttccgtctcaggtagattgcaaagtgtaggccccacacattggaaaaaataataataaaacaaagcaaaaacaggaaattatggattttagttgtatattggtttatgtattttttcttaagtatacagtgcactgtttgaaatgtattgttgagtattactttgtacaggttgatcactttttttagagtgaagaaagaacaaacttgttttttgtgttttttaaaggaatataaaataatgaaggatgtataattgatgccaaataagcttgttctttagtcacaccgacgtcttatttttccctttaggccagttctgtttttaaggtgtacatggacaatgttacagtgtaagaaactccatatccatatgttcccattcgcattttgtattggttcatgtataccatttttacaaaaaaaaaaagaaaaaaaagaagtactataaaatatctgtcttcttaataaaaaaaaattaggttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaataacaggagggggacgcgactataatcatgcgcgggtacactttacgcctccgagtaacgcgagacccctgtgaatagagagaagagcgggaagtgagacagcacaaacaacagaaaggcagagggacgacaaagacggtcagcgcgggtgtgaatatccaggcaagagcacacaccattcgggggtgggagacaacaaagagagacaacaaaacacaaaaccgagaacaacagcactcgaccgagaggaaaaaaacaaaaggagagatgtagacgataacccgagaagtccccgtaagacgaccgcacgacagagagtcacacacacc

SEQ ID NO: 105180 - DNA, 4779 bp, Homo sapiens
cgccgaacgccagcgccagggggcggggtgggggagggagcgaggccctccgagagccgggttgggctcgcggcgctgtgattggtctgcccggactccgcctccagcgcatgtcattagcatctcattagctgtccgctcgggctccggaggcagccaacgccgccagtctgaggcaggtgcccgacatggcgagtgtagtgctgccgagcggatcccagtgtgcggcggcagcggcggcggcggcgcctcccgggctccggctccggcttctgctgttgctcttctccgccgcggcactgatccccacaggtgatgggcagaatctgtttacgaaagacgtgacagtgatcgagggagaggttgcgaccatcagttgccaagtcaataagagtgacgactctgtgattcagctactgaatcccaacaggcagaccatttatttcagggacttcaggcctttgaaggacagcaggtttcagttgctgaatttttctagcagtgaactcaaagtatcattgacaaacgtctcaatttctgatgaaggaagatacttttgccagctctataccgatcccccacaggaaagttacaccaccatcacagtcctggtcccaccacgtaatctgatgatcgatatccagaaagacactgcggtggaaggtgaggagattgaagtcaactgcactgctatggccagcaagccagccacgactatcaggtggttcaaagggaacacagagctaaaaggcaaatcggaggtggaagagtggtcagacatgtacactgtgaccagtcagctgatgctgaaggtgcacaaggaggacgatggggtcccagtgatctgccaggtggagcaccctgcggtcactggaaacctgcagacccagcggtatctagaagtacagtataagcctcaagtgcacattcagatgacttatcctctacaaggcttaacccgggaaggggacgcgcttgagttaacatgtgaagccatcgggaagccccagcctgtgatggtaacttgggtgagagtcgatgatgaaatgcctcaacacgccgtactgtctgggcccaacctgttcatcaataacctaaacaaaacagataatggtacataccgctgtgaagcttcaaacatagtggggaaagctcactcggattatatgctgtatgtatacgatccccccacaactatccctcctcccacaacaaccaccaccaccaccaccaccaccaccaccaccatccttaccatcatcacagattcccgagcaggtgaagaaggctcgatcagggcagtggatcatgccgtgatcggtggcgtcgtggcggtggtggtgttcgccatgctgtgcttgctcatcattctggggcgctattttgccagacataaaggtacatacttcactcatgaagccaaaggagccgatgacgcagcagacgcagacacagctataatcaatgcagaaggaggacagaacaactccgaagaaaagaaagagtacttcatctagatcagcctttttgtttcaatgaggtgtccaactggccctatttagatgataaagagacagtgatattggaacttgcgagaaattcgtgtgtttttttatgaatgggtggaaaggtgtgagactgggaaggcttgggatttgctgtgtaaaaaaaaaaaaaaatgttctttggaaagtacactctgctgtttgacacctcttttttcgtttgtttgtttgtttaatttttatttcttcctaccaagtcaaacttggatacttggatttagtttcagtagattgcagaaaattctgtgccttgttttttgtttgtttgttgcgttcctttcttttccccctttgtgcacatttatttcctccctctaccccaatttcggattttttccaaaatctcccattttggaatttgcctgctgggattccttagactcttttccttcccttttctgttctagttttttacttttgtttatttttatggtaactgctttctgttccaaattcagtttcataaaaggagaaccagcacagcttaggatttcatagttcagaatttagtgtatccataatgcattcttctctgttgtcgtaaagatttgggtgaacaaacaatgaaaactctttgctgctgcccatgtttcaaatacttagagcagtgaagactagaaaattagactgtgattcagaaaatgttctgtttgctgtggaactacattactgtacagggttatctgcaagtgaggtgtgtcacaatgagattgaatttcactgtctttaattctgtatctgtagacggctcagtatagataccctacgctgtccagaaaggtttggggcagaaaggactcctcctttttccatgccctaaacagacctgacaggtgaggtctgttccttttatataagtggacaaattttgagttgccacaggaggggaagtagggaggggggaaatacagttctgctctggttgtttctgttccaaatgattccatccacctttcccaatcggccttacttctcactaatttgtaggaaaaagcaagttcgtctgttgtgcgaatgactgaatgggacagagttgattttttttttttttttcctttgtgcttagttaggaaggcagtaggatgtggcctgcatgtactgtatattacagatatttgtcatgctgggatttccaactcgaatctgtgtgaaactttcattccttcagatttggcttgacaaaggcaggaggtacaaaagaagggctggtattgttctcacactggtctgctgtcgctctcagttctcgataggtcagagcagaggtggaaaaacagcatgtacggattttcagttacttaatcaaaactcaaatgtgagtgtttttatctttttacctttcatacactagccttggcctctttcctcagccatagtgcatagctactaaaatcagtgaccttgaacatatcttagatggggagcctcgggaaaaggtagaggagtcacgttaccatttacatgttttaaagaaagaagtgtggggattttcactgaaacgtctaggaaatctagaagtagtcctgaaggacagaaactaaactcttaccatatgtttggtaagactccagactccagctaacagtccctatggaaagatggcatcaaaaaagatagatctatatatatatataaatatatattctattacattttcagtgagtaattttggattttgcaaggtgcatttttactattgttacattatgtggaaaacttatgctgatttatttaagggggaaaaagtgtcaactctttgttatttgaaaacatgtttatttttcttgtctttattttaacctttgatagaaccattgcaatatgggggccttttgggaacggactggtatgtaaaagaaaatccgttatcgagcagcattttatttacccctcccctatccctaggcacttaaccaagacaaaaagccacaatgaacatccctttttcaatgaattttataatctgcagctctattccgagcccttagcacccattccgaccatagtataatcatatcaaagggtgagaatcatttagcatgttgttgaaaggttttttttcagttgttctttttagaaaaaaagaaaaacaaaaacaaaaacaaaaaaaaaaaatcacaccattgctcacagaattggcatctcatttttgggacctcccatctttctgttttgaaaagtgtacagtagtgcagtgttcctgatgtaactttatggcttacaatgttgacatgtctcaggttcatgtgtttcgattggtgttttccgtctcaggtagattgcaaagtgtaggccccacacattggaaaaaataataataaaacaaagcaaaaacaggaaattatggattttagttgtatattggtttatgtattttttcttaagtatacagtgcactgtttgaaatgtattgttgagtattactttgtacaggttgatcactttttttagagtgaagaaagaacaaacttgttttttgtgttttttaaaggaatataaaataatgaaggatgtataattgatgccaaataagcttgttctttagtcacaccgacgtcttatttttccctttaggccagttctgtttttaaggtgtacatggacaatgttacagtgtaagaaactccatatccatatgttcccattcgcattttgtattggttcatgtataccatttttacaaaaaaaaaaagaaaaaaaagaagtactataaaatatctgtcttcttaataaaaaaaaattaggttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaataacaggagggggacgcgactataatcatgcgcgggtacactttacgcctccgagtaacgcgagacccctgtgaatagagagaagagcgggaagtgagacagcacaaacaacagaaaggcagagggacgacaaagacggtcagcgcgggtgtgaatatccaggcaagagcacacaccattcgggggtgggagacaacaaagagagacaacaaaacacaaaaccgagaacaacagcactcgaccgagaggaaaaaaacaaaaggagagatgtagacgataacccgagaagtccccgtaagacgaccgcacgacagagagtcacacacacc

SEQ ID NO: 105181 - DNA, 4915 bp, Homo sapiens
cgccgaacgccagcgccagggggcggggtgggggagggagcgaggccctccgagagccgggttgggctcgcggcgctgtgattggtctgcccggactccgcctccagcgcatgtcattagcatctcattagctgtccgctcgggctccggaggcagccaacgccgccagtctgaggcaggtgcccgacatggcgagtgtagtgctgccgagcggatcccagtgtgcggcggcagcggcggcggcggcgcctcccgggctccggctccggcttctgctgttgctcttctccgccgcggcactgatccccacaggtgatgggcagaatctgtttacgaaagacgtgacagtgatcgagggagaggttgcgaccatcagttgccaagtcaataagagtgacgactctgtgattcagctactgaatcccaacaggcagaccatttatttcagggacttcaggcctttgaaggacagcaggtttcagttgctgaatttttctagcagtgaactcaaagtatcattgacaaacgtctcaatttctgatgaaggaagatacttttgccagctctataccgatcccccacaggaaagttacaccaccatcacagtcctggtcccaccacgtaatctgatgatcgatatccagaaagacactgcggtggaaggtgaggagattgaagtcaactgcactgctatggccagcaagccagccacgactatcaggtggttcaaagggaacacagagctaaaaggcaaatcggaggtggaagagtggtcagacatgtacactgtgaccagtcagctgatgctgaaggtgcacaaggaggacgatggggtcccagtgatctgccaggtggagcaccctgcggtcactggaaacctgcagacccagcggtatctagaagtacagtataagcctcaagtgcacattcagatgacttatcctctacaaggcttaacccgggaaggggacgcgcttgagttaacatgtgaagccatcgggaagccccagcctgtgatggtaacttgggtgagagtcgatgatgaaatgcctcaacacgccgtactgtctgggcccaacctgttcatcaataacctaaacaaaacagataatggtacataccgctgtgaagcttcaaacatagtggggaaagctcactcggattatatgctgtatgtatacgatccccccacaactatccctcctcccacaacaaccaccaccaccaccaccaccaccaccaccaccatccttaccatcatcacagacacaacggcgacgacagaaccagcagttcacggccttactcagttgcccaattccgcagaagaactggacagtgaggacctctcagagattcccgagcaggtgaagaaggctcgatcagggcagtggatcatgccgtgatcggtggcgtcgtggcggtggtggtgttcgccatgctgtgcttgctcatcattctggggcgctattttgccagacataaaggtacatacttcactcatgaagccaaaggagccgatgacgcagcagacgcagacacagctataatcaatgcagaaggaggacagaacaactccgaagaaaagaaagagtacttcatctagatcagcctttttgtttcaatgaggtgtccaactggccctatttagatgataaagagacagtgatattggaacttgcgagaaattcgtgtgtttttttatgaatgggtggaaaggtgtgagactgggaaggcttgggatttgctgtgtaaaaaaaaaaaaaaatgttctttggaaagtacactctgctgtttgacacctcttttttcgtttgtttgtttgtttaatttttatttcttcctaccaagtcaaacttggatacttggatttagtttcagtagattgcagaaaattctgtgccttgttttttgtttgtttgttgcgttcctttcttttccccctttgtgcacatttatttcctccctctaccccaatttcggattttttccaaaatctcccattttggaatttgcctgctgggattccttagactcttttccttcccttttctgttctagttttttacttttgtttatttttatggtaactgctttctgttccaaattcagtttcataaaaggagaaccagcacagcttaggatttcatagttcagaatttagtgtatccataatgcattcttctctgttgtcgtaaagatttgggtgaacaaacaatgaaaactctttgctgctgcccatgtttcaaatacttagagcagtgaagactagaaaattagactgtgattcagaaaatgttctgtttgctgtggaactacattactgtacagggttatctgcaagtgaggtgtgtcacaatgagattgaatttcactgtctttaattctgtatctgtagacggctcagtatagataccctacgctgtccagaaaggtttggggcagaaaggactcctcctttttccatgccctaaacagacctgacaggtgaggtctgttccttttatataagtggacaaattttgagttgccacaggaggggaagtagggaggggggaaatacagttctgctctggttgtttctgttccaaatgattccatccacctttcccaatcggccttacttctcactaatttgtaggaaaaagcaagttcgtctgttgtgcgaatgactgaatgggacagagttgattttttttttttttttcctttgtgcttagttaggaaggcagtaggatgtggcctgcatgtactgtatattacagatatttgtcatgctgggatttccaactcgaatctgtgtgaaactttcattccttcagatttggcttgacaaaggcaggaggtacaaaagaagggctggtattgttctcacactggtctgctgtcgctctcagttctcgataggtcagagcagaggtggaaaaacagcatgtacggattttcagttacttaatcaaaactcaaatgtgagtgtttttatctttttacctttcatacactagccttggcctctttcctcagccttaagaaccatctgccaaaaattactgatcctcgcatgatggcagccatagtgcatagctactaaaatcagtgaccttgaacatatcttagatggggagcctcgggaaaaggtagaggagtcacgttaccatttacatgttttaaagaaagaagtgtggggattttcactgaaacgtctaggaaatctagaagtagtcctgaaggacagaaactaaactcttaccatatgtttggtaagactccagactccagctaacagtccctatggaaagatggcatcaaaaaagatagatctatatatatatataaatatatattctattacattttcagtgagtaattttggattttgcaaggtgcatttttactattgttacattatgtggaaaacttatgctgatttatttaagggggaaaaagtgtcaactctttgttatttgaaaacatgtttatttttcttgtctttattttaacctttgatagaaccattgcaatatgggggccttttgggaacggactggtatgtaaaagaaaatccgttatcgagcagcattttatttacccctcccctatccctaggcacttaaccaagacaaaaagccacaatgaacatccctttttcaatgaattttataatctgcagctctattccgagcccttagcacccattccgaccatagtataatcatatcaaagggtgagaatcatttagcatgttgttgaaaggttttttttcagttgttctttttagaaaaaaagaaaaacaaaaacaaaaacaaaaaaaaaaaatcacaccattgctcacagaattggcatctcatttttgggacctcccatctttctgttttgaaaagtgtacagtagtgcagtgttcctgatgtaactttatggcttacaatgttgacatgtctcaggttcatgtgtttcgattggtgttttccgtctcaggtagattgcaaagtgtaggccccacacattggaaaaaataataataaaacaaagcaaaaacaggaaattatggattttagttgtatattggtttatgtattttttcttaagtatacagtgcactgtttgaaatgtattgttgagtattactttgtacaggttgatcactttttttagagtgaagaaagaacaaacttgttttttgtgttttttaaaggaatataaaataatgaaggatgtataattgatgccaaataagcttgttctttagtcacaccgacgtcttatttttccctttaggccagttctgtttttaaggtgtacatggacaatgttacagtgtaagaaactccatatccatatgttcccattcgcattttgtattggttcatgtataccatttttacaaaaaaaaaaagaaaaaaaagaagtactataaaatatctgtcttcttaataaaaaaaaattaggttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaataacaggagggggacgcgactataatcatgcgcgggtacactttacgcctccgagtaacgcgagacccctgtgaatagagagaagagcgggaagtgagacagcacaaacaacagaaaggcagagggacgacaaagacggtcagcgcgggtgtgaatatccaggcaagagcacacaccattcgggggtgggagacaacaaagagagacaacaaaacacaaaaccgagaacaacagcactcgaccgagaggaaaaaaacaaaaggagagatgtagacgataacccgagaagtccccgtaagacgaccgcacgacagagagtcacacacacc

SEQ ID NO: 105182 - DNA, 4727 bp, Homo sapiens
cgccgaacgccagcgccagggggcggggtgggggagggagcgaggccctccgagagccgggttgggctcgcggcgctgtgattggtctgcccggactccgcctccagcgcatgtcattagcatctcattagctgtccgctcgggctccggaggcagccaacgccgccagtctgaggcaggtgcccgacatggcgagtgtagtgctgccgagcggtgatgggcagaatctgtttacgaaagacgtgacagtgatcgagggagaggttgcgaccatcagttgccaagtcaataagagtgacgactctgtgattcagctactgaatcccaacaggcagaccatttatttcagggacttcaggcctttgaaggacagcaggtttcagttgctgaatttttctagcagtgaactcaaagtatcattgacaaacgtctcaatttctgatgaaggaagatacttttgccagctctataccgatcccccacaggaaagttacaccaccatcacagtcctggtcccaccacgtaatctgatgatcgatatccagaaagacactgcggtggaaggtgaggagattgaagtcaactgcactgctatggccagcaagccagccacgactatcaggtggttcaaagggaacacagagctaaaaggcaaatcggaggtggaagagtggtcagacatgtacactgtgaccagtcagctgatgctgaaggtgcacaaggaggacgatggggtcccagtgatctgccaggtggagcaccctgcggtcactggaaacctgcagacccagcggtatctagaagtacagtataagcctcaagtgcacattcagatgacttatcctctacaaggcttaacccgggaaggggacgcgcttgagttaacatgtgaagccatcgggaagccccagcctgtgatggtaacttgggtgagagtcgatgatgaaatgcctcaacacgccgtactgtctgggcccaacctgttcatcaataacctaaacaaaacagataatggtacataccgctgtgaagcttcaaacatagtggggaaagctcactcggattatatgctgtatgtatacgatccccccacaactatccctcctcccacaacaaccaccaccaccaccaccaccaccaccaccaccatccttaccatcatcacagattcccgagcaggtgaagaaggctcgatcagggcagtggatcatgccgtgatcggtggcgtcgtggcggtggtggtgttcgccatgctgtgcttgctcatcattctggggcgctattttgccagacataaaggtacatacttcactcatgaagccaaaggagccgatgacgcagcagacgcagacacagctataatcaatgcagaaggaggacagaacaactccgaagaaaagaaagagtacttcatctagatcagcctttttgtttcaatgaggtgtccaactggccctatttagatgataaagagacagtgatattggaacttgcgagaaattcgtgtgtttttttatgaatgggtggaaaggtgtgagactgggaaggcttgggatttgctgtgtaaaaaaaaaaaaaaatgttctttggaaagtacactctgctgtttgacacctcttttttcgtttgtttgtttgtttaatttttatttcttcctaccaagtcaaacttggatacttggatttagtttcagtagattgcagaaaattctgtgccttgttttttgtttgtttgttgcgttcctttcttttccccctttgtgcacatttatttcctccctctaccccaatttcggattttttccaaaatctcccattttggaatttgcctgctgggattccttagactcttttccttcccttttctgttctagttttttacttttgtttatttttatggtaactgctttctgttccaaattcagtttcataaaaggagaaccagcacagcttaggatttcatagttcagaatttagtgtatccataatgcattcttctctgttgtcgtaaagatttgggtgaacaaacaatgaaaactctttgctgctgcccatgtttcaaatacttagagcagtgaagactagaaaattagactgtgattcagaaaatgttctgtttgctgtggaactacattactgtacagggttatctgcaagtgaggtgtgtcacaatgagattgaatttcactgtctttaattctgtatctgtagacggctcagtatagataccctacgctgtccagaaaggtttggggcagaaaggactcctcctttttccatgccctaaacagacctgacaggtgaggtctgttccttttatataagtggacaaattttgagttgccacaggaggggaagtagggaggggggaaatacagttctgctctggttgtttctgttccaaatgattccatccacctttcccaatcggccttacttctcactaatttgtaggaaaaagcaagttcgtctgttgtgcgaatgactgaatgggacagagttgattttttttttttttttcctttgtgcttagttaggaaggcagtaggatgtggcctgcatgtactgtatattacagatatttgtcatgctgggatttccaactcgaatctgtgtgaaactttcattccttcagatttggcttgacaaaggcaggaggtacaaaagaagggctggtattgttctcacactggtctgctgtcgctctcagttctcgataggtcagagcagaggtggaaaaacagcatgtacggattttcagttacttaatcaaaactcaaatgtgagtgtttttatctttttacctttcatacactagccttggcctctttcctcagccttaagaaccatctgccaaaaattactgatcctcgcatgatggcagccatagtgcatagctactaaaatcagtgaccttgaacatatcttagatggggagcctcgggaaaaggtagaggagtcacgttaccatttacatgttttaaagaaagaagtgtggggattttcactgaaacgtctaggaaatctagaagtagtcctgaaggacagaaactaaactcttaccatatgtttggtaagactccagactccagctaacagtccctatggaaagatggcatcaaaaaagatagatctatatatatatataaatatatattctattacattttcagtgagtaattttggattttgcaaggtgcatttttactattgttacattatgtggaaaacttatgctgatttatttaagggggaaaaagtgtcaactctttgttatttgaaaacatgtttatttttcttgtctttattttaacctttgatagaaccattgcaatatgggggccttttgggaacggactggtatgtaaaagaaaatccgttatcgagcagcattttatttacccctcccctatccctaggcacttaaccaagacaaaaagccacaatgaacatccctttttcaatgaattttataatctgcagctctattccgagcccttagcacccattccgaccatagtataatcatatcaaagggtgagaatcatttagcatgttgttgaaaggttttttttcagttgttctttttagaaaaaaagaaaaacaaaaacaaaaacaaaaaaaaaaaatcacaccattgctcacagaattggcatctcatttttgggacctcccatctttctgttttgaaaagtgtacagtagtgcagtgttcctgatgtaactttatggcttacaatgttgacatgtctcaggttcatgtgtttcgattggtgttttccgtctcaggtagattgcaaagtgtaggccccacacattggaaaaaataataataaaacaaagcaaaaacaggaaattatggattttagttgtatattggtttatgtattttttcttaagtatacagtgcactgtttgaaatgtattgttgagtattactttgtacaggttgatcactttttttagagtgaagaaagaacaaacttgttttttgtgttttttaaaggaatataaaataatgaaggatgtataattgatgccaaataagcttgttctttagtcacaccgacgtcttatttttccctttaggccagttctgtttttaaggtgtacatggacaatgttacagtgtaagaaactccatatccatatgttcccattcgcattttgtattggttcatgtataccatttttacaaaaaaaaaaagaaaaaaaagaagtactataaaatatctgtcttcttaataaaaaaaaattaggttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaataacaggagggggacgcgactataatcatgcgcgggtacactttacgcctccgagtaacgcgagacccctgtgaatagagagaagagcgggaagtgagacagcacaaacaacagaaaggcagagggacgacaaagacggtcagcgcgggtgtgaatatccaggcaagagcacacaccattcgggggtgggagacaacaaagagagacaacaaaacacaaaaccgagaacaacagcactcgaccgagaggaaaaaaacaaaaggagagatgtagacgataacccgagaagtccccgtaagacgaccgcacgacagagagtcacacacacc

SEQ ID NO: 105183 - DNA, 4070 bp, Homo sapiens
gccaggattaccaactaattagaagggtgttactgaaggcatcggatgggagagagtaagtgctggtactgtggttttgaggcagtgtgtgagtctgattttgcctgatgatatcatttgctaaacattatactttgtgtttttgtcacacagataagcctcaagtgcacattcagatgacttatcctctacaaggcttaacccgggaaggggacgcgcttgagttaacatgtgaagccatcgggaagccccagcctgtgatggtaacttgggtgagagtcgatgatgaaatgcctcaacacgccgtactgtctgggcccaacctgttcatcaataacctaaacaaaacagataatggtacataccgctgtgaagcttcaaacatagtggggaaagctcactcggattatatgctgtatgtatacgatccccccacaactatccctcctcccacaacaaccaccaccaccaccaccaccaccaccaccaccatccttaccatcatcacagattcccgagcaggtgaagaaggctcgatcagggcagtggatcatgccgtgatcggtggcgtcgtggcggtggtggtgttcgccatgctgtgcttgctcatcattctggggcgctattttgccagacataaaggtacatacttcactcatgaagccaaaggagccgatgacgcagcagacgcagacacagctataatcaatgcagaaggaggacagaacaactccgaagaaaagaaagagtacttcatctagatcagcctttttgtttcaatgaggtgtccaactggccctatttagatgataaagagacagtgatattggaacttgcgagaaattcgtgtgtttttttatgaatgggtggaaaggtgtgagactgggaaggcttgggatttgctgtgtaaaaaaaaaaaaaaatgttctttggaaagtacactctgctgtttgacacctcttttttcgtttgtttgtttgtttaatttttatttcttcctaccaagtcaaacttggatacttggatttagtttcagtagattgcagaaaattctgtgccttgttttttgtttgtttgttgcgttcctttcttttccccctttgtgcacatttatttcctccctctaccccaatttcggattttttccaaaatctcccattttggaatttgcctgctgggattccttagactcttttccttcccttttctgttctagttttttacttttgtttatttttatggtaactgctttctgttccaaattcagtttcataaaaggagaaccagcacagcttaggatttcatagttcagaatttagtgtatccataatgcattcttctctgttgtcgtaaagatttgggtgaacaaacaatgaaaactctttgctgctgcccatgtttcaaatacttagagcagtgaagactagaaaattagactgtgattcagaaaatgttctgtttgctgtggaactacattactgtacagggttatctgcaagtgaggtgtgtcacaatgagattgaatttcactgtctttaattctgtatctgtagacggctcagtatagataccctacgctgtccagaaaggtttggggcagaaaggactcctcctttttccatgccctaaacagacctgacaggtgaggtctgttccttttatataagtggacaaattttgagttgccacaggaggggaagtagggaggggggaaatacagttctgctctggttgtttctgttccaaatgattccatccacctttcccaatcggccttacttctcactaatttgtaggaaaaagcaagttcgtctgttgtgcgaatgactgaatgggacagagttgattttttttttttttttcctttgtgcttagttaggaaggcagtaggatgtggcctgcatgtactgtatattacagatatttgtcatgctgggatttccaactcgaatctgtgtgaaactttcattccttcagatttggcttgacaaaggcaggaggtacaaaagaagggctggtattgttctcacactggtctgctgtcgctctcagttctcgataggtcagagcagaggtggaaaaacagcatgtacggattttcagttacttaatcaaaactcaaatgtgagtgtttttatctttttacctttcatacactagccttggcctctttcctcagccttaagaaccatctgccaaaaattactgatcctcgcatgatggcagccatagtgcatagctactaaaatcagtgaccttgaacatatcttagatggggagcctcgggaaaaggtagaggagtcacgttaccatttacatgttttaaagaaagaagtgtggggattttcactgaaacgtctaggaaatctagaagtagtcctgaaggacagaaactaaactcttaccatatgtttggtaagactccagactccagctaacagtccctatggaaagatggcatcaaaaaagatagatctatatatatatataaatatatattctattacattttcagtgagtaattttggattttgcaaggtgcatttttactattgttacattatgtggaaaacttatgctgatttatttaagggggaaaaagtgtcaactctttgttatttgaaaacatgtttatttttcttgtctttattttaacctttgatagaaccattgcaatatgggggccttttgggaacggactggtatgtaaaagaaaatccgttatcgagcagcattttatttacccctcccctatccctaggcacttaaccaagacaaaaagccacaatgaacatccctttttcaatgaattttataatctgcagctctattccgagcccttagcacccattccgaccatagtataatcatatcaaagggtgagaatcatttagcatgttgttgaaaggttttttttcagttgttctttttagaaaaaaagaaaaacaaaaacaaaaacaaaaaaaaaaaatcacaccattgctcacagaattggcatctcatttttgggacctcccatctttctgttttgaaaagtgtacagtagtgcagtgttcctgatgtaactttatggcttacaatgttgacatgtctcaggttcatgtgtttcgattggtgttttccgtctcaggtagattgcaaagtgtaggccccacacattggaaaaaataataataaaacaaagcaaaaacaggaaattatggattttagttgtatattggtttatgtattttttcttaagtatacagtgcactgtttgaaatgtattgttgagtattactttgtacaggttgatcactttttttagagtgaagaaagaacaaacttgttttttgtgttttttaaaggaatataaaataatgaaggatgtataattgatgccaaataagcttgttctttagtcacaccgacgtcttatttttccctttaggccagttctgtttttaaggtgtacatggacaatgttacagtgtaagaaactccatatccatatgttcccattcgcattttgtattggttcatgtataccatttttacaaaaaaaaaaagaaaaaaaagaagtactataaaatatctgtcttcttaataaaaaaaaattaggttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaataacaggagggggacgcgactataatcatgcgcgggtacactttacgcctccgagtaacgcgagacccctgtgaatagagagaagagcgggaagtgagacagcacaaacaacagaaaggcagagggacgacaaagacggtcagcgcgggtgtgaatatccaggcaagagcacacaccattcgggggtgggagacaacaaagagagacaacaaaacacaaaaccgagaacaacagcactcgaccgagaggaaaaaaacaaaaggagagatgtagacgataacccgagaagtccccgtaagacgaccgcacgacagagagtcacacacacc

SEQ ID NO: 105184 - DNA, 1586 bp, Homo sapiens
cgccgaacgccagcgccagggggcggggtgggggagggagcgaggccctccgagagccgggttgggctcgcggcgctgtgattggtctgcccggactccgcctccagcgcatgtcattagcatctcattagctgtccgctcgggctccggaggcagccaacgccgccagtctgaggcaggtgcccgacatggcgagtgtagtgctgccgagcggatcccagtgtgcggcggcagcggcggcggcggcgcctcccgggctccggctccggcttctgctgttgctcttctccgccgcggcactgatccccacaggtgatgggcagaatctgtttacgaaagacgtgacagtgatcgagggagaggttgcgaccatcagttgccaagtcaataagagtgacgactctgtgattcagctactgaatcccaacaggcagaccatttatttcagggacttcaggcctttgaaggacagcaggtttcagttgctgaatttttctagcagtgaactcaaagtatcattgacaaacgtctcaatttctgatgaaggaagatacttttgccagctctataccgatcccccacaggaaagttacaccaccatcacagtcctggtcccaccacgtaatctgatgatcgatatccagaaagacactgcggtggaaggtgaggagattgaagtcaactgcactgctatggccagcaagccagccacgactatcaggtggttcaaagggaacacagagctaaaaggcaaatcggaggtggaagagtggtcagacatgtacactgtgaccagtcagctgatgctgaaggtgcacaaggaggacgatggggtcccagtgatctgccaggtggagcaccctgcggtcactggaaacctgcagacccagcggtatctagaagtacagtataagcctcaagtgcacattcagatgacttatcctctacaaggcttaacccgggaaggggacgcgcttgagttaacatgtgaagccatcgggaagccccagcctgtgatggtaacttgggtgagagtcgatgatgaaatgcctcaacacgccgtactgtctgggcccaacctgttcatcaataacctaaacaaaacagataatggtacataccgctgtgaagcttcaaacatagtggggaaagctcactcggattatatgctgtatgtatacgatccccccacaactatccctcctcccacaacaaccaccaccaccaccaccaccaccaccaccaccatccttaccatcatcacagattcccgagcaggtgaagaaggctcgatcagggcagtggatcatgccgtgatcggtggcgtcgtggcggtggtggtgttcgccatgctgtgcttgctcatcattctggggcgctattttgccagacataaaggtacatacttcactcatgaagccaaaggagccgatgacgcagcagacgcagacacagctataatcaatgcagaaggaggacagaacaactccgaagaaaagaaagagtacttcatctagatcagcctttttgtttcaatgaggtgtccaactggccctatttagatgataaagagacagtgatattgg

SEQ ID NO: 105185 - DNA, 670 bp, Homo sapiens
gctaggctgatctcgacctcctgacctcaagtgatctgcctgcctcagcctcccaaagtgctaggattacaggcatgagccaccatgtacaagttttaagtagtaagttttcagaatctttatatctgtgtaacttgcttcataaactgctcatttcagcaacttcacataagggagcttaataacttattagtaactgtggtaatgatgacaaataaagcagtttgaatcattctgaatatgttactatttacttccaaatgttcagagtttagagcatgtagatttaaaagttcagatgactgttgccatgagccacacaaaagggcaccaagtctcctgagatgggaaaaagaaattgatttctctgtgttttttatactccacaacactcttgaaaagcactttctgggcacataactattgatctactgctctggggtaaatatgagatcacatgaaaatgaaacgtgtcattcttttgattcatgcaagatgccttttaaagttcatcagagtcataaaagcatgtgggcatatgtaggctccattcacctgcaataaaacgagaattagggagggctgatgttccttttaaatttgactctgagtattctgtttcattatcacagaaatgtagtaaacatataatgcctaaaactagtattat

SEQ ID NO: 105186 - DNA, 254 bp, Homo sapiens
tggacctctttctccatgtgaatgaactttgaaaagagcttgtacacaatctactaagcaagaggatgactggtagaatattaagcatgcaggaccacatcctatttatctgtaaaccatggtaaattccaattaccactgatgcctattagaagattttaagcagtatgataatataacattcaatatttaaaatgtcactctgagcaatttctggagatgattagacaacaaattggacacaagaaaagctc

SEQ ID NO: 105187 - DNA, 318 bp, Homo sapiens
atacacaccactgcagacaaatgacaaattacaccatctgcttgccaagcacagtatctgattaataatttgcagactgacagcaacagtgcactcccagcatggagacttagtttctccaagatcacctttagcctttctaagatctcctatgtctcaccttattctacatatggctagccagttttcccaacaccatttattaaacagggaatcctttccccatttcttgtttttgtcaggtttgtcaaagatcagggtcgtagatgtgtggtattatttctgagtgctccgttctgttccactggtctgtatctc

SEQ ID NO: 105188 - DNA, 411 bp, Homo sapiens
ggatgaccctgggactcatacagtgtttctggacgcttttatagatactgcgagatgctgttttactgaagttgagattgtgttataagtatttctgactcatttagtgttgttttggggtttttagtctctttgcgtgccacaaagatgtctagcataaatctcataccatgaactcaggtgtgcaaaaaatataaatttcttttccatctatgtaacgtaagccaaaaacctgggagttatccctgagcttccctctttcctgtattcccactgttcctggccaccgccccccacagccatgtacaatgcattggcgaattctgacagttccttcaaagtatatcatgtattcactaacttctcttcatctctctaataccacccaaatctaatcattaatatcacctg

SEQ ID NO: 105189 - DNA, 204 bp, Homo sapiens
tcaaaggtgcaggactcagagtgggcctgggtgctgaggctccaggcaggaccactgatgtctcccccggcttggcaggcacacagcaggtacccaggagcacctgccagctggcccccagcaacgcctggctccatctcaccgagagaggccgaggaccttctagaagcttggctgacccttccttcattcccgactccggct

SEQ ID NO: 105190 - DNA, 1474 bp, Homo sapiens
gataattgcatttgagaattaatttagctagattaatttataactaacttaatcagatatctataaattcacttgtttagacaaagtataatttattgtacatttaatgtgaacagatgaataaataaccacactatttttattgcctcccaaattgtggaacttcatgctaccacataatacagtttatgacttgtgactaacaggcttgagtgatggctgaaatgtcaaatacagaaaaaatttagcaaacatgaattcttttttaaaaagattaacataaacagatatttcagaatttttttgatcattctaatgaatcaccttgtttttccccctctgccatttgaagccactattctatagtatggatataaattgtgaaactgttttcctgtgatcaagatttatgtgtgttcacgtcctctctctcttctctttccctttctctcccctttcctctcctcccctcttcctctctttcctttcctcttccccctcttattccaaataatgctgttatcagcatccttgtatttatattcttgaatatttgtgtaaatgtgtaggtaacagattactaggagtgaatttgattggtcagatggcatacatatttaaaataatcagctactgccatgttacccaaaaacattctgataatttgcactctcaccaatgatcattgaaatatttctagtcacacaattggtagaaagggaaaaggcctgtgtgtagaaaggagaataaaacacaaacatatcagatattctaatgatagtaaaagatgaatgttacctcttaaggagatagagcataggcagtaaaagaatacagataaaagatttttttaactcctagaatctattcattaaggccatagtgagaaagttgtcacctaatatcttgtcttctgatttcccttcagtacttagtagcaaaaaaacagttggcccatacctttagaaaatgtttcttataacccctaatagacatatctaatgtttaattatattttttaatctgcagagcagatgtttagtgcaggaagcattttgatggttcttctttcatttaggaagacttgtggaagagagactttagtttcataacttgacagaatttggttctctgtgactactaacaggagaaaatggagaggatgagatttagaaactaaggcaaatcaagatgaaaacatccggctggggacaatgactcacgcctataatcccagcactttgggaggctgaggcaggtgggtcacttaggccaggagtttgagaccagcctggccaacatggtgaaaccccatctctactaaaaatacaaaaattagctaggcgtggtggcgtgttcctgtattctcaactactgaggaggctgaagcacaagaatctctggaacctaggaggtgaggtggcagtgagctgagatcgcaccactgaactctagcctggacggcagagcaaga

SEQ ID NO: 105191 - DNA, 116 bp, Homo sapiens
tgggagtagcgaggtagaacactgtacgaaatgtttactgtgcaatttcattgaagttcaaaatcaagtgcctcattaccagcattccgttagattttcatttgtaatcatctctt

SEQ ID NO: 105192 - DNA, 407 bp, Homo sapiens
cttcacaatcactttgagagcaccaactctgggccaggtggtggatccggatgtacagaggtcatgtaggcataaagaagtttccaatctcatagtgagcaaattaatactaaagagaaccattaagctttaaatgtatttttaaaattctgctcctctgaagcccattcccacatgttcttttagtccccagatgtgtcagcgatgtaagctatgcctttcaaccagggcatggcacgttttgggtagttaaatgatttgggaggctggcacttagtacttaatcagatgctaggtgccctgctatgctagaaaccagcctccactcacatgacaatagcaccccactgataaacactgggaacggtgggggtgcactggtttcctatggctactctaacactacc

SEQ ID NO: 105193 - DNA, 550 bp, Homo sapiens
gggtggggctttaggtgatgtgcctgtcattgacttgcatggaaggagaattggtctgagtacagtgggcagaggttggtcaggggtctggaagagaaacaattgaaaataaaagactaaagggtctgagttagaagaatgtggttagacacatgagagtaggtatacagtatgcctactagaaaggattcaccatggaagaggtacgaaacaactaagcagacaaaatgactcagccagttgatgtcagccaatcttttttttgttttgttgtttgaggcagagtttcactctgtcaacaggctggagtgcagtggcatgatctgggctcactgcaacctccacctcccgggttcaagtgaatctcctgcttcagcctcccaagtagctgggactacaggtgtgtgccaccatggccagctaatttttgtagttttagtagagatggggtttcaccatgttgggccaggatggtctcgatctcttgacctcgtgattcacctgtctcggcctcccaaagtgctagggttagaggcgtgagccaatcttt

SEQ ID NO: 105194 - DNA, 332 bp, Homo sapiens
cctcggaagccatccctgatacaagtccccagctttcctgcttcccctcttgtggtgtgtggctttgtctccctccctccctcctggaagccccgacctctgaggcaggtgtaaagggtgtgtgctttggtggccacggccaccctgtggtgctggttctcctccgagggaagcagtgcactcctggtcatcttggagacgcccaacacaggaccccacaggcaccaagctttttttgggaaatggtttcacttcccacttgaaaagccctgaatgtcagttccacacttagtgaatttgatccaagctaaactgagtctgtgcctaaaact

SEQ ID NO: 105195 - DNA, 943 bp, Homo sapiens
gggagtttataatctagacagataggatttgtacaggcaacaatagggcagatttgggcaaatcccattacagagcagtatgcaaagtaccatgggaccacagatgaggtgtccggggaagaagtgacatatccctgccctacagcggctccctacctggtggaatgggtgagtaaaaagataggatggaaggagatcagtactcccatagggatagaatactgtgggaacataagagagacaggaggttgggggcaagagagggacatcaatttcggcctgctgactgaggagaggagggggttttagtcaaaaagaattgccattcaagaaccacagatattcagtatggcgggggtgtgatgagggagcctgctagagctgttcccgtgctgagttctgaaaggtcaggaattcatcctggggccagaaatggccaataggtaacaccggtgccatcacttaccctgtgacagctacctcagactgtactaatctatcagtaatttgtcctcttgagttggtctccacatttttctcaacagcgtgcttactgtcctgtaagttaaaacacatttgtcattgtggatgtagggaataggccgttggagggtgtcttggtctgctctggctgctgctgctaagtaccttagattgatggctggacacgggtggctcatgcctgtaatcccagcactttgggaggccgagacgggtggatcacgaggtcaggagatcgagaccatcctggctaacacagtgaaacctcacctctactaaaaatacaaaaaattttgccagacgtgatggcacacgcctataatcccagctacttgggaggctgaggcaggagaatcgcttgaacctgggaggcggagcttgcagtgaaccaagatcacgccactgcactccagcctgggcgacagagtgagactccgtctca

SEQ ID NO: 105196 - DNA, 444 bp, Homo sapiens
gcgcagcaaccatatgatcccactggattgatgaaatagagatttggtaaagatctagtctaagaagctttacattttttaaaaaagcaggtatagaatagcttctaattgcagttcttgaattcactgtctccctgtattttgaatgtttggtagtttaagcctattatccttcctgctttactttttaatttatttgtatcagtttaacaggtagtattttaagttctcagattcttacagttatatgaaacattaatataccgtggtccctttctccaccaatacatgtacctcaagtattagagatggtgttattttgtaaagtatttcagttctttccggtaataaccttgcttgttatccaagtatttcttccgtttcagtttatgtcacattcaacacttttagtctccttttgttaactgttaacattttctatag

SEQ ID NO: 105197 - DNA, 355 bp, Homo sapiens
gagacccctaaaataaaggcccacacctccaaccaactgatcttcaagaaaatcaacaaaaataaacaatgaggaaaggataccctattcaataagtggtgctgggaaaactggctaaacatatgcagaagaatgaaactggatccctatctctcaccatataaaaaaattaacttgagatggattaaatacttaatataagacctccaactataaaaatcttaaaagcaaacctaggaaatactcttctaagactttggcctaagcaaggaatttatgaagacctcataatatatgcagcaaaataaatgcagcaaataaaaggaatttatgaagacctcataataaatgcagc

SEQ ID NO: 105198 - DNA, 340 bp, Homo sapiens
gtccagacagatgaaggcaggaaggattagttttgatcatgcctgctgggtgtatgagtcacattctacctggtaattatttttgacatttgacagttctaggcacaaccttttgcagctctgaaatcttggcaggccatttatttttgaagcttcatattttccttttcacaggatatacctatttgggtaccctgttcaaattaaggtagagatttttgaagagtcacaagcccggaggaaaatgtagagtttcaggaaagaactcatcacttagcaacaacaacaacaacaacgacaacaacaacaacaacaacaacaacaaaagtgtgacctttac

SEQ ID NO: 105199 - DNA, 731 bp, Homo sapiens
gcgtgaaccaccgcgcccggcatattgctgcaagattctcgctcagagtcttctctgccttgtgtgtggtgtggttataaaggtcttcaacatgaccctctgtggcatttagtgttgttccacacaaagagaaagatcctacagcagcccatatgtcctactcttgttgcagacgaggaattattttgtcaagaggttatgaattttccctcatgctttgtcactaactttgaaaaacttactaatctgaggggtttagcaggagctcttcagtctcagcctcccctctcagtatctctctcgttctggcaagtattcagtacaattgggagtcatatctatacacacgcaaagttagagtaatatttgtttgtttattttatcaaagatctagtttattttcaggtttcttacagaagcttttttttgagctttttcaaaatgggaaaaggggaacgatgtaaagcaggcaaagatgtatattttccatctctaataatctgaaaacttattttttggaataaaaatacaatgcatgattaaaggatacccacttataagggtagaatttcatacatatttcatagttttaagggttcattaagactttaaaatctctatttggtatcaatttttctcttgccaatctgtgctgtgtgtatgtgtgtgcatgtgtacattggtgggtatttatttgtaaaaatgtataaagtatttcaaaagaaagtgtg

SEQ ID NO: 105200 - DNA, 412 bp, Homo sapiens
aatatgtgtcgtatggtgctattctttcatgaagctggataaaacagcctactcaggttttttttaaagggtgcatttcactaacataaaaaaaaaaacctgatctccacatttgacattaacctccccctaatatacaatacaagtatctactggctttatatatatacatagatagacgatatagatagcaatagatccatacaggttgctatggatgtattctgaaaaaagatataagattatattttgtatttagaaaatgagaaagaccaatacttggtacacacaggtgtgaaaatttactatcactggttgaccatccccctctttgtcatgaggcctcagaatcctcatcgatagaattcaaacaacataaaccaataaagaaatggtacatgctatgactctt

SEQ ID NO: 105201 - DNA, 576 bp, Homo sapiens
gcatgttgaaaacctaagcatcaaagtcaactgattcaatcattaatttcagtgtaagttgcattacctcttatctagattaatactttaagagtttcccaagaaatatcttaactccaatctggcacatgcaccaaatccacctgaaaatctaaatcttcctcaaccattttcactgtgtcattcctctgctgaaaaccaactattgttctctattatctatcaatcgggtctatacataactctggctatataagcccaccatgatttgacctaatccaatctattcaacttcccttctgtggtgagaacggtaggttaaatgcggttacacattctttgtagttccatcaaccaagatgcagtatctatttcttccatttttgaatatgggtaggcctcttgacttgcaatgaacagaatgtggcagaattgacactgtgttacttctgatgctcagtctcaagaggccatgcaattcctgctattttcctcttggaacactaccatgtaagaaatctgggctatccttccagaaaagaaatatggaagtgagccagttaatggtcgacctaa

SEQ ID NO: 105202 - DNA, 151 bp, Homo sapiens
gggctaaataaaagcacgcgggtggcacactgaaatgtcgtagaaggcaggaagccccgctactatgaacctacaactctccgtttgcggctgacgcatcgctcctgcccgcacgcacctgggtccgtgccaacagcaccgggcagccctc

SEQ ID NO: 105203 - DNA, 356 bp, Homo sapiens
ctgccttggcctcccaaagtcctggggttacaggtataagccaccccatacggcctgattcttttaaaaacagcgtttgggcttgcaccccagacgtttcacttggaggccctgaatgggaccacgccctcttccccaaggcaccatcacacacacacagggctccagcctgtcggacccacgatgcgatggacggccagacggcccacctgggctacggtccacctgggcagtggctccccctctttgggcctctgcttcctcacctgcagaactggggtaaataacagtgcccaggtccgggtgggcaggcatgagaggttaaggaccacacttgagtcctcactccagccaat

SEQ ID NO: 105204 - DNA, 294 bp, Homo sapiens
taatctacaatacagctgcactgttggtagaagtgagaatctaactggtggctggagtgaggtggcataatcacagctgaatgcagcctcaatctcccaggcttaagagatcctccctcctcagcctcctgagtagctgagaaaacaggcatgtgccaccatggccagctaactttttaaattttttttaagagatgggggtctcactgtgttactcaggctggtcttaaattcctgagctcaagctatcctcccacctcatcctcccaaagtgttggaattacaggcatgagc

SEQ ID NO: 105205 - DNA, 307 bp, Homo sapiens
tccaacaggaagaatggaaagtctaagatataagaagcaataatgagtaaagaaagtggcaatatttgggttaatatttgggaattaatttaattttaattaattaattaaaagtgggaatatttgtgttaatctaagtattaattgcttgaaataataatgtctcataactttaaaagtttggcagaaaatatgtgaaaatatagcagatcagtcaaaaaaggacaacttcaaatttttgtactgaaatccttgtatagttgagaaaaagaaaaaagatacctataaacttaattttgataagtat

SEQ ID NO: 105206 - DNA, 263 bp, Homo sapiens
agagcttcatggaagaaggggcttttgagctgggctttgggaaatgattagcatttcttggagcgggaaaataaatctgggtagtaggattgcataagacatgagggccaggatattctagtgttttaatgacagagtagagttgttttgttgaaataaatattgtgcatgaaggagaatgatgcagaataactaaaaataaacccattaaaccttatatcagttttagaaggaatcttaatagttatcatttctgatctttt

SEQ ID NO: 105207 - DNA, 394 bp, Homo sapiens
ctgttcccagcaggccaggagtgtgacttcacggtgaagcgtcacgtccaagttactctgtacgtggcaatgccagctacccacaagaaaggagggctgtgaagggggagctggggccgcttctgggtaatggatttcccccgcccccatttctggcaaagagctctgtggtcacagaattaaaaaaatctatcaattgtaagctaaggcacatgctgggtggaagtgagagtgagggaacctattcttatcactagctctgaggtaagatagaaatgtctggaagctccccgcttgcagctgggaactgtgccttagtcatctttatgtttccatggctttgcacaaagtaggtgctcaggaaatgcttgttcaataagcaaaccacaaggac

SEQ ID NO: 105208 - DNA, 309 bp, Homo sapiens
tacattttgtgctttggggaataactcaaattccataaacaaaactattagtacaaatgttttctggacaatctgtgctgtgattttggaaattgtgtgtgaaagaggagagtagctgggcgtggtggctcgcgcctgtaatcccagcactttgggaggccgaggagggtggatcatgaggtcagttcaagaccagcctggccaagatggtgaaaccctgtctctactaaaaataaaaaaaatagccaggcatggtggtgggtgcctgtaatcccagctactcgggaggctaaggcagagaattgcttg

SEQ ID NO: 105209 - DNA, 400 bp, Homo sapiens
cccctctataaaatatgaaacatctcatagttaaatggtattgcaaaaacatttaagtacaatggtatttataactaaataaataattgttgaggtacagaaataaatgaaatgttcccatcctaatcaaacaggtgatgaagcaatggtgtgatctctaaaacacaaatattcacctccccctgccctcgccaaatcaccccaaatactaggctttcaacgaatgccacattcaatgacacagtgctttgataaaagtcatgtgtgactgagtggggttgccaagaatagccaaggtagcaatggccaacagtgaaaggatgtttgggatgtgccagcgaacatttgaggcattaataaaaataggatatgagagttttaataaaagaatatcacacct

SEQ ID NO: 105210 - DNA, 512 bp, Homo sapiens
tcacatttcatgtttcatctacctaataagcataattcttcccttgcagaactagtgggggtgaaatatgagattgtagaaagcataaggatttgggtcacagaaggttctgagcttctcccaacaccttcttcctatggcctgtctctgccttagcctttagccaactccatcttattctttaatgagtctgtcatcacagatagatggagagcttcttgtaattctttctaacctttgcatgaaatttcaattcaggataatggctgtgtctagggagggaaggaaggagatcggaattgggtagagggacaggagtaggggaatagggaatcattctttaatattttatttattaagctgggtggcgcatacatgtatattcgattaactaattatatttttcacttgaaatatttgatagtctcaagaaagcagcctatatacctatttttactactgaggtgcttcccttgggagcaggtaaaatgaacacacagctgaattctttt

SEQ ID NO: 105211 - DNA, 223 bp, Homo sapiens
atatcttctcccaggtaggtgtggccagctgattacttattcccagggagctggagcagcaggaaggaatggcctggaaactggaaataatcccatttgccggggtaagctagctgtggaaaactgaccaggctgtgggtaccgagagagcagcttcctgctaaacttcctgctgtgggtgaagggcagcgtttaaagagtaagatggtgctccccattccag

SEQ ID NO: 105212 - DNA, 452 bp, Homo sapiens
aaagagggaaaataaagttaccgagctgatcaatgactaaagtagcacaggtaggtagtcatatcaagcctagaaatttagtcattggacttgactaggtttacctaaggtgaatggatgtacagcagaggatttatctacctataaaaaatgatgtgtgccttttggtgacaatttagcccacccgttgaatccattcctaaattaacctatctcggcattcaaagagaaaacatggatcaatatgaagaaaaatggactgatagaagacagtgaactctaatcctagctgttgagtgaatattaagtgtttttctaaatagcattaaataactttctgggagatgttaacaggatgctggggttggaaagatgttgagaaaagtagtttagtgtatcttcctcttatggggtctgggctgctgacacagctgactctgcaactgaagggt

SEQ ID NO: 105213 - DNA, 774 bp, Homo sapiens
tgcttacaggtccccagccctgcccggctgggtggcagtggaggcccgtcgagaatttgagcatggcacgggcaggccggctgtgctgggggacctggcgcccccctctgcagctgctggcccaggtgctaagcccctcactgcccccgggctgggggcgcaggccggctgctcggagtgcgggggcctgccgagcccacgcccacccggaactcacgctggcctgcaagtgtgcgcccaaccctggttcccaccagcgcctctccctccacacctccccacaagcagagggagccagctccagcctcggccagcccagagtggagctcccacagtgcagcggcaggctgaagggctcctcaagcgcggccagagtgggcgcggaggtcgaggaggcgccaagagcgagcgagggctgccagcacgctgtcacctctcactatgaacaattggcaggacagtcatggtctggacctaaggaaggtttgctcagggctgacctacccacgagcagctgctcctggcagtctgagcgcctttcatatttcctgtattaaccttgtggcgcacaaagacagcatcgagaacaagctaatgagaatcatccctctcatcatggaacccgcatcccctgcctcaaaccaagccatgtgcacatgcacacttgatgatagcagaatcgaggcatctgttgacatttgtcttctttttgtttctagagtgtggtgggatgcctccatcactgtagcactgtcagatgggcgacagccttat

SEQ ID NO: 105214 - DNA, 955 bp, Homo sapiens
ccaaagaatatctggtctctgaggtactgggaaatgaggcaaaagtgtctctcttcactgctagctccttggggaccagcaagcggctctcaagttgcgtggtggcccaactggaaaaaaggcagttcggtgcatcctgggaatatccaggtgaaagtgtgagatttacctagaatagcttctgggcctctggggttttcacgctgtctctggtgaaggtgtccattttagaactgaagcaaaaaggtttcaatccgttccgttttctttgtatagcacttacccagtagctccatacaagtgagcactcagtaattaattttctcctagtccttgcattacactttctttgggatggaaatttctattttatgctccagaatagccatttctaactcacccatatggcctcaaagagttgggacttaaacataagcctataagcactcagattattgagaagtatgcataaaaaatggacaagctgaagatatggacaattttactgatgtttaattgcacaattgttaaaattgcatcactgccatcgaggtcaatttgacttaagtaactctgtttagaaatatgaattatgatataaaaacaattaagcaagcaatacttttatgttatttaaaaccttgctgtataggaaaagctacttttaggccaggcacaatggctcacacctgtaatcccggcactttgggaagctgaggtgggaagatcgcttgagctcaggagtttgagagcagcctgggcaacatagcgagacctcatctctactaaaaatacaaaaaattagtcaggcatggtgtcgtgcacctgtagtcccagctgcttgggaggctgaggcaggaggatcacttgagcccaggagattaaggctgcagtgagctgtgatcgtgccactgcactccagcctggatgacatagagagtccctgtctcaagaa

SEQ ID NO: 105215 - DNA, 458 bp, Homo sapiens
taaatttgcaaccgcgtcgacgcacaattgttaaaattgcatcactgccatcgaggtcaatttgacttaagtaactctgtttagaaatatgaattatgatataaaaacaattaagcaagcaatacttttatgttatttaaaaccttgctgtataggaaaagctacttttaggccaggcacaatggctcacacctgtaatcccggcactttgggaagctgaggtgggaagatcgcttgagctcaggagtttgagagcagcctgggcaacatagcgagacctcatctctactaaaaatacaaaaaattagtcaggcatggtgtcgtgcacctgtagtcccagctgcttgggaggctgaggcaggaggatcacttgagcccaggagattaaggctgcagtgagctgtgatcgtgccactgcactccagcctggatgacatagagagtccctgtctcaagaa

SEQ ID NO: 105216 - DNA, 297 bp, Homo sapiens
atgatatattttttcattctttactttcaacctgtatttatatttaaaaagcatctttttaaaacaacatagcattaaatcttgcattttatccagtgttaatatgtttgctttttaattggagagtttattccatttatatgtaatgtaattatttataacatgattgtctctattgcaattttattcataccctccattttcattcctatgttccccattttctgttttcctttgaaatcctttgttcctcattttctgttttcttttgacttgattaaatatttttcatattcc

SEQ ID NO: 105217 - DNA, 992 bp, Homo sapiens
agtctcaattcaagtcagtataaggctttaagaggggaatgctaaaattaacagtttaatgcatttaattccttgtcatcctaatgtttttacagactgaacagtttaaaataataacgtttacagtgaatatacctccaaagcagactttttaaaaaagggaaaaacaccaggccacatttctaagatttaaattgaaggtgaagagtaacactttgctttctgatctttagtacagcaaaatgtggcaataatttttctttttaaatgacataacatatagattcatcagaaaaaccagcataaagaaaatggctatcaaaaaagagaagagtgttttacatacagaggaagaacatatcaagcaataaattgtgaatcagcctgcttactaaaaaggctgagctctactgattatggtaaatttagagcaaaaaatgttactgggcaaaattatactcaaactgtaataatcccattatctacatatacactgctttcattctactcatcagagaaacacatatttaccttttataatggaattacagaaaagcagttgatgactggtttgcaaggcccttcaggatcactgacctgaaattcttgactctctgaaagttgcctttaggttttgttcacttgtgatcctaagtattggtcttcaagctgaatttcattaaatactgacacttgaaactacaggaaacatctttcctttgacaagtctttgagaaggactcgacaacacttgcaaatactcatttcccaacacatttttaagataaagaatcaccacaactgccaccaccacaccatattttcaacttctgctctaatccaataataaaaccaaatttggtaatcaagtacacttaagtagggaacacctaaaccaattaatttttcacaggggttcccccttcataatatgcttcctgtttcaattcccatatgaaaaatccagctgaacttcaaaagccaccacttat

SEQ ID NO: 105218 - DNA, 679 bp, Homo sapiens
attttttctaggattgtcttgaccttgtatcaaaattatagaaatctctttataaaaaaatctctctgaagagttcagcatcccaggctgagctctactgattatggtaaatttagagcaaaaaatgttactgggcaaaattatactcaaactgtaataatcccattatctacatatacactgctttcattctactcatcagagaaacacatatttaccttttataatggaattacagaaaagcagttgatgactggtttgcaaggcccttcaggatcactgacctgaaattcttgactctctgaaagttgcctttaggttttgttcacttgtgatcctaagtattggtcttcaagctgaatttcattaaatactgacacttgaaactacaggaaacatctttcctttgacaagtctttgagaaggactcgacaacacttgcaaatactcatttcccaacacatttttaagataaagaatcaccacaactgccaccaccacaccatattttcaacttctgctctaatccaataataaaaccaaatttggtaatcaagtacacttaagtagggaacacctaaaccaattaatttttcacaggggttcccccttcataatatgcttcctgtttcaattcccatatgaaaaatccagctgaacttcaaaagccaccacttat

SEQ ID NO: 105219 - DNA, 295 bp, Homo sapiens
tgagtcaatattaaatggcattctttgtgtcactaagctgaactcccttgtcttctaaggaagcatttctaatgccagaggtagtcagccaagctaggttccttatctttttagttctatggaaaaacatatcaagttctcttatgagtgctttcctggaaatcagatgagaaagaaaaaaaagtaacaatgtaacaaatcattgtgatgttgttatattgtcgacagataaaggatggatttgatcctgcgtctgaaactaagtaggtaatggtatctacaatatagatcatgc

SEQ ID NO: 105220 - DNA, 298 bp, Homo sapiens
gctggtgcctgtaattccagcttcttgggaggctgaggagggaggtttgctcaaggcccggagtttgagaccagcctgggcaacacagttagaccccggcgggggcaggggagtgagtttctgggtggcctctcaccccagggtgcaccttacaatgaccacgaggtgccaggaaccagggttggtttggcatccacacagggtcaaaaaaatttaatggatctttgttctctgaaagggaacaggaaggtaaacacaggctgccactatttttgttcagtaactggaaaggctgctc

SEQ ID NO: 105221 - DNA, 464 bp, Homo sapiens
atcaatcagagacctaaatgtaaaacaaaactataaaacccctagaacatcacataggaggaaatctaggtgaccttgggtttggcagtaactctttagatatgacaccaaaggcatgatcctcgaaagaaaacattaataggttgggcttcattaaaataatacatttctggctcatgcctgtagtcccagcactttgaggggccaaggtgggagggtcacttgggctcaggagttggagaccagcctggataacagtgaaaccccatctgtacaaaacagtcagaagattaggcaggtgtggtggtgcgtgcccgttgtcccagctactcggaacactgaggtgggaggattgcttgagcctgggaggccgaggctacagtgaactgtggttgcgcggctgtgctcttaacttgcgtgacaaagtgagaccctgtctcaataaaataattaatgaaactgaa

SEQ ID NO: 105222 - DNA, 275 bp, Homo sapiens
gtttggggacagtgactccctttctcccctaagcctatcctggtttgggtttgtgtgacttgcaaacaaagaatctggtcccatagagtagtcgtgctttgtttaaggggtttcttttttttttttttttttgcagccatgaagatgattttatttatctatagttatggttgacatttttcatgcataaaaacttctattgctcaagaaaaaagttaagtacttcctatggaaacaatagacaaatgacaacaagaaatttacaaagaaagaaa

SEQ ID NO: 105223 - DNA, 301 bp, Homo sapiens
gacaaaaagcttatctttcgtttttagcatatgtataaacagaacaaaataaaaacagcaagccttaatatctttcgtttctcattttaatcttgctaaaaaatatttaatcatttgtataaaaatattgcaagcaacaaaagcgtattgtggtaatagttctacaactcaataaatttaataaaaatcagtggatgagtgaattttatatacataaattataccttgataaagctgtttttaaaagttctaaatcaaaggtgaaccaaaccagtatttcattcaaacaagtccatgggaa

SEQ ID NO: 105224 - DNA, 318 bp, Homo sapiens
ggggaataatttacttacagtaaaatgcagaaactttaagtttacacctaggcactattttagatctggcaatattgaattaaagcctgtgctcctatgaagttggccaaaaaaaatcatcagctctgaaaagacaaatcaatcagcaggtcttaaagacagtgagttagtagaaactgccctgagattgaaagacagaggtttaactttattttttaaattcttttaaaaattttattaccagaaaagtaattttgaaaaatattctagattagtgataaattatttgatagatttgcaaataaaactataaatttt

SEQ ID NO: 105225 - DNA, 371 bp, Homo sapiens
tcatgcagtgactagtatgatgtcttcctttacccaagctagtatggcttttttctcttattatttatgtatcaaggaacctcctcaaggttagctgctattataagaaacaactggaaattgtctttgaagtaccacacagaagaaacttggcttgtttcctatctgtttatgattgtttatgctaatgtatggattgtccttcagttgtcaatttctattccagaaacctggcaatacttttgtgcacgtgtgtgtgtgtgtgtgtgtgtgtgtgtgtgtgtgtgttttgaggtgaaattcacataacaaaaaaatagtaaaaaatacttgaaagcatacaattcagtgacatttggtacatttacagt

SEQ ID NO: 105226 - DNA, 354 bp, Homo sapiens
attattgaaaaacaaaacagtaaaacgcatctcagtctccatagttttataggtacatctcatttggtacaagtagaacctgtaatgtttatagaattgaaatgtaaatcagtttcttctgaacttatttgtgtgatttaaagttgctactttttatttattaatcttatagggatatgttgaaaaacaagattttaaatatggattaaaatataaataattttattaaccaaaaatgtcagtttattggaaacataaacaattttgtgtctgttgggtgaaaagtagaatatgttgttttatgcatatgatagattattttccttaacatttaacagtttaacaagttatttt

SEQ ID NO: 105227 - DNA, 401 bp, Homo sapiens
taaacagacatttctaagaagacatatgaatgggcaataagcacatgaaaagatgctcagcatcattagctattggagaaatgcaaatcaaaatcacaaaaagatactgctatgcaccgactaagaaggctgcaacctagaaagcagctaatagcagtgctcatgaggatgtggagaaattggaacctttgtatactgctggtgggaatgtcaaatgaggcggccacttgggaaaacagtctggcagttcttcagtatgttgactgctaatagatgttatggttgcacaactctgtgaatacactgtaagtccttggtttgtataatttaaatgggtgaattacatggtatgtaaattatatcacaataaagctgttattaaatgacattttacaagctta

SEQ ID NO: 105228 - DNA, 379 bp, Homo sapiens
tgccatgttgctcagactggtctcaaactcctgagttcaagcaatccacctgccttggcctcccaaagtgctgggattacagatgtaagcgactgcttacatagagcttttacactttttacataggccggcatagtgcttttgatctgaagtagctttcttcgtattgctgctttttctctcttcagctcagttatttattcattcacctagtgtttattgagcgtgtactaggtggtgatccactaggcactggcgatttcatggtaaacaagataggtaatgtccttgccatacagaccctacttacagagatgttaagttggaggatgttacacagtcgtagttgagcaactaggcagactgagttatttcagag

SEQ ID NO: 105229 - DNA, 241 bp, Homo sapiens
gccccagccagcgatcttcctcaagggttcatcctcaaggttctcctgcatcccggctccctgagctcagccatgcccacgacttgacgagatcaactccttgacttctctgatgacaaagcccccagggtccagccctgacctcactccagagttcagacacatctccgccagggtgtccttcaggtcccctaaacccagcatcagctcttggctcttccactactctctgggggatttg

SEQ ID NO: 105230 - DNA, 371 bp, Homo sapiens
acatccacacacaaacctattatccacatgtacacacacatacacacagacctattacacatgtacacacgcacacatgtgcagacacatgcacacatccacaaacataactattatgtagctacatgcttacacacacctgcacacatacagacacacatgcactcacacatccatacacaaaactattgcatgcacactcacaggcacatgtgcacataaaaacagacatacacattcagacccatgcacatgcccccacacacctattacacacatgctcacacacacaggtgtgctgacacacaaacacgcactaaggcacacatgtccatgcacatatctagtacacatgtgctcacacacacaaa

SEQ ID NO: 105231 - DNA, 775 bp, Homo sapiens
gaaaaatagtccataatccatctacccaaaggtaatttactagtaaaattttggcttatttttttctagcttatctcattttaactgaatattcaagtaaaacctgaatgtattctaactgtaaaatattctggatggcataactagattgactatgtgatagattacctttagtttctttccccggaagtaactactgtcaatttatggtactatgtttaatcctttatctgtgatttgaaatgtaagcatatttacatgtagatcttttaaaaaaggattctccatatacaccttcagcttgcctttttacagtatttcttagcacttttcatgtcaatacatgaagataaatcttactgtatttaaacattgcatagtattccatggatacacctttacttaacacctctaagttgttttctttttactattataaactgtacagtaattaacaatatccttgtaaacatgtcttagaacacattggtatatatttctttagaatagatctctggtaatgaaatttttgagtcaatattatgtatgttagatattgccaaattgccctccagggaaagttctaccgtttatattcataacaggaatgttatttttctggccactgatggcaaaataattaatttaaaaattaatacttatttttaatatgtttattagctacatttatattttttgtgagttacctatttgtgtcctttgcccattttctagatttttttgtcttcctttttgatgtataggaactctttct

SEQ ID NO: 105232 - DNA, 480 bp, Homo sapiens
ctcgcgaacgtgttatcctatattaacctataaacatgggaaaagaagagggcacatacattaaatccttccatttgggaaagaagatcatggtaaacaaggtatgtcatatcctcacagatgggaattctgtttcttggtctgaaagtggagttagttttttggccaaccaatttgggcggttacagaaccaaacactgcctccacagttgctgaaagattcatctcaattcttcattgttgctcttttctgtgttcacatttcccgtgggtgtatctgataggtggaagttaagctatgtgtctgccctgtagaggcaagggattctggggatgtgaatttcctgtattctaccttgggaatgtagaactcataatgtgagaagttatccaagacgtaggatgaatgttgaaaatatatcagtcgcaaacgataaatgtatcctacgtcttggataacacgttcgcgaggggatcctc

SEQ ID NO: 105233 - DNA, 354 bp, Homo sapiens
tacagtcttgggacctgggtcctggccctggttctgcattaccaggggaagtgttctctgcagcctcagtttccctcatctgtaatggaaggggtttcaacaacatcatctctgacatttctccaggctctgacattctgagatacacctaaatgtagctgatggcacaggatttgaaattgggagacctgtgttcaagcctgtatctcacttcttagtgacttggtgactgtgagtgaatcactttaaccccccaaagccccagttcccacatctctcaaatggggacacttgaaatttcctcatgaatattgaatgggttatagaagatgacatggcataaatgtgatttaa

SEQ ID NO: 105234 - DNA, 1423 bp, Homo sapiens
agcgggagagcgcagcgcgcctctccccggccgggcggacacttggttcattccagccgcagaagctcagggctcccgcgtaccgggattttttccgagcagaaaaaagctccagagctctcctgacctcctttctcctcggcggcgagcggagcctctccctcggcgctgccggccgcgccatgccgcgctcgcggggacgggagctggggcgctgcggctgccccgcggggagggctcgcggcgaaaccgggatttcggcgcttgtgccgggcgccgggagccgctggggccgcccgccgccgccaacgccgccgcctctgctgctgttgctgggctgtgggttgctcagcgtctcggccgccgcgggccagaactgcacgttccaactgcacggtcccaatgggacagttgagagcccagggttcccatatggctaccccaattacgccaactgcacgtggaccatcaccgcggaagagcagcacagaatccagcttgtgttccagtcctttgccctggaagaggactttgatgtcctgtcggtgtttgatggtccaccccagccagagaatctgcgtacgaggctcacaggctttcagctgccagccaccattgttagtgcagccaccaccctctctctgcgcctcatcagcgactatgcagtcagtgcccaaggcttccacgccacctatgaaggtaagtgcctccctcatcggccacaggagccggagatgtgatgtcctaatagccacaagcaggactgcattgctcacagatgcagggaagtgttcttcagacccagagcttgcgcctgtcctgacaaggctggttactaaccagtaactcagttacttaaattgtccctcttggttcccaggaaactgagaattgaaatcaaagctcatgtgcagtagtttatcctgagggcctggtaacatctacttctctgtcccctttaactgggttttgttgtgtttttatttttttaattctgttttatattgggcttcattgtataaggtacctcaggttgtttttgaaaataaaagacatataaaccctaagtaaaagaaataaaataagcaactgaaaacaccatacaatgactgccaagagtcagttttatatcattcagagaagaacaatcgatttttccttaatagcatggattaggggcttttggtttgtgctatgcaaataatttgtacttctctcagtctgtttaaatatggtgttagaattcaaattaacactaatatcttcagattatacactattattattattaactttattatgttcagaaggtggtacttctagatctctgtcatttccctgggaaatttacatctcattaataggtaattatgccactcttggctaagacctgcactgttattttgtgttaagatcattaata

SEQ ID NO: 105235 - DNA, 1181 bp, Homo sapiens
agcgggagagcgcagcgcgcctctccccggccgggcggacacttggttcattccagccgcagaagctcagggctcccgcgtaccgggattttttccgagcagaaaaaagctccagagctctcctgacctcctttctcctcggcggcgagcggagcctctccctcggcgctgccggccgcgccatgccgcgctcgcggggacgggagctggggcgctgcggctgccccgcggggagggctcgcggcgaaaccgggatttcggcgcttgtgccgggcgccgggagccgctggggccgcccgccgccgccaacgccgccgcctctgctgctgttgctgggctgtgggttgctcagcgtctcggccgccgcgggccagaactgcacgttccaactgcacggtcccaatgggacagttgagagcccagggttcccatatggctaccccaattacgccaactgcacgtggaccatcaccgcggaagagcagcacagaatccagcttgtgttccagtcctttgccctggaagaggactttgatgtcctgtcggtgtttgatggtccaccccagccagagaatctgcgtacgaggctcacaggctttcagctgccagccaccattgttagtgcagccaccaccctctctctgcgcctcatcagcgactatgcagtcagtgcccaaggcttccacgccacctatgaagatagggatgacgggaagaaatgacccaaaacgagaattaacacaaagagaatattcaccatgattactggccagggagaagggcccttcttaaagaattagggaaacacgcacacagcagatctaaatggattcacccatgttaaacggagaatcctggttacagggcgtttaggggcaacattgtagagataccaacggtccttaggtgtgggttaccccttgcttgttacacaagcgggtatctgggcgcaaaatatctttgttttatcacctttggggaccataccatatatcatcgcggaggcccgggagaaagaaagcgtctctataatacagataatgagtcccggggaaccatgcgtgctaacccgagcaaaatataaacgaaccctctcataaatcgacgaatcccgctaagaaggattagacctatgccggacagaatattcgtgagcaaagcatatatattcacacccggag

SEQ ID NO: 105236 - DNA, 252 bp, Homo sapiens
ctgcttattttattctaattctttgttacatattagaagcaaggaaataaatttaaatgaggaaaagaacagaataaaaagaatatagagatcttttagggaccgctgaggctctccagcagtccttgaagattatataaattcccttttgatgaaattctgaaaattttaccactaatagacctgagctgtagtttctctaggactgatacatgaatttttttagtttatttaaatagagttgttgaaata

SEQ ID NO: 105237 - DNA, 404 bp, Homo sapiens
tgagccctgtagccccacagcctggcgtggtatttgttgaaagaaggcagagcctctaccctcgtgtaactcagtgcgggtggagagcccatggcagacccaggactggaggctcctgcgtcattaggaacattggtggctgaagcttgcttgtcccagctggcgagagccaattacgcctgtctccttccacctccacgtatggtgacatcactttgatagcttgacgtcagccactgggggactatttacatcatggatatgggcaaaagacaccaatctgagcttttgtccttttcttttttttggagtgcctgcacacccgtgagcctttccaacctcgtaacctattattttcctgacgagatagttttttacagatgagaaagttgaggcacagagaa

SEQ ID NO: 105238 - DNA, 415 bp, Homo sapiens
tacagaaaaaaacaacagacacagagtagtgaagtgacttgacccaagtctcacagctaatagttggtatcagagccaggattcacccctaggcaatctgggcactggatctcaataaaggttatattccttctccttcctttcacccttaactttcaagcccagaggaatcccacctttgctactgaatctttcctgaccagcccaggcccagccagcccagtaggagcagaaatccctccctgggggcatgcctccagagggtagggtgtctgtgcatgctttcaacaccatcttctgctaagtccaggtttcagggacgcacctggtgcgtggaggggagaggctgaaggtccttcctgtccccacccctacctcaaagtaagcagcctcacttttatctgctttctatatt

SEQ ID NO: 105239 - DNA, 438 bp, Homo sapiens
gcaagactaggatcagggacagatctggaggcccaggacatggctgagaggtggtcagcaggctgggggcatggagcagagagggcttgggtacaagctggagaggaaggagattctggcatgttggggtgagggcagagggacagatgaggggaggagggtgctggctaaacaggaactgaatgaatggcctgaagctccctctcccaagggttcccactcccattggcctggccctgtacgtgcactctgtcatctccttggtcaccctctgctccaggccttctccaccacaggacctcagctgtccctccttctacccaaggtggagtcccccaaagtcccttctgtctggcctatcctgtgcccaccacctgtggcttcatccagccctcctcctctatctttatctgccataggccgcagccctggccccct

SEQ ID NO: 105240 - DNA, 425 bp, Homo sapiens
ccacctgcctcagcctcccaaagtgctaggattacaggcgtgagccgccgagcccggtggactgtcttctctctaagcagtaagagacagtgggaactgcagaagggtgtttgcagcctcatgcagttgactgaatgaattggccccagagtcacccctagcaccatcttgatatggacaggaggcagggaaatactgggtagaagagggtggttccccagcaaaggccccaccctcaagcctggaaatccggagccctaaatgggaacaggcattcccgtttttgtgcccaaatgttgccttttggctcaccacgcccccctctcctgtatccatataaaccccaaaccccaggctccacaagcagaagagtggcagagcagtgcagcagagaaggagaaaagaaaaggtgcttctgaacattg

SEQ ID NO: 105241 - DNA, 143 bp, Homo sapiens
ggcttgcgcctggtcccccagagatcgtcctgtgtgccactgcccttagctgatttcgctgtcatcttcttgctagaatgaatcttggctgtgggtcctactaggtcatgaagacggaggtcgcggggacgcccccacgcact

SEQ ID NO: 105242 - DNA, 315 bp, Homo sapiens
ccgaggtggctggatcacttgaagtcaggagttcgagaccagcctggccaacacggtgaaaccccgctactataaatacaaaaattagccgggcatggtggcacatgcctgtagtcccagctacttgggaacctgagacaggagagttgcttgaacttgggaggtggaggttcaatgagccgagattgtgccactgcacttgagtctgggtgacagagcgagattctgtcttcaaaaaaagaatgggggctcactgtgttgcctaggctggactcaaactcctgggtgcaagtgatcctccttagcctccaagtt

SEQ ID NO: 105243 - DNA, 584 bp, Homo sapiens
aataattattaaatatctatatgccagatattgctgggacgacccctcaattcataaactgccccctctctcacgacatgtgatcatgtcactcacctccttaagacttatcatgatgccctgttgccttgaggataaagtccaacctcctaatcacagctttggggctttttgtgatccagcctttccctacacctctaacttcactgacctgcccctcaccacctacaccttctgcactgtgttccagatacagtggacttccagcactccccacattcaccctctctgcctccttttcaccgacatctggggtgtctcacctcctccttgcagtgtctcttcactccccaggtggggttgggcaacccacttttgttttcccaaagatccccatgcttgctcctctcaaagtgctaactacactgcagtgaattgtggtttatttgtctagttcccctactagactgcctttagggacagggactagttttattcatcttccaaatctgactccttcatttattactaactgtgtaacatagggcaagttgcttaccttctctgagtctcagagttattat

SEQ ID NO: 105244 - DNA, 536 bp, Homo sapiens
aacgtggcatcaccactccctgctgctccctctgcttgagatgccaatattcctccctcactccttacctctccctttccctagctggcaaactgtttcccacccatgaatggattcaaaagtgtcaccatatctatgaggtctcccctataccccaaatcagtgaatccctctcacagcatttttgagatggggtctcgctctgtcacccaggctggagtgcagtggcacaatcgcggctcactgcaacctccgcctcccgggttcaagtgattctcctgcctcagcctcttgagtagctgggattacaggcacccgccaccacgcccagctaatttttgtatttttagtagagacggggtttcaccatgtttgccaggctgatctcgaactccggacctcaggtgatccgcccacttcagcctctcaaagtgctggaattacaggcatgagccactgtgcccggccacaaactatactcttaaacattggacgtcacattgagggctgggtctagtttccagtcagggactctc

SEQ ID NO: 105245 - DNA, 402 bp, Homo sapiens
tgtatttttagtagtgacagggtttcaccatgtaggccaggctggtctcgaactcctgacctcaggtggtccccctgcctcagccgcccaaagtgctggtattacaggcatgagccaccacgcctggccgagtctcattcttctccggtgtaacctgggctaccccaccccttcaggtgtgcagcacaaggtctgtttccaaatatgcacctgtgtgacctgcagccagaccaggccacagaaggacctcaggcctggaggctccctgagctccctgcttccagcatctcatttttgtataaataccctggtcctctcccagttcaccacagagcagtggccccccctgtgccagacagtgccctaaataccactgcctggggttgtgtctcctaatggtgt

SEQ ID NO: 105246 - DNA, 330 bp, Homo sapiens
ccgaagcctggtttactacccggatgaacagccccgggctttcctgaggcttcacctcatgtcaagactgagcagccaacacctcgtgaaagctggtttatgagaaaacgccaggcagtggccaggccgggcctccgtcgccggatccaggttttgagaactgccctgggcggggagctgcgtgcatttgcgatcgcagctcagctcgcagcagcgtctggctccacgctgctctcgttgtcactatcttaaaagtgccgcccctgaccctgcctctcggtcttctcgatggccagccttattttaccatcacccctttctagagaagag

SEQ ID NO: 105247 - DNA, 372 bp, Homo sapiens
atactttatcatgtctgatgtcttacctgaagtaagtgctcagtgaatgctcaatgaacttgttttggtggcacgcagctacttaacatgacgttaggatgtagcattaatcagctatgaggctgtcactatctgtaacctaagccccttttaggaaaggtagcttctctcagtgataacgacagaccaaatatgacaaccctggtttactacaggtttgttcttcatgggtgtctgggtggggccagggggcctggtgcagacagttgacctggaaagagctggtgactacacagcgtgcttgcttttcggcgaggagggaagagcctgtttgcaaacagactcctacatgtgacatttggcatcatttct

SEQ ID NO: 105248 - DNA, 337 bp, Homo sapiens
tatacaaaatatagatctaaatgtgaaaagtaaaaaaataaagcttctgaaaggaaacagagaacagtaggtaaaaaagaaattttttaaagaatgtgagaagcactaagtaggacatgtcagcttaacatgagctaatactctgttaagattacaaaaacaggctgggcgtggtggctcatacctgtaatcccagcactttgggaggtcaaggtgggtggatcgcttaggtccaggagttcaagaccagcctggtcaacatggtgaaactccatctctactaaaaataaaaaattagccaggtgtggtggcgcacacctgtgaatcccagctactc

SEQ ID NO: 105249 - DNA, 509 bp, Homo sapiens
gatccagattttattaaagttcttcaaaggacatttgacatttggctaactgttgaaatttccagccagtttcagcattctcagagtagggggatgaagtagaatgccataacatctcctgtgaaatggtatgctagtggaattaactgtcacctcagggtgcactgattatctgcatccccaactttctccttactggtagccagtgctccgcagatgctgaagaaccgcaattagtttcactgattttatggtgtgtgaaggccttaggctgtgcttttgactggtaagtatttctataccaacctcagaatttgtcttaaatttctagaactgtgctgctgggccggatatgagcccaatatgttacaatatgtctttctcagatcactttttatttttatatattatttaatttttaaaattaaatccccttttatttacttatttattttgacacagtgttgttctgttgtccaggctggagtgcagtggcacgatctcagctc

SEQ ID NO: 105250 - DNA, 424 bp, Homo sapiens
tgcctggctactttttaaattttttgtagagatgaggtctcacgatgttgctcaggctggtcttgaactcctggataaagcagttctcccatctcggcctcccaaagtgctgggattacaggtatgagccaccacatctagtcctgggtgttttcaaagctaagacctctaccccactagaaaccaacgtcaaggagcctgaggaggcagggagggttgcagctggggtgagatgctcttgggcgaagctgcagggcctccacttcagggcagtgttcccaggtgacagagtgggacagctcagagggcctctgaatctcctgcacagaacaccgagaccagaaaatgggtctctgattaagggctgttattttcttttcgtttttccttccacagggcttttgatgattcttgtaaaaaaaaa

SEQ ID NO: 105251 - DNA, 434 bp, Homo sapiens
ccataaagtttcactgccttccttctggaggggcggatggcagttcctgtttgcgatgtggctgtgtgagaatgtgtgttttcaggatggacatgaatggctgcttgaggaagggcatgactttgaataacacatggttcattttttattgtattttcaaatggctcttctgggggaaaaacagttcaggaaccacattccgattgctggcccaaaatccatgtaagacttagaaaatatttggggtgaaatgatgggcagtgccttgttttgcacattttatgatgtgagttcgtggtcccctctgaagaggcgtttcctctgaatctcctgcacagaacaccgagaccagaaaatgggtctctgattaagggctgttattttcttttcgtttttccttccacagggcttttgatgattcttgtaaaaaaaaa

SEQ ID NO: 105252 - DNA, 342 bp, Homo sapiens
ccgccatgcccagccagtaaattttctctttaaatctcactttcgttttacaactattgagttgtaaaactaagaacattttcttgagccttgtgagtttatatttttttaatttaaatgaataagatttagtttaagatttaggttttttaattaaaaaatgtttagttttatgggtggattacttgagctcaggagtttgagaccaccctgggcaacatggcaaaaactcatctctaaaaaaataaaaataaaaataaccaggggcatggtgacacacacctggcagtcccacctacagaggagatggctgcaggggggcgctggaaatggggaggaact

SEQ ID NO: 105253 - DNA, 265 bp, Homo sapiens
cccaactccagaggcctgcccaactccagaggcctgcttcggcctcccaaagtgctggaattacaggtgtcaaccaccatactcggcctcaactaattttttaatttttttgtagacatggagtctctctctgttgcccaggctggtcttaaactcctgagctcaagggatgctcctgacttggcctcctaaagtacagggattacaggcatgagcccactgtgcctggctcatttacattgtttatacaattcgggccttgctg

SEQ ID NO: 105254 - DNA, 709 bp, Homo sapiens
gcttataccttttaagttgtataatattgtaccttactttcatcttttctaaatgccctgatgcctcatgtgtgaacatttgatatactcaataaaaaaggttgatgccagtacattttttttccctaaatgcaagcaattcaagactttggaaaagctgctgtagacgtttgtcttacttatactactactgcaaaacagaaaaacttaagattactatcctcaggcttgacttattttatagggttcaaaaatagattgatatgaaaaaatgcttttaaatgtttttatatgttgcccatggggttgttctgatcttttctaatagtatatttactcagaggccaaatatgtgaagccaatacataaatgtggctatttattttatgaggactacaaaatacatctgctacacaaaacagaaataatgctatttaagggcttactacagtatcatatttaatctttatataggctcaatgacacacaaacatttccctgatagaatgttatataaaagtcttttttgtaggcttccttacagacaagaataggcaagaaacaaataaaattggctgaagttaatgttttgactaaactcttcttcagaactgactacaaagttaagttcaagataaagcattgtctaaaacagtagctgtttccactttgttttgggtaaaattactctcttatgagattgcatgtg

SEQ ID NO: 105255 - DNA, 333 bp, Homo sapiens
gctggtctcaaactcctggccttaagcgatcatcctgctttcgcctcacaaagtgttgggattacaggcatgagcaactatgcccagccttcaagcatttttttttatattgacataatttcatgtctacagaaaagatgcaagaatagcacaagaattcctgatacccttcacccactgtccccaaagtgttaacattttactacattagctacatttgctttatcatattaattctctccgccatcacatacaaatttgtgcacacatacattgtttcactaaaccatgtatgttactcaaatgaagctccattatctttaaatatttaac

SEQ ID NO: 105256 - DNA, 136 bp, Homo sapiens
tcacagccaacaagtgtggaaaccgcctcaggaccggcttgagtggagcggctgcgggagttacttcatgactgtggtctcacgctgtgtttcgccacccatccctgcctggcctggcttccttccttcctcctgg

SEQ ID NO: 105257 - DNA, 297 bp, Homo sapiens
aaaaaaccgtagtcaaagatggctgggtaaactccaggaatcatgtctgtgtaccacagctataaggagggtggaaggggaaggggaagaaaaaggtacaggatgcaggcctgctatattttaaagaggttcctgggcagggcgcagtggcttacacctgtaatcccagcactttgggaggcagaggccagcggatcacctgaggtcaggagttcgagaccagcctgtccaacatggtgaaacgctgtttctattaaaaataacaaaaactagctgggcgtggtggcaggtaatccc

SEQ ID NO: 105258 - DNA, 416 bp, Homo sapiens
tgccagccccaagagttctaattaatatatatttagctccctgactgtctttagacccaaacagttgagcgtagaagacaggaggaaaaaaatacattgagattggaaaaggaaagtctttcttaaaagaggaaatttttgtgcaatgctctgctcctatgtctatgtcagaaattactttcaggccactgagtgccttatgaaaaatggagtggaagatgataattatttttattgatcacacattcaagttattaattttttagtctactttctttcttttatttttcacaaaaatgttcatgcccagggaattatgtgcattcacaatcctcctctggtttgttctcccctctcctccctctgccctttttctctccgacctcacactattaaaaagcgatattgttcctctt

SEQ ID NO: 105259 - DNA, 177 bp, Homo sapiens
atttgcacagagttggtcctaggtgagcctaagaggaaactgggtgcatggggcctcttcctcttcccctttcctctaaacttattatagttgatatgcaggggcagttgttagttactggttcacttgtttggctaaagacaaagagacgtgttctgagcgtgtcttcctggaggg

SEQ ID NO: 105260 - DNA, 340 bp, Homo sapiens
gattacaggcatgagccactgcacctggccaaaaattgatttattttaaatccagcatggacatgatctagcaatatcaggttctaatcagacataaagtgagaaagaaaaagtggaaagtaatcaacttttgaaagtactgataccttttttgtactatttttaccagttaggattctaaatattattgtatgtatgacattatgttaggtataaacactttattcatattgtctgataatattttccataaagttaattatatcatgaatgagcttttgagtcttctactttttgatagctgtaaaaacttggtttagatccatcgacctttttattg

SEQ ID NO: 105261 - DNA, 328 bp, Homo sapiens
aactcctagcctcaagtggtcctcctgccttggcttcccacagcactgggattgtaggtgcaagccactgagcctgcagtcctgcaattctttttgtatataggatagttctttccagagcagggcttgtaattctcttcttgggatgtgctaagaccctgactatagttattaaccagaggataatgagtcatagtagaggcagatcttaagaataaatgtcattggaccaggcgtggtagctcatgcctgtaatcccagcactttgggaggccaaggtgggcagatcacctgagttgaggcattcgagaccagcctgaccaacatg

SEQ ID NO: 105262 - DNA, 1157 bp, Homo sapiens
  misc_feature (1134)..(1134): n is a, c, g, or t
gccgggctgcacacatccgtgctgggaggcagcctgtctgtgcagcgagcagtcgtgcgcggtggagagccgtagatgcacgggggcgtcacaggtcggacaggcagcatggggaagggagggaaccagggcgacgggggccgccgagcgcgaggatggtcggtgcccaccttcagcttgggagggagattctagatagcattaactcgtgcgcatcgcgacaggtgtgcttggtcattgatcgctgctaaggatttacaaacaatcacactagagagtggtccatccaagcacccagtgggagtgcctagacgggctcgatcggtgcactacgctgcgatgaagatgcaacggatgccgttccggcgaccttccagcgcctggaccctgggagattccgtgtgggcagatgttacgtatgaaacaccacttgactgattggctgtaacctgggccccggggacggagcccaatgaccatggcaccaccggtcacacgaaactcataacgactcacatgaggacttccgggccctgaggaagacggctgaggacatgaacctgttcaagaccaaccacgtgttcttcctcctcctcctggcccacatcatcgccctggagagcattgcatggttcactgtcttttactttggcaatggctggattcctaccctcatcacggcctttgtccttgctacctctcaggcccaagctggatggctgcaacatgattatggccacctgtctgtctacagaaaacccaagtggaaccaccttgtccacaaattcgtcattggccacttaaaggtgcctctggcactggtggaatcatcggccatttcagcaactggacaggctaaatcttcccaaggatccgatgtgacatgctgacgtgttggcctggcgaatgcagcccatccagtaggcaggagaactgtatcggcctagatacagtaccaaatatttcgtaatgtggccgcgaaacacccaggattccgatacaattatcgacagtgccctaaagggggcacgcgtcgcaaaaaaggatcacacgactagaggagccctcccatagttgcgaagtgtggcccacaagagacgacacgtcaacccactggcttacgcgcggtaaatnccacacgtatacacacgccaacc

SEQ ID NO: 105263 - DNA, 448 bp, Homo sapiens
cggaactacaaatcttggagggacaagagacttcagaaatggcaagttcttagtttgggaggctaggtattgaagtttatccaaattaatttggaagtttagatcagttgcaatcaaaatccttatttgattgacagtggggatggataaaatggagtttggatttgaaaatctacataggaggaggaagtaatagtatatctattttattatacgtgtgtgtgtgtgtataactataacaattagaatatcataacactgttaatagaccataaagtgacaaactaccccaaaacaaatcccattttcacataaaaatttaatatatgataaaaaagccttcacaaatcaaaggggaatgaaaggcaagattattcatcagatagttaggtcttcatcttacaccggaataaattcaattgaactgaagagttaaatatgtattaca

SEQ ID NO: 105264 - DNA, 258 bp, Homo sapiens
gaccttgaggctcagggaggttaaggtgccagcctgagatcacacagccagtgagaggcagagacagggcttaaactccaaacgatggctccagagccccctctcttttccatgccctgggctgcctctttccccagtgcaccttgctttttggaaccagatgaccaatgtggaaagacacgaactgattcaatcagagtgtatggagaagggacttagagaccctggtatttttaaagctccctggtaattctcatg

SEQ ID NO: 105265 - DNA, 698 bp, Homo sapiens
attaaagtaagcacaccttattattggaaacaatcccactctggttccttggcctgtgaggtaggggatattgtaaaaagaaatgccaaatggaagcctctgaaattacccttgtactctacagtcaagagagtaaatccaaaataatatcttattctggaaaaatagccacagttagtgccattattaaagacctaaggatccatgggaggtagtcccgatgatatcgccatttattcaccaacataaaaaagtcagatggatctttgagcgtgaaagtgagctactgtaactcaagtaaatttatgccttaattgtagatgctgtgtcatatatgatatcttttctggagcagtggattagttccttcttgcattgctttaaagaaatacctgacactgggtaatttatgagaaaagaagtttaactggttcacagttctgcaggctctacaggaagcatagcgacatctgcttctggagaggccgcaggaagcttccaatcatggcagaaggcaaagggagagaagcctgtcacatgtaagcaagagcaggagaatgagtggggaagtaccgcacactttcaaatgaccagatctcacgagaactcactcactagtaggatttgatcagctcactatgggagtgttacagaaaatagataccatgagcagagattctggcagcagctgggccacc

SEQ ID NO: 105266 - DNA, 755 bp, Homo sapiens
tgtttccctgacatcatcaagtgggccatttaaatagaagattggtcataatgcaaaggactcattggccacctcccttccctgttaaaatacctccatggctccccagtgcccaagaaacagagtctaagtccctctacctgatgagaaaggatcttctagacatggttcccgttagtttctccaccctcccctggccaggctctgcctcatggtcaccttcccagaaagaaataaactacagtacctgcagttcccttcgtgccatgccgtttttctcctccatgtctttgctcatgtggactccatgtctttgctcaaagaggacttccagacaaaatcctctttgcctggaagaactcaccgtaacccctctttgcctggcttagtgcagctcatcctttatgacttcatacaagggccatctctttttggttgccctccctattaccccaggctgggttagtcccttccgcatggcccacaatgtcttgtacattccattctaatggccactgtatctgcctcccaaccttgagggggtagcttcttgaagggacagtcactgtgtcattctgcatctctaggtgccgaacaaggcttgtagacatggtgggtgtagcatacatgtttgtggggcacacagatgcctcaagagagagaatggttgagtttgttatcttgtgttgggagtgatgaagggaaagagatcaggtacttaagatgatagtactaagaagagaaacctaagatct

SEQ ID NO: 105267 - DNA, 512 bp, Homo sapiens
gattggagaagagggtaagagtgatcttattgaattttattttgtctaccaatttagtgcccacattttccccagacatatggaggccctcatgttcctggcacagaggatgagcagtttttgcttgtgcctttgtctgtgcctttagagaggaccagtcctttgtgaaataaaccaactgctctggtaagttcgaaagtctgtaatgccaaatgtatttgactgtcaaattcaacaggaagggaagatgataagaagaaagatctcttttcaattaatttttaaacatgttgttttgtgaataccatcgttaacaagatataaatcctttacatatcatgcttcccataccttttcctttcattctgcttacgtacaatacttaccttgaaagttagcagtgaacactcccagtcaccatgcatagtggaaagcttcaagaaataagaataataataaaaaagttaaaactataatgataacttggccgggcacactggctcactcctgta

SEQ ID NO: 105268 - DNA, 290 bp, Homo sapiens
tctgtattagtaaactcttctcagttgataaatattgccctagtacaatgttttgcatatactattcataaaatattttcttgtatcatactgttagagaaactccagacaaatctcatagatgatataaaaactcacagaatgaagagtgagccaaatattgaacctcatgagaaataacagaatataaaacaatttgcttgctataggctattgctagcaatgcaaggtataagagtagtggtattcccacatttcttcagcctcttcaaaaataatttataatttga

SEQ ID NO: 105269 - DNA, 329 bp, Homo sapiens
tcttggctcactgcaacctctgcctcccaggttgaagcgattctcctgcctcagcctcccaagtagcttggattacaggcgtgcgccgccacctcacccggctgatttttgtatttttagtagagacggggtttctccatgttggtcaggctggtcttgaactcctgacctcaggtgatccacctacctcggccttccaaagtattgggattacaggcatgagccaccacgcctggcccaaaccagtttcttttgtcctatattctcagccccttgatagtaggtagcaccccttaaatacttctggagtggatgtctcaagcaagcct

SEQ ID NO: 105270 - DNA, 322 bp, Homo sapiens
tatgcaagaataaaatgaaatataaatgtatgtgtataacacaccaatcaaaacaaattcacaaatgaaatacagagtaaattaccaacccaagaccactcaattgaaggatattaattcagcctaatgggtaatgtggttttgtggaagcaaaattgctcattcagagcttcagggtagaaagttgcaaccctggttctgggtctgcagtgaatgtttctgtatttgcctgtaatcgtacccttgtataatgtctgttgacatatgtatgtaacacagaatgctaggaacatcttcaaaactttgtctcaacgggataatc

SEQ ID NO: 105271 - DNA, 283 bp, Homo sapiens
attgattcatcttacagttgcatgggctgactgggcagctcttctctctgggcatgcttggcggatttgctggacttcctcatgcttctctggtcagctggcatgttggaggcagccagatgatctagaatgacttccttcatgtgtctgacagttggagggctctttgcaagggaccagctgcttctccacatggagtctcctccatagggggctagcttgaactcagtcacatggtagtcctagagttccaaacacagcaagaggacaagcccagggctca

SEQ ID NO: 105272 - DNA, 754 bp, Homo sapiens
cagcagctgggcaaagctgctcctcacttcccagatggtgtggcagccagggagaggtgcttcttacttcccagactgtggggtggcgaggcagaggtgctaacagcactatgtgtaatagtcagtctggaagcaatccacacatcctttgagataatgggtaaattgtggaagtcacacaacgaaaaaccaatattgtaaatttcaaaattgagaagagtagactttaaatggtctcaacacacaaaaaaagcacgtgaggtgatagatatgtgaattagcttggtttaatcattctactgtgtatgtataaacatatcaaaacatcacatcataccccataaacatatacaattatttgtcaattaaaattaaattggccaggtgtggtggctcatgcctctaattcatcccagccccactttgggaggctgaggcaggaggatcacttgagcccatgagttcaagaccagcctgggcaacatagtgagaccatgtctctataaaaacatttaaaaaaattagccgagcgtggtggtgcacctgcagtctcagttattcgggacgcctgaggtgggaggatcccttgagcccaggatttcaaggctgcagtgagaaaatcatatcactacacttcagcctagatgacagaataagaccatgtataaaataaaataaaatatagaaaataaaatagaaaataaaacaaaatggtcatgagaatgaacaaatgataactacccagatctacttg

SEQ ID NO: 105273 - DNA, 165 bp, Homo sapiens
aaattccttggcactaagtctaatgttgtctagctgctattatctcacacataccacacaagttgctgctagaggaattaagtacctcctgtgtgactcccctgggagaggaatctcggaagcacattcctgatttcctccagactttgccttatgagcttacct

SEQ ID NO: 105274 - DNA, 323 bp, Homo sapiens
tggtagaaattgacaacccaatcctaaagttcacaggaaaatgcaagggatctacactagtcacagccatcttgaaaacaaacagaattaaagacgcacttttttcttctcaatttcaacacttactataaagcttcagtaatcaatacaatgtattaccggcataaaactaataataattgaatcaactaactgaattaaaggtccagatataaatctatacatctgtggtcaactgatttttaagaaggtggctaagaccattcagtaggtgaaaacagtctcttcaagaaatggtgctaagacaaatggatatccacatg

SEQ ID NO: 105275 - DNA, 480 bp, Homo sapiens
ccatgttttggccaggctggtctcaaactcctgacctcagggtgatccacccgcctctgcctcccaaagtgctgggatgacaggcgtgagccactgcgcctgggcaagtctgcgtgcattaaacacaaccccccagcatgggctctgacatgtctctgtaactgactgaagtgaagcacaaatgccagggcgtataaggccaccagaaaatacgaagtaagtgcccctgggtctcttggcacagcctagataattagctggccctgactctcagcattgtttaaaggcattattgagcattatctcttgtttcttttgctatggtagtgaaggggttgggctctggaggctgaaattttagtttaagattgtcacttgccttccactgtctttcttggagtgacactcccctaaactataccccaatcctccttttttttttttcttttttctttttttttgagacagagtctcactctc

SEQ ID NO: 105276 - DNA, 436 bp, Homo sapiens
tataataatcagtttactggtcaagtatacaagtaaaggattctagttcaaacaattacagtagttaaaggtaacagaattcttagtgtttccctaagacaagcattgtaacactgttatcctatttttaaaaatataaagcatgagccactgcgtcgggccaaccttctcttacctctgctctgaagttgtgatttcttcaaggagtcctgattccttatagaagaatagtatttttaagccaaaatctgcatgttagatgtgtaaaaattgtttttaaaatctcacagagggctgagtgcagtggctcacacttgtaatcttagtactttggaagaccaaggtgggaggatctcttgagcccaggagtctgaggctgtagtgagctatgattgtgtcactgcactctagcctgggtgacagagcgactgtcaaa

SEQ ID NO: 105277 - DNA, 625 bp, Homo sapiens
taaaagaaactagctcttactctgtcacccaggctggagtgccatgtgatcatagctcactgtagttttgaacttgggcttgaacaaccttcccacttcagtctctggagtagctggggctacaggcacgtaccaccacactcagctaacagcagttatctttgatgaggatgtagtataggttgagcatccataactggaaaatctgaaatctgaagtgctccaaaatccaaaatttgtctgagcaccaacaggtacaaaattctacaccagaccttatgtgatgggttgcagttaaaatgcacccccggccgggcgcggtggctcacacctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacctgggaagcggagcttgcagtgagccgagattgcaccactgcagtccgcagtccggcctgggcgacagagcgagactccgtctcaaaaaaaaaaaaaaaaaaaaaaaatgca

SEQ ID NO: 105278 - DNA, 379 bp, Homo sapiens
tacagtcagaggaaaaactgcgcagcaaccggaccacagggtgctggtcatccagcagctctggacggggtgaggggaccacggcaggaagcacaaagatagagaaagagaagagggagagacaatgaggggggcactgactagcacaagcattactgggaggtgggggcactcagatccaaggtgagctaagagagaagcagagatggtcagagccactgggcatctcttgcagggaagaacagtggtgtcatcatacaatgagtctgaaagaagggataagtgagatctcatcatacagcaatgccttccccttgctccttgagcataattccgtcagtgcttgtagacatcagtcacatcattgtgaacaggggtg

SEQ ID NO: 105279 - DNA, 293 bp, Homo sapiens
ttcagtgctaccaggatagagattatttgactgctaggaataatacaaaaatcttcaataggatcatctttatttttatgtgggtttagggaaatgttagacagctttctaaagttagactaagagacagtgaggcctagtatccaggaatccttggcttgcctcccatttctaccactaatgagcagtggtcttgtttttccttggctatatggggttggttgaagctccttagttctaccaaagttgttttggggataaagtgaaataatgaaaaacatatggaaattgtg

SEQ ID NO: 105280 - DNA, 681 bp, Homo sapiens
ctcagcataaattcacgagcactcaagaaagctaaagcaaagaatgcatttaacctagctaagaattcacaagaaactaatggaatattttacaaatgcattaagagatagacggagtaaagttttaaatgtactaattaaaacagaagccaaagcaatgttagatagaaataaaaatcttaaagtatgttgtatctcctgatcataattgaagatttcatttaattataattaatgacgatatagaaatttaagtgtttgacagaatgtgttaaacttagttaaggtagtttgttttaaatttatcctgtaacattcttaagtagagacaaacttaagaatcattagtagttattttgtcatatttccttggggaggggaaaaaaaaatcccagatgcataatgggaaatacagagtgacagggaactatggagcccagttcacataactaagaggattctggaataattctttaaaaagcaatttgtaatgcctagaggataacaaggtgttaagtaattgcaatgtgaactcattgccaaaaaataaaatcacaaaatgagtttaccttttttttttttttaacttagaaatagaccttggaattgactaaaaagtagacttagctagaacttctcacaatagatttggaatccagaaagcctatacatttgctaatg

SEQ ID NO: 105281 - DNA, 349 bp, Homo sapiens
tgactataatcgtgttgcttaatttccaactatccaaaggtaacatttttgatttccaaaataattattttttggtcttggagcatactctgtaaaatttcaaccctttgagatttatgaagtcattaaaaattattcagcatgtaagttaccatggtgagttccccatgtgtacttgaaagaaatgtgtaacctacagttgttggttgagtattctgtaaatatcaattaaatcaagtcacttgataatgtttttagatcttctttattcttaacattgtttctacatgttctgccagttattaggagaagagtgttaaattcttcacctgtgattgtgagtttttat

SEQ ID NO: 105282 - DNA, 795 bp, Homo sapiens
gctcaaagtgatttgcctgcctcagcctcctaaagtgctgggattacaggcatgagccaccgtgcccggccgagaagaagttttaaagggctttttattgtggaaaaattcaaatgtacataaaagtggaggagaagatataaggaacactcatgtggccatcactcatcctgtcctcctctcctgctccgcaccctccatagtttgagtcatatcatttcattcataaatattctcttaccattttacttgacaatgattttaggcttacagaaaagtggccagagtagtgcagggctcctatagttggcttcccctgttgccatcatctcgtctgatcgtagggcaggttagcattgctacaggcctcttacccggcctacagctcttaggcacatctgtccatttgactaatggccattttctggatagtccatgctcacttctggagccccctcccacccaggctcccacatggccggtgctgttgcctgaaggcccctcttcctcctgacgtgggaccccttcaggtagccccgcatcttttcagcgtgccccttcacattctgactgttcctcttctggaacctgcaagatgctctgggatccttgtatttttcctgcaccagcccgtttcatccctgagcttctgttattttattggaggatggtgctagaaacacaggtctggatgcaggcaggagacacacgcgtccacactagcatgtgtgtgtacacacatctacatgtgcttatcccccgcgttcatgttaaaaaccatgggatcataccggt

SEQ ID NO: 105283 - DNA, 478 bp, Homo sapiens
tgggatttcattgggatgatcatctaaatatacatgttgtatgctaatcagtttctgaataaacgtttaaaaactaaatactgccaccaaattttcatcatgttgtttgcacttggtgttttgaatcatgcataaactaagtggagaccaaagaatagaaaggttgctaaacaaataaagtctgtttagagaaaaggtgaggatgaagtgagtcattacagaacactgggtagcacaggcaggcaaaagtacctgtactatagaggttataatcatcatgagtgtgaagataatgcatgcatcctatctctgtgtagcttctacataatctgttctccattccagaaatcttggaatacagcttacagatttgatttagaattcgatgactccacaatactaatcacattttcaagggaacgaaaagatgttatagagatctcaggtgatacctcattaaacctgacatttgagggat

SEQ ID NO: 105284 - DNA, 328 bp, Homo sapiens
tataaggaacatagcatttgttttcgttgattttctcagttgcattgtgcacgtttcaggtgctcagtagctgtgtgtgactagtggctactgtactagacagtgcagaatagaacatttctatcgtaggaagttttgatggacagtgctgtggtagagtgtcttccagagaactctgaggaaaaaactatgataaactaagaatcctaaattgatgaagttatcctttacataggcagtgcaacaagatggctttttataggtgtgcaggaactcaaagtatatcactcgactacttgggaaaaaaaaaaagacttaactacaccca

SEQ ID NO: 105285 - DNA, 583 bp, Homo sapiens
cggccccagacgctacagccgccgaaatgttgatgcctaagaagaaccggattgccatttatgaactcctttttaaggagggagccatggtggccaagaaggatgtctacacgcctaagcagccagagttggcagacaagaatgtgcccaaccttcatgtcatgaaggccatgcagtctctcaagtcccgaggctacatgaaggaacagtttgcctggagacatttctactggtaccttaccaatgagggtatccaccatctccgtgattaccttcatctgcccccggagattgtgcctgccaccctatgccacagccgtccagagactggcaggcctcggcctaaaggtctggagggtgagtgacctgcaagactcacaagaggggaagccaacagggatacctacagatggaatgctgtgctccctggtgctgacaagaaagccgatgctgggagtgggtcagcaaccgaattccagtttagaggcagatttggtcgtggacatggtcagccatctcagtaaaattggagaggattattttgcattgaataaacttacagccaaaaaaaaaaaagtcaaac

SEQ ID NO: 105286 - DNA, 247 bp, Homo sapiens
catactctgcaagtgtttgcctcagcataattgtgtttatgtggaattgcactggcattgcaatgtgagaatgacagagttgacaggaccactaacatgtaccctgggaattgtttcccccatccccatagctggctgaagaaactttatttctgagttattatgtagggactgaaaggttttttttttgtttttgtttttgtttttttttacatatatacacagattgttttttacctacaatgag

SEQ ID NO: 105287 - DNA, 702 bp, Homo sapiens
aggctcagggggatgaagtactttgctcagggtaacacagccaggaaggagcagagcaaggccatgagctttggatttttctgtttccaatgtctcctctaccgtgctcaattagatgatgagaaacagttggtgtctgatgctggccaataagagaaaagaaagctcaagtgggctggggctgtcagggagggcttcatggagaggctgtcttgaaaatgacagaggtcaaaagaaaggtcactccaagacgcagctgccagaatggtccaacacagtgaggagttgtgtctggatgggccagtggaacgggggaagtgaaggttgatataagtggaggttgaggcagtttaggcgtgatgtacagtccagccacagcaggttcttgagcaggagggtagcatagtgagcatcaggttctaggaagaagcaccagttcagccatcagatggggcaggatgcctcccagctactcctctccccgagaaggaattgcccccggagcggccctcatttattccaggagaagccaggccctgctgcttcagtttccatcctcactgacgcagataatccaaagagtcacttcagctgcttggaacagcagggttgggtcttgtgctacctgattcttaatttggctgatgtctaccccatttcctccaggcttctctagaggtggcaggggtggggtggggagaa

SEQ ID NO: 105288 - DNA, 331 bp, Homo sapiens
gtaaattctgccttcacccagtatatctttccaatgtaggatgatttatttttcattacatttgttctaagattttgtagtgattactctagtgtttgtcatgtaaatgttagtttatcaaaatcaggctcagttctccagtaatatgtggttaaatttcagtgatgtacacacatatttgtcctctatagctctattatgtttttgcctttctggggtactttgttgcatatgtaacaactcagtgttccacattcaacaatatattcttataattattacttttccactggtagtcatttagttcagtttttatggtgttatttataaa

SEQ ID NO: 105289 - DNA, 525 bp, Homo sapiens
actgttatagcaaattatccaaactccctccccccatgatttatagccagttggtcagaagtacaagaggcctaaacttgtgattggcatccgaagagggggcagccttgtgggactgagcccttaacttgcaggatctgatgctaactccaagtagttagtgtcagcatttaattaaactgtataataggacagccggctggtgtccaaagagttggagaagtgtttgttggtatgaggaaaaacccacacacttggtgtcagaagtgggtagaaacagatcatagtaattggtaccatctgtcaactcatcaatagccaaggaaaaccacttgaaatcatctgccttgttttttaattgactattgatgttgataccatgtaggatttcatttgagaatcagagttccatcaaaaaaagtttaaaagccattctcctatattagtttcactccaatttcttctgtttaaacaactattaaatttcatctgtaattatttttcctctgaaatgcctttcatgtc

SEQ ID NO: 105290 - DNA, 654 bp, Homo sapiens
  misc_feature (12)..(12): n is a, c, g, or t
  misc_feature (15)..(16): n is a, c, g, or t
  misc_feature (32)..(32): n is a, c, g, or t
  misc_feature (37)..(37): n is a, c, g, or t
agtcttttcccnggnngttccgggcatgacgnaccgntattacatgcgaaaagaaccacaattaacactgaagatgtgaagctcttagccaggaggagtaattcactgctaaaatacatcacagacaaaagtgaagagattgctcagattaacctagaacgaaaagcacagaagaaaaagaagtcagaggatggaagcaaaaattcaaggcagccagcagaggctggagtggtggaaagtgagaattaaagtccctcgccgcttggaaagtgcagccttctacaggtagagccacctagaaatgcatatggctgcaaaggaaactttgaagggttaaatagagatttaaaaaaataaaataaaaaggctgggctagggtgctttttgtgctgaattctccacattgttaactgccaaagctagttttagagaatgagaaagtcttaagcaaaatactcccaggtctcactccagaacataaaaatggtgtgtgatcgaatggtatatattagaaattacatctgttgtaattaaaattgtgtgagcaattaaacatggttgactttttcaagcaaaaatcagttcatcttttgatgtaattttctaggctaaatggcaatctctgaaagatgaataaagctatatttatttagc

SEQ ID NO: 105291 - DNA, 1112 bp, Homo sapiens
caggtttcttcccttgacttaaaatgaccaacttttctctaattaaagcaatttctttaaggtattctcttcactttctcatcctcatccgttaaatggaaatgaggcttatcgctatggagcatcttttcattttaatattttctttctcttttctccagggtagtcttttagatcatttttttttttaagtaaggaggagattgcatatctttgaatgcttgctgcctgagccagattgctgagttttctttcctttgccatctgcttctctttaaaagcacatatgcaggaagcggcaggaataaggaaaagcagcctcctgactttcctcgcttggtggtttgagtggacctcccaggccagtgccgggcccctcataggagaggaagcccgggaggtggccaggcggcaggaaggcgcacccccccagcaatccgcgcgccgggacagaatgccctgcaggaacttcttctggaagaccttctcctcctgcaaataaaacctcacccatgaatgctcacgcaagtgtaatgacagacctgaataaaatgtattaagcagcagtgatctttcctctcctccttcccaagtcatttgaaaagtgtttgttatttaaattccaataatgcccaatactgacgtgtcttgagtaatttggaacccaaagtgaagatctttgataaagatttttttgtggttcgactggactgtgctgagtgcgggcactgggcttttcttctgatgttcattatggtgctgggaagctctgtctttgatttaaaataaaatagctaaaggctacacaattaagagttcagaataacatcttatttcagtttatgaattgatatgaattgtctaatttaaaaaatatttccctcacattaaaagcaaatttttaacatcaggctcgaagagcaaaatgattattcctcatgttttagctgaaattaattttaaaacatattaaacagaaaacctgctgacatgcctgtgaaactgatactcgaacttgctgttatgtaccagttttaattagtagcttaatgggttgcaattcttttcatggattatagcttcagatttgctttgggaggaatgaaggctac

SEQ ID NO: 105292 - DNA, 824 bp, Homo sapiens
tgcccggtttttcattgtttcccaaacacctagcatatgcccttactgagttggagctctgcagatagtttggaataagtgagtgaaaccactcagggccttggcaggcatcagtctgacctgtctccccactgacttgccatctaatttcttatctttacctgacataaatcataaccattaacaaggaagtaatgtttccacaagtcgcactccagtgggtctcattaacttattagtacacttgaaaagccactcagccattatggaaagcgccagagggattgggctgagcagaccctctccttggtcttcattttttaaggcgtgaaaagctcttatttgcagccttacccgtgaaatattttgatgtttttccccagaggctaaaggcagcagttcactatactgtgggttgtctttgcgaggaagttgcattggacaaagagatgcagttcagcaaacagaccattgcggccatttcggagctgactttccgacagtgtgaaaattttgccaaagaccttgaaatgtttgcaagcatatgcaggaagcggcaggaataaggaaaagcagcctcctgactttcctcgcttggtggtttgagtggacctcccaggccagtgccgggcccctcataggagaggaagcccgggaggtggccaggcggcaggaaggcgcacccccccagcaatccgcgcgccgggacagaatgccctgcaggaacttcttctggaagaccttctcctcctgcaaataaaacctcacccatgaatgctcacgcaagtgtaatgacagacctgaataaaatgtattaagcagca

SEQ ID NO: 105293 - DNA, 566 bp, Homo sapiens
caggtttcttcccttgacttaaaatgaccaacttttctctaattaaagcaatttctttaaggtattctcttcactttctcatcctcatccgttaaatggaaatgaggcttatcgctatggagcatcttttcattttaatattttctttctcttttctccagggtagtcttttagatcatttttttttttaagtaaggaggagattgcatatctttgaatgcttgctgcctgagccagattgctgagttttctttcctttgccatctgcttctctttaaaagcacatatgcaggaagcggcaggaataaggaaaagcagcctcctgactttcctcgcttggtggtttgagtggacctcccaggccagtgccgggcccctcataggagaggaagcccgggaggtggccaggcggcaggaaggcgcacccccccagcaatccgcgcgccgggacagaatgccctgcaggaacttcttctggaagaccttctcctcctgcaaataaaacctcacccatgaatgctcacgcaagtgtaatgacagacctgaataaaatgtattaagcagca

SEQ ID NO: 105294 - DNA, 1444 bp, Homo sapiens
ggaggcggtttccgcggcaacgcggctggaccctggcctgcgctggctggggaggaagcggttctaggggagcgtgcgggcgccggggtccggcgacgagaggccaccttctggccttgcgatgaatcctcggtttccccttctcagatggggttttcgtgagggtacaacgtcggcattagacattccaggtgacgcccgtacgcggtgggcggttcgggccggagctctggaacgctggccctggaggcgtcgacccctcgttactgatgcagggacgcggtgcggaccagtcaggcccagagctcgtccttagatgtgggttcgaatctctgccccgccaacttgtgatcgtatcgactcggcccagacgcaattttcttctctgcaaaatcgtcataagaataatcacttgtcagggtagctgcgggcatcccattcgttcctttcatcagcgccgggcatatggggcgtcagaggctgagaacgttgccgtgaagaggcttaaaagcaagacccggagtggcgaccttaaagaggacggactgaagaaacgcgggaatgagctccagacgcgggagtttcctctctacaaagttacactgcagcagctgtctaccctgccccttgtcttttgagaagttcaaaccttcagaaaagttgcaagaacacgaggctaaaggcagcagttcactatactgtgggttgtctttgcgaggaagttgcattggacaaagagatgcagttcagcaaacagaccattgcggccatttcggagctgactttccgacagtgtgaaaattttgccaaagaccttgaaatgtttgcaagacatgcgaaaagaaccacaattaacactgaagatgtgaagctcttagccaggaggagtaattcactgctaaaatacatcacagacaaaagtgaagagattgctcagattaacctagaacgaaaagcacagaagaaaaagaagtcagaggatggaagcaaaaattcaaggcagccagcagaggctggagtggtggaaagtgagaattaaagtccctcgccgcttggaaagtgcagccttctacaggtagagccacctagaaatgcatatggctgcaaaggaaactttgaagggttaaatagagatttaaaaaaataaaataaaaaggctgggctagggtgctttttgtgctgaattctccacattgttaactgccaaagctagttttagagaatgagaaagtcttaagcaaaatactcccaggtctcactccagaacataaaaatggtgtgtgatcgaatggtatatattagaaattacatctgttgtaattaaaattgtgtgagcaattaaacatggttgactttttcaagcaaaaatcagttcatcttttgatgtaattttctaggctaaatggcaatctctgaaagatgaataaagctatatttatttagc

SEQ ID NO: 105295 - DNA, 1238 bp, Homo sapiens
ggagctcctgataatgtgtactgcgttacatgatctgtaaatcgtgggctacgcatcctctacacccgactggaacacgctttgcacctatgcgcacacgtgtttcgcggagagtggtgctcagcgttgtgccaggcgctgaatcaggctctggggtgcagcagtgacctcggtggtcatgtccccgcgtcgcccggccacctccgcagagcaagctgagcagggggctggctggaggccgacggcggaatcccctcaacggagcgccgccagggggcgcgcgaggcagggcggagctgcgtactttgtccgcccgcgcggcccgtcgctcgcgccgcggcgggaaaatccgacctggccgcgcaccaccgccccttctcggccctcctgcgtttgcccagggtcggcccgcagtgatggaggaggaggcggagaccgaggagcagcagcgattctcttaccaacagaggctaaaggcagcagttcactatactgtgggttgtctttgcgaggaagttgcattggacaaagagatgcagttcagcaaacagaccattgcggccatttcggagctgactttccgacagtgtgaaaattttgccaaagaccttgaaatgtttgcaagacatgcgaaaagaaccacaattaacactgaagatgtgaagctcttagccaggaggagtaattcactgctaaaatacatcacagacaaaagtgaagagattgctcagattaacctagaacgaaaagcacagaagaaaaagaagtcagaggatggaagcaaaaattcaaggcagccagcagaggctggagtggtggaaagtgagaattaaagtccctcgccgcttggaaagtgcagccttctacaggtagagccacctagaaatgcatatggctgcaaaggaaactttgaagggttaaatagagatttaaaaaaataaaataaaaaggctgggctagggtgctttttgtgctgaattctccacattgttaactgccaaagctagttttagagaatgagaaagtcttaagcaaaatactcccaggtctcactccagaacataaaaatggtgtgtgatcgaatggtatatattagaaattacatctgttgtaattaaaattgtgtgagcaattaaacatggttgactttttcaagcaaaaatcagttcatcttttgatgtaattttctaggctaaatggcaatctctgaaagatgaataaagctatatttatttagc

SEQ ID NO: 105296 - DNA, 1286 bp, Homo sapiens
ggaggcggtttccgcggcaacgcggctggaccctggcctgcgctggctggggaggaagcggttctaggggagcgtgcgggcgccggggtccggcgacgagaggccaccttctggccttgcgatgaatcctcggtttccccttctcagatggggttttcgtgagggtacaacgtcggcattagacattccaggtgacgcccgtacgcggtgggcggttcgggccggagctctggaacgctggccctggaggcgtcgacccctcgttactgatgcagggacgcggtgcggaccagtcaggcccagagctcgtccttagatgtgggttcgaatctctgccccgccaacttgtgatcgtatcgactcggcccagacgcaattttcttctctgcaaaatcgtcataagaataatcacttgtcagggtagctgcgggcatcccattcgttcctttcatcagcgccgggcatatggggcgtcagaggctgagaacgttgccgtgaagaggcttaaaagcaagacccggagtggcgaccttaaagaggacggactgaagaaacgcgggaatgagctccagacgcgggagtttcctctctacaaagttacactgcagcagctgtctaccctgccccttgtcttttgagaagttcaaaccttcagaaaagttgcaagaacacgacatgcgaaaagaaccacaattaacactgaagatgtgaagctcttagccaggaggagtaattcactgctaaaatacatcacagacaaaagtgaagagattgctcagattaacctagaacgaaaagcacagaagaaaaagaagtcagaggatggaagcaaaaattcaaggcagccagcagaggctggagtggtggaaagtgagaattaaagtccctcgccgcttggaaagtgcagccttctacaggtagagccacctagaaatgcatatggctgcaaaggaaactttgaagggttaaatagagatttaaaaaaataaaataaaaaggctgggctagggtgctttttgtgctgaattctccacattgttaactgccaaagctagttttagagaatgagaaagtcttaagcaaaatactcccaggtctcactccagaacataaaaatggtgtgtgatcgaatggtatatattagaaattacatctgttgtaattaaaattgtgtgagcaattaaacatggttgactttttcaagcaaaaatcagttcatcttttgatgtaattttctaggctaaatggcaatctctgaaagatgaataaagctatatttatttagc

SEQ ID NO: 105297 - DNA, 1154 bp, Homo sapiens
tgcccggtttttcattgtttcccaaacacctagcatatgcccttactgagttggagctctgcagatagtttggaataagtgagtgaaaccactcagggccttggcaggcatcagtctgacctgtctccccactgacttgccatctaatttcttatctttacctgacataaatcataaccattaacaaggaagtaatgtttccacaagtcgcactccagtgggtctcattaacttattagtacacttgaaaagccactcagccattatggaaagcgccagagggattgggctgagcagaccctctccttggtcttcattttttaaggcgtgaaaagctcttatttgcagccttacccgtgaaatattttgatgtttttccccagaggctaaaggcagcagttcactatactgtgggttgtctttgcgaggaagttgcattggacaaagagatgcagttcagcaaacagaccattgcggccatttcggagctgactttccgacagtgtgaaaattttgccaaagaccttgaaatgtttgcaagacatgcgaaaagaaccacaattaacactgaagatgtgaagctcttagccaggaggagtaattcactgctaaaatacatcacagacaaaagtgaagagattgctcagattaacctagaacgaaaagcacagaagaaaaagaagtcagaggatggaagcaaaaattcaaggcagccagcagaggctggagtggtggaaagtgagaattaaagtccctcgccgcttggaaagtgcagccttctacaggtagagccacctagaaatgcatatggctgcaaaggaaactttgaagggttaaatagagatttaaaaaaataaaataaaaaggctgggctagggtgctttttgtgctgaattctccacattgttaactgccaaagctagttttagagaatgagaaagtcttaagcaaaatactcccaggtctcactccagaacataaaaatggtgtgtgatcgaatggtatatattagaaattacatctgttgtaattaaaattgtgtgagcaattaaacatggttgactttttcaagcaaaaatcagttcatcttttgatgtaattttctaggctaaatggcaatctctgaaagatgaataaagctatatttatttagc

SEQ ID NO: 105298 - DNA, 1398 bp, Homo sapiens
ggaggcggtttccgcggcaacgcggctggaccctggcctgcgctggctggggaggaagcggttctaggggagcgtgcgggcgccggggtccggcgacgagaggccaccttctggccttgcgatgaatcctcggtttccccttctcagatggggttttcgtgagggtacaacgtcggcattagacattccaggtgacgcccgtacgcggtgggcggttcgggccggagctctggaacgctggccctggaggcgtcgacccctcgttactgatgcagggacgcggtgcggaccagtcaggcccagagctcgtccttagatgtgggttcgaatctctgccccgccaacttgtgatcgtatcgactcggcccagacgcaattttcttctctgcaaaatcgtcataagaataatcacttgtcagggtagctgcgggcatcccattcgttcctttcatcagcgccgggcatatggggcgtcagaggctgagaacgttgccgtgaagaggcttaaaagcaagacccggagtggcgaccttaaagaggacggactgaagaaacgcgggaatgagctccagacgcgggagtttcctctctacaaagttacactgcagcagctgtctaccctgccccttgtcttttgagaagttcaaaccttcagaaaagttgcaagaacacgaggctaaaggcagcagttcactatactgtgggttgtctttgcgaggaagttgcattggacaaagagatgcagttcagcaaacagaccattgcggccatttcggagctgactttccgacagtgtgaaaattttgccaaagaccttgaaatgtttgcaagacatgcgaaaagaaccacaattaacactgaagatgtgaagctcttagccaggaggagtaattcactgctaaaatacatcacagacaaaagtgaagagattgctcagattaacctagaacgaaaagcacagaagaaaaagaagtcagaggatggaagcaaaaattcaaggcagccagcagaggctggagtggtggaaagtgagaattaaagtccctcgccgcttggaaagtgcagccttctacaggtagagccacctagaaatgcatatggctgcaaaggaaactttgaagggttaaatagagatttaaaaaaataaaataaaaaggctgggctagggtgctttttgtgctgaattctccacattgttaactgccaaagctagttttagagaatgagaaagtcttaagcaaaatactcccaggtctcactccagaacataaaaatggtgtgtgatcgaatggtatatattagaaattacatctgttgtaattaaaattgtgtgagcaattaaacatggttgactttttcaagctaacacaaacaaaccaccacaaacaacaacacaca

SEQ ID NO: 105299 - DNA, 1238 bp, Homo sapiens
gcgttccaaaataagagcaaattcgctctaaacacaggaaaagacctgaagctttaattaaggggttacatccaaccccagagcgcttttgtgggcactgattgctccagcttctgcgtcactgcgcgagggaagagggaagaggatccaggcgttagacatgtatagacacaaaaacagctggagattgggcttaaaatacccaccaagctccaaagaagagacccaagtccccaaaacattgatttcagggctgccaggaaggaagagcagcagcagggtgggagagaagctccagtcagcccacaagatgccattgtcccccggcctcctgctgctgctgctctccggggccacggccaccgctgccctgcccctggagggtggccccaccggccgagacagcgagcatatgcaggaagcggcaggaataaggaaaagcagcctcctgactttcctcgcttggtggtttgagtggacctcccaggccagtgccgggcccctcataggagaggaagcccgggaggtggccaggcggcaggaaggcgcacccccccagcaatccgcgcgccgggacagaatgccctgcaggaacttcttctggaagaccttctcctcctgcaaataaaacctcacccatgaatgctcacgcaagtgtaatgacagacctgaataaaatgtattaagcagcagtgatctttcctctcctccttcccaagtcatttgaaaagtgtttgttatttaaattccaataatgcccaatactgacgtgtcttgagtaatttggaacccaaagtgaagatctttgataaagatttttttgtggttcgactggactgtgctgagtgcgggcactgggcttttcttctgatgttcattatggtgctgggaagctctgtctttgatttaaaataaaatagctaaaggctacacaattaagagttcagaataacatcttatttcagtttatgaattgatatgaattgtctaatttaaaaaatatttccctcacattaaaagcaaatttttaacatcaggctcgaagagcaaaatgattattcctcatgttttagctgaaattaattttaaaacatattaaacagaaaacctgctgacatgcctgtgaaactgatactcgaacttgctgttatgtaccagttttaattagtagcttaatgggttgcaattcttttcatggattatagcttcagatttgctttgggaggaatgaaggctac

SEQ ID NO: 105300 - DNA, 647 bp, Homo sapiens
  misc_feature (98)..(98): n is a, c, g, or t
tgaaaatggttttgccaaaaaacatggcgaaaaaagaacccaccaatttaaccacttaaaaatgtgaaagctctttagccaaggaggaagtaattcanctgctaaaatacatcacagacaaaagtgaagagattgctcagattaacctagaacgaaaagcacagaagaaaaagaagtcagaggatggaagcaaaaattcaaggcagccagcagaggctggagtggtggaaagtgagaattaaagtccctcgccgcttggaaagtgcagccttctacaggtagagccacctagaaatgcatatggctgcaaaggaaactttgaagggttaaatagagatttaaaaaaataaaataaaaaggctgggctagggtgctttttgtgctgaattctccacattgttaactgccaaagctagttttagagaatgagaaagtcttaagcaaaatactcccaggtctcactccagaacataaaaatggtgtgtgatcgaatggtatatattagaaattacatctgttgtaattaaaattgtgtgagcaattaaacatggttgactttttcaagcaaaaatcagttcatcttttgatgtaattttctaggctaaatggcaatctctgaaagatgaataaagctatatttatttagc

SEQ ID NO: 105301 - DNA, 1640 bp, Homo sapiens
  misc_feature (1624)..(1624): n is a, c, g, or t
  misc_feature (1636)..(1636): n is a, c, g, or t
ggaggcggtttccgcggcaacgcggctggaccctggcctgcgctggctggggaggaagcggttctaggggagcgtgcgggcgccggggtccggcgacgagaggccaccttctggccttgcgatgaatcctcggtttccccttctcagatggggttttcgtgagggtacaacgtcggcattagacattccaggtgacgcccgtacgcggtgggcggttcgggccggagctctggaacgctggccctggaggcgtcgacccctcgttactgatgcagggacgcggtgcggaccagtcaggcccagagctcgtccttagatgtgggttcgaatctctgccccgccaacttgtgatcgtatcgactcggcccagacgcaattttcttctctgcaaaatcgtcataagaataatcacttgtcagggtagctgcgggcatcccattcgttcctttcatcagcgccgggcatatggggcgtcagaggctgagaacgttgccgtgaagaggcttaaaagcaagacccggagtggcgaccttaaagaggacggactgaagaaacgcgggaatgagctccagacgcgggagtttcctctctacaaagttacactgcagcagctgtctaccctgccccttgtcttttgagaagttcaaaccttcagaaaagttgcaagaacacgaggctaaaggcagcagttcactatactgtgggttgtctttgcgaggaagttgcattggacaaagagatgcagttcagcaaacagaccattgcggccatttcggagctgactttccgacagtgtgaaaattttgccaaagaccttgaaatgtttgcaagacatgcgaaaagaaccacaattaacactgaagatgtgaagctcttagccaggaggagtaattcactgctaaaatacatcacagacaaaagtgaagagattgctcagattaacctagaacgaaaagcacagaagaaaaagaagtcagaggatggaagcaaaaattcaaggcagccagcagaggctggagtggtggaaagtgagaattaaagtccctcgccgcttggaaagtgcagccttctacagcatatgcaggaagcggcaggaataaggaaaagcagcctcctgactttcctcgcttggtggtttgagtggacctcccaggccagtgccgggcccctcataggagaggaagcccgggaggtggccaggcggcaggaaggcgcacccccccagcaatccgcgcgccgggacagaatgccctgcaggaacttcttctggaagaccttctcctcctgcaaataaaacctcacccatgaatgctcacgcaagtgtaatgacagacctgaataaaatgtattaagcagcagtgatctttcctctcctccttcccaagtcatttgaaaagtgtttgttatttaaattccaataatgcccaatactgacgtgtcttgagtaatttggaacccaaagtgaagatctttgataaagatttttttgtggttcgactggactgtgctgagtgcgggcactgggcttttcttctgatgttcattatggtgctgggaagctctgtctttgatttaaaataaaatagctaaaggctacacaattaagagttcaaaaaaaaaaaancggcctgttggnctca

SEQ ID NO: 105302 - DNA, 1114 bp, Homo sapiens
ggaggcggtttccgcggcaacgcggctggaccctggcctgcgctggctggggaggaagcggttctaggggagcgtgcgggcgccggggtccggcgacgagaggccaccttctggccttgcgatgaatcctcggtttccccttctcagatggggttttcgtgagggtacaacgtcggcattagacattccaggtgacgcccgtacgcggtgggcggttcgggccggagctctggaacgctggccctggaggcgtcgacccctcgttactgatgcagggacgcggtgcggaccagtcaggcccagagctcgtccttagatgtgggttcgaatctctgccccgccaacttgtgatcgtatcgactcggcccagacgcaattttcttctctgcaaaatcgtcataagaataatcacttgtcagggtagctgcgggcatcccattcgttcctttcatcagcgccgggcatatggggcgtcagaggctgagaacgttgccgtgaagaggcttaaaagcaagacccggagtggcgaccttaaagaggacggactgaagaaacgcgggaatgagctccagacgcgggagtttcctctctacaaagttacactgcagcagctgtctaccctgccccttgtcttttgagaagttcaaaccttcagaaaagttgcaagaacacgaggctaaaggcagcagttcactatactgtgggttgtctttgcgaggaagttgcattggacaaagagatgcagttcagcaaacagaccattgcggccatttcggagctgactttccgacagtgtgaaaattttgccaaagaccttgaaatgtttgcaagcatatgcaggaagcggcaggaataaggaaaagcagcctcctgactttcctcgcttggtggtttgagtggacctcccaggccagtgccgggcccctcataggagaggaagcccgggaggtggccaggcggcaggaaggcgcacccccccagcaatccgcgcgccgggacagaatgccctgcaggaacttcttctggaagaccttctcctcctgcaaataaaacctcacccatgaatgctcacgcaagtgtaatgacagacctgaataaaatgtattaagcagca

SEQ ID NO: 105303 - DNA, 940 bp, Homo sapiens
ggaggcggtttccgcggcaacgcggctggaccctggcctgcgctggctggggaggaagcggttctaggggagcgtgcgggcgccggggtccggcgacgagaggccaccttctggccttgcgatgaatcctcggtttccccttctcagatggggttttcgtgagggtacaacgtcggcattagacattccaggtgacgcccgtacgcggtgggcggttcgggccggagctctggaacgctggccctggaggcgtcgacccctcgttactgatgcagggacgcggtgcggaccagtcaggcccagagctcgtccttagatgtgggttcgaatctctgccccgccaacttgtgatcgtatcgactcggcccagacgcaattttcttctctgcaaaatcgtcataagaataatcacttgtcagggtagctgcgggcatcccattcgttcctttcatcagcgccgggcatatggggcgtcagaggctgagaacgttgccgtgaagaggcttaaaagcaagacccggagtggcgaccttaaagaggacggactgaagaaacgcgggaatgagctccagacgcgggagtttcctctctacaaagttacactgcagcagctgtctaccctgccccttgtcttttgagaagttcaaaccttcagaaaagttgcaagaacacgaggctaaaggcagcagttcactatactgtgggttgtctttgcgaggaagttgcattggacaaagagatgcagttcagcaaacagaccattgcggccatttcggagctgactttccgacagtgtgaaaattttgccaaagaccttgaaatgtttgcaagcaattaaacatggttgactttttcaagcaaaaatcagttcatcttttgatgtaattttctaggctaaatggcaatctctgaaagatgaataaagctatatttatttagc

SEQ ID NO: 105304 - DNA, 885 bp, Homo sapiens
acagaaggcacacaccccccgttccgccccccccgaccccttcatggtgacgcgagcatatgcaggaagcggcaggaataaggaaaagcagcctcctgactttcctcgcttggtggtttgagtggacctcccaggccagtgccgggcccctcataggagaggaagcccgggaggtggccaggcggcaggaaggcgcacccccccagcaatccgcgcgccgggacagaatgccctgcaggaacttcttctggaagaccttctcctcctgcaaataaaacctcacccatgaatgctcacgcaagtgtaatgacagacctgaataaaatgtattaagcagcagtgatctttcctctcctccttcccaagtcatttgaaaagtgtttgttatttaaattccaataatgcccaatactgacgtgtcttgagtaatttggaacccaaagtgaagatctttgataaagatttttttgtggttcgactggactgtgctgagtgcgggcactgggcttttcttctgatgttcattatggtgctgggaagctctgtctttgatttaaaataaaatagctaaaggctacacaattaagagttcagaataacatcttatttcagtttatgaattgatatgaattgtctaatttaaaaaatatttccctcacattaaaagcaaatttttaacatcaggctcgaagagcaaaatgattattcctcatgttttagctgaaattaattttaaaacatattaaacagaaaacctgctgacatgcctgtgaaactgatactcgaacttgctgttatgtaccagttttaattagtagcttaatgggttgcaattcttttcatggattatagcttcagatttgctttgggaggaatgaaggctac

SEQ ID NO: 105305 - DNA, 692 bp, Homo sapiens
gcgttccaaaataagagcaaattcgctctaaacacaggaaaagacctgaagctttaattaaggggttacatccaaccccagagcgcttttgtgggcactgattgctccagcttctgcgtcactgcgcgagggaagagggaagaggatccaggcgttagacatgtatagacacaaaaacagctggagattgggcttaaaatacccaccaagctccaaagaagagacccaagtccccaaaacattgatttcagggctgccaggaaggaagagcagcagcagggtgggagagaagctccagtcagcccacaagatgccattgtcccccggcctcctgctgctgctgctctccggggccacggccaccgctgccctgcccctggagggtggccccaccggccgagacagcgagcatatgcaggaagcggcaggaataaggaaaagcagcctcctgactttcctcgcttggtggtttgagtggacctcccaggccagtgccgggcccctcataggagaggaagcccgggaggtggccaggcggcaggaaggcgcacccccccagcaatccgcgcgccgggacagaatgccctgcaggaacttcttctggaagaccttctcctcctgcaaataaaacctcacccatgaatgctcacgcaagtgtaatgacagacctgaataaaatgtattaagcagca

SEQ ID NO: 105306 - DNA, 578 bp, Homo sapiens
ggagctcctgataatgtgtactgcgttacatgatctgtaaatcgtgggctacgcatcctctacacccgactggaacacgctttgcacctatgcgcacacgtgtttcgcggagagtggtgctcagcgttgtgccaggcgctgaatcaggctctggggtgcagcagtgacctcggtggtcatgtccccgcgtcgcccggccacctccgcagagcaagctgagcagggggctggctggaggccgacggcggaatcccctcaacggagcgccgccagggggcgcgcgaggcagggcggagctgcgtactttgtccgcccgcgcggcccgtcgctcgcgccgcggcgggaaaatccgacctggccgcgcaccaccgccccttctcggccctcctgcgtttgcccagggtcggcccgcagtgatggaggaggaggcggagaccgaggagcagcagcgattctcttaccaacaggtacaggaaaacgggggtcgggctgggctggggcaggacggcgtcgagtttctggacagaaaagtacccggcagcccccggcggcttctcatcggcaccccgcccccgggc

SEQ ID NO: 105307 - DNA, 1764 bp, Homo sapiens
ggagctcctgataatgtgtactgcgttacatgatctgtaaatcgtgggctacgcatcctctacacccgactggaacacgctttgcacctatgcgcacacgtgtttcgcggagagtggtgctcagcgttgtgccaggcgctgaatcaggctctggggtgcagcagtgacctcggtggtcatgtccccgcgtcgcccggccacctccgcagagcaagctgagcagggggctggctggaggccgacggcggaatcccctcaacggagcgccgccagggggcgcgcgaggcagggcggagctgcgtactttgtccgcccgcgcggcccgtcgctcgcgccgcggcgggaaaatccgacctggccgcgcaccaccgccccttctcggccctcctgcgtttgcccagggtcggcccgcagtgatggaggaggaggcggagaccgaggagcagcagcgattctcttaccaacagatggggttttcgtgagggtacaacgtcggcattagacattccaggtgacgcccgtacgcggtgggcggttcgggccggagctctggaacgctggccctggaggcgtcgacccctcgttactgatgcagggacgcggtgcggaccagtcaggcccagagctcgtccttagatgtgggttcgaatctctgccccgccaacttgtgatcgtatcgactcggcccagacgcaattttcttctctgcaaaatcgtcataagaataatcacttgtcagggtagctgcgggcatcccattcgttcctttcatcagcgccgggcatatggggcgtcagaggctgagaacgttgccgtgaagaggcttaaaagcaagacccggagtggcgaccttaaagaggacggactgaagaaacgcgggaatgagctccagacgcgggagtttcctctctacaaagttacactgcagcagctgtctaccctgccccttgtcttttgagaagttcaaaccttcagaaaagttgcaagaacacgaggctaaaggcagcagttcactatactgtgggttgtctttgcgaggaagttgcattggacaaagagatgcagttcagcaaacagaccattgcggccatttcggagctgactttccgacagtgtgaaaattttgccaaagaccttgaaatgtttgcaagacatgcgaaaagaaccacaattaacactgaagatgtgaagctcttagccaggaggagtaattcactgctaaaatacatcacagacaaaagtgaagagattgctcagattaacctagaacgaaaagcacagaagaaaaagaagtcagaggatggaagcaaaaattcaaggcagccagcagaggctggagtggtggaaagtgagaattaaagtccctcgccgcttggaaagtgcagccttctacaggtagagccacctagaaatgcatatggctgcaaaggaaactttgaagggttaaatagagatttaaaaaaataaaataaaaaggctgggctagggtgctttttgtgctgaattctccacattgttaactgccaaagctagttttagagaatgagaaagtcttaagcaaaatactcccaggtctcactccagaacataaaaatggtgtgtgatcgaatggtatatattagaaattacatctgttgtaattaaaattgtgtgagcaattaaacatggttgactttttcaagcaaaaatcagttcatcttttgatgtaattttctaggctaaatggcaatctctgaaagatgaataaagctatatttatttagc

SEQ ID NO: 105308 - DNA, 1904 bp, Homo sapiens
ggaggcggtttccgcggcaacgcggctggaccctggcctgcgctggctggggaggaagcggttctaggggagcgtgcgggcgccggggtccggcgacgagaggccaccttctggccttgcgatgaatcctcggtttccccttctcagatggggttttcgtgagggtacaacgtcggcattagacattccaggtgacgcccgtacgcggtgggcggttcgggccggagctctggaacgctggccctggaggcgtcgacccctcgttactgatgcagggacgcggtgcggaccagtcaggcccagagctcgtccttagatgtgggttcgaatctctgccccgccaacttgtgatcgtatcgactcggcccagacgcaattttcttctctgcaaaatcgtcataagaataatcacttgtcagggtagctgcgggcatcccattcgttcctttcatcagcgccgggcatatggggcgtcagaggctgagaacgttgccgtgaagaggcttaaaagcaagacccggagtggcgaccttaaagaggacggactgaagaaacgcgggaatgagctccagacgcgggagtttcctctctacaaagttacactgcagcagctgtctaccctgccccttgtcttttgagaagttcaaaccttcagaaaagttgcaagaacacgaggctaaaggcagcagttcactatactgtgggttgtctttgcgaggaagttgcattggacaaagagatgcagttcagcaaacagaccattgcggccatttcggagctgactttccgacagtgtgaaaattttgccaaagaccttgaaatgtttgcaagacatgcgaaaagaaccacaattaacactgaagatgtgaagctcttagccaggaggagtaattcactgctaaaatacatcacagacaaaagtgaagagattgctcagattaacctagaacgaaaagcacagaagaaaaagaagtcagaggatggaagcaaaaattcaaggcagccagcagaggctggagtggtggaaagtgagaattaaagtccctcgccgcttggaaagtgcagccttctacagcatatgcaggaagcggcaggaataaggaaaagcagcctcctgactttcctcgcttggtggtttgagtggacctcccaggccagtgccgggcccctcataggagaggaagcccgggaggtggccaggcggcaggaaggcgcacccccccagcaatccgcgcgccgggacagaatgccctgcaggaacttcttctggaagaccttctcctcctgcaaataaaacctcacccatgaatgctcacgcaagtgtaatgacagacctgaataaaatgtattaagcagcagtgatctttcctctcctccttcccaagtcatttgaaaagtgtttgttatttaaattccaataatgcccaatactgacgtgtcttgagtaatttggaacccaaagtgaagatctttgataaagatttttttgtggttcgactggactgtgctgagtgcgggcactgggcttttcttctgatgttcattatggtgctgggaagctctgtctttgatttaaaataaaatagctaaaggctacacaattaagagttcagaataacatcttatttcagtttatgaattgatatgaattgtctaatttaaaaaatatttccctcacattaaaagcaaatttttaacatcaggctcgaagagcaaaatgattattcctcatgttttagctgaaattaattttaaaacatattaaacagaaaacctgctgacatgcctgtgaaactgatactcgaacttgctgttatgtaccagttttaattagtagcttaatgggttgcaattcttttcatggattatagcttcagatttgctttgggaggaatgaaggctac

SEQ ID NO: 105309 - DNA, 1358 bp, Homo sapiens
ggaggcggtttccgcggcaacgcggctggaccctggcctgcgctggctggggaggaagcggttctaggggagcgtgcgggcgccggggtccggcgacgagaggccaccttctggccttgcgatgaatcctcggtttccccttctcagatggggttttcgtgagggtacaacgtcggcattagacattccaggtgacgcccgtacgcggtgggcggttcgggccggagctctggaacgctggccctggaggcgtcgacccctcgttactgatgcagggacgcggtgcggaccagtcaggcccagagctcgtccttagatgtgggttcgaatctctgccccgccaacttgtgatcgtatcgactcggcccagacgcaattttcttctctgcaaaatcgtcataagaataatcacttgtcagggtagctgcgggcatcccattcgttcctttcatcagcgccgggcatatggggcgtcagaggctgagaacgttgccgtgaagaggcttaaaagcaagacccggagtggcgaccttaaagaggacggactgaagaaacgcgggaatgagctccagacgcgggagtttcctctctacaaagttacactgcagcagctgtctaccctgccccttgtcttttgagaagttcaaaccttcagaaaagttgcaagaacacgaggctaaaggcagcagttcactatactgtgggttgtctttgcgaggaagttgcattggacaaagagatgcagttcagcaaacagaccattgcggccatttcggagctgactttccgacagtgtgaaaattttgccaaagaccttgaaatgtttgcaagacatgcgaaaagaaccacaattaacactgaagatgtgaagctcttagccaggaggagtaattcactgctaaaatacatcacagacaaaagtgaagagattgctcagattaacctagaacgaaaagcacagaagaaaaagaagtcagaggatggaagcaaaaattcaaggcagccagcagaggctggagtggtggaaagtgagaattaaagtccctcgccgcttggaaagtgcagccttctacagcatatgcaggaagcggcaggaataaggaaaagcagcctcctgactttcctcgcttggtggtttgagtggacctcccaggccagtgccgggcccctcataggagaggaagcccgggaggtggccaggcggcaggaaggcgcacccccccagcaatccgcgcgccgggacagaatgccctgcaggaacttcttctggaagaccttctcctcctgcaaataaaacctcacccatgaatgctcacgcaagtgtaatgacagacctgaataaaatgtattaagcagca

SEQ ID NO: 105310 - DNA, 1386 bp, Homo sapiens
  misc_feature (1370)..(1370): n is a, c, g, or t
  misc_feature (1382)..(1382): n is a, c, g, or t
ggaggcggtttccgcggcaacgcggctggaccctggcctgcgctggctggggaggaagcggttctaggggagcgtgcgggcgccggggtccggcgacgagaggccaccttctggccttgcgatgaatcctcggtttccccttctcagatggggttttcgtgagggtacaacgtcggcattagacattccaggtgacgcccgtacgcggtgggcggttcgggccggagctctggaacgctggccctggaggcgtcgacccctcgttactgatgcagggacgcggtgcggaccagtcaggcccagagctcgtccttagatgtgggttcgaatctctgccccgccaacttgtgatcgtatcgactcggcccagacgcaattttcttctctgcaaaatcgtcataagaataatcacttgtcagggtagctgcgggcatcccattcgttcctttcatcagcgccgggcatatggggcgtcagaggctgagaacgttgccgtgaagaggcttaaaagcaagacccggagtggcgaccttaaagaggacggactgaagaaacgcgggaatgagctccagacgcgggagtttcctctctacaaagttacactgcagcagctgtctaccctgccccttgtcttttgagaagttcaaaccttcagaaaagttgcaagaacacgaggctaaaggcagcagttcactatactgtgggttgtctttgcgaggaagttgcattggacaaagagatgcagttcagcaaacagaccattgcggccatttcggagctgactttccgacagtgtgaaaattttgccaaagaccttgaaatgtttgcaagacatgcgaaaagaaccacaattaacactgaagatgtgaagctcttagccaggaggagtaattcactgctaaaatacatcacagacaaaagtgaagagattgctcagattaacctagaacgaaaagcacagaagaaaaagaagtcagaggatggaagcaaaaattcaaggcagccagcagaggctggagtggtggaaagtgagaattaaagtccctcgccgcttggaaagtgcagccttctacagcatatgcaggaagcggcaggaataaggaaaagcagcctcctgactttcctcgcttggtggtttgagtggacctcccaggccagtgccgggcccctcataggagaggaagcccgggaggtggccaggcggcaggaaggcgcacccccccagcaatccgcgcgccgggacagaatgccctgcaggaacttcttctggaagaccttctcctcctgcaaataaaacctcacccatgaatgctcacgcaagtgtaatgacagacctgaataaaatgtattaagcagcaaaaaaaaaaaancggcctgttggnctca

SEQ ID NO: 105311 - DNA, 1181 bp, Homo sapiens
ggaggcggtttccgcggcaacgcggctggaccctggcctgcgctggctggggaggaagcggttctaggggagcgtgcgggcgccggggtccggcgacgagaggccaccttctggccttgcgatgaatcctcggtttccccttctcagatggggttttcgtgagggtacaacgtcggcattagacattccaggtgacgcccgtacgcggtgggcggttcgggccggagctctggaacgctggccctggaggcgtcgacccctcgttactgatgcagggacgcggtgcggaccagtcaggcccagagctcgtccttagatgtgggttcgaatctctgccccgccaacttgtgatcgtatcgactcggcccagacgcaattttcttctctgcaaaatcgtcataagaataatcacttgtcagggtagctgcgggcatcccattcgttcctttcatcagcgccgggcatatggggcgtcagaggctgagaacgttgccgtgaagaggcttaaaagcaagacccggagtggcgaccttaaagaggacggactgaagaaacgcgggaatgagctccagacgcgggagtttcctctctacaaagttacactgcagcagctgtctaccctgccccttgtcttttgagaagttcaaaccttcagaaaagttgcaagaacacgaggctaaaggcagcagttcactatactgtgggttgtctttgcgaggaagttgcattggacaaagagatgcagttcagcaaacagaccattgcggccatttcggagctgactttccgacagtgtgaaaattttgccaaagaccttgaaatgtttgcaagacatgcgaaaagaaccacaattaacactgaagatgtgaagctcttagccaggaggagtaattcactgcatatgcaggaagcggcaggaataaggaaaagcagcctcctgactttcctcgcttggtggtttgagtggacctcccaggccagtgccgggcccctcataggagaggaagcccgggaggtggccaggcggcaggaaggcgcacccccccagcaatccgcgcgccgggacagaatgccctgcaggaacttcttctggaagaccttctcctcctgcaaataaaacctcacccatgaatgctcacgcaagtgtaatgacagacctgaataaaatgtattaagcagca

SEQ ID NO: 105312 - DNA, 1023 bp, Homo sapiens
ggaggcggtttccgcggcaacgcggctggaccctggcctgcgctggctggggaggaagcggttctaggggagcgtgcgggcgccggggtccggcgacgagaggccaccttctggccttgcgatgaatcctcggtttccccttctcagatggggttttcgtgagggtacaacgtcggcattagacattccaggtgacgcccgtacgcggtgggcggttcgggccggagctctggaacgctggccctggaggcgtcgacccctcgttactgatgcagggacgcggtgcggaccagtcaggcccagagctcgtccttagatgtgggttcgaatctctgccccgccaacttgtgatcgtatcgactcggcccagacgcaattttcttctctgcaaaatcgtcataagaataatcacttgtcagggtagctgcgggcatcccattcgttcctttcatcagcgccgggcatatggggcgtcagaggctgagaacgttgccgtgaagaggcttaaaagcaagacccggagtggcgaccttaaagaggacggactgaagaaacgcgggaatgagctccagacgcgggagtttcctctctacaaagttacactgcagcagctgtctaccctgccccttgtcttttgagaagttcaaaccttcagaaaagttgcaagaacacgacatgcgaaaagaaccacaattaacactgaagatgtgaagctcttagccaggaggagtaattcactgcatatgcaggaagcggcaggaataaggaaaagcagcctcctgactttcctcgcttggtggtttgagtggacctcccaggccagtgccgggcccctcataggagaggaagcccgggaggtggccaggcggcaggaaggcgcacccccccagcaatccgcgcgccgggacagaatgccctgcaggaacttcttctggaagaccttctcctcctgcaaataaaacctcacccatgaatgctcacgcaagtgtaatgacagacctgaataaaatgtattaagcagca

SEQ ID NO: 105313 - DNA, 397 bp, Homo sapiens
gtgtttaatttttttgtacctgtaacctccattcccgaacaacctttaccgtcttatctactcctctctggcaaatgcctaccctaagaatccgccacagcatcactatcacgccgaattaactgttgcctcctcttaagttcccggggacaatacttctgtgaattccagaccagggccgctatggatcgcgactcccagcgggcagagacctactccctcctacaaccactacctgctacatgacacctttggaaaaccttggctgactaaatttaaaaaccacatcacccaaggcacacatctcctacatcatacacgtcaatctccacagcctacgtaggaaaatcctcaagggaaccccggcacgaattcaaggccagacccacaagccagg

SEQ ID NO: 105314 - DNA, 839 bp, Homo sapiens
gatcactttgggtagctatatcaacagtattcttccagtgtataaacacaatattttttatttattcatttgtattttatattttttatccatgttttgtcgttttcagagtagagatcttttacctttttagttaagtttgttgctaggtgtattagttgggcttccctagagagatcatgagatcccacaataggttgtctgcaagtttgaggagcaaggagaggtggtccatgtcccaaagctgaagaacttggagtctgatgtttgagggctgcaagtgtccagcacaggagaaagatgtagtctgggagcttaggccagtctctctttttcacgtttttctgcctgctttatattcactgtcagctcattagatggtgctcacccaattaagagtggatctccctttcccagcccactgactcaaatgttaatctcctttggcaacaccctcacagacacacccaggatcaatgctttctatcctccaatccaatcaatttgacaccctgtattagccatcacattaagtattttcatttttgtagcttttgcatatgcagaagaagaattggatgaaattcagccttgattatgatgaaaactctcaacaagttaggaatagaaggtatgtgccttaactcaataaaggccatttatgaaaaagcaatgctaactttatactgaataaggaaaagttgaaagctttctctctgagatctggaacaagacaaatcgtccaaactttcagccctcttattcaacatagtactggaagtcctagccaaggaaattaggcaagaggaagaaataaaagtcatactaattgaaaggat

SEQ ID NO: 105315 - DNA, 246 bp, Homo sapiens
ggagcctaagaggggttgtgaagcagaacttctgttggccctgttcagcttgggggagactctgtgtgggatgtcttgagtgttccaggacgtgcctctcaccttgtctgccattgtattcacagcttagtccccagtggtaggcaaagctcatgctcttaacatttacattatgttgtctttatgaggagctatatccacatgaagtattgtttcaagtgtgtgatatcacacatagactcaaca

SEQ ID NO: 105316 - DNA, 165 bp, Homo sapiens
ggagccacagggaaagggtaatctcacagccttgcggagatggactctggtcacaaagcttcagggactacaagtgctcagtcctttggactgagttgaccacacccagctactcactacttgagagctgagtaggggacaactaggtcctctgaggttctgcgc

SEQ ID NO: 105317 - DNA, 558 bp, Homo sapiens
tttcaattatctagctaatggtcagtcttgtttcatctctacttgcttatttttaaacaaatgcttctatcagttcaatatatagttcagaattttctctagagtgtttagaagaaaacatgcatattacacgtaaaacaacagtaactatgagtaattaattttaatgtcagatattcagacagatatcaaatttccccagttgtaactcactacctcccacccccatgcatatgtggtaaaggttgttggagtcaggatccaactaatgttcataattcatttataattggttacgattgataactctcaagtctataaactccccacctaccttttcttagagtttacttgaagaaaaaccttgctttttatacattatttagataatcttttgcttcatcagcatctgaattcatgaattttgatgtgactttaaaaatgtacttgataaggccagccaccgtttcctgcccgaaactctattttaaaagctggcttcttcccactgatttggctttttgtgtggcggaaaaatcattggtggttaaacccccg

SEQ ID NO: 105318 - DNA, 254 bp, Homo sapiens
gcatatgtggtaaaggttgttggagtcaggatccaactaatgttcataattcatttataattggttacgattgataactctcaagtctataaactccccacctaccttttcttagagtttacttgaagaaaaaccttgctttttatacattatttagataatcttttgcttcatcagcatctgaattcatgaattttgatgtgactttaaaaatgtacttgataaggccggggcacggtggctcacgcctgtaa

SEQ ID NO: 105319 - DNA, 240 bp, Homo sapiens
aaaatactagtttacccgtggggcttgattttcctcttaatagtgattctcattggttgtggtaccctttcctggggcattttggttggcgtggttgtgggaagggcgctactggcatttagttgggggcaagcagaggtgccaaatgccctgcaatgagtgaggcagtccaagaaaatgaagaattgacccttgtacttgggaatttcgtatcttcttctgtaggagcaatatgaatct

SEQ ID NO: 105320 - DNA, 764 bp, Homo sapiens
ccaaacacttgccttgttaaagccaagcaaacatttggtctttatttccttgtcagtaccagcctctatccttctttatccttcagtctttctcctcttctctcccaacctctctaccctcctctgttaagaacctgtacaaattccaactcaggtaggatgacacataacacataattatttctttcactcaaggcctgaggaactaagtcaagtctacgaatctgtttttgttgctaattttttgtttgtggatttttaaaacactaaagttgatcaatttatttgtacgttatttacatatgtgcatatacgaacacatacagtatatgcaaaattcatctttctgtctcagaatttaggagcctaaaggaaagaccatgtgccaaccatgaatctaatacatgacgtatgctaccaacataaacttgcatgcatcagaggctatcagaaataatatgggaaaataggtctctaccaagtgacttcataaggagtgaatgatattttcttgactctaactctaatgagatcatgttttcttctggctcatgtctttgcctgtatgttctgttttctacatctttttcaaattacccttcacttttcagctttattcctctgcttctgtctgacttaaagctaatgtatgaaacgcacaagaatttggatggaaaagcccatggcaagttttggcagaggttccaccagtctttccataaagggcaggaggaaaagtcattttcagaataggtcaggtgaca

SEQ ID NO: 105321 - DNA, 656 bp, Homo sapiens
ggaagatggtgacatgcacaaggctacacaaataataaataaggattgggaaacatacatttgggtctcttgactccaatttggttgctcttttaatgataccaaccactttgaccattcaaaggggtcattgtggtcccaccagcccccctccatacctgctgagcccaagtacagactcaaaaggaatttcccttgtggctagaggatgtactgtataaaagatcaggatcccatttcacctttcctttctttcagaactatcttagctttacctttggataaatgtatgtcattagtgggagatcatctgcctcttaaattcttatctttcacaatggacaccagacttccttttaaggtgctatgtgtgactcatcagtagtttaaaattttgtaagatacatgaacattttctgattgagaaacactttagaaatgctgaacatattattgtgaaataacaatgactaatattgttgttaaattgttgaattgtaatagctttaaccttttttgattcagtctgtttattccaagttatcttgccttttaaatggctttgaaacattggcaaacaatgctggtctctcttacagatctcagtcctgcttttaacaatgacaggcagtgtattcaaaacatacctgaattgg

SEQ ID NO: 105322 - DNA, 598 bp, Homo sapiens
aaaaaaaaagcacatgttagaacaataacattatgatctcatttctgtaaaaattaaaaagaatgggctgtgcatatatgcataaatatgtaggtatatacatttacatctgcataagcataaaaaaatatggaagatagcacccacagtgtcaacagtggtttcctttgaagtgtagggtttaatttcttccttagtttgctcattcattcattcagtaaatgtacactgagtgcctactacacgctaagcactattttaggcactgaggatacaatgatatgtaaaatccctgtcctcatggagcttacactctaatgcaggaagacagacagtaaagaaataaaattatagtatcttggatggtgatatgtgctatagagaaaaataaaatagagaaaggagatgggagggcggtttgcagtttcaaataaagtggattgaaagtgtagagggaacattttatatctttgtatccttaaataattggtaggattatcaagtgttttcctttcttatcatgtgagtagttttctgtatagcccaaataaacagtataaaaaagagaataaaaagttatttttttcccagaattaaa

SEQ ID NO: 105323 - DNA, 172 bp, Homo sapiens
cttttcctaacactcacaacaaaactaactaacactaacatctcagacgctcaggaaatagaaaccgtctgaactaccctccccaccattgcccacccgctgcctgcctgccccatcccccaacccagttccctggtctgcctgcctttattgatgctggcctaccgagaga

SEQ ID NO: 105324 - DNA, 379 bp, Homo sapiens
aatatcacaattgaaattttactcctttacaagcctatggaaagtatattatgaatggtcaattttcagctgtcatcccagtcaccctttcagtggcattcaaacagttactaattgctccatccttcttgaaactctttatttggcctctatgactgtagactcttctggttctcttctaccttattagctttctctgctgggtccttctcaccttcccaacctctaaatactggcccattccagggctccttcatcagatctctttccaatgcctacactcaattcccaaatgatctcccattcatccgttctatacctttaaatctccagtcttggtctctcccctgaactcccaacttttatgtctgactgccct

SEQ ID NO: 105325 - DNA, 117 bp, Homo sapiens
gcgagttcgagaccagcctggacaatatagggagaccctgcctccacaaaaaataaaaattaaaattaatccaatgccctagttgaccaatcatttcggaagggcttggagagggtc

SEQ ID NO: 105326 - DNA, 534 bp, Homo sapiens
attgattctctttctttctttctttctttctttctttctttctttctttctttcttcctttctttctttctttcttttttcctttctttctttctttcttttttttggggagaagaaggaatagaggacagcagaatacctaacgcatttgtgatgcgctgcttataaatgcatgttcagaggcaaatgaccatgataaactaccatctaggaaactgctttatttaaatgaagtcatttccctcctgctgccttacagggcatcaacaaatgagttgtgcgtgaggaagggagaagcacgtagtgctgatgctcactgtgtcatcttgcaggggcttcgttatggagaggtatgccgatgctgatccagacagcctaactggcagcctgaactgactaatggagccatctgcatgttggctgacatctggttttagaagttatttataaagaaaggatcgttgtaatcaaaacagccagagaggttttaaatgtcaaatgtactgggaaagattcacttagggtgactggcac

SEQ ID NO: 105327 - DNA, 234 bp, Homo sapiens
gtacatgcacattgagtagaacagtggcccccaacctttttgcaccaaggactggtttcatggaagacaaattttccatgggctgggagtggggttggggggtggaggggatggttttggggtgaaactgttccacctcaaatcatgaggcattagattcccataaaggagcgtgcaacgtggaaccctcgcatgcacaattcacaatagggttcgctcctttgagaatctaat

SEQ ID NO: 105328 - DNA, 297 bp, Homo sapiens
atcatctagaagagatgaataaactcctagacacatgcaatataccaagattaaagagtaaaaaaaaaaaacatagaaaatctgaacagaccaaaaaaagtgaggagacttgttcagtaattaatgtttcccatcaaagaaaaccccaagacctggtaaacccactgctgaattctattaaacatttgaagaaaaactactatcaattcttctccaaaaccagataacaacactacaaaaggaaggaaggaaggaaggaaggaaagaaggaaggaaggaaggaaggaaggaaggaag

SEQ ID NO: 105329 - DNA, 653 bp, Homo sapiens
gttattgtggcatatattctcaacaactctgaaatattcctgctgaggaaaaaaaaatcagttttcacatcttaaaatttaaagcatattttaacagtggttctcaaagtgtagctgggccacagcaaagtgctgggccagctgcatcagcattaacagggaattgggaaacatgcaaatccctccaccccatcccagaccaaatgaatgaaagagttgaggcccactaaagagttttacaaatcctgggtgatttgaatacacaattttgagaaccaccgtgctaaattcatttttcctaactgcggtacctactcaagatttatattcaaattaacttctgggtcatatagatgtttacattgatctattttagtttcactcttatatttcctctagtgttgagacaatattttatatctttcctctgccttccctgatagtttaacacacttttgaacagaatcttagagtattagaactagaggaaatgatcagccagaatctgtcattttgtgagttaaaaatgcctgatccagtggatgtgaggtcacttgtccatgttcacacagatgtaggtactggtagctcctagatttttgtataccttttcttccatttcaattatagacactctgtctttttcactaaaa

SEQ ID NO: 105330 - DNA, 340 bp, Homo sapiens
ctcacttacaagtgggaaccaaatgatgagaactcatgtacacatagaggggaacaacacacactggggcttgttggagggtagaggatgggaggagggagaggatgaggaaaaacaatgagtaccaggcttaatacctgggtgacaaaataatctgtacaacaaacccccatgacacaactttacctatgtaaaaaacctgcacttgtacccctgagcttaaaataaaagttaaaagaagaaaaaagaaaataacatgtcatccactgttcattaaggtccaggcattgactccagagtttattctctaaggacgctactgctctgcatctcaaatgta

SEQ ID NO: 105331 - DNA, 366 bp, Homo sapiens
aatccttgttgagctctggggctgcttcctaggaaaaggctgtgcttcccctgtactccctgccccatcctacccctcctctcctcccttctttctcttctttgttcctgcttgttaggagccaagagctgcccctgaccaaggccgcaggctgacaggggcaagcgagaggttttccgaggaggggaagacagcactcccgggagggaagcaagacgtctgagaactcagccttcagatgcctttctaagaccttagctttgctagttcctcaaagagctgacatttattgagagctgagccacaattctcttccccttcttctcttctgaactttctgtggattcctctagttggtttttttga

SEQ ID NO: 105332 - DNA, 292 bp, Homo sapiens
  misc_feature (256)..(256): n is a, c, g, or t
cacaggccacttcttctgcagagccctgtgctccgtgactccaccagccgagaaggaaggggaatgcttgacactttgcaagaatgagttaatctcagtgaagatggcagaagctggctccgagttggaaggcgtgtctttggtgacaggtggttcctaaagaattatccaggaagctgtggcctttccaggaagagggattggacaggctcctatcagattggcagaggacgctgtaagctgactacttatgagncaggaggaggaggattcgctaagcatccgtagatca

SEQ ID NO: 105333 - DNA, 1063 bp, Homo sapiens
  misc_feature (790)..(790): n is a, c, g, or t
  misc_feature (853)..(853): n is a, c, g, or t
  misc_feature (1018)..(1018): n is a, c, g, or t
agagaggacatcatggaaaaagtcagactctttctaggatttgaatcgggagtctgaagaggagaggggtgaatgtgcaagcccttaaccaccccacatcactgatctggaccagagaacctgcttggaagaagtgagaagccatgctagcgaaggccaggagcttgcaggggctcagagcctggcagttgcattagtttgctgtgatgcacagtgcaaagaggtggctggtcaaggaccagtggcatggtgaagtgtctccagggtgcaccgcttttgcggcagtttagtatggacagagtctgggcaggctcagtgtagcaagcctgtcatgagaggtgaggaccaaggtggaggttggtgtgacaggaacaaggaaagggaagaacatagagcaggaacacaggagaacaaagaaaggtcaggaccgtcagcctccaaaggccactgaggaagaggggccatccactggaatggaaaacgaagacgtacctgtggggaaaggatcttaaattcagtttaacagagcaggccttcagcaaatacaagaattcttaatttcaggtaggaagatattagcagtgtcttctaatatttgttttcggaaagatttatgtcattttagttcacacaactctgtctgccagcatcattaacttacctaacttgtttagaaacaaaaatgctaacagcaccactgagaccttgctagtctaagtgtgctttggagaccattggcatcagcaccatttaggcacttgttagaatgtagagtctccgggccaggtgnggtggctcacacctgtaatcccagcactttgggaggccaaggcaggcagatcacatgaggttngaagtttgagaccagcctggccaacatggctaaaccctgtctctactaaaaatacaaaaattagccagacacggtggcacacgcctgtagtctcagctatttgggaggctgaggcaggagaattacctgaacccgggaggtggaggtagcagtgagtcaagatcntgccactgcactccagcctgggtgacagagtaagactctgtctcc

SEQ ID NO: 105334 - DNA, 748 bp, Homo sapiens
gcaagatcacagccctcctctccagctgcctggatataaactctgctattggtggggcacagtgggagtgagactggccttgcaggctgcatgagagctaggtgaggtctgtcactgccggctttcctccactttcctggtgacctgtatgacacagcagaggcaaccatagtgcccctgggaacataactccattggcctgagaaccctctcacccccaacactcaaagtggccagagcaagctccactcagggagagtctgatctcagacctgcctaccctacagccacctgatgatttttctctacctgccctggtagcctaagacaaaagacataagctattgggagctgtatggccccacccatcaacaaaaaaccctagtactcatcctggccaacatagggcaagattatatcccccttctactactgcagctggtgccctcttgaaagcatcacctgctggctggatgccaaccaagccattacatcaactaataacagaaaaatcctgctccaaagaaggagaaaacaacagctctttttaccacttgcaacaccctggctagtcagagatcctgagtctgtccacatgacaacttgactgctagcataactagcatttgtggaaaccagtgcactaaacaaaactacaaccagggactcccacagagctcacttcaccccctgccacttccactggagcaggtcctagtatctgtggctgggagacctgaagatgaat

SEQ ID NO: 105335 - DNA, 466 bp, Homo sapiens
ctggggtcagagagaggaggacaaagcaggtgtgtagcccagggaatgacagcaccccttccgagaagacagggagggtgcagacatggccaggttctgagctagaaaactgtcagcagggggctgaagctgaggatagtcattgccaaggaacagcctccgtcacagaggagacgcacagatgcggtgacgagggagggatgcggggctggtgaccgctgggaacggatgtgtgaggcagagtctccaggcatggtctgtggggcggtttgatgatactagaacatctcagagtagaaggacgtcccgacctgcagactggaaagcccccagagctcccggcaggacgtatgagggccagcccacacccaggtctgtcctgatacaactgaacgccacagtgtcttagctcctttactgttgctatcaagaaacacctgaggctgggaaatttatgaagaatcat

SEQ ID NO: 105336 - DNA, 376 bp, Homo sapiens
tctcccttagggggttacgtgggggaccgaatccttttttctaccctggagcaagtgccagcacatggaggtggtagaaatgtttgctcaggtgcccacagccaattgatgccccactgctcttgtgtttgtattgaatccctttgttaatttttttcttgtttagaggaaatacatatggtgattttgcaatcaatgcagcattgcataataattaaagggctagccttggggccagactatttcagattctagccctcccatttgccttgcatgattacttatctcaagctcagttttctcttctgtaaaacggttatttcttaccatgctattaagaggacagaatgaggtaaggatgacccaaatgtcagtc

SEQ ID NO: 105337 - DNA, 394 bp, Homo sapiens
gagaaatacaaggcatgctccaatctatatgttccttcagtagggaaagtgaaaatgttaactttgcagctaagagatgatagccactgtcaggttttgtagggtgtcatctaatactgggaaaatatcatttgcaaaggtggtatatttactgggtcataaaataaagataaaaaataaggagttaggcattttctcccatctttccctatttccttacatttcttcttttaaatagcatttttggatataaaaaaatgcaaggaggatgggatgtaggaactggatagcaagaaagatactccagatggacaacgtcactttcaaattggtaggctgaatccatccaagatgagatgatctgtactttctttcaacctattgtgtcttgaac

SEQ ID NO: 105338 - DNA, 791 bp, Homo sapiens
gtagagaggggtttcaccatgttgctcaggctgatcttgaactcctgacctcaggtgatccacttgcctcggcttcccaaagtgctgggattacaggcataagccaccgcatctggccaacatggtcttttaactgtttgttaacttatctgtctccaacctgggccatatgtctcttgtatactattgtatctcatatatatagtgaagtctaagaagaaactcagtgaacaagtgaggaatgaatgaatgagcacttgtccaagaggacctgtccacgggctgcttagtatcctgaaaaaattttgataatctgaaattttaaaaaaacctaaaactgaaataagttgagcaaattggactggaccatttaggaattacaaaatggggaactgttgagaaaatctgtagttagtcatgggccaaaagctggaagtggtagttgagatgagccatggcaacaatggctgtgtttacactaaaattatgaggaaacaaaaactgtggttaagcagagaagaaaacagagcagtcatacagaaagaagcaattaggtcaaaagacaatgaggcaaagagagcagctcactccatccagactgtgtctggaacagcccttgcccttctttacctgacatgaaagctgagaccatgtgacagctcctcaggaagcctccctgaccagcagtgtttgggggcagaaaccaatgttctctgaaaaaatgatcatatgcttctttctagccctgaatgccaaccccacctgacacacattgtaagaattcagaggcc

SEQ ID NO: 105339 - DNA, 773 bp, Homo sapiens
aatatacatcatgacacctgtattcacactcctcatatactgcagacaaatgccattttgaagagagggagctttattcctgagtgggcggaggaagaaggatgaattgaggaagtgtgttcattacttgtcagctgccaacactgaaaacaacacatgtttattttcttacatttctgtaggtcaggagtctgaaatggatttcactattttaaaatcaaggtgttgggaggcttgcagtctctccagaatctctaggagagaattcatttcttactttttctagtttttacaagccacctgccatccttggctcattagccgttaccccatcttcaaagcacatgactccgacctctgcttccatcctcacatcccttttttctgcggttaaatatctcccttcctctccttataaaagccctgggaccccactgtgattccatagatcattcaaaaaatgtccccatcttaagaaccttacctgaatcctatctgcaaattcctctttgtcctaaaagttcacaagttctaagaattaggatgtgggcatctctggggaccaggattgtacctgccacatagggtttgaacacctgatgggatctgggagcctgatgagggagggtgtcacccctgaggggctgggtcaaagtgaaccaagtagctagaacaggtggtcacaagaagttggtgattcccaagggcaccagcttgggagaagtaagtggggcagctggggacccctccacctctagggtcatggatttgga

SEQ ID NO: 105340 - DNA, 619 bp, Homo sapiens
gcaaaagcaatttgacacttcataacgtctagaaatattttttcaaatgtgatgtatgaataggaagtagcatacaaaaacaaattactgtgctatccctcccccaagaatacatattctctcttcacaccacgtggctgctgctggggcatgggggaggggtggcattggcagttcaagactgtcctaccctcttcagtgactcttttagcaatatgaagttaaaaaccaggtactgttaccactcacctgatgtttaattctcatgaagatgcttttttgtgtagatagttgtcaaatgtgatgttcctgcagggaggacaattggtggaggcttctatttggccaacttgctcctcctcatttgtaaatatttcagtgggtacctgtgatttgctttgaagtacagtaattggagaaagggtaatgagagttaacaaatacggctaaagtggaaacgtggtcagtcttgagctgattattgttgaagctgaatgagggatttataaaggtctgttatgcttttctttctaagagtttgcttgaaatcttttatactttaaagttgagaaaaccaacaatgataccagctcagtacagtactcacacagtgaaggtt

SEQ ID NO: 105341 - DNA, 465 bp, Homo sapiens
gttcccagtgtctcctgctgccaccccggcatctcccgatgggccccagtgagtcagggccatgtggcccaactgctggttcctttgggctctgggcccctcccctggctaggcctgtggcctcccaactccaagcttgagtcttcgaggtggtagaggaagtgggggtggtggcgggggtcacaatccctcacccaaagggcgtttgcccaactcccccacttcccctgcctcaccccacccaccctggaacaacagttgtatttcccaaccacccagggccacccaccttcctcttcctcagccccagccccactccaggtcatgggccctggattctgggccagctggagtcagcctcctcctcctggttccccataggcccctgaggtgtgtggcggacccctgctctggcagctgtggacactgtccagctgttctccagagctgcccatctgcaggctg

SEQ ID NO: 105342 - DNA, 429 bp, Homo sapiens
acccagttacacagctacagctgcttggagtactgtgtacagaaagatctggccggctgctggtggctcctgtctttccagctgatctgtcccactcttgcccccatcctcagcactcagccctccccaccagcagcccaatacaggctaatggccacgcaccacagcctttctgtttgcaggggcttcctctgcaggaggaaaacaacctatgcatataatgttagaatcagacatgtggacctttatgatcccacgtggagaatgataagcatatttttggccttaatgaatctgcttttggagtactcttccccctacctaatgccctccttttccttactgttgaaatcttactcatccttcatgtcccactcaaggcaggctgtgtcagtcatccaggtccaggagattcactgaccctgggct

SEQ ID NO: 105343 - DNA, 636 bp, Homo sapiens
ggttatgttgatgagtgtgtacaaagtgcagggtcaagcctgctctgacaagaggcaatggctttggaagccatttaatggaggcatatttaggagtggagtttcttcctcttctgttcttgctctcccttcttagagtgccttttagactgaacttctccagctactgctcatcatggtgagagccaggtgtagaaaggttaccttatcaccatcaacgcaatattccctttcatttttgcctcctggaggctgaaaaatggcctagattccaagaaagtgaaaaaaagaggtgtggaggagggcctttagcttttctcaatagcgtttccttggggtcctttccaggcaagcatgaccctctctcattttctagatgagaaatcccagggatgagcacttaaatggtatttctaaatcagagtcagggcctgcgtttcagatggaacccacagactctcctgagaggctctggatggggcggatttggcatgcaaaaagtaggctcctggcctggctctgccctcaccaactgggtgaacctgggcaaatcatttccagcctggactgatacctggactggtagcatcagcatcaccagggagcttgtcaaaaatgcaatgttctgccctcctc

SEQ ID NO: 105344 - DNA, 309 bp, Homo sapiens
gaattatagaaagttaaatatcagttagatgactacaagaaaaacataactatttgatccagttaaagaagttacttgctgtcactgtctttcacagtggctaagagccagaatcttgagtttaacataaattataaaattaccatagttttctagttcctaacaatgagaagcagtaatgagcattaattcagcctgctggctctttatattctgggaattcagaaaacagctagctggatgagaaacagtttgattccaggttaagatctaatgttgtagacacagtgaatcaacttttcaaatctg

SEQ ID NO: 105345 - DNA, 736 bp, Homo sapiens
caaatgtcttgggggaggggagaaaactataactcttggaaatttgatagaattgtcaaaagaatataatcagctacatacattgtttaaccaaagttgtagttctatgataaaagataaaaattttcttttatgagaataaaatacctaggaatccaacttacaagggatgtgaaggacctcttcaaggagaactacaaaccactgctcaaggaaataaaagaggatacaaacaaatggaagaacattccatgctcatgggtagaaagaatcaatattgtgaaaatggccatactgctcaaggtaatttatagattcaatgccatccccatcaagctaccaatgactttcttcacagaattggaaaaaactactttaaagttcatatggaaccaaaaaagagcccacatcgccaagtcaatcctaagccagaagaacaaagctggaggcatcacactacctgacttcaaactatactacaaggctacagtcaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggatta

SEQ ID NO: 105346 - DNA, 703 bp, Homo sapiens
gttttaaggactcaacaataagttaatgagacacagtgtttgctttcatggagcttacagtctggaggggacaaaggcttaaacaatactcatataattatatatgtgatcagtacaatgaaggagctcagtggggtaaataagcaggaacctgaacttgatctgttccggagggccacagaaggcttccttgaggccttgagaaagtgatttgcatctgagttctgaaggattgtaagaggtaactagggaaaaagttgacaggaagaggaaggggatccagacaagaaacatttgcaaagatcttgaggcataaatgagcttgagacatctggagaaactgaggaaaagtgagagagtaggcagggcctggagccgcagagccattgctaaccatcctgtgtgagatatcccccattctgtagctttattctcataaccctgctcaattttctttataacacttctcacagatttatatacgtgtttgtttttgttatctgtctctcccaccagaccacagctccatgagagcaaggtctttgcttaccaatatatcactagcacttaaaactatgcctggtacacagtaggttcttaatatgtgttgaatatagccatcaaattgatattggatataattcaatctgataagatattttgagatattaaagagtttttaacttgataccataaaaacttt

SEQ ID NO: 105347 - DNA, 1446 bp, Homo sapiens
  misc_feature (1409)..(1409): n is a, c, g, or t
  misc_feature (1415)..(1415): n is a, c, g, or t
  misc_feature (1418)..(1418): n is a, c, g, or t
cggaggctgaccttagaggacccccacggcaggttgtactgttcttattaaaacatcatcccatgatgggatggtgttgatatatttggaaactcttggtgagagaatgaatggtgtgtatacatactctgtacatttttcttttctcctgtaatatagtcttgtcaccttagagcttgtttatggaagattcaagaaaactataaaatacttaaagatatataaatttaaaaaaacatagctgcaggtctttggtcccagggctgtgccttaactttaaccaatattttcttctgttttgctgcatttgaaaggtaacagtggagctagggctgggcattttacatccaggcttttaattgattagaattctgccaataggtggattttacaaaaccacagacaacctctgaaagattctgagacccttttgagacagaagctcttaagtacttcttgccagggagcagcactgcatgtgtgatggttgtttgccatctgttgatcaggaactacttcagctacttgcatttgattatttcctttttttttttttttaactcggaaacacaactggggaaatatattctttcccagtgattataaacaatctttttctttttttaaagtcctttgggcttctagagctcataggaaaatggacttgatttgaaattggagccagagtttactcgtgtgggttatctattcatcagcttcctgacatgttaagagaatacattaaagagaaaatactgttttttaatcctaaaatttttcttccactaagataaaccaaatgtgcttacatatatgtaaacccatctatttaaacgcaaaggtgggttgatgtcagtttacatagcagaaagcattcactatcctctaagatttgtttctgcaaaactttcattgctttagaattttaaaatttcaccttgtacaatggccagcccctaaagcaggaaacatttataatggattatatggaaacatcctcccagtacttgcccagcccttgaatcatgtggcttttcagtgaaaggaaagattctttttctaggaaaaatgagcctattttattttattttattttattttttgacacaaactgtagattttagcagccctggcccaaaggaatttgattacttttgttttaaacagtacaaaggggacactataattacaaaaacatccttaactgatttgagttgtttttatttctttggatatattttcagagtggtaaattgtgtgtgagaattacaaatgattattcttttagtggtttcttagcctctcttacagcccacggggatagtactgtacatcaataccttcatatgaaatttttatatgcaatgaaaataaaagcatgggttgattctgcctaaaaaaaacaaaancacacnacncccacacaacatcaacacacaaaaaggg

SEQ ID NO: 105348 - DNA, 1896 bp, Homo sapiens
cggaggctgaccttagaggacccccacggcaggttgtactgttcttattaaaacatcatcccatgatgggatggtgttgatatatttggaaactcttggtgagagaatgaatggtgtgtatacatactctgtacatttttcttttctcctgtaatatagtcttgtcaccttagagcttgtttatggaagattcaagaaaactataaaatacttaaagatatataaatttaaaaaaacatagctgcaggtctttggtcccagggctgtgccttaactttaaccaatattttcttctgttttgctgcatttgaaaggtaacagtggagctagggctgggcattttacatccaggcttttaattgattagaattctgccaataggtggattttacaaaaccacagacaacctctgaaagattctgagacccttttgagacagaagctcttaagtacttcttgccagggagcagcactgcatgtgtgatggttgtttgccatctgttgatcaggaactacttcagctacttgcatttgattatttcctttttttttttttttaactcggaaacacaactggggaaatatattctttcccagtgattataaacaatctttttctttttttaaagtcctttgggcttctagagctcataggaaaatggacttgatttgaaattggagccagagtttactcgtgtgggttatctattcatcagcttcctgacatgttaagagaatacattaaagagaaaatactgttttttaatcctaaaatttttcttccactaagataaaccaaatgtgcttacatatatgtaaacccatctatttaaacgcaaaggtgggttgatgtcagtttacatagcagaaagcattcactatcctctaagatttgtttctgcaaaactttcattgctttagaattttaaaatttcaccttgtacaatggccagcccctaaagcaggaaacatttataatggattatatggaaacatcctcccagtacttgcccagcccttgaatcatgtggcttttcagtgaaaggaaagattctttttctaggaaaaatgagcctattttattttattttattttattttttgacacaaactgtagattttagcagccctggcccaaaggaatttgattacttttgttttaaacagtacaaaggggacactataattacaaaaacatccttaactgatttgagttgtttttatttctttggatatattttcagagtggtaaattgtgtgtgagaattacaaatgattattcttttagtggtttcttagcctctcttacagcccacggggatagtactgtacatcaataccttcatatgaaatttttatatgcaatgaaaataaaagcatgggttgattctgcctatttatgactcaatcttttacaaataaaagattattcattttaaattatagttcaatcagcatgtctcttaggatactgaacgtggttgaaatgaaaggatagtgacatcataaatgagcttgagacatctggagaaactgaggaaaagtgagagagtaggcagggcctggagccgcagagccattgctaaccatcctgtgtgagatatcccccattctgtagctttattctcataaccctgctcaattttctttataacacttctcacagatttatatacgtgtttgtttttgttatctgtctctcccaccagaccacagctccatgagagcaaggtctttgcttaccaatatatcactagcacttaaaactatgcctggtacacagtaggttcttaatatgtgttgaatatagccatcaaattgatattggatataattcaatctgataagatattttgagatattaaagagtttttaacttgataccataaaaacttt

SEQ ID NO: 105349 - DNA, 1396 bp, Homo sapiens
cggaggctgaccttagaggacccccacggcaggttgtactgttcttattaaaacatcatcccatgatgggatggtgttgatatatttggaaactcttggtgagagaatgaatggtgtgtatacatactctgtacatttttcttttctcctgtaatatagtcttgtcaccttagagcttgtttatggaagattcaagaaaactataaaatacttaaagatatataaatttaaaaaaacatagctgcaggtctttggtcccagggctgtgccttaactttaaccaatattttcttctgttttgctgcatttgaaaggtaacagtggagctagggctgggcattttacatccaggcttttaattgattagaattctgccaataggtggattttacaaaaccacagacaacctctgaaagattctgagacccttttgagacagaagctcttaagtacttcttgccagggagcagcactgcatgtgtgatggttgtttgccatctgttgatcaggaactacttcagctacttgcatttgattatttcctttttttttttttttaactcggaaacacaactggggaaatatattctttcccagtgattataaacaatctttttctttttttaaagtcctttgggcttctagagctcataggaaaatggacttgatttgaaattggagccagagtttactcgtgtgggttatctattcatcagcttcctgacatgttaagagaatacattaaagagaaaatactgttttttaatcctaaaatttttcttccactaagataaaccaaatgtgcttacatatatgtaaacccatctatttaaacgcaaaggtgggttgatgtcagtttacatagcagaaagcattcactatcctctaagatttgtttctgcaaaactttcattgctttagaattttaaaatttcaccttgtacaatggccagcccctaaagcaggaaacatttataatggattatatggaaacatcctcccagtacttgcccagcccttgaatcatgtggcttttcagtgaaaggaaagattctttttctaggaaaaatgagcctattttattttattttattttattttttgacacaaactgtagattttagcagccctggcccaaaggaatttgattacttttgttttaaacagtacaaaggggacactataattacaaaaacatccttaactgatttgagttgtttttatttctttggatatattttcagagtggtaaattgtgtgtgagaattacaaatgattattcttttagtggtttcttagcctctcttacagcccacggggatagtactgtacatcaataccttcatatgaaatttttatatgcaatgaaaataaaagcatgggttgattctgccta

SEQ ID NO: 105350 - DNA, 1571 bp, Homo sapiens
cggaggctgaccttagaggacccccacggcaggttgtactgttcttattaaaacatcatcccatgatgggatggtgttgatatatttggaaactcttggtgagagaatgaatggtgtgtatacatactctgtacatttttcttttctcctgtaatatagtcttgtcaccttagagcttgtttatggaagattcaagaaaactataaaatacttaaagatatataaatttaaaaaaacatagctgcaggtctttggtcccagggctgtgccttaactttaaccaatattttcttctgttttgctgcatttgaaaggtaacagtggagctagggctgggcattttacatccaggcttttaattgattagaattctgccaataggtggattttacaaaaccacagacaacctctgaaagattctgagacccttttgagacagaagctcttaagtacttcttgccagggagcagcactgcatgtgtgatggttgtttgccatctgttgatcaggaactacttcagctacttgcatttgattatttcctttttttttttttttaactcggaaacacaactggggaaatatattctttcccagtgattataaacaatctttttctttttttaaagtcctttgggcttctagagctcataggaaaatggacttgatttgaaattggagccagagtttactcgtgtgggttatctattcatcagcttcctgacatgttaagagaatacattaaagagaaaatactgttttttaatcctaaaatttttcttccactaagataaaccaaatgtgcttacatatatgtaaacccatctatttaaacgcaaaggtgggttgatgtcagtttacatagcagaaagcattcactatcctctaagatttgtttctgcaaaactttcattgctttagaattttaaaatttcaccttgtacaatggccagcccctaaagcaggaaacatttataatggattatatggaaacatcctcccagtacttgcccagcccttgaatcatgtggcttttcagtgaaaggaaagattctttttctaggaaaaatgagcctattttattttattttattttattttttgacacaaactgtagattttagcagccctggcccaaaggaatttgattacttttgttttaaacagtacaaaggggacactataattacaaaaacatccttaactgatttgagttgtttttatttctttggatatattttcagagtggtaaattgtgtgtgagaattacaaatgattattcttttagtggtttcttagcctctcttacagcccacggggatagtactgtacatcaataccttcatatgaaatttttatatgcaatgaaaataaaagcatgggttgattctgcctatttatgactcaatcttttacaaataaaagattattcattttaaattatagttcaatcagcatgtctcttaggatactgaacgtggttgaaatgaaaggatagtgacatcataagttagtactgatattcataaccaaataaagccaacttgagtaattttgctacattaaaaatt

SEQ ID NO: 105351 - DNA, 862 bp, Homo sapiens
  misc_feature (825)..(825): n is a, c, g, or t
  misc_feature (831)..(831): n is a, c, g, or t
  misc_feature (834)..(834): n is a, c, g, or t
gggcgatctagaggatcccggaagttcctttcaccttttttaaagtcctttgggcttctagagctcataggaaaatggacttgatttgaaattggagccagagtttactcgtgtgggttatctattcatcagcttcctgacatgttaagagaatacattaaagagaaaatactgttttttaatcctaaaatttttcttccactaagataaaccaaatgtgcttacatatatgtaaacccatctatttaaacgcaaaggtgggttgatgtcagtttacatagcagaaagcattcactatcctctaagatttgtttctgcaaaactttcattgctttagaattttaaaatttcaccttgtacaatggccagcccctaaagcaggaaacatttataatggattatatggaaacatcctcccagtacttgcccagcccttgaatcatgtggcttttcagtgaaaggaaagattctttttctaggaaaaatgagcctattttattttattttattttattttttgacacaaactgtagattttagcagccctggcccaaaggaatttgattacttttgttttaaacagtacaaaggggacactataattacaaaaacatccttaactgatttgagttgtttttatttctttggatatattttcagagtggtaaattgtgtgtgagaattacaaatgattattcttttagtggtttcttagcctctcttacagcccacggggatagtactgtacatcaataccttcatatgaaatttttatatgcaatgaaaataaaagcatgggttgattctgcctaaaaaaaacaaaancacacnacncccacacaacatcaacacacaaaaaggg

SEQ ID NO: 105352 - DNA, 205 bp, Homo sapiens
aagctttatgataatttttgaatgcattatttattttttgtgccatgcattttttttctcaccaaatgaccttacctgtaatacagtcttgtttgtctgtttacaaccatgtatttattgcaatgtacatactgtaatgttaattgtaaattatctgttcttattaaaacatcatcccatgatgggatggtgttgatatatttgg

SEQ ID NO: 105353 - DNA, 672 bp, Homo sapiens
ctgatttcagcattctctctcctgtcacatcagaccctttgctggtttagatcacaatagtactgccagtgctgcacccttttagaacttctaaggccatgagttattggagattcagtttccagggtggttcttgaacctaagaaatcttctagaagcctgggtcatgttgtgaggtccttgtgcctgttgggtcgtggttctgtctgcctcaggttactgttggccccagggctctttttcctgcaggccttagttagcaccatgaatggttaggggtatgggggtcagggtgagtggtcaccagtgggtttcaagggattggcctatttcatctaagttgccaaacttatgtgcacagagttgttcgcagtatttccctagcatcttcttaatgtgtgtgggatcagtagtgatatcccctctttcatttctgattttggtcatttgtgcctttctttttttgtttgttagtctgctagaagtctgttacttctttttgttgggtttactttgttcatcttttaaaaaaaattttagagacctttcctcttttctgatataagcatttgatgctgtgaatttgcctccaagcactgctttagctgcatcctacaaatttttatatattgcatttttattttcagtcattccaaaccagtttctaatttt

SEQ ID NO: 105354 - DNA, 293 bp, Homo sapiens
gattctcctgcctcagcctcccaagcagctgggactacaggtatgcaccaccacacctggctaattttttgtatttttagtagagacgggattttgccatgttggccaggctggtctcgaattcctgacctcaagtgatccttctgccttagtgtcccaaagtgctgcatttacaggcatgagccaccacagggggcccaggcttagagattttaacttggccaagcctatcctcctaggaaatggaagggctaagatacaaggagtacaaagacaagagagattggttggga

SEQ ID NO: 105355 - DNA, 492 bp, Homo sapiens
agatcaactatcagattaagccccttggtctttctgcactcggctaatctgcctcctgcctctccactaaggagattcaaatgagaagacagaggcagtcgcctctgaactagaatcttcctactgaaatgcagagcctatgatagaaatgggcaccggggaccatctatccaaaagccagcctaaccgatacactcagaagaatttttctccagtcacactcctggatggagtcaggaacaaccaagaaacaagcaaaactgttcttttgcctcctccttcctgaaagaaccccatcaagaagcctacacatgacccctccagtgtgtaagccccaatcatgcctaaccaccccaaatcaccccaagtactcagccctactcaataactaacaccctctcccatctacacagaacagcgggtataggcagtcactgactcctgccctagaagcatcgggcgaggggtctcactcccagatcaaaggtttgt

SEQ ID NO: 105356 - DNA, 725 bp, Homo sapiens
ctcaaaaaaaaaaaattaaaaataaaagaatgcacagtccagtaatgtcacccagccctatatcagtaaaggtcacactctagagtggtacatatctcagctgcatctaaggccttgctaattagctcattagaatgtcacaaatgggtttttatattacccatgtatagctgccaaaaatgtttaagtgaatctaatcaaagttggaaaaaaaaataagaaaaatccaggttggaagacattcagcaaaacaatttccctgcactacactctaaaaaaagtcaagctagggaattggtccagacagataacacaactgggttggtccattaagtgacccctgatgcagcactgcattgaaggcaaaaaagctgtgagagagatttgagggacaactggggaactttgtagttatatatggactatatattagacagtattattgtatcatcattagatttttcagtgtgacagtggctatttacaagaatgccctagttcttaggatgttagtgctgaatcattagacaagagacctgatggctacaactgacatataaatgcctcagagactgatgtattttatatggaggtaaagcaaatgtaacaaactgttaatagttggtggatctaagtgatgagtctaggtgtgttattgtgcagttttttcaacttttctggaaaacgaacttttcaaaataaaaaattggaaaaatagaattcaa

SEQ ID NO: 105357 - DNA, 476 bp, Homo sapiens
atcaataaaagcttggaagataaacctgaagatatctttcagaatagagaaaaataagaaaagataaccatctaatttccagtttgtccattgttcaacatccagttggagccccagaaaaagtgaagaagaaaaatgagagaaaattagtaagagaataatagagaacgaatgaaaaaacaaagcccacagctgaacataatacagggaaatttcagaactcaaaagaaaaaaacaatatcctaaagggttccaaagaaaaagtacaagttatctgcaagggaaggagagtggactggtaacagatttatcatcagcaacactgcacatcaaaagtcaatggagcaatgtcttcaaagctctgaaggaaaataagttggttaacttatcaaatcggtgttatcatttttggtacctggagagtcaggtacacataacagaggcagacggtgagaggagctacaggaaataatgca

SEQ ID NO: 105358 - DNA, 401 bp, Homo sapiens
cccagatgtttatatttgttgcctccacacttccttcaagtctttatccaaatatcacctttatgagatttctgaattttttattcatctataacatacaaaaagtacagtgcacaaatcctaagtatattgctcaatgaattgttatcaactgatactcctgtgtaaaggtacctagttccagaaactgaatgttatcagcatcccaaaatcccaaccttttcattgaggctttccctaactacctattgaaaattgtgcccaggggatatggggagacatttgtcaaagggtacaatgtttcagctaaaagggatgaataagttctggatatctactgtacaccattaaccttaagagagatctcaaaaaggaaaagaactcacaaaaaaaaattgctg

SEQ ID NO: 105359 - DNA, 305 bp, Homo sapiens
gaacaaacttaagtctgactacacgtctgatttatatagcaagatagaaaaggaaattttgtttttgctttcccagtctatttctaaggagaaaaaaaatattttaaataagccaaacttacatacaatagttgttttactgagtatttgaattattctttcaaaaataattcacagtatggctcctttaagtagttattcctctggaccatttaatatgtggttcaaattataaaaatttacattgttgccttcattttaagtctaagcaatgtaatatgtgtgtcaactttttaaataataaa

SEQ ID NO: 105360 - DNA, 435 bp, Homo sapiens
cagcaaactcagcactgtagctggagaatattgaagaagaaggagagaaagggaagaaggcagagaagtaatgggaagccaattacgtgggacctgataggtagatgtaaggactttggatatagccagaaaagccactaagggatttgagaagaagaggaggaagaaaatctgacttaaatttttaaagaagcattgtggccattgtgttgtgattaggctagactcgagcaagagatctgctgttattttacgatttgcattgaaaactaaaaatattgtaaaatgagttcctctttcttttggttatctcacgccgatgttggttggaaattttaagttatgtttcctattcatggttgatgtaactacacctacgtttttactttgattatatatggtttactgaaaatgaattaaagatattgagctttt

SEQ ID NO: 105361 - DNA, 339 bp, Homo sapiens
gagttctgttttgttttaataagcctttccctctgacttcctttattctttttaatgtttttattatattttaagttctgggatacatgtgcagaatgtgcaggttagttacataggtgcagcaaaccaccacggaacgtgtgtaactatgtaacaaacctccatgttctgcacatataccccaggacttaaaagtgtaataaaaaaaaatcctttttaaagttaaaaaataaaagaaatgatatgatgttttgcatgttgattttatattctgcaactttattgaattcatttattagacctaacagtttttggtggtgtctttgacgttttctacat

SEQ ID NO: 105362 - DNA, 371 bp, Homo sapiens
agcagaaggtgaaaggggagaaagctcatcttccatgactggagcaggaggaagagagagagcagggaggtgctctctcaccaaccagatctcatgagaactcactcactatcaggagaacagcaaccagggaaaaatctgcccccatgatacaatcacctcccaccaggccccacctgcaacattgggaattacattttgacatgagatttgggtggggacacagaggaaaccatgtcacctggctaagtggtgaccacacagttctcacctgtgtgtgggttattcactttctgctcttccctaagactctccttaaattcctggcagactcttgctcatgctctcctttgggagttcttcttctgctc

SEQ ID NO: 105363 - DNA, 783 bp, Homo sapiens
tccggggctacgcgacccggcgccgggcatccgggaccctctctgaaacgcggcctaccagaccctcgcctccgcggcacacagaccagaaccctctcttggagtctgattgggacctttttcttgtgacagattctgccagtttctgttcttggcaggttccatttctacaaattcctcatctctataggtttaggatcagaatgttccagcaggggagcattacagctgtttcaatcctcagggagactactcatcttgggaataattccttcctggagtgattggaaaataattcctaaaagaaattgaaaagtcaaattgttgaacggtaaattcaccatcacgtttaccataaagcatgtagagaaatggaaatagttacacatcatggttgagagtgcaggatttgcagtcagacagtttctggcacttagtagctttagaaagtgacttaagccctctaagccctcagttttcacatctataaaatgaagtaaataatataagcctctcagaagtggagtgagcgttgaatgaaatagtatgtgagtagtttaacgcagagactggcactgacataagaaactattgtgatagaagcagagcagagaaaatattttgaatagctgtatgcatggcaattttttaacctctttattcgtggcaactcatttaattgccacaacaaactaagtacttttattatttccattgttatggactgagctatgctaccctcttcatttcatatgttgatgtcctaagtcccagtgccccata

SEQ ID NO: 105364 - DNA, 695 bp, Homo sapiens
actcagtctcaaaaaaaaaaaaaaaaaaaaaggtggttaaaaatggctgctctggggactggagggagctgggaggatgagacaccatcctgcaaatcaggcctggatgagatggggctgcagggctttctgacaggcacatctgacctcattctgcccctgctcacacagcctctgtggctccctattgccatcaggggagagtcccagctcccctgctccactggattgagtagtgtctggcaagaattcatgtctgagaattcatattcatattctgagaattcatattctgagaattcacctcagaatatgggcttatttggaaatagggtctttatagacagacatgaggttatcatggattagggtggaccctaaatccgatgactgggccaggcacgtggctcatgcctgtaatctcaacactttgggaggccgaggtgggcggatcacctgagttcaggagttcaagaccagcctggccaacatggtgaaaccccgtctctactaaaaatgcaaaaattagctgggtgtggtggcgggtgcctgtaatcccagctacttaggaggctgaagtgggaggatcacttcagcccaggagttggaggctgcagtaagctatgattgtgccactgcactccagcctgggtgacagagtgagaccctgcctcaaaaaaaaaaaaaaaaaaaaa

SEQ ID NO: 105365 - DNA, 388 bp, Homo sapiens
ggagacttaatattgttaagatggtagtactcctcaaattcatttacagattcagagcagtgatctattaaaatcccagctggcttccctgcagaaactgacaatcataaaattcacatggaaatgaaaggaacccaggatagccaaaacaatctttaaaaagaataataaagttaacactatgtggtcctggcatgcaggtagacatacagatctgtggactagagttgagagtccagaaataaaccctcatgtttatggtcagttagttttcaaaaaggatgccaagacaattcagggaaaaggatacagcctttcaacaaatggtcctgcatctttcaaaaaaatgaaattggccccctacttcacaccatatacaaaaattaaa

SEQ ID NO: 105366 - DNA, 323 bp, Homo sapiens
gcatggggctgaggtaaccagagcttgaatagaactgcagaagagacagatgattccagaagggtaaggaggtggaggcccctctttacttccttcccacagcaggcaccaggccagagttgggtgggcacctgctgggggatcctcatggtccagtattggttgtaggttttgagggggctgacaggagaggtggttgccagggaatggttccaagaagatgcaataggggaggaggctggggatacccaggggacatggcccagcttacggaggctcctgagcttccaggggcatagacattaagaaattgcacgctgagc

SEQ ID NO: 105367 - DNA, 242 bp, Homo sapiens
cacatgaccagaactgccagagccaggatggaccctgaccatctggcttcctcacctcccttctcttccgcaggctccagcaagcattggagtcatcttaaacgattggctttaataggaaaaacctctaatattggtctgctctccattttttgcttcatttattctagagaactttcttccttggaacagatagagttgcttcaatcttttttaattgctgcgtagtgttctgttctgtg

SEQ ID NO: 105368 - DNA, 438 bp, Homo sapiens
atgcaggctctattacgatgggactcacacatcacactggtctcggcctttgtcttttcttaatcctggcatgtggagaactaaggttccagagagattacaatgtgtgtaaaggtcacacaccaagtttttggcatacctacatttagagaagacattcagacctctgggctcagatccttggaatccctgtagctttcaagccagccctttgcttaggtcacctgtcagctcattcatccaggcctaaggtagaacacagcagtgcttctcaaacctgaatgtgcagttgaatcacctggggctcttgttaaactgcagattctgattcagtagggctggggtggagcttaggattctccttttctaacaagcttccaggtgatatgaatgctgctggtctatggactgcactttgagaagcaagggaatgatggc

SEQ ID NO: 105369 - DNA, 326 bp, Homo sapiens
tgtaatgactttgggttcatattgcccaaactgttatccaaaagatatgtagcaaatttactttttttaacaagaaggaaacccttaaatgctaaaagtaagaacacattttacacctctaatatctatatataaaatggcaaacaattttttaaattgcattctatatctaaaatactgagtcatgcctcttatactgtatttactgtacatttggagggggaaaaatcctacaatacccaaataatctctagtggttttattttcagcacaatgttgttttgaaaaggtaaactccaaaaagagtgtacttgctgcaaaataag

SEQ ID NO: 105370 - DNA, 351 bp, Homo sapiens
ctcccagacaaacatgctttcctgcccttgaaagccccattcccacctgtgctgttttctccccacctgcctcccttttctactccacagctgttccccatctcagtgcttttcacgccttttctagttcgctcccaagccaagtcccctgcccaaggggaccccttacataggtcaaatagcagagtttgccctcggtgtccaaggtcaggaagcgggcattgctgggcaccatccgccgccaggccatcaccctgagcagcaccaggttggcagcctctgagatgaagcccttgattgagctccaggggaaagaagtcactccagtcttcacttcctgttcagaactga

SEQ ID NO: 105371 - DNA, 1014 bp, Homo sapiens
tgtgattcttggaacacattttaaaaatatgtttactatacccatgaggacttatgtctggactctctcatctgtttcatcattcatttgtctttatgtcagtaccaaactgttttgattactatatgttcatagtatgtttagaaaatagaaagtatgatgcctctgtctttatatttttttcccaatattgtttggctgtttgtgatcacttgaaattccataaaaattgtagaatattttaaaacttctgcaaaaagtttcattggtattttgatagaaagtatattgaatcagctgagggttgtggctcatgcctgtaatcccagcactttgggaggctgaggaaggtggaacacctgaggtcaggagttccagaccagccatggagaaaccccatctctactaaaaatacaaaattagccaggtgtggtggcacatgcctgtattcccagctactcaggaggctgaggcaggagaacagcttgaacccaggaggtggaggctgcagtgaactgagatcacaccattgcactccaccttgggcaacaagagcaaaatccgtctcaaaagaaaaagaaagaaaagaaaagaaagaacattgaatccgtagaccacttttggtagtagtgacattttaacaatattaagtctataacctcttgaacaagagtgtgtttgagaatttgttgtttaatttttacttattctttgacatgctagtgtttttaacttcttgttttattgtatcatagttaggaataatttgtgtaattccatctgctgaaatttgctaagatgtgttttttaacttaacaggtggtctatctggaatattgtggcatgtgtgattaaaagtattgcatattctactgttgagtggagagatataaatgtgactgttaggtctaattgttctattgtgttgttgaaatcctctgtttacttattcatcttatgtttgttttttaatttacattactaaaagtctgataaaaaagtcatctactgtta

SEQ ID NO: 105372 - DNA, 888 bp, Homo sapiens
tgtgattcttggaacacattttaaaaatatgtttactatacccatgaggacttatgtctggactctctcatctgtttcatcattcatttgtctttatgtcagtaccaaactgttttgattactatatgttcatagtatgtttagaaaatagaaagtatgatgcctctgtctttatatttttttcccaatattgtttggctgtttgtgatcacttgaaattccataaaaattgtagaatattttaaaacttctgcaaaaagtttcattggtattttgatagaaagtatattgaatcagctgagggttgtggctcatgcctgtattcccagctactcaggaggctgaggcaggagaacagcttgaacccaggaggtggaggctgcagtgaactgagatcacaccattgcactccaccttgggcaacaagagcaaaatccgtctcaaaagaaaaagaaagaaaagaaaagaaagaacattgaatccgtagaccacttttggtagtagtgacattttaacaatattaagtctataacctcttgaacaagagtgtgtttgagaatttgttgtttaatttttacttattctttgacatgctagtgtttttaacttcttgttttattgtatcatagttaggaataatttgtgtaattccatctgctgaaatttgctaagatgtgttttttaacttaacaggtggtctatctggaatattgtggcatgtgtgattaaaagtattgcatattctactgttgagtggagagatataaatgtgactgttaggtctaattgttctattgtgttgttgaaatcctctgtttacttattcatcttatgtttgttttttaatttacattactaaaagtctgataaaaaagtcatctactgtta

SEQ ID NO: 105373 - DNA, 84 bp, Homo sapiens
ggcgacactccatcttcctccagcacctgtgacgttctcctctgagctgtcgggcgagtaagcgctttgcttcctcactttgtg

SEQ ID NO: 105374 - DNA, 425 bp, Homo sapiens
atccagacacccacgcacagacacactcacacccacgggcacacctagacatggatacacacacaggtagtcacaagcactcacatatccagacacccatgcgcacactcacactcacaggcacacccagacatggatacacaggcacacacatattgggacacccacgcatagacacattcacacacgggcacacccagactgatgcacacgaacacagacatgcactagtatagccagacacccaggcacactcaaactctcacagtcacacattcacatacactcacatgaatacagtgcatgcacacacaaacacatacctatacacttgtgtgtgcagagaacacacactcacacatttgcacttatactcacatgaatacaatagaaacacatgcatacacacttgtgtgcccagaccc

SEQ ID NO: 105375 - DNA, 362 bp, Homo sapiens
tagtagcgatggggtttcactatgttggccaggctggtctcgaactcctggcctcaagtgatcagcccgcctcagcctcccaaattgctgggattacaggtgtgagccaccatgcccagccgagttccacttttatcacagataaatctttttataatacactgcacataaggcagaagcattccttgacctcagcaggcttacaacaagtccctgaagtcatctaagaaagaaaaaactggaccatgtaacttactggcaaaaagaaaaagcatcacaactcagtaacagagagtcacagtcttattgcacttgatgatggatgctatggactcctgatgctgacttgcagcatttctgtt

SEQ ID NO: 105376 - DNA, 1048 bp, Homo sapiens
acctttcagcaaatacaatcttttcttggcattctgttaagttgtgttttttatttttgttttttagtgaaagaattggattgctagtttcatgttatttatattacatctctatgtgacaaataggatgaacttttgacaatatcagccagatcatgttactcccatgtctaaaaccctcttagggccttcatcttcacttggaagaaattcccagcttcttcttttgtcttacaaacccatgcgtgagctgacccttggctgtttgatctcattcagtactgccctccacctaccctattttgctgtagccacactgagcttttctcttgtctttgaccaatacaaacttctttctgtgtcagggtctttgcactactcttctctctgatctttacttgtcttctggggtttagttcttggcttcagtttcacgtctctgaggccttgtgtcactctcaaatctaaaatcatcgggcagttgttttccatcatatccttgtttggatctatcactgattggatatttctatcactggtatttttcagttggatctatcactgatctatcactggtcactgattggattgaatctgtcagtggtattggatctatcactgatatttttctccgtggttttgtgtatcttatttctctcactagagaggaatgtcagcaggagccttattccttcttgtttccaccagtgcttgacactcggtaggttccctatatgcatggaatagattattatttatggtgtatgtgaagagcagctgtgatttcccctcaggtgaggaacataaaagggtagtgtaggtttcacagcagtgcagcttaggtcttacatatctgttgaagaatatgtcttggaacaatcagatgttctaagaactatagtgtttactgttaaaagatcatatgtggtagtcaggcatggtgttgcacacctgtagtcctagctacttgggagtctgagatgggagaattttttgagcctgagaatttgagatcagcctgagcaacatagcaagaccttgtctctta

SEQ ID NO: 105377 - DNA, 748 bp, Homo sapiens
ggtagcagcagcaagaataaagggagacatctccgaggggagccctaaactcggagcaggaagagtgaggaattagatgcacagccaccctttcctccctggaagtgttttctgccgggcttgttttcagactctagaaaatgtcttgtttcagttaagaggggatcctttgccctgtatggtactggtgggggcgggaataagaattgcaaacccagagagcctggggtgccccttgcacccaccacgagcccattgggaaagttgcccttaggggcacctcttcacaaatcctggaggctttggaatgagtggcctaaaggcagcgggcagcaggggatcctaggccccgagtggcaggctagcccgagcccggcctggtctgggacagagctagcatggtgcgccctgtcgagcttcagcattcctttctgactgcatgggtataattagaggttcctttgcctttagtggtagctcatcagatcctatagtttccaagaactgaatctctgatccagaagcgctggcagtggggtagggcgcttgactgagtgagagcagggtgcacaagggagccccgacccagcttcctggggttgtcctccctcagtctgtggatggtgacggcagccctgccccaccgaagtcaggagcgtgggctgagtcactgtggctgcaggaagccgaccctctgcaagggctgggccatggagggctgggttctggcgctcagacatgcagctgt

SEQ ID NO: 105378 - DNA, 206 bp, Homo sapiens
tgggtgtgaattttcaatctggaagcatagtaatgctttggggaagaaggaaaattatacaatcatccgataaccaaaacagataagatgctaaaactacaaattataaaaaatcattagaaatacaaaactttgtgatgagaactaatcatggtgtataactagttgtgattatccatgagggaaaatacacatttaggtaacaa

SEQ ID NO: 105379 - DNA, 433 bp, Homo sapiens
tgggactgagattcactctgttgcccaggctggagtgcaatggcacaatctcagctcactgcaacctccacctcccgggttcgaggaaatctcctgcctcatcctctcaagtaggtgggattacaggcacccaccaccacacctagctaatttttgtatttttggtagagagggtgtttcaccagccaggctggtgttgaactcgtgacctcaggtgatccacccacctcggcctcccaaactgctggttttacaggtgtgagccacggcgcccagccttgttattctactttcataactgtgaatgatcttaatgaagggaagtaagcccagcttgataggtgtttcctaaaagtggcccgaggtgacattatgtgggaatatatggatctatgaagtatgaacgatggcagtttttgccctaacctaccca

SEQ ID NO: 105380 - DNA, 768 bp, Homo sapiens
tattacacaaatatgtaaggctaaattatatatagtgaaaatggccctttgaaattctttatgtcacacataacatataatgtaagactgagatgttgcatgacaaatgcacagattaagaaaccaggttgcactcagctccgtgctcacacaaagagaggtttgcaaaccctcccactctggggagcagcgcatcctcactctgggcatatgctattcggctacttaagaggaatggagccaacacgatttaaattgcactgtctctttttgctgctattttgtggaattcacacatgtaaaaaaaatgctaataatgtgactttacttaactatgcagtaaaagagataagctctaatggtagagcttttgtaaatttctggcagtggactttctagattgctggatcttttcaggagacttgaatgtaagctccacagttgggctctgtagctaggtccagatatatccttagaaagtcattaaaaccacccaggctgtatgtaaaaatgttgctctcttgatgatactctgagaaaaactgtaaaagatgtaaagctttgagcttcttgtgaaatattctccttaatgattggagacgatgtatttccttgatttgtgattataatttggtaacgttccatagcctgtagtcattttccatgtattgttttgtgtttgaaactgcactttagcagttgtagaaccaaagttgtgggaagtggactccttgttaagcccacataaatgtttacaggaactgtata

SEQ ID NO: 105381 - DNA, 362 bp, Homo sapiens
cttggattgcatcatctgttcagcttaacaccttatctaaaactgttgactttgcagttttctgcactgtgccgtagggttttgcagaaatttcatccccttatttttcctttcttctgttccacattgatttacctgctctgtaatgctttgaattttgttttgcctctgtttctccaaaaccctcttctgaatcagttttgtttccttttttaaaaaacacaatgtaacacatatctgttctatctgttgataaaagtaacatgtttgttagagaaaactggaaaataaaaacaagaaataagttacctcttgtaatcacttccaccactcagaagcaacatcagccagtgtgaatattt

SEQ ID NO: 105382 - DNA, 1120 bp, Homo sapiens
accaaatggcatcaggacattctgactacgggttgtggcttatggccagcagtccatctggggaccagtccatctggggtccactccatagcataagtcacatgacctgtgtaaagcagctgacagaaaaacaaaaccaagaatgccttgaaacatcttatattttatgaatgaatactaggaagtcctttttgtttttctgttctttggttttaggtatttcaaaatctgttaaacaggtgaggctgactagggaagccaacaaatatagcttgtgattttggacagttgtgtttccaagttgagggcacttttttgatcaacttccaatcatttataaagcaaaagatagtatccaattagcgcaaatttatgaagtttgttttatgttacatggggatatcataaagaagcatgtttttcattactgctgaatacagcctgtaagatatgcatagcctgatggtcatcgttcattcctacagatatgatgcctcttggcatatctcttaggtgaaagagtttcccttctggtaatgtcctagggaaaaaggtcacttgtgtccaggagattaaaaccaatattaacttctacaatatgtagaggacaggttagtcttggaaaacactttttaattatctgatcatgtggctagaatatgtaggctgataattagactaccttgctatctgaacaccagaaatctcccctgagcccaggctgagatacagtactttcttctcttagatgcttttggttataagttttttcctgaagttgacaggaacatgaaaactacacaacatttaatttttccttgaagaagtgcttatattttcagaacacatagtccctaattagagtaaattactcctgatggaataagcattctgcaaaagcaggaaagaaaccaaatttaatttcccagtgccatagggaggtcttgactattcaaaaactgtctctaaatcttaggaactatgctttcaagggctaaactaatagaactgagcaggaaataagcctgattagcattttgtaagtaattttgagcacaaaagatatatttacaataatagccaagacttatcatctgcaattgaacccaaacactagcaa

SEQ ID NO: 105383 - DNA, 428 bp, Homo sapiens
agttactgctatatgctaaggaaattaaccatttatgttttgctaaaatagagtttacacaagacctctttcaaataatctaacctgggagcccacgtttccataacactatcaccatagtctgtgaccctgcagtgtccaaaaaagggaatttaaagttaaactagagatggaagactggtgtacataaataacaaggcgagagtaaaccatcacattccaggagaatctgttgggaaaacaaatacaaaagtctttctgagaaggaagtgatccctgggacctggagcataaaatcaagggacagcttccccaattcagcaggaccccagcctctcatgtcctcactaatttgccaggcctctggagttggacaggcctctggagttggacaggcctctggagttggacaggcctctggagttggg

SEQ ID NO: 105384 - DNA, 375 bp, Homo sapiens
tgagatggagtttcgctcttgttgcccaggctggagtacaatggcaggatctcggctcactgcaacctccacctcccaggttcaagcaattctcctgcctcagcctccctagtagctgggattacaggcatctgccaccacgcccggctcatttttgtatttttagtagagatggggtttcaccatgttggtcaggctggtctcgaactcctgacctcaggtgatccacccacctcagcctcccaaagtgctgggattacaggcatgagccaccatgcccagccccacagtcccttttcataggcaggaagaggctcatttgcctctgtgtacctagaagctcttcactaatttttttttttttgagatggagtc

SEQ ID NO: 105385 - DNA, 692 bp, Homo sapiens
agtcacccaggttcgagtgcagtggtgccatctcagctcactgcaacctccgcctcccaggttcaaatgattctcctgcctcagcctccctaatagtgggtactacaggtatgcaccacgatgcctggctaatttttgtatttttagtaaaagacagggtttcgccatgttggctaggctggtcttgaactcctgacttcaagtgattgagccatcgcccctggtccctttgtccattttttaatcactttttgttgagttgtgtgtaggtgtgtcttttgctttggatattgaccccttatgaggtgacttgcaagtattttattctgtaggttgtcttttcactcgtttcttttgatgtatagaaatgtttacattttaggttttcaagttccatttgtctgtttttgattttattgtatgtcatatccaagaaatcattgccaaatgtaatgccctgaagcatttaccctatgtattcttctaggagttttattcgctgttaatgtttaggttgttgatccattttgagttaatttttgtttatgatgtaaggtaaaagtccaacttaattttgtttgcatgtggacatccattttttcccagcactatttgtggaagcgatgtttttccctgttatgtaggcttgggactcttgttcaagatagttgagctcagtcatttacttcttt

SEQ ID NO: 105386 - DNA, 778 bp, Homo sapiens
gtgagggaaggacacagttcttatagtcagttaaatagtattaaagaaacaaatttatctgtcagtcttgctgggtccccaagggcttggggcatggggaagaggaaaaagagaaggaagagggtgagaatgagatggaaagcaggaccatcatggaaggaattcacgagtgtagcctttttaggttacagaaagcagcatccaaagtcatgaggaggcaagactaggaggagctgaagcagctggggctccggggaccagcatgtggctcttttggtcacatgagctgggaaccaggggcataggaagcagcatccaggacccagaataatgaggctgatgaggattaggccaagcatctaggctgttactgaaaactttagtgaacatcactgcgttcctggctttgtgctggaagaaacagaaggaatcagacatggtcttcctcaaagttgaagcgattcctccaaaactgaccaggcatgtaaaaacggcaatgacagtggggcacggtcagtgttgtgaaggtggagtggacaacgcattgcaggagctcagaggcagaactcacccactgtgcaaaggtgcagatcagcgctcctaacccatggggaagctgagaaagcagccaactcctacaagccttgcccctcccacccagggctctgggctgtgcttcttctgagaggcagcatcctgaggaagggctgcatggaaaagttgcggtggataaaaatcacaggagttatccatccccaggggctgagtggaatgggag

SEQ ID NO: 105387 - DNA, 281 bp, Homo sapiens
aaaaaatacacctatcatctatctactcaatatcctggaattctggaacaggagtgttctggattcatttgcaaaaaaactggttccccaggtctaatcaaattaaattgagaggtaaatttaaattatatgtattttttatccaacagagaaataaaaagcactttgccaaacagttaaacacttgcgacccagataactaaactcttcagacctaggaattctaaaattaaattgctttcatgaaagtaaaaaattcagtcttcttccaacaaccaaag

SEQ ID NO: 105388 - DNA, 249 bp, Homo sapiens
gaggccattaccctaagtgaactaactcagaaacagaaaatcaaatactgactgttctcacttataagtgggagctaaacaatgggtgcccatggacacgaagatggagagagcaggcaccgggcactttacagtagggaggcgggggcgggggagcgcagaaagagtccctctccatgcgataccggaagcccagtccccaccagtgcacaatattcccatgtgacaaacatgtacacgtgcccctga

SEQ ID NO: 105389 - DNA, 404 bp, Homo sapiens
  misc_feature (364)..(364): n is a, c, g, or t
aaaaaaagtaacaagaaaagacatcagagagaagttgaaaatgctcaaatggaataaatcttgattaaaacagggctgagggcaatcttctatgcataggctttccctgttattctcagcacttaaacagttttatatgtcagagatcaaagttgttttccaaagctgtgcttctaaagcagtaggtttggcctttacattgtcattcccttacctcattctctgtagttaaaggatatcagcattttagagcacaaaggccactttaaaacaatgtggaattaaaatggtacttcaaaacaatgaggacacaaaaatatacatttgggcatggcaaggctagcttccttgctacgtttagacnaaggatccagaattctcgagtagtagtagtagtagtcgac

SEQ ID NO: 105390 - DNA, 946 bp, Homo sapiens
tagaataagggtctggagaagtaaggtccctatttttatccattgttagcattttatggttaccaagaacctaataccaggtgaaggagttcagcagaagaatatatatttgtgacattgttctggctggacagtggaggctgagctggtgaggggagaaaggaatcctgaagaccatattggcagtttttttcagagcccaagagagacagtgggattctgacccagccactagaagggggccagaggagaaggaatagatgtgatgttttgaagataaaatgagcagaccttaagggacacggaagatcaagcagcaaattcccaagccagaagtctgggcctctacatcctggtgagacctacgacatgacaaatgaggccaggcccaggtccgagaggcactgctttccttgcagctctctggagctaccctgtcttcacagtggctaatgcctctctgatgttgggaagggctggagacaagggaggagacaacccaactcatagcaggctacctggctatcgtaggctaccttgacactgactaggttccctacttgtaccatgtgtggttttccaggattcctgtgatctctggtattttccctccaaggactggggttccctcaaggcaagtcaccctactgaaccaatagcaaggttgtaatcatcactactgttagttgaggggttcctgtgtgccaggcaccatactaaatgccaaatgtgttacatctcatttaatcttcacctgaggagggaagttctcttatgccatttgcaaagccagtagtcccagtcaggattagaacaactctgatgtacaagtctgtgcccctttctcccaggtgaacttctcagtgcacccccaaggactcctctccccatgtaagagttctttgttaaattgaaagagcagttcttgcctgtagtaaaaaggtca

SEQ ID NO: 105391 - DNA, 387 bp, Homo sapiens
gtctactcttctgtcctctgcaactcctgcctccattcattcaaaagaggtttgctgtacagagactccttgacttatgggtttatcataagtcaaagagtatactgaatatgtattagtttcacacattgtaaagtcaagaaatcataagtcagggaccatctgtatttgtttaagaaattagataattaccatgtaaacacagtatttaatttcatgaagaatttactaaaataaacaccatggatgtgaacatccacatatttggataacagtatctggccagtgtttcaaatgctgggaaaaaaattcaaatcagaatgcataaagctgcaaagatgataaactacccttaagtttacagtcaaatggagatgccaagcataa

SEQ ID NO: 105392 - DNA, 212 bp, Homo sapiens
tatcctaatatttatatgctttaaattttcagtggcatacaattgcagttttttttttcagcatcgagatgagattatttgaatccaagttaaaagcttactttgacttttctgtgtttaatgaattgatggagaaaagagtggaaatggagagactaattaggaacttgttgtagtccaggtgaaagacaatagtgatagtttaaaagtga

SEQ ID NO: 105393 - DNA, 245 bp, Homo sapiens
gcagaacatgtaaagaagaaagaagtggactggttgatagtttaaatgaattttttataacatttttagaagattctcttaaaaattatggtaaattatataccaatttcatataatcattaaatataatatcaaatattatataattaaataatactaaatatataaatatatactaattttaagcaatatatccatgttcatttaaatatttgaaaactatatatatgtgtgtacatatatat

SEQ ID NO: 105394 - DNA, 263 bp, Homo sapiens
agagttcgggtctcatattattgtccaggctggcctcaaactcctgtcctaaagtgatcctcttgcctcggcctcccaaagtattgggattacaggtgtgagccagtgagcctggcccatttttcttttctgtaataattgtatgtgtgctcactgctggattttggcaacatctgactgacagaggagcctcattacttgcattggtagctgcctctcatgttaagtaatgcttattcttcagtgcacctgttgtcattttt

SEQ ID NO: 105395 - DNA, 162 bp, Homo sapiens
tgctgggattgcaggcaattcttttaaatttaattcagctgaagtttttcttttatcaatagggctaataatccccaccctgccagtatcactaggatgttgtgaggatctgacgcaatttgagttacgggaatgttgagaaagaaaagggcgtaatggagt

SEQ ID NO: 105396 - DNA, 401 bp, Homo sapiens
ccaggctgctacctgagccaccggcccaggcctcctgcctggagcacaggcgtacacagccccactgcctcctgcctcctaagagggtacagctccagttccccttccagggagcaactccctccctccagcacccacagcctctgggaagggccccaagtcggctcctaaatggggtggggatgcagcggaggcctcgggagacggatgcccctcctcaaaggcagagtaggggcatgggctctggagcaattctgcacatgcgtgtttatgtgtacacaggcatgtgtttgcatgcaggcacgtttatgcatgcacaggcatgtgtgtgtttgcatgcagatgtgtttatgcgtgtacaggcatgtgtgtttgcatgcaggcatgtgtttatgtgtgca

SEQ ID NO: 105397 - DNA, 438 bp, Homo sapiens
aacatgctattggccaaaagcatttcaaatgaaatgaacaaattggatgccccaaaaattacatttatgattcatcagaatataagtagaagatagtatgctacatgtagaaagatcgattttttgtagtagtctcatgggtttatattattgttaaaagtaattgtaaaatgttaataaacatcaaagaaatggaggccacctaatcctcataaaaatttatccttgatacattctgaaatcttctgagagaaaaatatgtgcattatcagcaacaactttaattgtacatttaatttttcaaattacgctatgacttaattagaattcattctcctttgagatctctttctttttcatatttctttaactgtcttaggactgtaagagtcttctgcagcaattactaaataggtttttccgttttaaaatttatcc

SEQ ID NO: 105398 - DNA, 471 bp, Homo sapiens
actcgtcaacccaaatcataccaacactgaaaagaagagacaataagaagcattctttctttcaacatcacagacattggcaactctaggatgtctatacagagggataaaaaggggtggcagttggctgggcgtggtggctcatgcctgtaatcccggcactttgggaggcccagggaggtggatcacttgaggtcaggagttccagactgacagtctggcccaccatggtgaaaccccgtttctaataaaaatacagaaaaattagctgtgcgtggtggtgggtgcttgaattcccagcttcttgggaggctgagacaggagaatcgcttgaacttaggtggcggaggttgccgtgagcttgagatcacgttcactgggacgacaaagtgagactctgtcttcaaaaaaaaagggagggggtggtggcaggctttcgaagggaggaactagaggtttgtggtctagctt

SEQ ID NO: 105399 - DNA, 179 bp, Homo sapiens
acacagtaggcaccttataaacgtttgttctcttaatggcaggcacatttgcctctggccttgaagggcttctgagctcccaggtgaatgtagttgctggggaaagacctgggcgagtgcttctaagactggagcaatgggctttagagtgttcctgagctgctgggccagcccccaca

SEQ ID NO: 105400 - DNA, 747 bp, Homo sapiens
ctggaacgaatgaataaaatgtgtagcgtggctaatggtgctaactgctatggaggaaaataaagcaggggtgggagaaggaagtgggggctttgcctcttaaatcgggtggtcagggaaggtgacacttgaacaaagaccccgaggagctgagggacaaagccgtgcagacctctgtgggaggcactctaggcagcaggaacagtaggtgcgaaggccctgaggctggcctttgcttgcttggtgtgtttccggaatggcaaagaggctcctgactggagttgaggcagagcaatggaagagggagaagcgggcagagcagtggaagagggaggagagaagggggcagagcaactgaagagggaggagagaagtgtgggagggccctgaagatagatgagcacagattagagcaaaggtaacaggaagcagcaggccagaggcaggaacatgcccagtgcagtggaggaagggaaaggaggcccacgtgccatgctcagttagcagccagtgcgaaagaggtgaggtgaactgggagtttctctggagccagctgggctgctttcaaggttaagtgtatcaggtgctgtcaagtctaactcaggcctaactctcagcttctccacatgtgcctttaggcaactcacaaacctccctggggaccgcttttctccttacaaaatagggctgcagccgcctccttcatatatcaccttcttagggccatagtgggaatggcaaatgcgg

SEQ ID NO: 105401 - DNA, 733 bp, Homo sapiens
aggagagagccttgttcactatatttaggttaaaagggacgtgcttcactctctgctgcattttctcctcacataaaggagaaaataagatgataaacagttcggccatctccctggccccttcccgacctaccttacccatctaactggttccttctctgtgttgttcttttgaagaggtcttcttggcctaccaggattgcccacgtttctttggacccattgcacacccataaggaccacccccttcattcttttttcctatcataatcagcctctcctaaccagcttgtttttctagctgggcaacaataactcaaatccctgcaagtgtgcaggtgaatggagcaggcagggtgaggaattgatggcattgaagcaggcggaaagcgcttgcccctcccaaggggcagccacagcttggctgcagccagctgttaccttgtggaattgagggccctgacttgccacacatctcctgatttttcaagagaaggcagaaatcaggatttttaagggaaatttcctcatttttaatgttggaagctatttcaatgttttttaaattatattacgcaaatcaacagaccgtggccaaacagcacgtttgtgaactgtgttttgcccacagacggctggtttgtgaccatcttcaggtctttgagcacaagtgtgcctcgtttcctcaaggataatacacatgaatgcagtgctcagctagagcatcgcctcc

SEQ ID NO: 105402 - DNA, 792 bp, Homo sapiens
caaatttaaaagaatttggaaaatttatgaaccattccaaaaattataacaatcaccaaaagagctgtaattctggcttgttctggaaagaaagaaaatgtgtgtgtatgcttgcttgtgagagtgagtgagtagtggctatgtatgtgtgttttatgttgtgttcataaacatgagagaacatcactcaatatgaagttgggttcgaagtcactggctattaaatattaagtaggataactttctcaacagagtagcctggagaatgaaagagaaggtattaaaatgctacttgtaagtaacctttgatagccacattattttgttcctggatggttcttggtatcccagataaaaaagcacaaaacagtttcttgaaagcaattattttaatgttgtcttgaggatattcattatgcctgccatcagtaggagggacattttccttaagtagaatagggagaagggaaaaaacacctagaagagatgatttaaacataaatcagttctgaatgtgacaaagatttgtaaggacaaacgggaagatagtgatgttatgcactaaggactgggtggtgatgagaaagagaagggaagtgtatcacctggttttcccattttaaaaaatgctattataaaattccccctccaatgattatgcattgtttaagaaggaacattctttgaatttcagcttatacaagaaaatactcaaagaatgagagtaaagttattttcattcctttcaaataaaatttattttatgtattatgtaaatagcaaataagctgt

SEQ ID NO: 105403 - DNA, 184 bp, Homo sapiens
tttgggccttaaacagtactagctcttatgagcaaaaaaaggacacaactgcagcctgggcaacgtggtgaaaccctatctatattaaagtacaaaaattagctgggcttggtggtgtgtgcccataatctcagctacttaggaggctgaggcaggagaatcagctgaactagggagatggagg

SEQ ID NO: 105404 - DNA, 6730 bp, Homo sapiens
  misc_feature (947)..(947): n is a, c, g, or t
  misc_feature (1735)..(1735): n is a, c, g, or t
  misc_feature (2061)..(2061): n is a, c, g, or t
  misc_feature (2732)..(2732): n is a, c, g, or t
  misc_feature (2736)..(2736): n is a, c, g, or t
  misc_feature (6034)..(6034): n is a, c, g, or t
  misc_feature (6120)..(6121): n is a, c, g, or t
  misc_feature (6138)..(6138): n is a, c, g, or t
  misc_feature (6146)..(6148): n is a, c, g, or t
  misc_feature (6224)..(6224): n is a, c, g, or t
ggataatcatgccacctcctggggctgctgggggatccagtgagctgatttccatgaaggcggaatgttggcgatgcgagtttttagctagtccccgacacacactgagaacaggaaacgagccactgggtgctcagctctccaagcacggccgtccctgagtgctgggggatgggcaggtccagccatgttcccggaataactccggcctgggcggcggccagcaggtcagagctgggccagaggtgccgacggtgcccagggtaaggggatgccgggaagacgttgaagacaaatgtgtgcctgtggggagcagcatgtttatggcaaataaaactcctgataacgattcacgaatcctggcagccctgccttccttgccgtacctgggggcttgtactgccaggggaggcttcgtctcatttccttcactgctggggaaggactgcccaggactcaaacaggaaaactgagcctcggagacgttcaactccaacagggagcagcagccgctgctgttcggtcgcccagcggcctccctggaggagagtccctcagtgatgcctcttcaaaggctctgcgtgctgcccactgtccgtaaggagtgaggcaggtgtggtcagagtgcctggacccgcatcgccctttgcctccccagctgcaatctcacttgctcacttggggggctttggctgagctttgcaggttggcctggaccggcaggtgggcacaggcccattgcacctgactgggtgtgattaaggaaacaggaatggaaatgcttctccaactggaggaagtcagaaagccacagggcatcctcagacgaaacccctgcttcctccatcagagcgggggcaagcagatggggaggggagatgcttttcctcagagacaccaatgcctctacacccaggcctctccatgcaggtgttatggacattccnggctggataattcttcgttgttagggccatcctgggcatggaagcatgttgaacagcatccctggtttccacccactagatgccaatagcacccccgacaaccaagtgtgtctccaggctttgcccagttcccttgaagggcagaatcacccctcaccgagaaccactgctccacccaatgcaaagatgtaactctcggcatgtttaggaccaagtattgggatgtgcagaaggacgcgcaggacgtggaaccctgtgtgcttgggtcgtggccgtgccttccggatgcttcgagggaaatgacctggctcctggtcagacataaaagtgggaagtgtattttccctctgatgttgtcactactggctggtgccgcagacggactcagaaagcaccgtttcattttgctcgagtaaagaaggcaggcgcagagtgctgctcatatattgattgactcatcaaatgatctgctgcagctgcctgcatttgtttacagggcgaaaattaatgccacagatgtttactgtataataggatttgaaatctgttggggggagcacccgttgaaaccattgggccaagaatgagaaaaacactttgcataaaggaggatttggttcactaagtagcacacggtgcttgctgtcaaatgctaacaagaaacatgggcctcctctcccttggccagcgctggcgttcgcgcctggctccctggctttcttctacactgtgctttgatgtggcaccttccaaagtgttttcatgatggagagggcttcctctgaaangtagcacccgagcctaattaactgatgcgtgattcttcattagcatctgggcaggcctggggcccccagttccctttccttcctcggcccctctttgcagcgggcaaccctggattgcccagcgaggctgcctggcccttgggtgtctgtgtctggggttcccctggtgaccccaccagctcctgttgtgtccctgccttccactgcctggagccaggtctctgaatgaatatagccatcctccgagacgggagctgctttttcttggcacagcatctaagccctgcaaccctgagtgtcttgacggcacagccaattcctcgctntgcccaagggcttttcccaggcatcagggcagacagggacccccagtgcttcttagagcctcctccagaggaaatggctttggggtgtgtctcccagtcgaggacggaggacatggcaggctgctggtgctcctggtgaccattgggaggccctggagggagcctccttcccaggaagtttccttccagtgggttcgagtgtgcatactccgtttgtattttcactttccttatgtttttctcttcagccagctctgattggattcaccacagattaacattttccattatacgttataatgtgtttttttaaaaccaaatctcccttcacagattgctgtctttataatataggaattatttctcagtcactttaaaagtcctgcttcattagcttggtgactgtttggtaatttgcaaagtcactttcgcaagttttaatactgcccggttgaggatcacagcaataaatgtattaggtttgaatagtgttatgattctgtctgaagtgaaaaaattagaatcagtcattagctctgacctcagcatcagcccacaccgtgcaggagatgatgcagatagatgatgcgatcacagcctccgccatgggaagaatcctgggtaaggccttggagccctttgtctcagctctttgccaagactcgaagcantagntcctacatctccagtaccttccacgtttctgttctccttagagtggcttaaagctcccccttccatataagtctctcatgtctagactcagccctccagggaaggcaaatggagactttgaagcccccaaccttgggctccccctccagcttttttgacagatgatggtacctgctgagagaatgtgaccagaggctttcattgggattttgggggccattctgttttcttcctcctcctgtgttgaggccatctctgagccatgctgagaaaacagggaggttgccaagggcagagatgtccagcccctgctctgaggctgtcaagtgcctcctcagggagaaggggagggtgcgcattgctcgattttgctcaattcccagcaggcttctccacctcccaggaggcgcctctgagtccctcccagcccgagactctttccccctggaagagagggtgggcaggctcggggagaaccccagagcctcatgtggccatgtcgtgtttcatttgccctgattaatttggcatctgtatgaaccagagggagtggtgctcgaccctaacctttcacagatgttccaggccgaggttttctggcaaaatcgattttgacattttgataagaaccgttttgctgtgttctgtattttgaatctttgactctaagctgttctgaaaaccagctgtgaagctaaatcttgtttgtaaaatctgcatactgcatcagcagcagaaaacgccagagcctcgaggtcatttcatagacacttgaagcaagttaggtgggatgcgaggatattgaattgcggtggtttgtcagacttctgccatgggaagcattgtgagagatgcataatgaatgtcttgaaccctcttctgtctcttgcagtgtttggaatgcaaaaaaaattagacctttaatggaaagatttggtattcatgagaaagacagagtccctactacttaggaaacttggttgccttgtaaaacagaacatctgtatcaggagcacggtgatcttttgtcatttggtataaggaaaaaaattaaacattggattggaaacatttgaggtcactgtgtaaaaggcacacacctgctgtccaaactgaagttctcatttgcaagcgttatttgagggggaaaaggagtggtttccaaactgccttagcttccaaagaaatggcttgcttccctgcctccctgcgtacctgcactcagaaggaggctctgtttcctgcttcactgtcggagacctcctgaagaaataacacaaaccgacggggacaagcagagtatgcaaggagaaaggtccagagcccaggcgggagggaaaagatgaggcgagtgaccggcaacctcccacctgctctttctcacagcagacagccagtgggaggtgatctggtgggcggggacattgcagctgccctagggctgcctctgacatgagggccactgcaagttcttgaccctctttgtctttcttccaccgtgggtcccttgcatgacagggacgcattctaggtcttgggagcatttcatgaatgacagtggacatgctgttaaaaggctggatgtggcccctgagaaggctgcatggtgacaccaaacaaagaccaaaggaaccaggagccactaggcctgggctccggccacgattctgctcctggcttcctctgtgatgtgggcacagccatctccctttggggcactgggtgtcctgtgtgtacctggggacagtgggatggatgagcagggccctggaatttccgagtgcctgtggcaagccattgttttctctggagcatcactgtacagttagggtgggtttgtggcaggtacttagagaagtcctagtaggagacagcagatcaaaatacagggagatgctgggatccacccactttatagttaaggggtaccctttctagagtcagaagatgaacagattgaccctggaggtaacccccacccgagactcccgtctgtaggtgttgaggtttgcatttgatagcaggaaaaggtgctattaagatcctggagtcattgataaatgaggggtgcatcagtgaatgagcctgtcttagatttcctctctttttcctttgtgaggtcgatggggtttatcttcagctctccaggcctcctcctctgtcccctttccaaccccgccatcacttcccatctctgggcacttagatctttcactgctgtccacatccctttctggcaggagaggatctgagaaattgactcacactaaggcaataatgaatttatgtgtaatctgtcctgtgcgtgtgatacttgctctaaagaggactggatgaagagagtacgcttgcctgaagggaaggggtgctgatggtggggttccaggcatgtgacacccacccgagttccgggatgccctcctgtcccccacaccagcccggaggctggaagctcttgggaaaggagactggtcaagggcttgtgggcagtctctttgggtttattggactccaaatctttactgtccaggagttaaaaggtgatattcttcctctcagctcctcagggagtccatggtttggctgtggggagagcaggtctgtttccctgcagagcccctccccactccagccgggcttgtgggtgccagcatggagcctgcagcctctgcgtgtgcacatccttcattaaatatctctcctgtcctgtgggcagaacatcccctgaccagtttgcagtctgtccacactgggcccttctccagccaggatgagtaaaaggtacacggctgaacatcagtgccagtgagtgagaggctacagaggcacggaacaggatggtggcagagaggtccctgggaagcctgtgccggggcagcaggggtgtggggggctgtgggccggaggaggcagcatcactgtggacaggcaggaaggtggcctcggggggaaggggacagggcagaatgagcctttcccaaaagtgagacactcaaagcctcgtcatgccgggcagcgcccatccctgcctacctgtcccttttgctgtctcggagggagcctgtgggagggaggtcgagatcccagcctctgtgagggcaccgttgggggggggattgggcagggaaaagagtggcgcccacagagcaggacacggagaagccttgagctggaaataaggaggccaatatctaggcctgacctgtcattaacgagccatgaggcatgaggtctttttttttttttttccaagagatcctcccacctcagcctcctgagtggctgggaccacaggtgngtgccaccatgcctggttaatttttaatttttttagggaagaggtcacaccatgttgttcaggctggtcttgaattcttgagctcnngtgatcctcctacctcngcctcccnnngtgctgggattactggcgtgagccactgcagccagtgagccatgaggtcttgagcaaggccgcccctctgttagangtccccttctctatgcctcatggttccacagcctggggtaccccagctccaaatgacacatctccctgcgtttgctgtgcacgtgcctgggtgtgggtgatgctgatttctaatgcatttcttcattcattcagttccacatttatggggcatctcttctagagctagctctgtgccaaaaaggaggtataaagataaatagagcaggcgcggtggctcacggctgtaatctcagcactttgggatgccgagatgggaggatcacctggggtcgggagtttgagaccagcctggccaacatggagacatgtttaatagagacatggccaacatgtctctacaaaaaatacaaaaaaaaaatagccagatgtggtggcacgtgtgatcccaggtacttgggaggctgaggcaggagaatcgcttgaacctgggagacggagattgcagtgagctgagatcgccccactgcactgcagcctgggcaacaagaatgaaaactccacctc

SEQ ID NO: 105405 - DNA, 420 bp, Homo sapiens
atagaatgggctttccctgatacattctaacagagaagtggctttcttttcatattttaaaattttttttgacaatttaaaagttgtatatatggagtacaatgtaatgtttggatgtatgtattaaatcaagctaattaacgtatttatcacctcacctacttttttttttgtggtgagaacattttaaatctattcttttaggaattttgagatatgcagtacattattattaactgtggtcaccatgcagtgcaatagatcactaaaacttactactcctgtccaactgcaactttgtactctttgactaacatctcctcttttcccaatccccaactcccagcctctggtaaacaccattctactctctgcttctatgagttcaagatttttagattctacatgtaagtgacatta

SEQ ID NO: 105406 - DNA, 681 bp, Homo sapiens
gtgtggatacaatacagccacacagaatatcttatgtcatctttaatcttcataaaatgttaggggtacaaagcatttagatatgattcacattcaaggagaaatctaaagcctcaaagctgcagtaacttccccaggttgttcagctacttgggaacagaaccgggtttaaaatctcagcttcttcctctgcaaaatggaataaaaatagggcaactctataaggttgctgtaaggagcagatgagtttttaaataatttgcaatagtccttggctcagtaaatgttagctatccttattattatctaaacccttgtcagtatctcgactgaggccacatggatggccaatgctgttggctgccaagcacggtgctaggtattaggcacatatcatctcaaagaaataagagctgctgacatagcagaagttttgcctctgattctcaatgaattattctgtttctgacataaagtaacaaggcaaaagagacatgaaaagttatctaaatttacaggtcaccaagaaaatggacctcctctatctaattgccacttgaaaggagactaaggaaggaggtgcaagggtacaggagcagtggacatttgaggaggaatttgctgctttagagaatttggcttgtttccactgaattcccctctcccagtggggagaaaaaa

SEQ ID NO: 105407 - DNA, 312 bp, Homo sapiens
cagaaagctgttgtccctgctgttggggtgtgtggctcatgtttagtgaacctggcatggtgcaggacagagccaccggcagacactgcaggcaacaagcttgtgccatctgtgaccaggctccttgtccttggaacttcactcctgactcctcagggaccccgaccctcaggaaatttcaaagaccttttaaaaaatttttattgcagcttattacggttgagtgtcagggattgccgagtcagaattggtttgtcctggaacagagaactgccatcctccccagggcccagcagggacactgtgaccccc

SEQ ID NO: 105408 - DNA, 289 bp, Homo sapiens
gttgtgtggctgagtctgggggtttatgtgggctcagaatggaggaagtgcatgaagtgcatgctgattggtccatgggtaggtctggaaaaaacaccatttgattggctaaaaggcatcaaggaagttctcactccaggttgtggattctgccgggaactggcagcccggttttcaggcttcaggcggcctttggcttgaaggtcaggtttcaccggggacctgctcctatctgcctaggaatttgtctgccattatcacttttatttcttcaactgtcactccattg

SEQ ID NO: 105409 - DNA, 783 bp, Homo sapiens
ctataaaataacagcaagcaccaaggagacataagtagggcaccaacagccactgctacagttcctcttctacctcctttattcctgttcctgacttttagattctgcttctgcttctcatgccctctgaatccattgcatttggaagtccaaggaaaccttaggaatcagacatgtttggactggagaagagtagatagaagctataatccttgttccaatgaacttttatgaagaaaataaactggtgttatttccccttgaagatagtgggcagtccggggagggagagagatataacttaacatagagaaggaccacaccgatcaaaccttatgtattgagatcaaatgcatcagaatttaaagagctccctgctgatggagctgcccagactgagcctgtcagtgatttgtagggaattctggcatcaaatgagaagcaacacaaaatcagggcctctgagatacctctttcatggtcagaacactgtgactgccaaaatgaggaagaaggagcttttaatcatagacttaagctctatatccttctaatatctgttagaatgagaaagaaaaaagcaataatttactgaatctttactatggtccaagcactgtatgaaactttaggtatgttatctgatttaatcctccaaagaaaactatatggtaagaattattgcccccagaattgtaaactcagcttatagaaaatgacatttgcctaaggtcaataattgatagagctacaagtgaattcaggtctactgatttatgcctt

SEQ ID NO: 105410 - DNA, 651 bp, Homo sapiens
  misc_feature (9)..(9): n is a, c, g, or t
  misc_feature (18)..(18): n is a, c, g, or t
gtcttgtancagcacttnagtatggggacaggccctcagtcaaacgagggccgctgatatctaggatacttgagggcactctacgtgtaaagcagcattatgtttgggattcagaaaccaggccctgacaggcgttttaaatagcatcaacacatcttttgtctgtagggaattagtttcttgccactcttcctttttaggcttagcccatgacacagacaattagaaaaccccatttaaccagatggtgctaaaaagatttcatcgtaatgtgctttctaatttcaattggattgaagggggacacatgaaggtcattgttaatatttccccaagactagaccttgaatgaagtgtcttaggcaagtttgttcctgcctgaatgtttcattacccttgcaaaacttctgtcaaagcaaagctgttggacaggttcatgtttaagagccttaggaagctccatcttagcagcaattacagcacctactaaaaataatttacagagacacacagaaagtgtgcatgaaggtgaacagtttgaatgtttctgcctcctataggcaagataaacagcttatcattgtggttgattaattcaacaaaacgactgaacacttgattaactctgaagcggtttggatatgaaataag

SEQ ID NO: 105411 - DNA, 713 bp, Homo sapiens
ggggaagaacacagcacagagtgtgtctattgtctaagcagcctctggacttagccctgtttaggccattggttaattttcagttaactctccatgttcctgagtacttgtcactcctttgggagggctgaggagggctgccaaggggtccagtcccagaccctgttacccacatagacactcagtgctgtggggacctgaggacagagaaagatcaacttgggccaccagcctcagggaaggcttcctagaggaaacagccttgaaggggagacagatgaggcctcaagtcagagggtgaaagaggagatattgctgtgccagcatcagagaagggagcacccgctgctgggagcagagctactgacacacgggaccaatgggaggccgagctgcgtagatagagggcgtcctgtgctgaggagcctggaggagcagctgcagagtcaatctgccctgcaaggtgggtgggcggggttggagtgccttatgcttctacagtccaaggaggggcatgaggaatgtggtggatctggtcggaagcaaggaggtccgaggtcactgtcccttgaaggctgcagcggaggaaacggagaggctgggctggccctaccctacgtagcctaatcaaagcaagaatctgcaggatttagtaacaaactggacaccagtgatgatggaggtgtgagggtggcagttgccatataagactg

SEQ ID NO: 105412 - DNA, 254 bp, Homo sapiens
taaataaggcttccccactttcctcaaattcccatctttcttctttacttccttctctcagctgatgtgttgctttatatctcattaagaaaatagaagccagtaaatggcccactgtcaaatccatttatccattagcatcttcagtgatcttcgtattccctttttgttagagttaatgtgaaaggccattcacactgtatgtagtggttattccattttctctcatctgatcaagaacttcacagcactga

SEQ ID NO: 105413 - DNA, 617 bp, Homo sapiens
atcccatccgagtcgacttgctcaaagcggtcatcacagaggccgtctgctcctttctcttccacagcgctctgctgcacttccaggaagtccgaaccaagcttcgtatccacctgctggctgcactcatcacctttttggtctatgcaggaggaagtctaacaggagctgtatttaatccagctttggcactttcgctacatttcatgtgttttgatgaagcattccctcagttttttatagtatactggctggctccttctttaggtatattgttgatgattttgatgttcagctttttccttccatggctgcataacaaccatacaattaataaaaaggaataactgttccaaagactcagactaacatacaggacagtccagctggatgtgataaagattttatcacctcatatggaaaacaccggctgcactggattcatcagtgttaacttcctttgaggaagctgccttatagttttcatcactgggactttaaaaaaaaattactgtgaaaatgaggtattctgtacttctcagttaagacttgttctttgagtgatgtattaaatgctgctagaaaagcctcattacattaaatataaatcaatctta

SEQ ID NO: 105414 - DNA, 968 bp, Homo sapiens
tagatattttatttgcttgacacatctctaaaaccagttaatggtcagttaaataaggttgagataaaaatgaaaaaactgttaatagttgagattaatgaaaaaagagagactggagaaagtaacctaacattgtttttatttgaacattctaagtgaaaactccgagtgctttcagttgctttattctctaggtatgtccctggggcacggaggaaaaggagagtgttaccattttaaagaggagaaaatgaagacccaagtctagaactaaagagccagaactaaaactacatctttggatttagtttatcctttgaattcattgtttagatcctattggttttaccaaatgcatactgtgtttaaggattcacagttgaagaaaaaataatctgagaataatagatttaaatctgatattagatttaaatctgagaatattagatttaaatatctaacatgtttcacgtagaattgatgtagccaattctttaagcatggctttccaaacatctaggtatataattgtaattttaaaatatacccacctagtgattatgaacctccttaaagattgtttttttattttactgtattttgtctttcaggtatattgtatattgttgatgattttgatgttcagctttttccttccatggctgcataacaaccatacaattaataaaaaggaataactgttccaaagactcagactaacatacaggacagtccagctggatgtgataaagattttatcacctcatatggaaaacaccggctgcactggattcatcagtgttaacttcctttgaggaagctgccttatagttttcatcactgggactttaaaaaaaaattactgtgaaaatgaggtattctgtacttctcagttaagacttgttctttgagtgatgtattaaatgctgctagaaaagcctcattacattaaatataaatcaatctta

SEQ ID NO: 105415 - DNA, 424 bp, Homo sapiens
  misc_feature (61)..(61): n is a, c, g, or t
gtataggattacgaacgagcataacgtcaaacacaaacaccaaggacgtagtgggtaaacngggcagattctttgtatattgttgatgattttgatgttcagctttttccttccatggctgcataacaaccatacaattaataaaaaggaataactgttccaaagactcagactaacatacaggacagtccagctggatgtgataaagattttatcacctcatatggaaaacaccggctgcactggattcatcagtgttaacttcctttgaggaagctgccttatagttttcatcactgggactttaaaaaaaaattactgtgaaaatgaggtattctgtacttctcagttaagacttgttctttgagtgatgtattaaatgctgctagaaaagcctcattacattaaatataaatcaatctta

SEQ ID NO: 105416 - DNA, 500 bp, Homo sapiens
atcccatccgagtcgacttgctcaaagcggtcatcacagaggccgtctgctcctttctcttccacagcgctctgctgcacttccaggaagtccgaaccaagcttcgtatccacctgctggctgcactcatcacctttttggtctatgcaggtatattgttgatgattttgatgttcagctttttccttccatggctgcataacaaccatacaattaataaaaaggaataactgttccaaagactcagactaacatacaggacagtccagctggatgtgataaagattttatcacctcatatggaaaacaccggctgcactggattcatcagtgttaacttcctttgaggaagctgccttatagttttcatcactgggactttaaaaaaaaattactgtgaaaatgaggtattctgtacttctcagttaagacttgttctttgagtgatgtattaaatgctgctagaaaagcctcattacattaaatataaatcaatctta

SEQ ID NO: 105417 - DNA, 407 bp, Homo sapiens
gtccgatgtaaatagttagccggttataaaagacaaaggaggggtgttagtgggtacgtatattgttgatgattttgatgttcagctttttccttccatggctgcataacaaccatacaattaataaaaaggaataactgttccaaagactcagactaacatacaggacagtccagctggatgtgataaagattttatcacctcatatggaaaacaccggctgcactggattcatcagtgttaacttcctttgaggaagctgccttatagttttcatcactgggactttaaaaaaaaattactgtgaaaatgaggtattctgtacttctcagttaagacttgttctttgagtgatgtattaaatgctgctagaaaagcctcattacattaaatataaatcaatctta

SEQ ID NO: 105418 - DNA, 1384 bp, Homo sapiens
tagatattttatttgcttgacacatctctaaaaccagttaatggtcagttaaataaggttgagataaaaatgaaaaaactgttaatagttgagattaatgaaaaaagagagactggagaaagtaacctaacattgtttttatttgaacattctaagtgaaaactccgagtgctttcagttgctttattctctaggtatgtccctggggcacggaggaaaaggagagtgttaccattttaaagaggagaaaatgaagacccaagtctagaactaaagagccagaactaaaactacatctttggatttagtttatcctttgaattcattgtttagatcctattggttttaccaaatgcatactgtgtttaaggattcacagttgaagaaaaaataatctgagaataatagatttaaatctgatattagatttaaatctgagaatattagatttaaatatctaacatgtttcacgtagaattgatgtagccaattctttaagcatggctttccaaacatctaggtatataattgtaattttaaaatatacccacctagtgattatgaacctccttaaagattgtttttttattttactgtattttgtctttcaggtatattgtatattgttgatgattttgatgttcagctttttccttccatggctgcataacaaccatacaattaataaaaaggaataactgttccaaagactcagactaacatacaggacagtccagctggatgtgataaagattttatcacctcatatggaaaacaccggctgcactggattcatcagtgttaacttcctttgaggaagctgccttatagttttcatcactgggactttaaaaaaaaattactgtgaaaatgaggtattctgtacttctcagttaagacttgttctttgagtgatgtattaaatgctgctagaaaagcctcattacattaaatataaatcaatcttaaatgataattgttaactttgatgaaaaacgagtacaggatgagaagggaagtaaaggtgatagtaagatcaacgaatttgtgtatcaagtgtcacccaaatgaacagaatttttaactataaaagtacaaggcgtcaacttacagaactggggagaggatactttcagccaccacctcacaaaatgataccatcaagcagtgtcatctttcaacaggaaagttgcttttagaagtagaatatatattcactcacatgcaagcgatttcctacattttaagtacattaaaatctaatacctaaaatagtttctctaaatagacaatctcactagctccagccaagtggttattctttaatagaatataataaaacaaaacacccatacaaagtcaggatttaagcttttcacattct

SEQ ID NO: 105419 - DNA, 1033 bp, Homo sapiens
atcccatccgagtcgacttgctcaaagcggtcatcacagaggccgtctgctcctttctcttccacagcgctctgctgcacttccaggaagtccgaaccaagcttcgtatccacctgctggctgcactcatcacctttttggtctatgcaggaggaagtctaacaggagctgtatttaatccagctttggcactttcgctacatttcatgtgttttgatgaagcattccctcagttttttatagtatactggctggctccttctttaggtatattgttgatgattttgatgttcagctttttccttccatggctgcataacaaccatacaattaataaaaaggaataactgttccaaagactcagactaacatacaggacagtccagctggatgtgataaagattttatcacctcatatggaaaacaccggctgcactggattcatcagtgttaacttcctttgaggaagctgccttatagttttcatcactgggactttaaaaaaaaattactgtgaaaatgaggtattctgtacttctcagttaagacttgttctttgagtgatgtattaaatgctgctagaaaagcctcattacattaaatataaatcaatcttaaatgataattgttaactttgatgaaaaacgagtacaggatgagaagggaagtaaaggtgatagtaagatcaacgaatttgtgtatcaagtgtcacccaaatgaacagaatttttaactataaaagtacaaggcgtcaacttacagaactggggagaggatactttcagccaccacctcacaaaatgataccatcaagcagtgtcatctttcaacaggaaagttgcttttagaagtagaatatatattcactcacatgcaagcgatttcctacattttaagtacattaaaatctaatacctaaaatagtttctctaaatagacaatctcactagctccagccaagtggttattctttaatagaatataataaaacaaaacacccatacaaagtcaggatttaagcttttcacattct

SEQ ID NO: 105420 - DNA, 458 bp, Homo sapiens
aataaaagtcacatttagtaaccatttatttccagttacaaggaaatggaagataaatcatttgaaatcactctgcttaaaatctgttacaggaggaagtctaacaggagctgtatttaatccagctttggcactttcgctacatttcatgtgttttgatgaagcattccctcagttttttatagtatactggctggctccttctttaggtaagcgtatttttatttaatatgtctgaaagattagggtattttaaaatatgatatgtgtatatcattgtaacatgtcaatttccaaagccacagcaggcacaaaacagaaaatgaaaaaggtagctaacatgcctgaaataatactttgtgtagtatcctttaaaactgttaaaggtagtcagtttcagatatgctatcactttaagaaaccttagatctgagcaccaaaaaagcaacgagtgctta

SEQ ID NO: 105421 - DNA, 732 bp, Homo sapiens
ggtgtgagtcctggtatactgggaagaattacatgcagtttgtctaaaagagctggttagaaaaatagcactaaggttggaaagccagaagggctattgtaagatgagatactgttgatgcttttcctgcttgttcatgttgcatcatgctttactgtattaagaaaattcattttgagtgttcagtgagataatgtctaatgctcttaagtttttagtttttaattgtgggctttctttaagagcataaactctacttctttcgtgcacgctaagagggagattgagggttaccctgttctggtttgcccattacagttctgctgcttcccaagaatagttgccattgttgcacttaagctttctctcaaaggacaaaataagtaatttccgatgaaattgccgccttttcatgggtctctccctccacttactgcatcacagctgggtctcctggctcttcctaatggatatcctgtgctagtggtaaattctaaagaaaagcctcgagatcctaaaagcattgaggggaagattatcttaaacattagcacaaaagactcacaaaccaggcactgtggaccagggactggtttgttaatattttggcatttcagggggttgcaggtgaggaattgcacagggaaacatgagatcattctttgatacatcttgactctccttgcttaaaattgaaaagcagattctctagaatgattgttgaaacctaac

SEQ ID NO: 105422 - DNA, 611 bp, Homo sapiens
caggcaggccttcttgagctgtgatgcttcccagttggagcttcccggctgctttgtttatctaagcaagcctgggcaatggcgggcgcccctcccccagcctcactgccgccttgcagtttgatctcagactgctgtgctagcaagagactccgtgggcgtaggaccctccgagccatgtgcgggatataatctcctggtgcgccatttttttaagcccgtcggaaaagcgcagtattcgggtggaagtgacccaattttccaggtgccgtctgtcacccctttctttgactaggaaagggaactccctgaccccttgctcttctggagtgaggcaatgcctcgccctgctttggctggcacacggtgcgcgcacccactgacctgcgcccactgtctggcactccctagtgagatgaacctggtacctcagatggaaatgcagaaatcacccgtcttctgcgtcgctcacgctgggagctgtacatcagagctgttcctattcggccatcttggctcgtgcctccacattattctttagctagtcttatatgtaactaagaatcactatgtcaaagaattttaagtatgtaggatgaagtatgctattt

SEQ ID NO: 105423 - DNA, 343 bp, Homo sapiens
ctgtggaacagatgctgcatgtgttgatagtacacagaaagaagtgcaagatgccacaaccctgtttgccaaacttaccgggaaaataatagtgctctcaggttaaagtataaaacacacagagtagatgagagtgtagttatgaagagtcaccttatgaagaaagaaaagctcccaggctgagtctcaactatgtaatactcaatgtaagcgttgggtaacaagaagtaaagaggtgggtgtaggaacttagcaagagaagcgccggaaaggaagtatgacagaagcaaatttgagtctcctaagagaatttagaggtgaggatattgtgggctacaaataa

SEQ ID NO: 105424 - DNA, 853 bp, Homo sapiens
caaccaaaaatcaataacatcaaaagtttgcaactacaagccgacggaaaataaatacatgaattctaccacagtgaattggactgcactgggaaacacagatgaagaaagccaacaccgctttgtccttcagtacctggctcccttttcagctcgtcttgcgactccaggcattatgcctgaaaagtctcctggacgcctgtgaggctctaattccctgggacccattgtcatgtctctggatttgcgaagattaaccggaccttctgtggaactcccgtgtccctcaacttttgtgacatgtcccctaattctgcccatggtcatctgcacctgcacgacttagggtccatgttccttggacgggaagagacaggcaggagtcggaatgatgaaccagcacactggggcattttctcatgtagcccaagtgaccccatggtcttcttgagctttggaaccagtcgcgtcccccttgacactgcacccgactcccagtttctcaatcttgttggccctccggcgatctcccgttggatgaattgcatctgctgaaactcgagtcccctttgatttgtgcttcattaattattcatgattcaggttggaaggcctgctgacgaccccctgtggccgttttccgagctttccggtcacatcgtttccttccaccctctttggttccttgtggtcctgctccttctgctgtcagaggagcagagagttgatcttattgattctggatacggatactttgtaggtgatctggataatcaagataacgaccctcaaaagcggcggaaagggagcagccatttggtgtgtctcagcaaatcccgctgagttccgaggc

SEQ ID NO: 105425 - DNA, 261 bp, Homo sapiens
tcagacggatctgaaaaaagagtaacctcttatgcccactacatttacttacaaaaaattcgaaaattaaaataattagaaagtaaccaaccacataatttctttttatttttcttttcttttatacacctacatgaaatcagtgcttacctatcagacgggcaaaaactccaaacgctgggccgggtgcaggggctcacaccgtgtaatcccagcacttcggaaggccgcgcgcccgcggttaccgagcctcgaatccgt

SEQ ID NO: 105426 - DNA, 492 bp, Homo sapiens
aagatcgcaccattacactccagcctgggggacaagagcgaaattccatctcaaaaaaaaaaaaaaaaaaaaaaaaaagaagagaactctgcacctgcactgcagggccgttctgaccaggtgacagatgaggaaactgaggctgagggaggcaggttggtttgtcagaggcacagctgagctgcagctggcctgtgtttctttccagaatccagagaaaatacttcgtgcaggctgaaagcagaggaggacccgctttggggccaacacaacttaaggttgttataggggaaccgccgaaggaggcctaagaaggctgcagccaggttctgctcaagaagtagcagggccaggattgaaaccaggcctttctgctgggcgcagtggtccacgcctattctcagcactctaggaggcccaggcacagggatcgcttgagcccaggagtttaagaccagcctgggcaacggagcaaaactgtatctctacaaa

SEQ ID NO: 105427 - DNA, 231 bp, Homo sapiens
atgaggacatcaagacaatgaaaggttaaacctgcccacgtcgttcaccaggagtgtctgcattccaagcctgctctctggaccactggcccagaatgtccccacagaaggtggagcacctggtggatgtatgaagaggctgagtccaggaggaacaccctggacatggggcaagcaggctatgtcagcccctgagttctggcccatggatcggtgccctcgggagctcca

SEQ ID NO: 105428 - DNA, 570 bp, Homo sapiens
ctgtaagctgtagtttgctgacccctgatctcgataattaaactagaaaagaacagtaaattgtcatttatgaatgagaatttgcacaaattctaagtaaaaatttattaaaattcagcatctattcattataaaaactgttagcaagctaaaaacaaaaggaacttccttaacctgatagagtatctaataaaaccaatagcaaacatcgtatttttgaaatgttcaaagcattcccatgacagataagaataagacagttatgcttgctattatgctaacatttaatattgaactgtgatcctagccactgcaattaagacaagaaaaataaatacaaattgtaaagattccagagacaaaattgtccttatttacagaagatgtgattattaacttagaaaacgaaagaaaaacaacaggaactattattaatagaattagtgaacacatttagaaggactgcaagagataagattgatatctaagaaaaccagctgaatatttctggttctgactagcctgggcaacataatgagaaccccaattctacaaaaaaaaaaaaaaaaa

SEQ ID NO: 105429 - DNA, 548 bp, Homo sapiens
ctgtaagctgtagtttgctgacccctgatctcgataattaaactagaaaagaacagtaaattgtcatttatgaatgagaatttgcacaaattctaagtaaaaatttattaaaattcagcatctattcattataaaaactgttagcaagctaaaaacaaaaggaacttccttaacctgatagagtatctaataaaaccaatagcaaacatcgtatttttgaaatgttcaaagcattcccatgacagataagaataagacagttatgcttgctattatgctaacatttaatattgaactgtgatcctagccactgcaattaagacaagaaaaataaatacaaattgtaaagattccagagacaaaattgtccttatttacagaagatgtgattattaacttagaaaacgaaagaaaaacaacaggaactattattaatagaattagtgaacacatttagaaggactgcaagagataagattgatatctaagaaaaccagctgaatatttctggtctcaaactcctgagtagctgggattacaggggtacc

SEQ ID NO: 105430 - DNA, 561 bp, Homo sapiens
aagagtgcaccagaataagagcgcaccagaataagagcgcaccagctaacaatgtgatacggccatatgtcacttaaggatggagatatgttctgagaaatgtgtcattaggcgattttgtcattaaacatcatagcatgtacttccacaaacctagatggtatagcctactacacacctaggctatttggtatagcctgttggtcctggggtacaaatctgtacaacatgttactgtattgaatacagtaggcaattgtaacacaatggtaagtatctaaacatagaaaagggacagtaaaaatatggttttataatcttctgggaccaccattgtatatgcggtacatcattgaccaaaacatcgttatccagcatatgactgtatttggttatgaaagccaactgttacttgattctgcttttagttcttaagaggatcaggcttttaaatactcatttacaagttttctatcctccttcagtgttaaagtagaaagtaaaaagagtatcttatacatgcatgaaattaaagcatataccaaatgcaaaaaaaatgaa

SEQ ID NO: 105431 - DNA, 680 bp, Homo sapiens
gcctgtctccgcgtggtgcgagcgctgcaccagcccctggctggtggttactgtccgaacggcgtggtgtggtcgctgactctctgggcgtgcagctccgcagccctgccggctcggttcggttcgtgagcggcctgggatttgacttactgcaggattctcagcccttgcctgggagaacagttcaggagacagatggcccccaagagcccagatccaggaccgctgacatttggggatgtggctgtggcctttacccggattgagtggagacacctggatgctgctcagcgggccctgtacagggatgtgatgctggagaactatgggaatctggtgtctgtggggcttctctcttccaaaccaaaactaattactcagttggagcaaggggcagagccctggactgaggtgcgagaggctccatcaggcacacatgcagtcgaggattactggtttgaaacacacgatgtcagccctaaagcacagcacttctgaagcatgcgttctgggagagcgaacgaaacgtgtcatgatggaaaaaggcctggactgggagggcagaagctccacagagaagaactataagtgcacaggaatgtgggaaagtttcagatacaattcggcattataagccacagagagatcaagcaggtgggaacgagataatgtagagaatg

SEQ ID NO: 105432 - DNA, 412 bp, Homo sapiens
caggtgaggccagcatgtgacattacataatactgaataggaaaatgtctctctctctctctctctgtctcatccatccatccatccatccatccatccatccatccatccgtccgtccgtctgtccgtccatccatccatcctgagggttggagtataccttaaatagttcatgatgagttaaaatatacttttcattttggtcatagctgttttacttactagctagaaagcttttaatggaccatggtttaaacaatttaaataaatttagttagtttttctaataacttgatttttatttgtctatgaggatattggcaagctaaaattgtatagacatcagaaggtctgtgtcttttggagaaggtgtatgaaaaaaatgaagcacaaaataagacaaaaataagac

SEQ ID NO: 105433 - DNA, 296 bp, Homo sapiens
gaaaatcataacaaatacataatgagtgagggatactcattttactcagtcccattcctacctcaccagatagttttcattatttctaccctttcctcttaaattcactgctgaatattagaacttctattaatgcatatttgcaggatgattttaattattcatagaatcgcatttataaatttgtagatccccacaggaaaatgttatatctcagcaagtaaacttttaaacggaaattattttctatgccactattgtgggaattgttatagtcatactactacttccaatag

SEQ ID NO: 105434 - DNA, 388 bp, Homo sapiens
ggtttcaccgtgttagccaggatggtctcgatctcctgacctcgtgatccgcccacctcggcctcccaaagtgctgggattacaggcgtgagccaccgcgcccggctattcatgtattaatttcttactttaatgttctttagagtataatgtaaggtgtttcaaatttttggttaaatttatttcaaagtatagttatagttattgagatggaattgttttttaattcattctgagatagttgtcagtgaatagaaattctgacttttggatgttgcttttgtattctgcaagtttaataaatttgtttattctaataggttttagtaaagtcttaggcttttcttatgattatgcatagagataaaatattatataggaataattt

SEQ ID NO: 105435 - DNA, 219 bp, Homo sapiens
cttggcattcttgattttactaattctcagctttctactgtggtcctttctcttcctgtttacttcctcaaatcctaaccactgtccagcctcttccctgtgagatttttctgcttgtttccattcactttgattccctttcatttgtactactacgtcgcgtcttgtctttagatttgatgatcatcatggcagcttaggtagaatggaaagaaccct

SEQ ID NO: 105436 - DNA, 243 bp, Homo sapiens
gttcaaagctaacagttatggggtgcctcctcagtggcaggcactgttctgtgtgctttacacatgtaactcatttaatcctgacaacaaatctatgatatagttactattattatctccatttggcagatgaggaaactaagccacagcaaagttaagtaactcgtttagggtcacacaagccattaagttgaggatcatagccaggctggctacagaacctgtgctccggccacacctctt

SEQ ID NO: 105437 - DNA, 319 bp, Homo sapiens
gctcatgtgtgcgtgcactgtgacacagcttaagttagaagggcaggcagggcgtggtagctcacgcctctaatcccagcactttggagactgagcgggggtggatcacctgaggtcaggagttcgtgaccagcctggccaacatggtgaaaccccgtctctactaaaaatacaaaaaattagccaggcatgttggtgggtgcctgtaatcccagctactcaggaggctgaggcaggagaattgcttgaacctggtgggaggtggaggttgcagtgagccgagatcgctccattgcactccagcctgggcatcaagagt

SEQ ID NO: 105438 - DNA, 690 bp, Homo sapiens
ctaggttatgattatagagcgaggattattataatattggaataaagaataagtactgctgattaattatattcatatataatcatatctaagatctatgtctggcgtaactattgttgttttacattttgttatactggaacagctcgtgtcctcggtctcttgcctctgcacctgggtggcttgccgcccacacatttgcacacacatataacaaaaaatgtatcagttgatttaattttgttaaatatttactaagaatgggtgttgaagataatcacttattttctgtttgaagagggtgtttaacaaagagtgttttctctggagtcaaagttccctgtgttttaaaactggctccactgttgtgagcaagtaatttttctctgtggctctatttctttctctttaaaataaggataataataatgcctatgctatggaattactgtgaaaattaaatttattaacacagtgttatgggtagtgtttagtacaaattaactattaataaaatgtgtaggccgggtgtggtggctcatgcctgtagtcctaacagtttgggagactaaggtgggcagatcatgaggtcaggagttcgagaccagcctagccaatatggtgaaaccctgtctcttctaaaaatacaaaaattagccgggtatggtagctcatgcctgtagtcccagc

SEQ ID NO: 105439 - DNA, 396 bp, Homo sapiens
tccctggccctgacttggcctcgattttcacactctgcagcatgcctgtttacctccaactgtatctggtgttttggctcccagagtccttggtgactggtcagcttgtcacaagcccctgctctgtaatcaagtgacctgtccatcaccagtagaatgtttggggaagctgtcacacatcgcctttggttgcattcaggaaaaaaacaagagttctttgtagatcttttcctctctcccttctttaatgctatccaggtgtggagtttcctccaaactgttaaatgtcttcccttcaaatctcagtctgacacaaattaccagttaaatctcaggaccgctgttacctcgtcccgggattcgaagctctggatcttttataatttccacattgtc

SEQ ID NO: 105440 - DNA, 736 bp, Homo sapiens
tgtgtgtctgggtacatttgctgttgtaacaaatattccttgatatttcggtagctcaacaaaatagcagttgattacccccacaataggcaggggtggcccttttccaagtgggattcagggacccagctccttcccttttgtggttttgccatccctggggccttgcaacgctctgcttcccaaggaaagggtaagagaggttgagggtagccccctgcctaactgctttggccagaagtggaaaaagtaatgcccaggctaaatacactaagctcatcctggggcaatggacatagcacttccgttgccattccatcagtgagagctagtgacatagcctgcctaggtgcaaggcatgctggaaaatggagtccctggctaggcagtggttcctggtggcaatgtgacagcacagaggggaagtacagcttttggaaggcagttagccatcactaccacactcgtcatccatacagaacacaccatcacctgcccttgcctcttgacagcaataaaaagacatccctgacccttgccttctcagagtgcccagtccagtggggggacctggcaccacacagcgatgacctagagtggttcgtaccaaccacaatgaggagcacaggccagatgggtcaggaccgggatgggggaggcacaggcagaggggtgggggctggagttgggggaggcacaggaagttatgggatcccagggaaagtgcctgactcac

SEQ ID NO: 105441 - DNA, 289 bp, Homo sapiens
gtagagacagggtctcactatatcgcccaggctggtctaaaactcccggactcaagtgatccgcctgcctcagcctcccaaagtgctggaattacagtcaggagccacggcgcccaacccatccttgcatcttttacatacttcatgccctctcttctttaccttttttctttctttctcctaattgcattcaactcaatcccttctcacatctgcatgttgttcctctcttcttcctcctcctcctcattctgcggttccctccttctcatcttacttttttctattg

SEQ ID NO: 105442 - DNA, 738 bp, Homo sapiens
aaaggatacatgtactaaatttctcaatagctcaccaaatcaatattttcatttgattcttctaaatttattaagtgccaaacaactatcaggaacaacatacaaagtaccaatgatacaaagatagcaaggctggtcccagtccttaaggagggcttacagtttagtcatggagacaacctgtacagtctagttctgatgagtgttgttggaacatccacagcatgctacgagaatcctgatgagggacacctacattagatggggggtagagaagtcttttctgaagaggaaacaagtaaaatgggtcttgaagcaccaggtgacattagccaggtcacggaaggggtagtacaggagtgttccagatagagaggacagcattttgaaagattacaagaatgaaacagcaagatatctattgtaaaagggaagaatctttgtgtagtagactgaataaaataagtagaggaacagaaggaagcgaggctaggccagtaggtgggttcagaagatgaccagcctatggacttcaccctaaagtttcagagaagcactacaggatttgccctggggaggggggccacggcattcacttttgaagaatcactctggctgctgtgtggagaatggattgtatggggccaagagtggaagctattacaagaatgcaaatgggaactgatgagggctggaattagggcagaaacagtagagacagaaggaagggagagatct

SEQ ID NO: 105443 - DNA, 317 bp, Homo sapiens
ccagagtgttcagtggaggtagtgaaacaaggtcggatcctgaatgtattttaaagattgactgaggctgtggccaggagcccactgggaatgcctgtccacctccgtgaaacaggctgagctagagaactggctcaagttgctgtgtcctgggagtctgagcccttctccttttgtgcttgtcaattcctgtgcctcagccactctgtcataaggtggccttttaacagttggaaaaatagaggcatagtgggtcttcctgatacccttgtctacccttggaattctgatattctgcatttggtctctctcctccc

SEQ ID NO: 105444 - DNA, 508 bp, Homo sapiens
tactctcattaccaggggaagggcgctccccttttccctggtaatactccgggagcccctactcggaagcccaagagtcaaagggatacaggggtgactggagagcagcgggggacagcgtggcctcacccaaggtcagcgctggtccccacgtgtcggccgggggaggggaggggagcggacagtcggagcgttcggatgtccagttgagccgcggcgcggggcagccgggggcgcaaagttggaggcagggctgggcgacgaggagagagggagggccgggagccgaagggacgcccgggtgcaccccgctgcagaggccgagtccgagcggccggagaaggctggtcgcagaagggcggcctccggtgcaaaaaacggaaaccttggagcagaggatgaggaggaatacggaggcggggagcccacagaaaaagatgttgaggaaagaagaggagaccccggcctaaacaaatcgaaactgtgcaatgaacgtggcccgggagaa

SEQ ID NO: 105445 - DNA, 321 bp, Homo sapiens
acaagagagctagtaagtagcttcaaaggagattttaagagtgattttaacttggggaatttaagagctggagtcattgtttacttcactgtggcacctttgaaactgttacattaacataaggtaattgaagaattgttattcctcttgtattcaactgaatatttatggttagcttacagaaatttgcagttgtgaaacagaacagaaacttgtgttgaattcggctactacttaaatatgcatttttaatactctttaacacctcctccctcctcatataatctctcaaggcctgtgattacatattgcatattgaag

SEQ ID NO: 105446 - DNA, 233 bp, Homo sapiens
gttatagttttgggtggctgattagcttataggctttcttcctctttagagtgaaaggtgaacggtatctgagttattggtgacgaatctgtacgtgtctacagcgacctcaatacctgccttctcattagaaagaattcaaccgaggggcgtaagagagaaaaagagacgggcaagtttcagaggaggagtggaagtttatgtaaaaaggctttagaacaggaaagaaagga

SEQ ID NO: 105447 - DNA, 2354 bp, Homo sapiens
tcttcacaggttttgcacactagggaccaagaagccctcggggacactgctgagaaaagactgccgaagggaagaccagcggggatcatggaatctattccagaggaaactaaccaacagtgagcatcttcaactaaaactacccctggatgtaataagtgttgcatgcatcattcctttaattgagcagagttaactggatcaaattatttatgggagagagaggaaaagttataaagaattatagtaatttttaatttccaccaatatactctttgtaagtgaatcactctataattactttctgttgcactgaatgcagcaacaataacacaatagtattttaaggcactggtttttggcatactctaaccttgtaattatttaaataacagccaagtttactcatgtttttgattctgtcaagaaaaaaaaaaagttcctttactcgaaagtgatggccgaaacagaatcggaaatttgttttcttgaaattacataaatacacagaaaatggcacttattagcttttgttaaaacattaccttacctaatcactgcataaaagtccagatttgtagaaaattgtaattttctcagtatctaaaactattttgctttccattaagtttctatttgctattttctcagaattttacaattaaagataaatcacaaactgtttgtttttcttaaagttctttgagaaaatgtctaattatacaatccttggacaatactgtgtttttttggtgctgtgttttttaagaagtcctacttactggaattttgactatttggatatttttgtttttaaaaggggaggggaatttgcttaatacttctaaagatgtgaattgataattgatattaaaatagaattactctcaactcaccagaattaaattttatatctgcatatttaacactattagctcatataaattataagaaaaattttcaaaggatctggttttaattttttggatatgaaatgaatttgccttttctgccttttcttaagtactattttgtaactatattgcactaactatatccaaaacacattctgagcatcactgtgagtaacagccttccagtttgtacccttttgattcacagcatggccctatagttaattaagaggtggataacttaagctcacaactgcctttaatttgatttcacatccacagttataaactttgcatttaaaaggaaaatgagacatttaaataggttcctgttgtttcacatataattggtaaaaacatattcccttgtaggatcctattatcagagcatcaaataccaaagtcagcaacttgggttgccaaataaattaggctcattaattattttgaaaagggctgctgtttccatgtaaatgataattttctttttcatggacaaggttatggtacttatctactaaaagaaacatgcataaacatagtttttatctttaacttcagtattaaaatatgcagttttttgcaaagaggaaaaacatctggttcaattacgctgaactctgactacatgtgggccagtaataatatgaattggacttaagaataaaccttgtgtttaatctctttttttccttaaaattttaatgtgagttttctgttacgcaaattatccatgttagcacatttggaacaaatgtataaatgtactttctgaataaagtcaaaagtctaacttgtttttagttccataatgttttaatgtttaattatattgtgtatttttctccctttccccttactctccaaaatcaccaaatctggaaaacaggctgattgtatctgtctatgagcaaaggaaacctgaaggaaccaagggcctggctggacagagttgtcatgtgtctgcctgtctacacttgctgtgcagaacatccgctcacctgtacagcaggcacagacaggcagtcacatgacaacccagcctgaatgacaaccagccattgaaagaaagcagccctcacaccatagcatctacaccaagagctacaaccaaaatgaggggctcgggggcctggggttttaatctgttggtttaatacttaactcatgtattattttattttgattcaagtattaaaacccaccaaaagtaaagtgagtggtgcctatgaaatataataaaacccatttctgaaaatgttcctgtgcattctatagttctcttttcctaattgttgtcagcaaatcactacccttgacctttattgtacacagctttgcagcaccctatattgatataaaaactcaatataacaaaacaatataacttcagtctgatgcttaacaaagaataaattattctaagaattcttgtccata

SEQ ID NO: 105448 - DNA, 471 bp, Homo sapiens
tgagatggattctcactctgtcacccaggctagagtgcaatgatatgaaccttgctcattgcaaccgctgcctcccgggttcaagtgattctcctgctgcagcctcccaagtagctgggattacaggtgcgcactactgtgcccggctaatttttgtatcttaagtagagacagggtttcactatcttggccaggctggtctccaatacctgacctcaggtgatccacccatcttggcctcccaaagtgctgggattacaggcgtgagccactgcacccagccaggttacatcttgataagccattgttaagttgaaaatatcattaagtcaaaaatacatttaaacctatcgaacatcatggctcagcccagcctactttaaacatgctgggtacacttacattagcctagagttgggcaaaatcatctaacacaaagcctggtttataataaagtgttgaatagctcat

SEQ ID NO: 105449 - DNA, 396 bp, Homo sapiens
tctttttggtagagatggcatctcactttgttgcccaggctagttttgaattcctgggctcaagccatcctcccgccacagcctcccaaagttctgggattacaagtgtgagccactgtgcccagcttttgatttcagacattttaatgcagatcctctcctttacagcactattatttggttatctacttataattactgatttaacattgatctgttttcactagactgtaagctccatgaggacaagtcctgtgccagtatatctctagtgtcagcagacaatactcaaaatttgttgacagactatttaaagctgcccctatttttatcattaattgattgaatattaattaaatatattttattaatttaaaatgaattttaaatgcattt

SEQ ID NO: 105450 - DNA, 271 bp, Homo sapiens
tgtgaatcataacttgttaccatttctcccatccaactactaaccaggcttcaccctgcttagcttccaagattagctgtgttcagggtggtataaccatagacaacttatcaacatttctgttcatcaaattttatttttctgcttatttaacaaagttatggaagctatgaatattcaccagtgacattgggaattggctggtctctggattttagtttaactgcctcatcattccagagttgatagtctccacagtggcaaaaatcct

SEQ ID NO: 105451 - DNA, 457 bp, Homo sapiens
tgtctgcagtcctagctacccaggaggctgaggcagaagaatcgcttgagcccaggagtttgaggcttcagtgaactgtgatggcaccactgcattgcagcctgtgtgacagggcaagacctcgtctcttaaaaaagagtcggccaggtgcagcgactcacgcctgtaatcccagcactttgggaggccaaggcaggtggatcacctgaggtcaggagtttgagaccagcctgaccaacatggtgaaaccccgtctctattaaaaatacaaaaaattagacgggtgtgatgatgcgtgcctgtaatcctagctacttgggaggctggggcaggagaatcgcttgaacctgggagactaaggcgggagaatcgcctgggcctgggaggcagaggttgcagtgagcccagacggcaccattgcactctagcctgggcaacaacaaggagctccgtccca

SEQ ID NO: 105452 - DNA, 496 bp, Homo sapiens
ctgacatgctgcctagcatgcagaggccatgcgacccttggggaggctcctacttgccttggaaaagtagctcctcctcttctcaaatgtaataatggaaaccttacatgggtggatccaggggtaaagctctttgtggtgtatagcaacagaatgttaagtcaaagtggttgtcaacaaagtttatcgaacagcagctatattttttataatgaacactggtttgcctggaaccttgaagtaaccatgaatttttcctagaccctaatactatcagaaagaaacaaatcacccaacaataagatcagtaactaaaaccaacaaatcccaaaggcatctcacagtgctggcatatgtctctgccatagctcatgctcataaactgcaatgagccaaccctggcatcatgaaggaccccgattttaaaaatgggtaaagaagttctgaaagcctgggcaacatagtgagaccattctcttaaaaaaaaaaaattagc

SEQ ID NO: 105453 - DNA, 708 bp, Homo sapiens
tgcagtgagccaagatcaccccactgtactccagcctgggtgataagagtgaaactccgtcttgggggaaaaaaaaaagtgcagggcaaaggcagcccagaggactaactgtgcccagaaaagacagacatctgaaagtaaaggagagataactgggtgttacaggttcaactgtgtctccccaaaatgatatgttgatgtcctaacttccggttcctctgaaaatgaccttaggggatatctgaacacagagacagacatgcactgtctttctgaagacagtgcgaaaacagagagagaaggccccaggaaggttggggactgagtgatgttctgcagtctaggaatgccaaagacggtcagcaaatcaccacatgtggggagagaggcctggagcagcttctcttcacagcctcagaaggaaccaatcctgccaacaccttgatcttggactttgggcccccagaactgtgagaaagtaaatttctgttgtttgaagctccccagcttggtggtactttgttcccgcagctctgggaaaccatacataaagtagacgcaaaaggagagccgttaaagactgcatattgtaggcttggcagctgatttttgaattgttgggttagccagctaattaagcagctagagtggtgcctagcacacagcgagagctcagtaaacacttgtgagtaaccaatgggaggctgg

SEQ ID NO: 105454 - DNA, 504 bp, Homo sapiens
gtggcggacctgtaatcccagctactcaggaggctgaggcaggagaatagcctgaaccaggaggcagaggttgcagcaagctgagatcatgccactgcactctagcctgggcgacagagcaggattctctctcaaaaaaaaaaaaaaagaaagaaaaaaaaaagtcaacatgtgacatctgttaccactgaggaaataagacgaaatacaagctggggagagcagtatgtcatttgattaagacagcagaacctgtgcgtgttggaaagcagacaaaagaaaccaagaaaaaaaagatccgagacacaggacagagacgaaaatcctgtctgaagaatggtacaaaaggaaagcaaaacaccacatgcaaaagttagcctttaccgaaagtggattctctccagcagaaagaaaaagagttttcggttatgtggaacagtctctcaacaggtaaattatgtccaatggtttcaaacctgttattatatccttaaggtcatctgc

SEQ ID NO: 105455 - DNA, 240 bp, Homo sapiens
ctatgttcaggacttttggggatgtatttattcatgtatttgtgataaatgcctaggagtaggactgctgggtggtaagtgcagtgtatgtttaactttataagaaactgccaaactgttttccagagtgaatgtactgttttgcatttctgccagcaatgtatgagagttctagttgtttcacctcctctccaacacatgtaattgccagtatttttacttttctccattgtataatgt

SEQ ID NO: 105456 - DNA, 139 bp, Homo sapiens
tggagggtgttggaattgagtctgagaagcagaaggaggggttggtgagactcaaagccttgaaattggatctgtggttgtttttctctaaaaccaaatgtatacccacccactacccggccagctggtgccctttcag

SEQ ID NO: 105457 - DNA, 363 bp, Homo sapiens
tcagaaagggagaaacattatctttagtcatatgtatttcttggaggatcttggatagttttagtcagaatactttggcagggtggcaaaatgatgcttcctacataaattttgacatttcaaataaaaagatgataaagtgaaaagtgatttaaaaattttagcatgagttatcaaaagctctagaatttcaacaaatacaaatggaagagagtttaaaatttcaaagacaaatattctcaaaacatgataccccagaagagcccgggctcgcgtgctgatgagctcaggtttccggtctgaacacgcagcagctcctcacctgtctgaagccacatggaagccacagggacagtcccaaag

SEQ ID NO: 105458 - DNA, 828 bp, Homo sapiens
gtcaggaactgtcctagaagcagctttccttccttaaggagaaacagtgttctttcccacaggaagcaagtccaaatgtacatggtataggcggggctttgtgcaaaagagcaagggctctgcagccaccacaatgcatccatcacttattagtggtgtagccttgggcaagctatttaatttctccatgtctcagtttcctcatcagccaaaggaagataataatggcatctatcttatagtgttattgtgaaggataaatgagttaatgctcataaaacactcataactgtgcctgatacatagataggtctcagtaatgccactgttacttgtgtgtttctataaccacctgtcacaggatcatgactgaggctgcataattcagagaagtggcagttataccaaggacagaagaaccttcaggaggtcttcattgccaagggcaactggttttaaagaaaggtcacccccactgaaagcaggggtgtaaaatgtcatggtaaaaaaaagttttatcgggaacttacctttaaaatgaaattgtagattatgaaatgaagtgtgttttcaccttttagttaagaatatttagattacaatttcaactttgcattaagtcttagaataaacatggaataaaaggagtgttgactttttggcttaattgtgctgacaaaatgatgtaacagcacaatggagcattctttgttttgtgattgattttttaggactaccttaaaaatcctcatttttgtaaaaataaatcaaaacttaacagtttaacccaaatacctcctttaaccctttggtattcacattattatc

SEQ ID NO: 105459 - DNA, 766 bp, Homo sapiens
tgtgagaagtctgaccacccggaggccacccagtcgtgaggaagtctaagccacatgaagaaaccacagtaggagccatggtcaacagtccccgctgaggctggtcttggagtcatcccagtccagacagcaggcatacacacctgaggaagctcccttatgattctggcctccagctgttcacattctcccatcatggagcagagataagccttcctcactaggccgtctctattcctgacctgcagagtccacaagcctaagagtggttgctgtttaacaccacagtgtttagaagtgctttgtcacacagcagtcgacaataagaacaaaggtgctgcatataacagaggctgccttgtgccaggaagtcatgcgagcgctctccatgaaagtagcattagggctgcgatctgaagggtgaaaagacctccattaatggaaagagagggagaagcaggctgtaggcacaggcactgcaatcagagggagtgtggctggcacagaaaaaacagcacagagtgagaggagagtaaaaaggctgacaaggtaggcaggggtcagaccacattgggtgctttgctggtctggtgcttgacagcacttagaagtccctggaggggttgtctatatacatttttttaattgaaaattcacgtaacataaaagtcactgttatgggttgaactgcatatccccaaaattcacatattgaagtcattaccagcatctcaaaacgtgactttatttggaaatagaatcattg

SEQ ID NO: 105460 - DNA, 790 bp, Homo sapiens
acacacaaatctgtatctgtccacgcctctatctgaactccagacctacatttccacctctctactggacattttttttgagacagggtctcactctgttgcccaggctggggcgcagtggcatgatcatggctcactgaagcctcgacctcctgacctcagcctcccaagtagctgggactacaggcacgcaccaccatgcctggctcatttttttgtattttttttgaagaggcagggttccaccatgttgcccaggctggtggcaaactactgggctcaagcaatccacctgcctcggcctcccaaagtgctaggattacaggcacgagccaccgtgcctggcctccacttggctgtcttaatggcacataaaaattaatatatctaaatctgaaatcatggttttcaatctaaactatattcccttccaacatttcttacctcagtgaatagtgaatgtaacatccatttgcacaaaccagaaaccaaatagacattcttaacatctctctccatcaccttctaaactatttatattgataaagttacagcgatttgaaattctttttctagcctagtaatctgagtaatttgtaggataaacatgttgggggaggggcaggtacatggaggtgtcaaagtgcctgatggctgaggaagcaggctgggattactgcatggaggtgtcagagtttccagctttgtggctccatggttgggtggaggggcagggggagagatccagtggaagccatgttgtgccagtgccctcagggcgaggaggcag

SEQ ID NO: 105461 - DNA, 143 bp, Homo sapiens
agtctgaacgagtgaaagagagtctttaattttaacactaaagataacagatcttgctgtaaagtgcaatgatgcttaatagccctaaagatcaggttgtgattgatgggatttctcatggtgttcttgttaaagataaatag

SEQ ID NO: 105462 - DNA, 417 bp, Homo sapiens
aaggccgtagccgatctagccttctcttctgacttccaggcttctgctctttctcctcagagaggctgaggaccaacagtcttggttggtagcatttctgatctctgtgtgcagtggcagctggtggcaggaaagcagtgaaggcccttgccccagtattgcaggcaggcgggtgtcagtggcactgccctttgctggcagtggcagccaccgttgctccacactagggaaaggggacaccttggtgctgcttctctatgacagggagttggtgaataagtctgggtttcttcctggtagttattactttgacaaggacagaattccaatagggctagttatgcaacatctgggagcctctgcaaccatgactcttcgggagagatgtgttgtttttttaaaagcctgttggaattt

SEQ ID NO: 105463 - DNA, 720 bp, Homo sapiens
atttatgctttcatagaatttagattctaatggcagggggtgtgggtggcagattagtgagttaaatatgctacgggttagtgataaatgctagggtgtaagagtgtgtgtgcacacatgtgcatgcacgcacatatgtggaggctgaagacaatgcttgctcctgccccatccccaccacagacctcgtagcaactggttcccaaactttatttatcataaaagtcattgaccttgaatcacaatgggctgggtccctgcactacacaacatctgaatgtgaatgtgagtcttagattatagataattttccatacttaaaaagttatgagcatatggaaaaagcagtaacagtatacacaatttcatttctcagatgtacatctcttctcatgagttttcgtcctgaaaatacagagagatattagtactatcttgttcattatctggagagtccttgccaaaatattgcacacagttccactgattgagcatttctagggttctcagatgacttatataaataagcagctgctggtagccattgtcagctcattgtcttctttgagtctcattgtcttgttttaggcttagaccatctgccaaaaacaaacccaagggaatagtagtaagttgaagatatcaggttgaaggtatcaggccctagatgtgcatgaatgaaaaactaagagagaacttatttcttatttcccccctgtc

SEQ ID NO: 105464 - DNA, 439 bp, Homo sapiens
tattatgtttcatctgtattactgcatttactatccctagttgattcacttccctgaagtacaatattcagttgtgtggctataccataatttagttattcattttgttgtcagtaaaatttgggtgattatcagatttttttctagcatgaaaaatgctactaggaacattcgtgtatgtgtctaatggtatacactttcaagtgtttttttatatatgtgagagtagattacttggaccttgaagatgaacatgctatcttttccagatactgccaattatttcagcaagatatgagttcccatcattttatatttgtcagcatttgatatttccaggcctagtgatttccagtcatttactggatataatatgattatctctgtagggagttgatttccatctcctcaattactaataaagttaaaaatcttttca

SEQ ID NO: 105465 - DNA, 647 bp, Homo sapiens
aaagcaaggcacagttatgtgttcaatactaaatcagtaataaaaatcagattacattttagcaaacttttagtaaagtacggcattcaaagtaggaagctccatttatttcttggaatgtgcatttggagaattctctaagctaggggtctccaacccacgaactgcagactggtatgggttatgggtcatgggtctgcggcctgttaggaactgggatacacagcaggcagtgagtggctggcgagcaagcattaccacctgagctctgcctcctgtcggatcagcggcagcatgagattctcacagaagcacaaaccctatggcgaactatgcctgcgagggatctaggctgtgtgctccttatgagaatctaactaatgcctgatgacctgaggtgaaatagtttcatcctgaaaccatctctccacctcaatttctctgtggaaaaattgtcttccacgaaactggtcccaggtgtcaaaaaggttgggaaccactgctctaaggggatcattactgaggcatatatatacatttataggagaaagtgaaacaagtttaaaataccacctaacagcaggaaataaacaaaagcttttaaaaatccaaattagctggaaaaacttacagagcctgcgttacct

SEQ ID NO: 105466 - DNA, 517 bp, Homo sapiens
  misc_feature (335)..(335): n is a, c, g, or t
ttatccctctttttgaaccatcttgcccattgccgcctccataactgcctctacttccttcaaacgtcatcttctaggtaagcctttcttgggcactgtatcttaaacagaagccaccgtcacccgttcacgcccacacgcacactcacacatattctacatccctttcttcctttttttgccttagcatttccactaacataccatccatttgacttatttgtgaagtttattttttgcttccctaccaaaaaaaaaaaaagtaagcaccatgggggctggggggttttgtctgttttatttactgttctatctccagcacctagaataatatnaattatgttgagcacataataggtgctcaacaaatatttcttgaaagaataagtgaaagagtagacctaaaattaaaaagaatcgaaagagtagacctaaaaataggtcccatcgtgttgattccttctcattattcaaaagctctattcagccaccaatggtctctatccaccctatttta

SEQ ID NO: 105467 - DNA, 357 bp, Homo sapiens
gttgagggatgggcttgaaaatgctaaccctgtaatcatgcctttgcctttttgctgaccagctccatcctgaagctatcaatcaacatgagcatgcaaaaagacagcactttggagatttcaaggattttaggagttttgtaccaggaaacaggaacaaagaccaaatatatattatatttcacaatatcattggaaccttaagaaagaagcctctctcctttcttacggagcctagaggaataaagataataataaagattactttatttatgaatagtaatactttacaaagtaatctttattatctttattctagtttgcccttgaaccattaaaggttactaagttgaattc

SEQ ID NO: 105468 - DNA, 160 bp, Homo sapiens
gaggtgaggggtgttgtggggtgcagagacaggcagagtggtgagttgagggtgttttgtcattccaaatcagcacctccattaccatccctttggatgtttgagatctgggagtttacccagccccccacccccatctaggcaagtcctcaggatgtcc

SEQ ID NO: 105469 - DNA, 495 bp, Homo sapiens
atggaccaatttgttgaaaaatgtaaacttctataattcagccaatatgaagtagataatttgaagaaccccgtatctattaaagaaattggattaaaaatgtaaaaaattcctaacaaagacatttccagatccagatggtttaatctggagaattctaccaaaggtttaaagaattataccagttctacaccatctcttccagaaggctagacatggtggttcacacctataatcgcagcactctgggaagccaaggtgggaggactgcttaagctccggagtgtgagaccagcctgggcaacgcagggagaccctgtctctacaaataataaaaaaaaaaattagccaggcacagcagtacgcagctgtcgtcccaattacttgggaggctgagacagtaggatcacctgagcccaggaatttgaggctgcagtgagccatgattgtgccactgtcgccagcctgtgtgacacagcaagattctggtggggg

SEQ ID NO: 105470 - DNA, 350 bp, Homo sapiens
gtgaagtcgagtgacttgactttgcccaacaaaagtatttttgacactcagactagtgtctggatcttttcagaaaagaaaataaacaacaaagtctaacaatcagctcttcattggtgttcactttatttccttccatgaaactagcctcagcttaatgtcttgtacttttttaggatatagttccttgtgaataaattgtgtgctctagttcatcattttgtaagttgaatatatatatatatttgaataacaagaattgtttatgtaagcaacaactttctttgaaggcccttggaaaacattaattacattgttctcttgcccaaaatgtctcttgaagctttatg

SEQ ID NO: 105471 - DNA, 275 bp, Homo sapiens
aattgaccttgcttttctagttgggatctttcctgggagtttcagcgggacaacacaacccagctattgtgattcactaactcctacaaagagagctctttctttaaacttaatcacaatgactttgtttctactttagacaaaattaatccatgtccttaaaaaaggaaagcatttgtgttttttcagtctgatagttttcatcacagcatgctaccagataccaaaattcacaagagtatttagtagatatttagggatttttaaggaaaaca

SEQ ID NO: 105472 - DNA, 972 bp, Homo sapiens
ggggtgggagggggagggggacctccgcacgagacccagcggcccgggttggagcgtccagccctgcaacggatcatggtgcagcaggcggagagcttggaagcggagagcaacctgccccgggaggcgctggacacggaggagggcgaattcatggcttgcagcccggtggccctggacgagagcgacccagactggtgcaagacggcgtcgggccacatcaagcggccgatgaacgcgttcatggtatggtccaagatcgaacgcaggaagatcatggagcagtctccggacatgcacaacgccgagatctccaagaggctgggcaagcgctggaaaatgctgaaggacagcgagaagatcccgttcatccgggaggcggagcggctgcggctcaagcacatggccgactaccccgactacaagtaccggccccggaaaaagcccaaaatggacccctcggccaagcccagcgccagccagagcccagagaagagcgcggccggcggcggcggcgggagcgcgggcggaggcgcgggcggtgccaagacctccaagggctccagcaagaaatgcggcagccgcctctactacagcttcaagaacatcaccaagcagcacccgccgccgctcgcgcagcccgcgctgtcgcccgcgtcctcgcgctcggtgtccacctcctcgtccagcagcagcggcagcagcagcggcagcagcggcgaggacgccgacgacctgatgttcgacctgagcttgaatttctctcaaagcgcgcacagcgccagcgagcagcagctggggggcggcgcggcggccgggaacctgtccctgtcgctggtggataaggatttggattcgttcagcgagggcagcctgggctcccacttcgagttccccgactactgcacgcagaagataagaaaaatagaaaaaaggggaatggctgaagaagaacttatcagacctggtgat

SEQ ID NO: 105473 - DNA, 555 bp, Homo sapiens
ctagttttgcatttgataactgctgtttaattctgaaaatgttgtctcaaaccagatgtcagggacaggcttgaagattcctgatgtctcagcacccagcacggctgtcagcctcggcaggaggaagaccacggaaagtgagttttctgggcaggttggagagctgctgacagtgagaatgagcatggtgattacatctcaatatattaaactggctgatagagggaataaaaccacagacaaagtgtagaggggtagattaacatgttttgtcagaaatgtctgaagtagaaaatgaaggaaaaatatcaggggcagttgctgctattgaattcaataccagcaaactccattcctcagtgtctttttttttttcctataaacaatttacagtgtaaatgtattttgacatagaaatcattctgtattgagattcttgatataaaatgcttttatgagagcctgtaagtgatccttggaattattatcagattttttaaaagatgtgtttacatggtgagtgtgtgttgcatattaaatttggttttgtagaaa

SEQ ID NO: 105474 - DNA, 7979 bp, Homo sapiens
  misc_feature (1811)..(1811): n is a, c, g, or t
  misc_feature (1816)..(1816): n is a, c, g, or t
  misc_feature (2021)..(2021): n is a, c, g, or t
  misc_feature (3896)..(3896): n is a, c, g, or t
  misc_feature (3900)..(3900): n is a, c, g, or t
  misc_feature (3909)..(3909): n is a, c, g, or t
  misc_feature (3916)..(3916): n is a, c, g, or t
  misc_feature (3924)..(3925): n is a, c, g, or t
  misc_feature (3927)..(3928): n is a, c, g, or t
  misc_feature (3936)..(3936): n is a, c, g, or t
  misc_feature (3938)..(3938): n is a, c, g, or t
  misc_feature (3944)..(3944): n is a, c, g, or t
  misc_feature (3947)..(3949): n is a, c, g, or t
  misc_feature (3954)..(3956): n is a, c, g, or t
  misc_feature (3959)..(3959): n is a, c, g, or t
  misc_feature (3961)..(3961): n is a, c, g, or t
  misc_feature (3963)..(3963): n is a, c, g, or t
  misc_feature (3966)..(3966): n is a, c, g, or t
  misc_feature (3972)..(3973): n is a, c, g, or t
  misc_feature (3984)..(3984): n is a, c, g, or t
  misc_feature (3992)..(3992): n is a, c, g, or t
  misc_feature (3995)..(3995): n is a, c, g, or t
  misc_feature (3998)..(3998): n is a, c, g, or t
  misc_feature (4000)..(4000): n is a, c, g, or t
  misc_feature (4006)..(4006): n is a, c, g, or t
  misc_feature (4008)..(4008): n is a, c, g, or t
  misc_feature (4014)..(4014): n is a, c, g, or t
  misc_feature (4548)..(4548): n is a, c, g, or t
  misc_feature (4557)..(4557): n is a, c, g, or t
ggggtgggagggggagggggacctccgcacgagacccagcggcccgggttggagcgtccagccctgcaacggatcatggtgcagcaggcggagagcttggaagcggagagcaacctgccccgggaggcgctggacacggaggagggcgaattcatggcttgcagcccggtggccctggacgagagcgacccagactggtgcaagacggcgtcgggccacatcaagcggccgatgaacgcgttcatggtatggtccaagatcgaacgcaggaagatcatggagcagtctccggacatgcacaacgccgagatctccaagaggctgggcaagcgctggaaaatgctgaaggacagcgagaagatcccgttcatccgggaggcggagcggctgcggctcaagcacatggccgactaccccgactacaagtaccggccccggaaaaagcccaaaatggacccctcggccaagcccagcgccagccagagcccagagaagagcgcggccggcggcggcggcgggagcgcgggcggaggcgcgggcggtgccaagacctccaagggctccagcaagaaatgcggcaagctcaaggcccccgcggccgcgggcgccaaggcgggcgcgggcaaggcggcccagtccggggactacgggggcgcgggcgacgactacgtgctgggcagcctgcgcgtgagcggctcgggcggcggcggcgcgggcaagacggtcaagtgcgtgtttctggatgaggacgacgacgacgacgacgacgacgacgagctgcagctgcagatcaaacaggagccggacgaggaggacgaggaaccaccgcaccagcagctcctgcagccgccggggcagcagccgtcgcagctgctgagacgctacaacgtcgccaaagtgcccgccagccctacgctgagcagctcggcggagtcccccgagggagcgagcctctacgacgaggtgcgggccggcgcgacctcgggcgccgggggcggcagccgcctctactacagcttcaagaacatcaccaagcagcacccgccgccgctcgcgcagcccgcgctgtcgcccgcgtcctcgcgctcggtgtccacctcctcgtccagcagcagcggcagcagcagcggcagcagcggcgaggacgccgacgacctgatgttcgacctgagcttgaatttctctcaaagcgcgcacagcgccagcgagcagcagctggggggcggcgcggcggccgggaacctgtccctgtcgctggtggataaggatttggattcgttcagcgagggcagcctgggctcccacttcgagttccccgactactgcacgccggagctgagcgagatgatcgcgggggactggctggaggcgaacttctccgacctggtgttcacatattgaaaggcgcccgctgctcgctctttctctcggagggtgcagagctgggttccttgggaggaagttgtagtggtgatgatgatgatgatgataatgatgatgatgatggtggtgttgatggtggcggtggtagggtggaggggagagaagaagatgctgatgatattgataagatgtcgtgacgcaaagaaattggaaaacatgatgaaaattttggtggagttaaagtgaaatgagtagtttttaaacatttttcctgtcctttttttgtcccccctcccttcctttatcgtgtctcaaggtagttgcatacctagtctggagttgtgattattttcccaaaaaatgtgtttttgtaattactatttctttttcctgaaattcgtgattgcaacaaaggcagagggggcggngcggnggaggggaggtaggacccgctccggaaggcgctgtttgaagcttgtcggtctttgaagtctggaagacgtctgcagaggacccttttggcagcacaactgttactctagggagttggtggagatatttttttttcttaagagaacttaaagaactggtgatttttttttaacaaaaaaagggaccattgcaacttttgttaattnaatttttttttttttttttttttttttttttttggagggagaaaactgatgtcttctatgcatccgattcttaacaaaactgcagggagcttgaaaaaatgcagactgtacaaacgcttacaaaaaaaaaaactgtgaactgacttaagatcagagtttacttttcagatcaaattgtttatggttttacaaatgtgatttctacttgccaactttttttttgtaacttgttcccttatacctccttgattgaataccagacagcctagacctcagtacaaaaggtattgaaacatttttgatacataacagacctcagtcttttttaaaaattaatatattttcaggcgtatttttgtacagtgaaaagggaacattcttgctgtgttttttcagtaagactttcaggcacttcttcccttttgatttcttttttttcctctgttttttagcatgcaagtatgttggtacgttatgtcctggtttaaaaaggattaaaattttaaaataatccttgcatctaaaggccttgtggttttaaaaaaaaaaagcaaacttttttttgtacagctatagtagagatttgttcaatatttgtaggtaaagatttattgaaaatggtgatatagacctcagagctgttatcttagtttaaagattgtatatgtactgtactatagtaggactttatgtatctcatacgctgtgatgtggatggggccccagatggaaggtttgaaactggattctcgatttttagcaaaaaagaaaaaaaaaaggcacatagtttaaaaagtttctcattttgtgcaatataatctaaataaagtacagaccatctgcatattttgtagcaaatggtggcaaagcagactcaatgcactgtcgacatcattgcctgtttttttttttttttttttgtgctggaagtctgtatcttgacaattttaataaatcagctggaactgatagaaactcgcatcgccaatagtctctatggaagtcaaactggaggtcctgttgtcgcagagcattcggtggtgaggctgttgtgtgcgcggatgaggggaggtggcaggagagaattctacatttagggggttaggctgaaaagtgttcaattagcaggctgatttctttttcctcttccgctagttgtgaaagacaggggaagggtgttctttctctctgccctccctttccatctccagctccccatttcctttctcacctcctcctccactccctgcctcttctccccacccatcctggcgggcgggctgcgcggaggctcgggagctggccggggaggggcggatggaggggcctgggttgccagctcccttggtcggggtcctgctcgctggggcttgtgtgttctctgcggcgggccgcgtccccgctgagcctcgcggtgacagccgcctttggcagcgagcgctcggggcacttctatccccgcctctcaaagggtggggacagccgtttccagatttgaattttttctgttctttatttttaacgctgcatcttcgcgtgtgctcagaggtggttgttggcggagaacgccgccgcagtgtttgacctctagcggtgaagggggaaggggaagaggaaaggagagaagtggtcggtgtctgtttccttctgtcccccggggccgtggagctgtcggagggaaggaggacggtgcggggccgcagggggcgcggggcgcggcgggacccaggctacgagcgggagggaggcgggagtcgggggaagacgcggcaggccggccgagggcaccccgaggaacatggcatggcctctgtgcgatccgagtcgcggtctccggggtgcctgggagggccgaaccactggtgagggcgtggngacngggggtggnagagggnacccgggnngnngtccgggncncgcaangcnnngcccnnncgntncnggnccccgnncctggctcttnttgcctcnccnccncntgctcntnggcgcnacgccctccccgcgcgccggctcaggggctgccccggaatcagctccccggggccgccgcaacgaaggtggatccgcatcttgattgttctccgggagcctcctgggggctccggcggcggcgcgggcgcgacccatcccgctggcgctccccgctcgctgaaccccgtttgcctgtccacaccccctcgctccccaccatttttcctgaccggcctgtgtccccgagccctcgcggcaggcccgagcaggcgatcgcggccgggcacgcgcgccccgggctcccgccccccttccgagcatccgccgcctcttttctgctgggtctgggaggagggaggctgggaggccgctcggggcccagcgtgccagccccggagttcagcctcccgagctgcggcgcccgcagcggaggaggttttcagtggctgattgaaactcactgcaaaatcaccacgactctttcacctactgagatgattgaccgaggtttggccttccatttttactgagatttggcgagaccgaatggaancgtccgcanagtaactgcagctgctaggccagaggggccccggcgcccttcccgcctcccctcccgcttgcttttgccttactcgatcttaccaccacccctcccccggccccccgactgagaactcgggcctctcacccgccccccagcctcccgctctgggcgagcctcctccccagcccccacccctgggatgcgaagcagcaagcttttgctgcagatggacaggtttcttttctgtggctttttcctttcgataaaccatcagatttcagtagtacatttgggaaaagaaggggctgatggcgttaaccaggttctcaatatagaactggatttctggagttgtttaccttaccccacaccccctcaacatgtagactaatgcagccattggtggtacatttattttagccacggataattgaaccagcggtttacaattgacacgtgctccgtgctggtgattttatgtggcagccctctgctgcagttccgaaacttgttggcaacgtaaacccattgataggctgatctatgtattttgaaagcctgaaaacttggcatgtcttttctgttttaatcatagatgaatcttggacattttctgtggtgaggtggaaactttaagtaaattagtaaagtaataatttggcttcagaatgggaagagatagtcaagattttttttttttaaagccatgtggcctaacttgatacaaaaataaaagtaattgtttggcaatctaaatttaaaacctgttagaactcaggacaggcgcttcaatgcgctttttaacaatatttaaggctgttttgatgagtgcgttgtgagaatcatcttaatgaattctttattgagtgtctaaaacatagtataatacacatggtattcttgccactggatagtcttcaataaaagtttaattgatttttttttgttggtctcttaagtaagtcttatttttaactaagcattgacagaatatcttaaaatggtaacctgggggtggcgggtgggtgctgtgtgcacggcagcctagccagtggggatcctgctgtttattataagtagttcacagactctgatggcattttggtaagctttccatctttaagaaattgaaccagcattctcttattaattctttaaactgtggaagtaatttccagttcttacactctgatacgcatcccttttatttaaaaaaaaaaaaaatgctaataaaaggcagtgtacttaaactgtgctttgcaaatattgtgtatgttatgaatgactacagacactgggcaaattatttgtagaatgattatcctttagctagagaaagaaatcattacaactcttttgggcagagatgtttctttttaatgttaatcaaggggaagtgatttaaatatgcataaatgtagcagtcagggtgatttagttgcttttttcatgaaagaaaaagactcaaaagacaagacttatttttctcttctgggacttgaaatcataatcatctgatattagtacagtacaagaaatttacatttgttttttacttcagaatttaagtgacttttgcccaaggaatttgagaaataaggcaaataagttgctctattttaaagtagtcattcaatataaatatattatatcaatcttaacttttttattctctgatatgattaataatatgtatattcttacttttcttctaatgggcatatgtatccttgtggacactttgagagaggttttcttggactctcccatttatagaatctttatactcttttactgtgtggttccctgcttttaacagatttctgaggcaaatatatttgtgcttttttcttatgtaggaagaccagcgaaaatagtttactgagttgtcaattttatcagtagataagaaactttctttattacagtttcagggaagattttttcaggatatttctcagttattctaagggccaaattttgtaaaatttccattaggaatgtcagtttcaaataccctttgtatagcctaagcctgtgaggataacaagaatgagccttacctatcctaacacagggatttacaagttcccaaagtaaccgtctccatgtaactcttgacatacttttctgagatttggcttatttttattattggttatttctcactgttcattctatttgatttattctacaacatccccttttatttgatgatctggaaaattctgctctttgataacaactcaggatttttttgttcagttttggtttttgccccttcctgtggagcctacattttcaaccacaataaagatgaaacaaaatttatgaaactgagctctcttccattttacttactgctggctttttttttttttccttgattcctaccataccttcgtttttttcattgtacttttttaacactacctatatccattagctgcctaattagttttatctgttccatgtggatgcagtgagtttataagagaatttcacaaacaagtagttttttagtgaacttaaaataaacagaattttaaaggagacctatttttatactcaataaaagcacaaaagtgcagaaagtataaaacggcttacaaagggagacacaagctcataatgttccatgtataaaagtaataactttattgggtagagatattcttacaagatctagcacctctgccagtgcacagataggactgttttaaatgatttgggaacttttggttgcctgcagttgtgaacagagaacttctctacagagaaacaaaccactaaaagcaatatgaccgagttgagatgtggtttccaatgagcaattggtgaatttaagcaacctggatgtgcatatgtggaggctcccgtctcactgtttgatcaaacttcttttatgtagtcacgtagacttgattttttctgcagatgtcagggacaggcttgaagattcctgatgtctcagcacccagcacggctgtcagcctcggcaggaggaagaccacggaaagtgagttttctgggcaggttggagagctgctgacagtgagaatgagcatggtgattacatctcaatatattaaactggctgatagagggaataaaaccacagacaaagtgtagaggggtagattaacatgttttgtcagaaatgtctgaagtagaaaatgaaggaaaaatatcaggggcagttgctgctattgaattcaataccagcaaactccattcctcagtgtctttttttttttcctataaacaatttacagtgtaaatgtattttgacatagaaatcattctgtattgagattcttgatataaaatgcttttatgagagcctgtaagtgatccttggaattattatcagattttttaaaagatgtgtttacatggtgagtgtgtgttgcatattaaatttggttttgtagaaa

SEQ ID NO: 105475 - DNA, 8736 bp, Homo sapiens
  misc_feature (1811)..(1811): n is a, c, g, or t
  misc_feature (1816)..(1816): n is a, c, g, or t
  misc_feature (2021)..(2021): n is a, c, g, or t
  misc_feature (3896)..(3896): n is a, c, g, or t
  misc_feature (3900)..(3900): n is a, c, g, or t
  misc_feature (3909)..(3909): n is a, c, g, or t
  misc_feature (3916)..(3916): n is a, c, g, or t
  misc_feature (3924)..(3925): n is a, c, g, or t
  misc_feature (3927)..(3928): n is a, c, g, or t
  misc_feature (3936)..(3936): n is a, c, g, or t
  misc_feature (3938)..(3938): n is a, c, g, or t
  misc_feature (3944)..(3944): n is a, c, g, or t
  misc_feature (3947)..(3949): n is a, c, g, or t
  misc_feature (3954)..(3956): n is a, c, g, or t
  misc_feature (3959)..(3959): n is a, c, g, or t
  misc_feature (3961)..(3961): n is a, c, g, or t
  misc_feature (3963)..(3963): n is a, c, g, or t
  misc_feature (3966)..(3966): n is a, c, g, or t
  misc_feature (3972)..(3973): n is a, c, g, or t
  misc_feature (3984)..(3984): n is a, c, g, or t
  misc_feature (3992)..(3992): n is a, c, g, or t
  misc_feature (3995)..(3995): n is a, c, g, or t
  misc_feature (3998)..(3998): n is a, c, g, or t
  misc_feature (4000)..(4000): n is a, c, g, or t
  misc_feature (4006)..(4006): n is a, c, g, or t
  misc_feature (4008)..(4008): n is a, c, g, or t
  misc_feature (4014)..(4014): n is a, c, g, or t
  misc_feature (4702)..(4702): n is a, c, g, or t
  misc_feature (4711)..(4711): n is a, c, g, or t
ggggtgggagggggagggggacctccgcacgagacccagcggcccgggttggagcgtccagccctgcaacggatcatggtgcagcaggcggagagcttggaagcggagagcaacctgccccgggaggcgctggacacggaggagggcgaattcatggcttgcagcccggtggccctggacgagagcgacccagactggtgcaagacggcgtcgggccacatcaagcggccgatgaacgcgttcatggtatggtccaagatcgaacgcaggaagatcatggagcagtctccggacatgcacaacgccgagatctccaagaggctgggcaagcgctggaaaatgctgaaggacagcgagaagatcccgttcatccgggaggcggagcggctgcggctcaagcacatggccgactaccccgactacaagtaccggccccggaaaaagcccaaaatggacccctcggccaagcccagcgccagccagagcccagagaagagcgcggccggcggcggcggcgggagcgcgggcggaggcgcgggcggtgccaagacctccaagggctccagcaagaaatgcggcaagctcaaggcccccgcggccgcgggcgccaaggcgggcgcgggcaaggcggcccagtccggggactacgggggcgcgggcgacgactacgtgctgggcagcctgcgcgtgagcggctcgggcggcggcggcgcgggcaagacggtcaagtgcgtgtttctggatgaggacgacgacgacgacgacgacgacgacgagctgcagctgcagatcaaacaggagccggacgaggaggacgaggaaccaccgcaccagcagctcctgcagccgccggggcagcagccgtcgcagctgctgagacgctacaacgtcgccaaagtgcccgccagccctacgctgagcagctcggcggagtcccccgagggagcgagcctctacgacgaggtgcgggccggcgcgacctcgggcgccgggggcggcagccgcctctactacagcttcaagaacatcaccaagcagcacccgccgccgctcgcgcagcccgcgctgtcgcccgcgtcctcgcgctcggtgtccacctcctcgtccagcagcagcggcagcagcagcggcagcagcggcgaggacgccgacgacctgatgttcgacctgagcttgaatttctctcaaagcgcgcacagcgccagcgagcagcagctggggggcggcgcggcggccgggaacctgtccctgtcgctggtggataaggatttggattcgttcagcgagggcagcctgggctcccacttcgagttccccgactactgcacgccggagctgagcgagatgatcgcgggggactggctggaggcgaacttctccgacctggtgttcacatattgaaaggcgcccgctgctcgctctttctctcggagggtgcagagctgggttccttgggaggaagttgtagtggtgatgatgatgatgatgataatgatgatgatgatggtggtgttgatggtggcggtggtagggtggaggggagagaagaagatgctgatgatattgataagatgtcgtgacgcaaagaaattggaaaacatgatgaaaattttggtggagttaaagtgaaatgagtagtttttaaacatttttcctgtcctttttttgtcccccctcccttcctttatcgtgtctcaaggtagttgcatacctagtctggagttgtgattattttcccaaaaaatgtgtttttgtaattactatttctttttcctgaaattcgtgattgcaacaaaggcagagggggcggngcggnggaggggaggtaggacccgctccggaaggcgctgtttgaagcttgtcggtctttgaagtctggaagacgtctgcagaggacccttttggcagcacaactgttactctagggagttggtggagatatttttttttcttaagagaacttaaagaactggtgatttttttttaacaaaaaaagggaccattgcaacttttgttaattnaatttttttttttttttttttttttttttttttggagggagaaaactgatgtcttctatgcatccgattcttaacaaaactgcagggagcttgaaaaaatgcagactgtacaaacgcttacaaaaaaaaaaactgtgaactgacttaagatcagagtttacttttcagatcaaattgtttatggttttacaaatgtgatttctacttgccaactttttttttgtaacttgttcccttatacctccttgattgaataccagacagcctagacctcagtacaaaaggtattgaaacatttttgatacataacagacctcagtcttttttaaaaattaatatattttcaggcgtatttttgtacagtgaaaagggaacattcttgctgtgttttttcagtaagactttcaggcacttcttcccttttgatttcttttttttcctctgttttttagcatgcaagtatgttggtacgttatgtcctggtttaaaaaggattaaaattttaaaataatccttgcatctaaaggccttgtggttttaaaaaaaaaaagcaaacttttttttgtacagctatagtagagatttgttcaatatttgtaggtaaagatttattgaaaatggtgatatagacctcagagctgttatcttagtttaaagattgtatatgtactgtactatagtaggactttatgtatctcatacgctgtgatgtggatggggccccagatggaaggtttgaaactggattctcgatttttagcaaaaaagaaaaaaaaaaggcacatagtttaaaaagtttctcattttgtgcaatataatctaaataaagtacagaccatctgcatattttgtagcaaatggtggcaaagcagactcaatgcactgtcgacatcattgcctgtttttttttttttttttttgtgctggaagtctgtatcttgacaattttaataaatcagctggaactgatagaaactcgcatcgccaatagtctctatggaagtcaaactggaggtcctgttgtcgcagagcattcggtggtgaggctgttgtgtgcgcggatgaggggaggtggcaggagagaattctacatttagggggttaggctgaaaagtgttcaattagcaggctgatttctttttcctcttccgctagttgtgaaagacaggggaagggtgttctttctctctgccctccctttccatctccagctccccatttcctttctcacctcctcctccactccctgcctcttctccccacccatcctggcgggcgggctgcgcggaggctcgggagctggccggggaggggcggatggaggggcctgggttgccagctcccttggtcggggtcctgctcgctggggcttgtgtgttctctgcggcgggccgcgtccccgctgagcctcgcggtgacagccgcctttggcagcgagcgctcggggcacttctatccccgcctctcaaagggtggggacagccgtttccagatttgaattttttctgttctttatttttaacgctgcatcttcgcgtgtgctcagaggtggttgttggcggagaacgccgccgcagtgtttgacctctagcggtgaagggggaaggggaagaggaaaggagagaagtggtcggtgtctgtttccttctgtcccccggggccgtggagctgtcggagggaaggaggacggtgcggggccgcagggggcgcggggcgcggcgggacccaggctacgagcgggagggaggcgggagtcgggggaagacgcggcaggccggccgagggcaccccgaggaacatggcatggcctctgtgcgatccgagtcgcggtctccggggtgcctgggagggccgaaccactggtgagggcgtggngacngggggtggnagagggnacccgggnngnngtccgggncncgcaangcnnngcccnnncgntncnggnccccgnncctggctcttnttgcctcnccnccncntgctcntnggcgcnccccgccgcgggcccttgaggcgcgcggagacaccagcgctggcttcccgggcccgcgggccggggagggaagcctcggggctgcggggtgagaggaagaaagcaaacccggggagcaggcggctgccgcacccgcgcaccccgggccctcaccacgccctccccgcgcgccggctcaggggctgccccggaatcagctccccggggccgccgcaacgaaggtggatccgcatcttgattgttctccgggagcctcctgggggctccggcggcggcgcgggcgcgacccatcccgctggcgctccccgctcgctgaaccccgtttgcctgtccacaccccctcgctccccaccatttttcctgaccggcctgtgtccccgagccctcgcggcaggcccgagcaggcgatcgcggccgggcacgcgcgccccgggctcccgccccccttccgagcatccgccgcctcttttctgctgggtctgggaggagggaggctgggaggccgctcggggcccagcgtgccagccccggagttcagcctcccgagctgcggcgcccgcagcggaggaggttttcagtggctgattgaaactcactgcaaaatcaccacgactctttcacctactgagatgattgaccgaggtttggccttccatttttactgagatttggcgagaccgaatggaancgtccgcanagtaactgcagctgctaggccagaggggccccggcgcccttcccgcctcccctcccgcttgcttttgccttactcgatcttaccaccacccctcccccggccccccgactgagaactcgggcctctcacccgccccccagcctcccgctctgggcgagcctcctccccagcccccacccctgggatgcgaagcagcaagcttttgctgcagatggacaggtttcttttctgtggctttttcctttcgataaaccatcagatttcagtagtacatttgggaaaagaaggggctgatggcgttaaccaggttctcaatatagaactggatttctggagttgtttaccttaccccacaccccctcaacatgtagactaatgcagccattggtggtacatttattttagccacggataattgaaccagcggtttacaattgacacgtgctccgtgctggtgattttatgtggcagccctctgctgcagttccgaaacttgttggcaacgtaaacccattgataggctgatctatgtattttgaaagcctgaaaacttggcatgtcttttctgttttaatcatagatgaatcttggacattttctgtggtgaggtggaaactttaagtaaattagtaaagtaataatttggcttcagaatgggaagagatagtcaagattttttttttttaaagccatgtggcctaacttgatacaaaaataaaagtaattgtttggcaatctaaatttaaaacctgttagaactcaggacaggcgcttcaatgcgctttttaacaatatttaaggctgttttgatgagtgcgttgtgagaatcatcttaatgaattctttattgagtgtctaaaacatagtataatacacatggtattcttgccactggatagtcttcaataaaagtttaattgatttttttttgttggtctcttaagtaagtcttatttttaactaagcattgacagaatatcttaaaatggtaacctgggggtggcgggtgggtgctgtgtgcacggcagcctagccagtggggatcctgctgtttattataagtagttcacagactctgatggcattttggtaagctttccatctttaagaaattgaaccagcattctcttattaattctttaaactgtggaagtaatttccagttcttacactctgatacgcatcccttttatttaaaaaaaaaaaaaatgctaataaaaggcagtgtacttaaactgtgctttgcaaatattgtgtatgttatgaatgactacagacactgggcaaattatttgtagaatgattatcctttagctagagaaagaaatcattacaactcttttgggcagagatgtttctttttaatgttaatcaaggggaagtgatttaaatatgcataaatgtagcagtcagggtgatttagttgcttttttcatgaaagaaaaagactcaaaagacaagacttatttttctcttctgggacttgaaatcataatcatctgatattagtacagtacaagaaatttacatttgttttttacttcagaatttaagtgacttttgcccaaggaatttgagaaataaggcaaataagttgctctattttaaagtagtcattcaatataaatatattatatcaatcttaacttttttattctctgatatgattaataatatgtatattcttacttttcttctaatgggcatatgtatccttgtggacactttgagagaggttttcttggactctcccatttatagaatctttatactcttttactgtgtggttccctgcttttaacagatttctgaggcaaatatatttgtgcttttttcttatgtaggaagaccagcgaaaatagtttactgagttgtcaattttatcagtagataagaaactttctttattacagtttcagggaagattttttcaggatatttctcagttattctaagggccaaattttgtaaaatttccattaggaatgtcagtttcaaataccctttgtatagcctaagcctgtgaggataacaagaatgagccttacctatcctaacacagggatttacaagttcccaaagtaaccgtctccatgtaactcttgacatacttttctgagatttggcttatttttattattggttatttctcactgttcattctatttgatttattctacaacatccccttttatttgatgatctggaaaattctgctctttgataacaactcaggatttttttgttcagttttggtttttgccccttcctgtggagcctacattttcaaccacaataaagatgaaacaaaatttatgaaactgagctctcttccattttacttactgctggctttttttttttttccttgattcctaccataccttcgtttttttcattgtacttttttaacactacctatatccattagctgcctaattagttttatctgttccatgtggatgcagtgagtttataagagaatttcacaaacaagtagttttttagtgaacttaaaataaacagaattttaaaggagacctatttttatactcaataaaagcacaaaagtgcagaaagtataaaacggcttacaaagggagacacaagctcataatgttccatgtataaaagtaataactttattgggtagagatattcttacaagatctagcacctctgccagtgcacagataggactgttttaaatgatttgggaacttttggttgcctgcagttgtgaacagagaacttctctacagagaaacaaaccactaaaagcaatatgaccgagttgagatgtggtttccaatgagcaattggtgaatttaagcaacctggatgtgcatatgtggaggctcccgtctcactgtttgatcaaacttcttttatgtagtcacgtagacttgattttttctgctgtgaaaatgaaaaaataaagcaatatgacaaaaagtttaaaaatgcataaaaaataggatttcctctaggctcctcgaagagatttttttaatatgatgcttgtcttactttcttagacacgttacatttccccttccaaaaaaaaaaaaaaaggacaactggaagtaatttatcatataaagaattttgatcaaatagatattgacaaagggccctctgtcacatttttcttcatccagcttttgttcaaaaacagtatgcctcctcccttgaatcacatagggagaaacgttatactccattctcattaatttcccattttgtctacttttactcttgtacatatgttgtgggtttaagagtcttttgcatttgttctgtgacacctttttttgaattgactgttttaaaacggaggcctattttttccggtttgggactcctagtggttatggcatcccataatgcttcgtgacggccaccaggacagaaccacctgatgttttagagcagttttcagcatgacactgttaacaagtgtgtattttccaaggccacatgaaacttactttcttagccactccaggtttgggagcagaaaagctgaaaaacccttttgtgtagaagtctgagtggtttgtgggggggaccttttttagagtttgcatgccagcgcacggcctattgctgtgaaacagagagaaggtaaagctacctgaggcagtgcgctggaggatgaagtgtttgatagcactaggggggaaagaaaatgcatggcaaagtttcgtcttctcgtagactatctagcatgcagagtgtagtgtgttgaaacggtgtatgacattgctgtatcaaagttgtaaaattaagcattatttattgaaaactatgtatttttttgtaaaaacctgatcacatagagaatatcagtggcttgtgcttgtgcttcgatctaaccagcttcttgacccacccccccttggtatgcagtgttaatgctcagggttgaaaatagtacactccaatgtctcttttgcaagagtttttcacagaggattacatttgttcaaaagactctaataaaattgtgtgatcaatcttca

SEQ ID NO: 105476 - DNA, 1917 bp, Homo sapiens
ggcacgaggcgcaggcctggcgaggcggcggcgggcggaggctgggccggaggggtggggacggcgaggaggtggaggccggcgctccgctccgctccagctcggtttcatgtcccgccaggcgaaggatgacttcctgcggcactacacagtgtcggaccccaggactcaccccaagggctacaccgagtacaaagtaaccgcgcagttcatctcaaagaaggacccagaggatgtcaaagaggtggtggtctggaagcggtacagcgacttccgcaagctgcatggagacctggcctacacccaccgcaacctcttccgccgcctcgaggagttccccgctttcccccgggcccaggtgtttggccggtttgaagcctcagtgatcgaggagcggcgaaagggggcagaggacctgcttcgcttcactgtgcacatacctgcgctcaacaacagcccccagctcaaggagttcttccggggtggggaggtgacccgacccttggaggtgtccagggacctacacatcctgccaccccctctgatccccaccccgccccctgatgacccccggctatcccaactgctccctgcagaaaggaggggcctcgaggaattggaggtgccagtggaccccccaccatccagccctgcccaggaggccctggatctcctctttaactgtgagagcaccgaggaggcatctggttcccctgcccgaggccccctcaccgaggctgagcttgccctcttcgaccccttctccaaggaagaaggcgcagcccccagccccacccatgtggctgagctggcaacgatggaggtggagtctgcaaggctggaccaggaaccctgggagccaggagggcaggaggaggaagaggatggggaaggagggcccacccctgcctacctaagccaggccacagagctcatcacccaggccctgcgggatgagaaggcaggcgcttacgctgctgcactccagggctatcgagacggcgtgcacgtcttgcttcagggagtccccagtgacccgttgcctgcccgccaggaaggtgtgaagaagaaggcagctgagtacctgaagcgggcagaggagatcctgcgcctgcacctgtctcaactcccaccctaacagggagtgggccattccctgggactctcactcctgcactgccagccccttctcctctccccagggcctggccctacctcctggtcttgtaattacaggagccatttctgtaggtaactggaccaagaatgagaaaaataatgaattcttagctccctgattacacctgccaccttggaatccaggactcacacttctgaccctgcctgtctttttggggtttttttgagttggagtctcgctgtgtcgcccagactggagtgcagtggtgggatcacggctcactgcaacctccacctcccaggttcaagcagttctcctgtctcagcctccccagtagctgagattgcaggcacatgccaccacgcccagctaatattttgtattttcagtagggacggggttacaccatgttggccaggctggtctcgaactcctgacctcaagtgatccacccgcctcagtctcccaaagtgctgagattacaggcatgagtcactacgcccggcccatgtctgtctgtcttgatgtgtgagcagcagctgtggtcattaaaccattagtttacccctctagaactggggtctgcaaactcccacctgcagccaaatctggcccacctcctttttaatgtaagggctgtgagagtggtttttactttttttaatgattaaaaaaatcaaaataatattctgtgacaatgacaggtgaaatttatatgtgacaagtgaaaattatatgaaatttaagagtccataaataaaatttgttggaacaca

SEQ ID NO: 105477 - DNA, 492 bp, Homo sapiens
  misc_feature (11)..(11): n is a, c, g, or t
  misc_feature (42)..(42): n is a, c, g, or t
gggttcaaaanaaggtccaccctggtccacaaccctcccccnagtaagcctagaagatttgaagggcacatgccaccacgcccagctaatattttgtattttcagtagggacggggttacaccatgttggccaggctggtctcgaactcctgacctcaagtgatccacccgcctcagtctcccaaagtgctgagattacaggcatgagtcactacgcccggcccatgtctgtctgtcttgatgtgtgagcagcagctgtggtcattaaaccattagtttacccctctagaactggggtctgcaaactcccacctgcagccaaatctggcccacctcctttttaatgtaagggctgtgagagtggtttttactttttttaatgattaaaaaaatcaaaataatattctgtgacaatgacaggtgaaatttatatgtgacaagtgaaaattatatgaaatttaagagtccataaataaaatttgttggaacaca

SEQ ID NO: 105478 - DNA, 1887 bp, Homo sapiens
cccacgcgatccgcccacgacgatccggggacggcgaggaggtggaggccggcgctccgctccgctccagctcggtttcatgtcccgccaggcgaaggatgacttcctgcggcactacacagtgtcggaccccaggactcaccccaagggctacaccgagtacaaagtaaccgcgcagttcatctcaaagaaggacccagaggatgtcaaagaggtggtggtctggaagcggtacagcgacttccgcaagctgcatggagacctggcctacacccaccgcaacctcttccgccgcctcgaggagttccccgctttcccccgggcccaggtgtttggccggtttgaagcctcagtgatcgaggagcggcgaaagggggcagaggacctgcttcgcttcactgtgcacatacctgcgctcaacaacagcccccagctcaaggagttcttccggggtggggaggtgacccgacccttggaggtgtccagggacctacacatcctgccaccccctctgatccccaccccgccccctgatgacccccggctatcccaactgctccctgcagaaaggaggggcctcgaggaattggaggtgccagtggaccccccaccatccagccctgcccaggaggccctggatctcctctttaactgtgagagcaccgaggaggcatctggttcccctgcccgaggccccctcaccgaggctgagcttgccctcttcgaccccttctccaaggaagaaggcgcagcccccagccccacccatgtggctgagctggcaacgatggaggtggagtctgcaaggctggaccaggaaccctgggagccaggagggcaggaggaggaagaggatggggaaggagggcccacccctgcctacctaagccaggccacagagctcatcacccaggccctgcgggatgagaaggcaggcgcttacgctgctgcactccagggctatcgagacggcgtgcacgtcttgcttcagggagtccccagtgacccgttgcctgcccgccaggaaggtgtgaagaagaaggcagctgagtacctgaagcgggcagaggagatcctgcgcctgcacctgtctcaactcccaccctaacagggagtgggccattccctgggactctcactcctgcactgccagccccttctcctctccccagggcctggccctacctcctggtcttgtaattacaggagccatttctgtaggtaactggaccaagaatgagaaaaataatgaattcttagctccctgattacacctgccaccttggaatccaggactcacacttctgaccctgcctgtctttttggggtttttttgagttggagtctcgctgtgtcgcccagactggagtgcagtggtgggatcacggctcactgcaacctccacctcccaggttcaagcagttctcctgtctcagcctccccagtagctgagattgcaggcacatgccaccacgcccagctaatattttgtattttcagtagggacggggttacaccatgttggccaggctggtctcgaactcctgacctcaagtgatccacccgcctcagtctcccaaagtgctgagattacaggcatgagtcactacgcccggcccatgtctgtctgtcttgatgtgtgagcagcagctgtggtcattaaaccattagtttacccctctagaactggggtctgcaaactcccacctgcagccaaatctggcccacctcctttttaatgtaagggctgtgagagtggtttttactttttttaatgattaaaaaaatcaaaataatattctgtgacaatgacaggtgaaatttatatgtgacaagtgaaaattatatgaaatttaagagtccataaataaaatttgttggaacaca

SEQ ID NO: 105479 - DNA, 1659 bp, Homo sapiens
ggcacgaggcgcaggcctggcgaggcggcggcgggcggaggctgggccggaggggtggggacggcgaggaggtggaggccggcgctccgctccgctccagctcggtttcatgtcccgccaggcgaaggatgacttcctgcggcactacacagtgtcggaccccaggactcaccccaagggctacaccgagtacaaagtaaccgcgcagttcatctcaaagaaggacccagaggatgtcaaagaggtggtggtctggaagcggtacagcgacttccgcaagctgcatggagacctggcctacacccaccgcaacctcttccgccgcctcgaggagttccccgctttcccccgggcccaggtgtttggccggtttgaagcctcagtgatcgaggagcggcgaaagggggcagaggacctgcttcgcttcactgtgcacatacctgcgctcaacaacagcccccagctcaaggagttcttccggggtggggaggtgacccgacccttggaggtgtccagggacctacacatcctgccaccccctctgatccccaccccgccccctgatgacccccggctatcccaactgctccctgcagaaaggaggggcctcgaggaattggaggtgccagtggaccccccaccatccagccctgcccaggaggccctggatctcctctttaactgtgagagcaccgaggaggcatctggttcccctgcccgaggccccctcaccgaggctgagcttgccctcttcgaccccttctccaaggaaggtgacccgttgcctgcccgccaggaaggtgtgaagaagaaggcagctgagtacctgaagcgggcagaggagatcctgcgcctgcacctgtctcaactcccaccctaacagggagtgggccattccctgggactctcactcctgcactgccagccccttctcctctccccagggcctggccctacctcctggtcttgtaattacaggagccatttctgtaggtaactggaccaagaatgagaaaaataatgaattcttagctccctgattacacctgccaccttggaatccaggactcacacttctgaccctgcctgtctttttggggtttttttgagttggagtctcgctgtgtcgcccagactggagtgcagtggtgggatcacggctcactgcaacctccacctcccaggttcaagcagttctcctgtctcagcctccccagtagctgagattgcaggcacatgccaccacgcccagctaatattttgtattttcagtagggacggggttacaccatgttggccaggctggtctcgaactcctgacctcaagtgatccacccgcctcagtctcccaaagtgctgagattacaggcatgagtcactacgcccggcccatgtctgtctgtcttgatgtgtgagcagcagctgtggtcattaaaccattagtttacccctctagaactggggtctgcaaactcccacctgcagccaaatctggcccacctcctttttaatgtaagggctgtgagagtggtttttactttttttaatgattaaaaaaatcaaaataatattctgtgacaatgacaggtgaaatttatatgtgacaagtgaaaattatatgaaatttaagagtccataaataaaatttgttggaacaca

SEQ ID NO: 105480 - DNA, 1955 bp, Homo sapiens
ggcacgaggcgcaggcctggcgaggcggcggcgggcggaggctgggccggaggggtggggacggcgaggaggtggaggccggcgctccgctccgctccagctcggtttcatgtcccgccaggcgaaggatgacttcctgcggcactacacagtgtcggaccccaggactcaccccaagggctacaccgagtacaaagtaaccgcgcagttcatctcaaagaaggacccagaggatgtcaaagaggtggtggtctggaagcggtacagcgacttccgcaagctgcatggagacctggcctacacccaccgcaacctcttccgccgcctcgaggagttccccgctttcccccgggcccaggtgtttggccggtttgaagcctcagtgatcgaggagcggcgaaagggggcagaggacctgcttcgcttcactgtgcacatacctgcgctcaacaacagcccccagctcaaggagttcttccggggtggggaggtgacccgacccttggaggtgtccagggacctacacatcctgccaccccctctgatccccaccccgccccctgatgacccccggctatcccaactgctccctgcagaaaggaggggcctcgaggaattggaggtgccagtggaccccccaccatccagccctgcccaggaggccctggatctcctctttaactgtgagagcaccgaggaggcatctggttcccctgcccgaggccccctcaccgaggctgagcttgccctcttcgaccccttctccaaggaaggtgacccgttgcctgcccgccaggaaggtgtgaagaagaaggcagctgagtacctgaagcgggcagaggagatcctgcgcctgcacctgtctcaactcccaccctaacagggagtgggccattccctgggactctcactcctgcactgccagccccttctcctctccccagggcctggccctacctcctggtcttgtaattacaggagccatttctgtaggtaactggaccaagaatgagaaaaataatgaattcttagctccctgattacacctgccaccttggaatccaggactcacacttctgaccctgcctgtctttttggggtttttttgagttggagtctcgctgtgtcgcccagactggagtgcagtggtgggatcacggctcactgcaacctccacctcccaggttcaagcagttctcctgtctcagcctccccagtagctgagattgcaggcacatgccaccacgcccagctaatattttgtattttcagtagggacggggttacaccatgttggccaggctggtctcgaactcctgacctcaagtgatccacccgcctcagtctcccaaagtgctgagattacaggcatgagtcactacgcccggcccatgtctgtctgtcttgatgtgtgagcagcagctgtggtcattaaaccattagtttacccctctagaactggggtctgcaaactcccacctgcagccaaatctggcccacctcctttttaatgtaagggctgtgagagtggtttttactttttttaatgattaaaaaaatcaaaataatattctgtgacaatgacaggtgaaatttatatgtgacaagtgaaaattatatgaaatttaagagtccataaataaaatttgttggaacacaaccaggctaattcatttagtattgtgatagctgctttcgcgctacactggcagttgaaacagttgcagagttgagtctttgccgcctgcaaatcccaaaacatttacaacctggccctttgcagaaaacatttgctggcccctgagctagaaaatagggagcatagtctcagggaaatagaggacaagccgatggagccggtttattgggtggaagggacgaaggagaggaacccaaagcccgggtacttgtctcagaggccccaaagccaaatcctgattgctcagcgggctgga

SEQ ID NO: 105481 - DNA, 1088 bp, Homo sapiens
ggcacgaggcgcaggcctggcgaggcggcggcgggcggaggctgggccggaggggtggggacggcgaggaggtggaggccggcgctccgctccgctccagctcggtttcatgtcccgccaggcgaaggatgacttcctgcggcactacacagtgtcggaccccaggactcaccccaagggctacaccgagtacaaagtaaccgcgcagttcatctcaaagaaggacccagaggatgtcaaagaggtggtggtctggaagcggtacagcgacttccgcaagctgcatggagacctggcctacacccaccgcaacctcttccgccgcctcgaggagttccccgctttcccccgggcccaggtgtttggccggtttgaagcctcagtgatcgaggagcggcgaaagggggcagaggacctgcttcgcttcactgtgcacatacctgcgctcaacaacagcccccagctcaaggagttcttccggggtggggaggtgacccgacccttggaggtgtccagggacctacacatcctgccaccccctctgatccccaccccgccccctgatgacccccggctatcccaactgctccctgcagaaaggaggggcctcgaggaattggaggtgccagtggaccccccaccatccagccctgcccaggaggccctggatctcctctttaactgtgagagcaccgaggaggcatctggttcccctgcccgaggccccctcaccgaggctgagcttgccctcttcgaccccttctccaaggaagtctcccaaagtgctgagattacaggcatgagtcactacgcccggcccatgtctgtctgtcttgatgtgtgagcagcagctgtggtcattaaaccattagtttacccctctagaactggggtctgcaaactcccacctgcagccaaatctggcccacctcctttttaatgtaagggctgtgagagtggtttttactttttttaatgattaaaaaaatcaaaataatattctgtgacaatgacaggtgaaatttatatgtgacaagtgaaaattatatgaaatttaagagtccataaataaaatttgttggaacaca

SEQ ID NO: 105482 - DNA, 1801 bp, Homo sapiens
ggcacgaggcgcaggcctggcgaggcggcggcgggcggaggctgggccggaggggtggggacggcgaggaggtggaggccggcgctccgctccgctccagctcggtttcatgtcccgccaggcgaaggatgacttcctgcggcactacacagtgtcggaccccaggactcaccccaagggctacaccgagtacaaagtaaccgcgcagttcatctcaaagaaggacccagaggatgtcaaagaggtggtggtctggaagcggtacagcgacttccgcaagctgcatggagacctggcctacacccaccgcaacctcttccgccgcctcgaggagttccccgctttcccccgggcccaggtgtttgggtggggaggtgacccgacccttggaggtgtccagggacctacacatcctgccaccccctctgatccccaccccgccccctgatgacccccggctatcccaactgctccctgcagaaaggaggggcctcgaggaattggaggtgccagtggaccccccaccatccagccctgcccaggaggccctggatctcctctttaactgtgagagcaccgaggaggcatctggttcccctgcccgaggccccctcaccgaggctgagcttgccctcttcgaccccttctccaaggaagaaggcgcagcccccagccccacccatgtggctgagctggcaacgatggaggtggagtctgcaaggctggaccaggaaccctgggagccaggagggcaggaggaggaagaggatggggaaggagggcccacccctgcctacctaagccaggccacagagctcatcacccaggccctgcgggatgagaaggcaggcgcttacgctgctgcactccagggctatcgagacggcgtgcacgtcttgcttcagggagtccccagtgacccgttgcctgcccgccaggaaggtgtgaagaagaaggcagctgagtacctgaagcgggcagaggagatcctgcgcctgcacctgtctcaactcccaccctaacagggagtgggccattccctgggactctcactcctgcactgccagccccttctcctctccccagggcctggccctacctcctggtcttgtaattacaggagccatttctgtaggtaactggaccaagaatgagaaaaataatgaattcttagctccctgattacacctgccaccttggaatccaggactcacacttctgaccctgcctgtctttttggggtttttttgagttggagtctcgctgtgtcgcccagactggagtgcagtggtgggatcacggctcactgcaacctccacctcccaggttcaagcagttctcctgtctcagcctccccagtagctgagattgcaggcacatgccaccacgcccagctaatattttgtattttcagtagggacggggttacaccatgttggccaggctggtctcgaactcctgacctcaagtgatccacccgcctcagtctcccaaagtgctgagattacaggcatgagtcactacgcccggcccatgtctgtctgtcttgatgtgtgagcagcagctgtggtcattaaaccattagtttacccctctagaactggggtctgcaaactcccacctgcagccaaatctggcccacctcctttttaatgtaagggctgtgagagtggtttttactttttttaatgattaaaaaaatcaaaataatattctgtgacaatgacaggtgaaatttatatgtgacaagtgaaaattatatgaaatttaagagtccataaataaaatttgttggaacaca

SEQ ID NO: 105483 - DNA, 1985 bp, Homo sapiens
ggcacgaggcgcaggcctggcgaggcggcggcgggcggaggctgggccggaggggtggggacggcgaggaggtggaggccggcgctccgctccgctccagctcggtttcatgtcccgccaggcgaaggatgacttcctgcggcactacacagtgtcggaccccaggactcaccccaagggctacaccgagtacaaagtaaccgcgcagttcatctcaaagaaggacccagaggatgtcaaagaggtgaggctcctgggaggaagagggactgttctgcagttccagatctggaaactgtcaaggggcagctggtggtggtctggaagcggtacagcgacttccgcaagctgcatggagacctggcctacacccaccgcaacctcttccgccgcctcgaggagttccccgctttcccccgggcccaggtgtttggccggtttgaagcctcagtgatcgaggagcggcgaaagggggcagaggacctgcttcgcttcactgtgcacatacctgcgctcaacaacagcccccagctcaaggagttcttccggggtggggaggtgacccgacccttggaggtgtccagggacctacacatcctgccaccccctctgatccccaccccgccccctgatgacccccggctatcccaactgctccctgcagaaaggaggggcctcgaggaattggaggtgccagtggaccccccaccatccagccctgcccaggaggccctggatctcctctttaactgtgagagcaccgaggaggcatctggttcccctgcccgaggccccctcaccgaggctgagcttgccctcttcgaccccttctccaaggaagaaggcgcagcccccagccccacccatgtggctgagctggcaacgatggaggtggagtctgcaaggctggaccaggaaccctgggagccaggagggcaggaggaggaagaggatggggaaggagggcccacccctgcctacctaagccaggccacagagctcatcacccaggccctgcgggatgagaaggcaggcgcttacgctgctgcactccagggctatcgagacggcgtgcacgtcttgcttcagggagtccccagtgacccgttgcctgcccgccaggaaggtgtgaagaagaaggcagctgagtacctgaagcgggcagaggagatcctgcgcctgcacctgtctcaactcccaccctaacagggagtgggccattccctgggactctcactcctgcactgccagccccttctcctctccccagggcctggccctacctcctggtcttgtaattacaggagccatttctgtaggtaactggaccaagaatgagaaaaataatgaattcttagctccctgattacacctgccaccttggaatccaggactcacacttctgaccctgcctgtctttttggggtttttttgagttggagtctcgctgtgtcgcccagactggagtgcagtggtgggatcacggctcactgcaacctccacctcccaggttcaagcagttctcctgtctcagcctccccagtagctgagattgcaggcacatgccaccacgcccagctaatattttgtattttcagtagggacggggttacaccatgttggccaggctggtctcgaactcctgacctcaagtgatccacccgcctcagtctcccaaagtgctgagattacaggcatgagtcactacgcccggcccatgtctgtctgtcttgatgtgtgagcagcagctgtggtcattaaaccattagtttacccctctagaactggggtctgcaaactcccacctgcagccaaatctggcccacctcctttttaatgtaagggctgtgagagtggtttttactttttttaatgattaaaaaaatcaaaataatattctgtgacaatgacaggtgaaatttatatgtgacaagtgaaaattatatgaaatttaagagtccataaataaaatttgttggaacaca

SEQ ID NO: 105484 - DNA, 1851 bp, Homo sapiens
cccacgcgatccgcccacgacgatccggggacggcgaggaggtggaggccggcgctccgctccgctccagctcggtttcatgtcccgccaggcgaaggatgacttcctgcggcactacacagtgtcggaccccaggactcaccccaagggctacaccgagtacaaagtaaccgcgcaggtggtggtctggaagcggtacagcgacttccgcaagctgcatggagacctggcctacacccaccgcaacctcttccgccgcctcgaggagttccccgctttcccccgggcccaggtgtttggccggtttgaagcctcagtgatcgaggagcggcgaaagggggcagaggacctgcttcgcttcactgtgcacatacctgcgctcaacaacagcccccagctcaaggagttcttccggggtggggaggtgacccgacccttggaggtgtccagggacctacacatcctgccaccccctctgatccccaccccgccccctgatgacccccggctatcccaactgctccctgcagaaaggaggggcctcgaggaattggaggtgccagtggaccccccaccatccagccctgcccaggaggccctggatctcctctttaactgtgagagcaccgaggaggcatctggttcccctgcccgaggccccctcaccgaggctgagcttgccctcttcgaccccttctccaaggaagaaggcgcagcccccagccccacccatgtggctgagctggcaacgatggaggtggagtctgcaaggctggaccaggaaccctgggagccaggagggcaggaggaggaagaggatggggaaggagggcccacccctgcctacctaagccaggccacagagctcatcacccaggccctgcgggatgagaaggcaggcgcttacgctgctgcactccagggctatcgagacggcgtgcacgtcttgcttcagggagtccccagtgacccgttgcctgcccgccaggaaggtgtgaagaagaaggcagctgagtacctgaagcgggcagaggagatcctgcgcctgcacctgtctcaactcccaccctaacagggagtgggccattccctgggactctcactcctgcactgccagccccttctcctctccccagggcctggccctacctcctggtcttgtaattacaggagccatttctgtaggtaactggaccaagaatgagaaaaataatgaattcttagctccctgattacacctgccaccttggaatccaggactcacacttctgaccctgcctgtctttttggggtttttttgagttggagtctcgctgtgtcgcccagactggagtgcagtggtgggatcacggctcactgcaacctccacctcccaggttcaagcagttctcctgtctcagcctccccagtagctgagattgcaggcacatgccaccacgcccagctaatattttgtattttcagtagggacggggttacaccatgttggccaggctggtctcgaactcctgacctcaagtgatccacccgcctcagtctcccaaagtgctgagattacaggcatgagtcactacgcccggcccatgtctgtctgtcttgatgtgtgagcagcagctgtggtcattaaaccattagtttacccctctagaactggggtctgcaaactcccacctgcagccaaatctggcccacctcctttttaatgtaagggctgtgagagtggtttttactttttttaatgattaaaaaaatcaaaataatattctgtgacaatgacaggtgaaatttatatgtgacaagtgaaaattatatgaaatttaagagtccataaataaaatttgttggaacaca

SEQ ID NO: 105485 - DNA, 558 bp, Homo sapiens
aagcaaacaatgtttgtaagtgctgtttttaatattctttccttacactttctccttatgcccacctatcctctgttaccactgatccacattatgtgcataaggaagtatgtatatgtttgataggatgaaaactaacacagctaaaatgagaagggagggctaagaaaaagaaaactctatagggtgttgtcttcatgagtggtagaaggtcaaaactatgtgtaagtcatttttaatctcaacatttgatcttaaaaggagaagcaagaggaagagttgctcactacgttacccccaccaacaccctcccagataaatgcagttggcattgccattgacaaagtggtacaggaatttggcttacacaatgagaacttggaacagaggctagaaattaaacgtatcatggaaaatgtgttccaacacaagttaccaggtattttctagatttgtttttctatttaactacctaaaagtacctcattcatttctcctaccaatagtaattttcatcaaataaaaatttatttaccatgtcatgaagctcttgtgttt

SEQ ID NO: 105486 - DNA, 1303 bp, Homo sapiens
ggagcccggccgggacaggaagaggctggggaccgcggcgaaggtggtgagtgctcttgggcgccttctcccaacgtccctgccagactcgcctccgggctgattctccagttggtttcctggactccagagtagctgtccggcctggccccggaggtgcaaagtaagaaaattgaagtcaaagaccatgggagatacagcaaaaccttatttcgtgaagcgcactaaagaccgggggactatggatgatgatgacttcagaaggggtcacccccaacaagattatttaataatagatgaccatgctaaaggccatggcagtaaaatggaaaagggccttcaaaaaaagaagataacaccagggaactatgggaatacccccagaaaaggaccatgtgctgtttccagcaatccatatgcatttaaaaacccaatctacagtcaacccgcttggatgaatgacagccacaaagatcagagtaagagatggctgtctgatgaacatactggtaattcagacaactggagagaattcaaacctggacctagaattcctgttataaaccgacaaagaaaagactcctttcaagaaaatgaagatggttataggtggcaagacacaagaggctgcagaactgtaagacgactgtttcataaagacctaacaagcctagaaaccacgtcagaaatggaagcaggaagtcctgaaaacaagaagcagaggtccagacctaggaagccacggaagactagaaatgaggaaaatgagcaggatggagacttggaaggccctgtgatcgatgagtctgtactttcaacgaaggagctgctaggcttacagcaggctgaggagagactgaagagagactgcattgacaggctaaaaaggcgaccacgaaactaccctacagcaaagtacacctgcagactctgtgatgttttaattgaatccattgcatttgcccataagcatatcaaggaaaagaggcacaagaaaaacattaaggagaagcaagaggaagagttgctcactacgttacccccaccaacaccctcccagataaatgcagttggcattgccattgacaaagtggtacaggaatttggcttacacaatgagaacttggaacagaggctagaaattaaacgtatcatggaaaatgtgttccaacacaagttaccaggtattttctagatttgtttttctatttaactacctaaaagtacctcattcatttctcctaccaatagtaattttcatcaaataaaaatttatttaccatgtcatgaagctcttgtgttt

SEQ ID NO: 105487 - DNA, 1128 bp, Homo sapiens
ggagcccggccgggacaggaagaggctggggaccgcggcgaaggtggtgagtgctcttgggcgccttctcccaacgtccctgccagactcgcctccgggctgattctccagttggtttcctggactccagagtagctgtccggcctggccccggaggtgcaaagtaagaaaattgaagtcaaagaccatgggagatacagcaaaaccttatttcgtgaagcgcactaaagaccgggggactatggatgatgatgacttcagaaggggtcacccccaacaagattatttaataatagatgaccatgctaaaggccatggcagtaaaatggaaaagggccttcaaaaaaagaagataacaccagggaactatgggaatacccccagaaaaggaccatgtgctgtttccagcaatccatatgcatttaaaaacccaatctacagtcaacccgcttggatgaatgacagccacaaagatcagagtaagagatggctgtctgatgaacatactggtaattcagacaactggagagaattcaaacctggacctagaattcctgttataaaccgacaaagaaaagactcctttcaagaaaatgaagatggttataggtggcaagacacaagaggctgcagaactgtaagacgactgtttcataaagacctaacaagcctagaaaccacgtcagaaatggaagcaggaagtcctggtaatgttttccaacttgtcagatcacaaccccagagtcagcaatgttttattctttttcatccaaatgagttttgttattttcagcaatttagtttcagtttttcacagtttctgttttaagaaatggtcacttagtgtgattattttaaggatagtaatcatgatatttgagcagctaaaacacatttcatatgttgatccctttaaaagtttactttgccccagggctcactttacgtcagtaaacatgttttctgtaacgtgttttttacagaagagggtagctatatgctccaggggaccatatcgtaattgctcagtggtttgtgtgttttcaaaattgtgattataattttgtatttgaataattaatgtgttcataatataaatgacagaatataaagctttttttaaaaaaa

SEQ ID NO: 105488 - DNA, 229 bp, Homo sapiens
ctcaaaaataaatttcatgcacgttagttatcaccctcctgcctatctttctatctccctagccctaagcaaccactaacctactttcggtctctattgatttgtctgttctggatgtttcatgtaaatttaagcaatatgtagtcttttttttttttttgagacagtcttgctctgttgcccaggctggagtgcagtggtgtgatctcggctcactgcagcctctgcc

SEQ ID NO: 105489 - DNA, 739 bp, Homo sapiens
tttgttgctgcacccgccatagggaagaaatactgtatcttctcatgaaggaaggaaccgaagagaatgagtagccactgcaccttgccctgcgccatcaatgagaagatctgctcttagtagagccctgctttcccgctgaaggccctgaaatcacctgtgttccaggccacccactaaggataaacaaagcttccctgatatggggaattagctcaagtggtagagcgcttgcttagcatgcaagaggtagtgggatcaatgcccacattctccaagctttattatttaggtacccaaacccgagtcagtgtctgagagcaagacactgctctcggtgtctttggttcaagacataggagcagcaacaatacaggactggtgacagcttcctgctggcattcagtatagtgtagatctactgtgtaattaattttctgtttcttcgaggagctgtgaaaccaaaggacatataaaactgctcttttctccctgtttctgcctgcagcttggtcctaaatgtgagacaattgtgaaaagtggaggacagagccacctggttaaatacagccccagctttctggtgagaggactgaaaccaagatgtgtcaagtaactagaatgtgcctggacagatactgtagaaagcaaaaccataaagttgttcatgagcttgtggacgcacctgccagctgtgaataagtggctctaatcccgaacaacttacctaaaaagagcc

SEQ ID NO: 105490 - DNA, 277 bp, Homo sapiens
tgctgggattacaggcgtgagccaccatgtctggcctacattgtggctttaaaagagtcagaaactcagctggagaaaaggttttaggacagcaagagtgccttgtattgtgttgtgatagaaacctcttccataaacattatctaggccctggaatgcccacacccacctttcatgggcatgtcacaccccttcttccctgcctgaatgctcctgacccccatctggcctcctcaggtgttagacaccctgcttcgctggccacaattcaagccct

SEQ ID NO: 105491 - DNA, 400 bp, Homo sapiens
  misc_feature (180)..(180): n is a, c, g, or t
tcaacccaaccacccttctgctttctcttcactctaacatttcttgaaaaaaaagttttattttcttttgagatggagtctcactctgtcaacaggctggagtgcagtggcacaatctcggctcactgcaacctccgcctcccaggagaatctcgtgagcccaggaatttgaggccagtntgagcaacatagtgagaccacatctctattaaaaaacacaaaacaaacaaacaaaatttaaaaactttgtctctactaaaatacaaagattagctgggcattgtggtgggtgcctgtggtcccagctgctcgagaggctgaggcaggagaaatggcgtgaacctggggagttggagcttgccgtgagccaagatcgcaccactgcactccagcctaggcg

SEQ ID NO: 105492 - DNA, 445 bp, Homo sapiens
cctcccagaggtagctgaaaacactggtttgaactgctggttccaggcagtactttgtaaatctggaaaggatagtagcttattccccaggaccttttggtctcagttatatgccaggctatggatatggaagacttctttacaactggcaccattttagcccctgggcccatcagtctttcccttgatctcaggcaagcagggagtgtcatgcccccccagttgcctatcccaacaatagtcactactgactgaggtgcttctttggtcccagtgctgtgctggcccttttcagtcctcccaacaatctcacaaggtaggtattattacatcttccatttgtccatttggaaatacttaagtggcttccatgagtcagccaccatgccaggggtacactgaggagtacacctatagcctctgctctctaggtgcttgcagtcaa

SEQ ID NO: 105493 - DNA, 358 bp, Homo sapiens
cctgcttttaagccatctcctcccttggagcatacaaatcagcagcagccgggatttagctacttggatgctttaattcttccctccaaaatgatctgagtgggaatgaccttaatgaggggtgtgctctaaaggtgagctgtgcttctccaggcagtagattgagaaaagtataggaggatgtttggtttgagggagttgcagaggaagggcacattgttcttttacttatttacagtaaatgggaatttcagcacaggagctttattaagtatatttaagttgttggactccttaaagtgcggactcaatttccagagaaaactattagttaatgtgataaatgcagtctttctgc

SEQ ID NO: 105494 - DNA, 390 bp, Homo sapiens
gacacagggcagggaacatcacacaccggggcctgtcatggggtggggggatgggggagggatagcattaggagagatacctaatgtaaatgacgagttaatgggtgcagcaaaccaacatggcacatgtatacctatgtaacaaacatgcatgatgtgcacatgtaccctagaacttaaaagtgtaattaaaaaaacccatacacagtacattaaaacctgtctaaaccaataaatacactaattaaattaggaaaatataaaattaacataaaagtatatctatggtttcatacagtttaactatctgataaaataaagaaaaaatcttatttactataacattaaataataaatttctgaggaaaaaattaaccaaggaggtaatac

SEQ ID NO: 105495 - DNA, 464 bp, Homo sapiens
ccagagggcacaattaaaatcaaaagaaacagactccatgaaaccagatggtaacaatacaataaattctcctggattcctgcactgcactctaacagccctgaaataaacagtttcctcctcggagctcaagacgcaaccctgcagcaggtaatcaagtgttcaagtagggagggaggggcttggccttggaccaaacacagtttggtggtctgtttataatattttagctgaaacactgcaaacaacagatcgagaggcttactgctgtcacgggttactttcagacccaagtcaaagctgatttaaatccccagaaaacagggagatgggagtgctggggaggggaactgcagtaaggagaagcatctagggctttcagtgaaatgtgagtctaccttccaaaatcccaggggacaacagctcagcctctaaacacttggaaaaccaggattcagcctata

SEQ ID NO: 105496 - DNA, 278 bp, Homo sapiens
acgttgtacgctgactttgttcttcaggcagcatatcatcataggataaatggcaaggtctgcctgctgtgcttttaatggcaacagaaaaactgaagcaagactgctgtcataaagcttaatgctaatttttgtatttttagtagagacagggttttgcctgtaatcccagccacttgggaggctgaggcaggagaatcgcttgaacccaggaggtagaggttgcagtgagccatgatcgtgctgctgcactccagcctaggcaacagagcaagact

SEQ ID NO: 105497 - DNA, 510 bp, Homo sapiens
ttctggtgattatgtctttctgtattttccacctgacgtgggtttaccgccatttcctgcttatcagtgttggaccttatccgctagacttcctgctctcattataggctcctctccccgcctcgcaaatggttataattcctttactggttactttttgctgcaagcaacaagcgtttatctttttaatcttgttccatcaactctacagttattttggcccctgcaaccccttcttcacctagccccaggtgactactatttttgtctgttccagaatttcctataaagggaacttacgggtacgtctttatgtctggctttttttccctcagtgtaatgtttttgagattcttctaggttgttgtattgctctgttattgccgagtaacatcccactatatgaacgagccacaatttgtttattcattcacctgtcggtgaacatttgggttgttgcaaatttgaggctattatgaataaagctgtgatgcctattcatattcaagc

SEQ ID NO: 105498 - DNA, 824 bp, Homo sapiens
ttctttttacttcttcctttcctccattccttctttctttccttttcctttctacctttcttttctttttgcctttcaccttttttctcatttaccttctctcttgagcaacgtcagtaattgatcttgcatctcagagagagagaaagagcatgtgtgagagagaaactggtttctatgccagcactcctgaaaccccttactgtaaggatattttctcttaccccttgggatccaggctctgagtctcttctctttgggagtatccatcaaaatgactttttttaaaaacagattttcccccaaccagaagaatctgcacaaacttggcagcgtttttacttgtttaatgagtttaagacattacatggtgaaagagaagcattttggactcctgcatttttatttaccattcccagactgacgagaaaaagaaaattcctcacataacagcccttctctaaagaaaaaggaaaaagtggctgtaagattagaacattgctacaaagggaatgctgcatgttttatcaaaatgcaatgaccaggaatgatggttgattaaaaaaaaacaaaacaaaaaccactctttccccaccccacccccccaaaccctgaactggaatcaggaaagacggaggaaacaatcaaaatcaccattctattgctttgacacctttactaggtgaattggtggcattcacaaagctaatagggacgtttatatcaagaaacatttctgtatatattgttgaattttagttgtacatatactttgtatgtttttgtcttctttcatatatggagtaaaagccacaaaacgctga

SEQ ID NO: 105499 - DNA, 241 bp, Homo sapiens
tttcgtagtcaacatagtttattatgtatttctctataagccaggactgtggtcattacgataatcaatttagtctgcaaacagataatcttacctaagcgacactgagttcaccaaagtgaaaaacaactggaggtgttgtatgattttaaaaaataatgcaactttttagactggcgttaattttgaaatataaaaatttctttagaaaaaataagatattcattgcgctattaacttc

SEQ ID NO: 105500 - DNA, 207 bp, Homo sapiens
aacaaatgcagaaagtgccactgaggcaggaggcaggattttgcccactaaaagtcaaggctgagtcaggggttgaaggagagcatggtactgtgagttctgagacaggcagggagaggaacctgtgagatgggagtgagagagaggagccctctgctctcactggcacccgtgctgctgggcagggtcagccacaggtggaaattc

SEQ ID NO: 105501 - DNA, 4204 bp, Homo sapiens
tgtgaggcggtgcgcaggggcgggcggaggcgctgtccggccccggccaggcgccgggcggggagcatgggaaggggctagaactgctcgagccccccagccccctccccgggatccgcgccccccttcccgggagaggggccgccccccccggacggacatgggctcctgaagttgcgccgctgccggtcgggggaagagacctgacaggtaattaaatgtgtattttgtggacctgggcttggctggaatgctcaggggtcctgaagatcctattatagcttccttctgttgaaccattaagaaaagatggcgaaagtcaacataactagagacctcatccgtaggcagatcaaggagcggggtgccctgagctttgagcggcgctaccatgtcactgacccctttatccggcggctgggcctggaagcagagctgcagggtcactcaggatgtgtcaactgtctggagtggaatgagaaaggagacttgctggcctctggttccgatgaccagcacacgattgtgtgggacccgctgcaccacaagaagctgctctccatgcacacgggacacaccgcaaatatcttctctgtcaagttcctgcctcacgctggggaccgcatcttgatcacgggggcagccgactctaaggtgcatgtgcacgacctgacagtaaaggagaccatccacatgtttggagaccacacaaaccgggtgaagcgcatcgccacagcgcccatgtggcccaacacattctggagtgctgctgaggatgggcttatccgccagtatgaccttcgagagaacagcaaacactcggaggtgctgattgacctgacagagtactgtggccagctggtggaggccaagtgcctcactgtcaacccccaggacaacaactgcctggcagttggggccagcgggcccttcgtgaggctctatgacatccgcatgatccataaccacagaaagagcatgaagcagagcccttcagcgggtgtgcacaccttctgtgaccggcagaaaccccttccggacggtgcagcccagtattacgtagcaggtcacctgccagtgaagcttcctgactacaacaaccgtttgagagtgctggttgccacctatgtgaccttcagccccaatggcacagagctactagtcaacatggggggggaacaggtctatttgtttgacttgacttacaagcagcggccgtacaccttcctcttgcctagaaaatgccactcctcgggggaagtccagaatggcaagatgtccaccaacggtgtgtccaacggtgtgtccaatggcctgcaccttcatagcaatggcttccggctgccggagagtaggggacatgtcagcccccaagtagagctaccaccatacctggagcgtgtgaaacagcaagccaatgaggcttttgcctgccagcagtggacccaagccattcagctttacagcaaggctgtgcagagggcccctcacaatgccatgctttatggaaaccgagcagcagcctacatgaagcgcaagtgggatggtgaccactatgatgccctgagggactgcctcaaggccatctccctaaacccatgccacctgaaggcacactttcgcctggcccgctgcctctttgagctcaagtatgtggctgaagccctggagtgcctggacgacttcaaagggaaatttccggagcaggcccacagcagcgcttgtgatgcattgggccgcgacatcacagctgccctcttctctaaaaatgatggtgaggagaagaagggacctggtggcggcgccccagtccgcctccgcagcacgagccgcaaggactccatctcagaggatgaaatggtgctgcgggagcgaagctacgactatcagttccgctactgcggccactgcaacaccaccacggatatcaaagaggccaatttctttggcagcaacgctcagtatatcgtcagtggctctgacgatggctccttcttcatctgggaaaaggagaccaccaacctggtccgtgtgctccaaggggatgagtccattgtcaactgcctgcagccacaccccagctactgcttcctggccaccagtggcatcgatcctgttgtgcggctctggaacccccgaccagagagtgaagacctcacaggccgagtcgtggaagatatggagggtgcttcacaggccaaccagcggcgcatgaatgcagacccgttggaggtgatgctgctcaacatgggctaccggatcacgggcctgagcagtgggggtgccggggcctctgatgatgaggacagctctgagggccaggtgcagtgccggcccagctagaccctccagccctggtccccagcccctgctactggctggaccctctgccctgggcaggaggtcaggggattctgttttggtttgtcttccccaccacccttttttttcatttcccctgttttgtttgttagtttggcgttaggggtggaggttgctacaacttgctggctttcggactctgggctgattgtcccctgactatccccagccctgaaaaaaagagcaggaggggacacccctccatatgcccccccccatctcctgctttcatgtccctggagggctctggcctgcctcaaaaccccttctgcctcaggtggggaggaacaagctgaactgtcttcagggactgtcctgccctttagctggcagcagcaggaggagtgggattcccaattggtaagggctcgccttggcctgttgccactcttgctccctagcctgcaaggctagctcccctgtggtcttcaggaaaggttttgaaaaaggatgggtcccaccctccctccagagccaccagtgttagagcggagcccaaaggaaggatgggagccctggagtgggcaagaccaggccacctgctgaggtcgctgtggagcaccctcgctcctctcctggctactagctctggccctgcacctactctcactggccacctctggaggctctgcctttcccaagggccctggcagagggtggggcactgcaccttaccccacccatccatgccagcacttctgcactacggccattctcctcttgggcgctcctcagcctcactgtgacctttctgccagagctcccagccaggcctactctgctgaggtggcgcttcctgctaagggcccttctctgccctttctgccctccttcccatcccacatgctgagccgccacaaagaccaaagaagtgatggcttttctctgtcccctgctgctctgaggggagaggggtgggtctcctgagccactcagatgggaaagtcccttactcggcccctccctccccagcagccccaagctttacactggatgcagcgatcaacccaccactcaccaggcctctcctcccctctgcccccggctcttagctccagctgctccaggtagttggttcatccttccccctctctccctccctgcttccccttcagtgcttacttggctccagccctccagctgcagcccctggggaaaagcagcctcccttctcctctccctccactccctcgctccctccctcagcccctgtctctgccaggtgcctcctctcagtcaggcttcagagcagccctggagacaggagggccatgttaaaagctttttcacagttttaagaagacaagtggagggtgaggatagtggtggggggtctggcaccatctcattgctttaatcccagcaacacaggtggcagcttctcccccttccttcccaccccagtccctcttcccacccctctcttctagcttggtaatgaagtatatttattggtgaaggaaacagctgctgctgcttctcctgctgctgggacctgctcccctgtctcttctccgtgacctttctctagccagggagaagggagagcaggagtattggggctgggccctggggcccaaggaccagctgggtcccctttgctttcttgtgttccagccacctgccatttcctccctgcctcccaccctccctccctgccccctgtcctgcttcccaccccctgcctgcccagcctgggccctgcagtgtggagagacacataagccttactgtcctctgggggcaggagccgagcctttttgttgctccgctcccaggagagtgagggtgacgcaattgattaaaaccattttgttctagg

SEQ ID NO: 105502 - DNA, 5776 bp, Homo sapiens
tgtgaggcggtgcgcaggggcgggcggaggcgctgtccggccccggccaggcgccgggcggggagcatgggaaggggctagaactgctcgagccccccagccccctccccgggatccgcgccccccttcccgggagaggggccgccccccccggacggacatgggctcctgaagttgcgccgctgccggtcgggggaagagacctgacaggtaattaaatgtgtattttgtggacctgggcttggctggaatgctcaggggtcctgaagatcctattatagcttccttctgttgaaccattaagaaaagatggcgaaagtcaacataactagagacctcatccgtaggcagatcaaggagcggggtgccctgagctttgagcggcgctaccatgtcactgacccctttatccggcggctgggcctggaagcagagctgcagggtcactcaggatgtgtcaactgtctggagtggaatgagaaaggagacttgctggcctctggttccgatgaccagcacacgattgtgtgggacccgctgcaccacaagaagctgctctccatgcacacgggacacaccgcaaatatcttctctgtcaagttcctgcctcacgctggggaccgcatcttgatcacgggggcagccgactctaaggtgcatgtgcacgacctgacagtaaaggagaccatccacatgtttggagaccacacaaaccgggtgaagcgcatcgccacagcgcccatgtggcccaacacattctggagtgctgctgaggatgggcttatccgccagtatgaccttcgagagaacagcaaacactcggaggtgctgattgacctgacagagtactgtggccagctggtggaggccaagtgcctcactgtcaacccccaggacaacaactgcctggcagttggggccagcgggcccttcgtgaggctctatgacatccgcatgatccataaccacagaaagagcatgaagcagagcccttcagcgggtgtgcacaccttctgtgaccggcagaaaccccttccggacggtgcagcccagtattacgtagcaggtcacctgccagtgaagcttcctgactacaacaaccgtttgagagtgctggttgccacctatgtgaccttcagccccaatggcacagagctactagtcaacatggggggggaacaggtctatttgtttgacttgacttacaagcagcggccgtacaccttcctcttgcctagaaaatgccactcctcgggggaagtccagaatggcaagatgtccaccaacggtgtgtccaacggtgtgtccaatggcctgcaccttcatagcaatggcttccggctgccggagagtaggggacatgtcagcccccaagtagagctaccaccatacctggagcgtgtgaaacagcaagccaatgaggcttttgcctgccagcagtggacccaagccattcagctttacagcaaggctgtgcagagggcccctcacaatgccatgctttatggaaaccgagcagcagcctacatgaagcgcaagtgggatggtgaccactatgatgccctgagggactgcctcaaggccatctccctaaacccatgccacctgaaggcacactttcgcctggcccgctgcctctttgagctcaagtatgtggctgaagccctggagtgcctggacgacttcaaagggaaatttccggagcaggcccacagcagcgcttgtgatgcattgggccgcgacatcacagctgccctcttctctaaaaatgatggtgaggagaagaagggacctggtggcggcgccccagtccgcctccgcagcacgagccgcaaggactccatctcagaggatgaaatggtgctgcgggagcgaagctacgactatcagttccgctactgcggccactgcaacaccaccacggatatcaaagaggccaatttctttggcaggtccgaggccctgaagaggagggtgcagcccagttggcagcgggaggttgagtggggagtgttggggcataatggtttcagagaagaatctcaaatccctgctctgcctctgtacccttgggcaaatggcttcacctttgtcagcctctaaagttttttaatctatgaaatgaccaacctgccatgcccatttatgaggccataacaaggactaataagataacccaagtagagcctccagcgcagtgcctgaactactccttcatcccccacctccttctccctctgtctgcatgtgccagagcttggtttctttatctgcattcaaggaacctccctctgcttgagagtatgaggcagcagccctccaaggctgggaatcttggcacatctgttttgtgctcaaaactgtgccctgtgtactaagggacaaactctgtgtttcagacaccatcatccccacccctcatttgtagatgtactttctttgggtaggtgagacacatgaacatgaatcaagaatctctccataggccaggcacagtggctcatgcccgtaatcccagcacttggggaggctgaagcaggaggatcgcttgagcccaggagtttgagaccagcctggacagcatagacccccatctctacaaaaaatgttttaaattatctgggtgtggtgacgtgcacctgtagtcccagctattcaggaggttgacattggaggaccagttaaggccacagtgagccatgatcatgccactgtactccagcttgggtgacagaatgagaccctgtctctaagaaaaaaaaagaatccatcaagatgccctctaaatgtcagtggtgtgtgaggggcagggggagtctggatgccagaagcctggaactgctcaggggaggcttaaaacagggtattttggagacccgagagatgatgtaagatgatcctggcccaaggaggtaataatgaactataggggagactgtcttggagaaatccaggtagtcgctggccctaggtttaagagaacagtgaccagggctatatacctggaggaattctgggtcaagtgcacaccccagcgtgtgggggactgagtggctgcagacttccttgctccccctttacctaggccatgcagcctctacttgaggctgtagggcagtaccccacctgacctccctgccctttgcccccccgccacaacgctcagtatatcgtcagtggctctgacgatggctccttcttcatctgggaaaaggagaccaccaacctggtccgtgtgctccaaggggatgagtccattgtcaactgcctgcagccacaccccagctactgcttcctggccaccagtggcatcgatcctgttgtgcggctctggaacccccgaccagagagtgaagacctcacaggccgagtcgtggaagatatggagggtgcttcacaggccaaccagcggcgcatgaatgcagacccgttggaggtgatgctgctcaacatgggctaccggatcacgggcctgagcagtgggggtgccggggcctctgatgatgaggacagctctgagggccaggtgcagtgccggcccagctagaccctccagccctggtccccagcccctgctactggctggaccctctgccctgggcaggaggtcaggggattctgttttggtttgtcttccccaccacccttttttttcatttcccctgttttgtttgttagtttggcgttaggggtggaggttgctacaacttgctggctttcggactctgggctgattgtcccctgactatccccagccctgaaaaaaagagcaggaggggacacccctccatatgcccccccccatctcctgctttcatgtccctggagggctctggcctgcctcaaaaccccttctgcctcaggtggggaggaacaagctgaactgtcttcagggactgtcctgccctttagctggcagcagcaggaggagtgggattcccaattggtaagggctcgccttggcctgttgccactcttgctccctagcctgcaaggctagctcccctgtggtcttcaggaaaggttttgaaaaaggatgggtcccaccctccctccagagccaccagtgttagagcggagcccaaaggaaggatgggagccctggagtgggcaagaccaggccacctgctgaggtcgctgtggagcaccctcgctcctctcctggctactagctctggccctgcacctactctcactggccacctctggaggctctgcctttcccaagggccctggcagagggtggggcactgcaccttaccccacccatccatgccagcacttctgcactacggccattctcctcttgggcgctcctcagcctcactgtgacctttctgccagagctcccagccaggcctactctgctgaggtggcgcttcctgctaagggcccttctctgccctttctgccctccttcccatcccacatgctgagccgccacaaagaccaaagaagtgatggcttttctctgtcccctgctgctctgaggggagaggggtgggtctcctgagccactcagatgggaaagtcccttactcggcccctccctccccagcagccccaagctttacactggatgcagcgatcaacccaccactcaccaggcctctcctcccctctgcccccggctcttagctccagctgctccaggtagttggttcatccttccccctctctccctccctgcttccccttcagtgcttacttggctccagccctccagctgcagcccctggggaaaagcagcctcccttctcctctccctccactccctcgctccctccctcagcccctgtctctgccaggtgcctcctctcagtcaggcttcagagcagccctggagacaggagggccatgttaaaagctttttcacagttttaagaagacaagtggagggtgaggatagtggtggggggtctggcaccatctcattgctttaatcccagcaacacaggtggcagcttctcccccttccttcccaccccagtccctcttcccacccctctcttctagcttggtaatgaagtatatttattggtgaaggaaacagctgctgctgcttctcctgctgctgggacctgctcccctgtctcttctccgtgacctttctctagccagggagaagggagagcaggagtattggggctgggccctggggcccaaggaccagctgggtcccctttgctttcttgtgttccagccacctgccatttcctccctgcctcccaccctccctccctgccccctgtcctgcttcccaccccctgcctgcccagcctgggccctgcagtgtggagagacacataagccttactgtcctctgggggcaggagccgagcctttttgttgctccgctcccaggagagtgagggtgacgcaattgattaaaaccattttgttctaggtgtggctggtggcatttgtggggtgcagatgggtcttggaaccaaagtgagggcacctggtccctcacctctgtagctctatgacttagtaaccacacctctactggacagaatgaggcctgccttgaagggtcaccgtgagcagcggccacccagcccagcagggctgagtgcagagcccagctctcatggctgtgatttgtaatcatcagctttcactctctggctgttttctcatcagtaaaataagggacttggaatcttagtggtttttcaaaccattttacattgtgacccaatatacacatgattacttgtagatatgtgtgtgtgtatatatatataaaaaaaatgaacaaaagttttac

SEQ ID NO: 105503 - DNA, 4572 bp, Homo sapiens
tgtgaggcggtgcgcaggggcgggcggaggcgctgtccggccccggccaggcgccgggcggggagcatgggaaggggctagaactgctcgagccccccagccccctccccgggatccgcgccccccttcccgggagaggggccgccccccccggacggacatgggctcctgaagttgcgccgctgccggtcgggggaagagacctgacaggtaattaaatgtgtattttgtggacctgggcttggctggaatgctcaggggtcctgaagatcctattatagcttccttctgttgaaccattaagaaaagatggcgaaagtcaacataactagagacctcatccgtaggcagatcaaggagcggggtgccctgagctttgagcggcgctaccatgtcactgacccctttatccggcggctgggcctggaagcagagctgcagggtcactcaggatgtgtcaactgtctggagtggaatgagaaaggagacttgctggcctctggttccgatgaccagcacacgattgtgtgggacccgctgcaccacaagaagctgctctccatgcacacgggacacaccgcaaatatcttctctgtcaagttcctgcctcacgctggggaccgcatcttgatcacgggggcagccgactctaaggtgcatgtgcacgacctgacagtaaaggagaccatccacatgtttggagaccacacaaaccgggtgaagcgcatcgccacagcgcccatgtggcccaacacattctggagtgctgctgaggatgggcttatccgccagtatgaccttcgagagaacagcaaacactcggaggtgctgattgacctgacagagtactgtggccagctggtggaggccaagtgcctcactgtcaacccccaggacaacaactgcctggcagttggggccagcgggcccttcgtgaggctctatgacatccgcatgatccataaccacagaaagagcatgaagcagagcccttcagcgggtgtgcacaccttctgtgaccggcagaaaccccttccggacggtgcagcccagtattacgtagcaggtcacctgccagtgaagcttcctgactacaacaaccgtttgagagtgctggttgccacctatgtgaccttcagccccaatggcacagagctactagtcaacatggggggggaacaggtctatttgtttgacttgacttacaagcagcggccgtacaccttcctcttgcctagaaaatgccactcctcgggggaagtccagaatggcaagatgtccaccaacggtgtgtccaacggtgtgtccaatggcctgcaccttcatagcaatggcttccggctgccggagagtaggggacatgtcagcccccaagtagagctaccaccatacctggagcgtgtgaaacagcaagccaatgaggcttttgcctgccagcagtggacccaagccattcagctttacagcaaggctgtgcagagggcccctcacaatgccatgctttatggaaaccgagcagcagcctacatgaagcgcaagtgggatggtgaccactatgatgccctgagggactgcctcaaggccatctccctaaacccatgccacctgaaggcacactttcgcctggcccgctgcctctttgagctcaagtatgtggctgaagccctggagtgcctggacgacttcaaagggaaatttccggagcaggcccacagcagcgcttgtgatgcattgggccgcgacatcacagctgccctcttctctaaaaatgatggtgaggagaagaagggacctggtggcggcgccccagtccgcctccgcagcacgagccgcaaggactccatctcagaggatgaaatggtgctgcgggagcgaagctacgactatcagttccgctactgcggccactgcaacaccaccacggatatcaaagaggccaatttctttggcagcaacgctcagtatatcgtcagtggctctgacgatggctccttcttcatctgggaaaaggagaccaccaacctggtccgtgtgctccaaggggatgagtccattgtcaactgcctgcagccacaccccagctactgcttcctggccaccagtggcatcgatcctgttgtgcggctctggaacccccgaccagagagtgaagacctcacaggccgagtcgtggaagatatggagggtgcttcacaggccaaccagcggcgcatgaatgcagacccgttggaggtgatgctgctcaacatgggctaccggatcacgggcctgagcagtgggggtgccggggcctctgatgatgaggacagctctgagggccaggtgcagtgccggcccagctagaccctccagccctggtccccagcccctgctactggctggaccctctgccctgggcaggaggtcaggggattctgttttggtttgtcttccccaccacccttttttttcatttcccctgttttgtttgttagtttggcgttaggggtggaggttgctacaacttgctggctttcggactctgggctgattgtcccctgactatccccagccctgaaaaaaagagcaggaggggacacccctccatatgcccccccccatctcctgctttcatgtccctggagggctctggcctgcctcaaaaccccttctgcctcaggtggggaggaacaagctgaactgtcttcagggactgtcctgccctttagctggcagcagcaggaggagtgggattcccaattggtaagggctcgccttggcctgttgccactcttgctccctagcctgcaaggctagctcccctgtggtcttcaggaaaggttttgaaaaaggatgggtcccaccctccctccagagccaccagtgttagagcggagcccaaaggaaggatgggagccctggagtgggcaagaccaggccacctgctgaggtcgctgtggagcaccctcgctcctctcctggctactagctctggccctgcacctactctcactggccacctctggaggctctgcctttcccaagggccctggcagagggtggggcactgcaccttaccccacccatccatgccagcacttctgcactacggccattctcctcttgggcgctcctcagcctcactgtgacctttctgccagagctcccagccaggcctactctgctgaggtggcgcttcctgctaagggcccttctctgccctttctgccctccttcccatcccacatgctgagccgccacaaagaccaaagaagtgatggcttttctctgtcccctgctgctctgaggggagaggggtgggtctcctgagccactcagatgggaaagtcccttactcggcccctccctccccagcagccccaagctttacactggatgcagcgatcaacccaccactcaccaggcctctcctcccctctgcccccggctcttagctccagctgctccaggtagttggttcatccttccccctctctccctccctgcttccccttcagtgcttacttggctccagccctccagctgcagcccctggggaaaagcagcctcccttctcctctccctccactccctcgctccctccctcagcccctgtctctgccaggtgcctcctctcagtcaggcttcagagcagccctggagacaggagggccatgttaaaagctttttcacagttttaagaagacaagtggagggtgaggatagtggtggggggtctggcaccatctcattgctttaatcccagcaacacaggtggcagcttctcccccttccttcccaccccagtccctcttcccacccctctcttctagcttggtaatgaagtatatttattggtgaaggaaacagctgctgctgcttctcctgctgctgggacctgctcccctgtctcttctccgtgacctttctctagccagggagaagggagagcaggagtattggggctgggccctggggcccaaggaccagctgggtcccctttgctttcttgtgttccagccacctgccatttcctccctgcctcccaccctccctccctgccccctgtcctgcttcccaccccctgcctgcccagcctgggccctgcagtgtggagagacacataagccttactgtcctctgggggcaggagccgagcctttttgttgctccgctcccaggagagtgagggtgacgcaattgattaaaaccattttgttctaggtgtggctggtggcatttgtggggtgcagatgggtcttggaaccaaagtgagggcacctggtccctcacctctgtagctctatgacttagtaaccacacctctactggacagaatgaggcctgccttgaagggtcaccgtgagcagcggccacccagcccagcagggctgagtgcagagcccagctctcatggctgtgatttgtaatcatcagctttcactctctggctgttttctcatcagtaaaataagggacttggaatcttagtggtttttcaaaccattttacattgtgacccaatatacacatgattacttgtagatatgtgtgtgtgtatatatatataaaaaaaatgaacaaaagttttac

SEQ ID NO: 105504 - DNA, 3894 bp, Homo sapiens
tgtgaggcggtgcgcaggggcgggcggaggcgctgtccggccccggccaggcgccgggcggggagcatgggaaggggctagaactgctcgagccccccagccccctccccgggatccgcgccccccttcccgggagaggggccgccccccccggacggacatgggctcctgaagttgcgccgctgccggtcgggggaagagacctgacaggtaattaaatgtgtattttgtggacctgggcttggctggaatgctcaggggtcctgaagatcctattatagcttccttctgttgaaccattaagaaaagatggcgaaagtcaacataactagagacctcatccgtaggcagatcaaggagcggggtgccctgagctttgagcggcgctaccatgtcactgacccctttatccggcggctgggcctggaagcagagctgcagggtcactcaggatgtgtcaactgtctggagtggaatgagaaaggagacttgctggcctctggttccgatgaccagcacacgattgtgtgggacccgctgcaccacaagaagctgctctccatgcacacgggacacaccgcaaatatcttctctgtcaagttcctgcctcacgctggggaccgcatcttgatcacgggggcagccgactctaaggtgcatgtgcacgacctgacagtaaaggagaccatccacatgtttggagaccacacaaaccgggtgaagcgcatcgccacagcgcccatgtggcccaacacattctggagtgctgctgaggatgggcttatccgccagtatgaccttcgagagaacagcaaacactcggaggtgctgattgacctgacagagtactgtggccagctggtggaggccaagtgcctcactgtcaacccccaggacaacaactgcctggcagttggggccagcgggcccttcgtgaggctctatgacatccgcatgatccataaccacagaaagagcatgaagcagagcccttcagcgggtgtgcacaccttcatagcaatggcttccggctgccggagagtaggggacatgtcagcccccaagtagagctaccaccatacctggagcgtgtgaaacagcaagccaatgaggcttttgcctgccagcagtggacccaagccattcagctttacagcaaggctgtgcagagggcccctcacaatgccatgctttatggaaaccgagcagcagcctacatgaagcgcaagtgggatggtgaccactatgatgccctgagggactgcctcaaggccatctccctaaacccatgccacctgaaggcacactttcgcctggcccgctgcctctttgagctcaagtatgtggctgaagccctggagtgcctggacgacttcaaagggaaatttccggagcaggcccacagcagcgcttgtgatgcattgggccgcgacatcacagctgccctcttctctaaaaatgatggtgaggagaagaagggacctggtggcggcgccccagtccgcctccgcagcacgagccgcaaggactccatctcagaggatgaaatggtgctgcgggagcgaagctacgactatcagttccgctactgcggccactgcaacaccaccacggatatcaaagaggccaatttctttggcagcaacgctcagtatatcgtcagtggctctgacgatggctccttcttcatctgggaaaaggagaccaccaacctggtccgtgtgctccaaggggatgagtccattgtcaactgcctgcagccacaccccagctactgcttcctggccaccagtggcatcgatcctgttgtgcggctctggaacccccgaccagagagtgaagacctcacaggccgagtcgtggaagatatggagggtgcttcacaggccaaccagcggcgcatgaatgcagacccgttggaggtgatgctgctcaacatgggctaccggatcacgggcctgagcagtgggggtgccggggcctctgatgatgaggacagctctgagggccaggtgcagtgccggcccagctagaccctccagccctggtccccagcccctgctactggctggaccctctgccctgggcaggaggtcaggggattctgttttggtttgtcttccccaccacccttttttttcatttcccctgttttgtttgttagtttggcgttaggggtggaggttgctacaacttgctggctttcggactctgggctgattgtcccctgactatccccagccctgaaaaaaagagcaggaggggacacccctccatatgcccccccccatctcctgctttcatgtccctggagggctctggcctgcctcaaaaccccttctgcctcaggtggggaggaacaagctgaactgtcttcagggactgtcctgccctttagctggcagcagcaggaggagtgggattcccaattggtaagggctcgccttggcctgttgccactcttgctccctagcctgcaaggctagctcccctgtggtcttcaggaaaggttttgaaaaaggatgggtcccaccctccctccagagccaccagtgttagagcggagcccaaaggaaggatgggagccctggagtgggcaagaccaggccacctgctgaggtcgctgtggagcaccctcgctcctctcctggctactagctctggccctgcacctactctcactggccacctctggaggctctgcctttcccaagggccctggcagagggtggggcactgcaccttaccccacccatccatgccagcacttctgcactacggccattctcctcttgggcgctcctcagcctcactgtgacctttctgccagagctcccagccaggcctactctgctgaggtggcgcttcctgctaagggcccttctctgccctttctgccctccttcccatcccacatgctgagccgccacaaagaccaaagaagtgatggcttttctctgtcccctgctgctctgaggggagaggggtgggtctcctgagccactcagatgggaaagtcccttactcggcccctccctccccagcagccccaagctttacactggatgcagcgatcaacccaccactcaccaggcctctcctcccctctgcccccggctcttagctccagctgctccaggtagttggttcatccttccccctctctccctccctgcttccccttcagtgcttacttggctccagccctccagctgcagcccctggggaaaagcagcctcccttctcctctccctccactccctcgctccctccctcagcccctgtctctgccaggtgcctcctctcagtcaggcttcagagcagccctggagacaggagggccatgttaaaagctttttcacagttttaagaagacaagtggagggtgaggatagtggtggggggtctggcaccatctcattgctttaatcccagcaacacaggtggcagcttctcccccttccttcccaccccagtccctcttcccacccctctcttctagcttggtaatgaagtatatttattggtgaaggaaacagctgctgctgcttctcctgctgctgggacctgctcccctgtctcttctccgtgacctttctctagccagggagaagggagagcaggagtattggggctgggccctggggcccaaggaccagctgggtcccctttgctttcttgtgttccagccacctgccatttcctccctgcctcccaccctccctccctgccccctgtcctgcttcccaccccctgcctgcccagcctgggccctgcagtgtggagagacacataagccttactgtcctctgggggcaggagccgagcctttttgttgctccgctcccaggagagtgagggtgacgcaattgattaaaaccattttgttctagg

SEQ ID NO: 105505 - DNA, 4236 bp, Homo sapiens
tgtgaggcggtgcgcaggggcgggcggaggcgctgtccggccccggccaggcgccgggcggggagcatgggaaggggctagaactgctcgagccccccagccccctccccgggatccgcgccccccttcccgggagaggggccgccccccccggacggacatgggctcctgaagttgcgccgctgccggtcgggggaagagacctgacaggtaattaaatgtgtattttgtggacctgggcttggctggaatgctcaggggtcctgaagatcctattatagcttccttctgttgaaccattaagaaaagatggcgaaagtcaacataactagagacctcatccgtaggcagatcaaggagcggggtgccctgagctttgagcggcgctaccatgtcactgacccctttatccggcggctgggcctggaagcagagctgcagggtcactcaggatgtgtcaactgtctggagtggaatgagaaaggagacttgctggcctctggttccgatgaccagcacacgattgtgtgggacccgctgcaccacaagaagctgctctccatgcacacgggacacaccgcaaatatcttctctgtcaagttcctgcctcacgctggggaccgcatcttgatcacgggggcagccgactctaaggtgcatgtgcacgacctgacagtaaaggagaccatccacatgtttggagaccacacaaaccgggtgaagcgcatcgccacagcgcccatgtggcccaacacattctggagtgctgctgaggatgggcttatccgccagtatgaccttcgagagaacagcaaacactcggaggtgctgattgacctgacagagtactgtggccagctggtggaggccaagtgcctcactgtcaacccccaggacaacaactgcctggcagttggggccagcgggcccttcgtgaggctctatgacatccgcatgatccataaccacagaaagagcatgaagcagagcccttcagcgggtgtgcacaccttcatagcaatggcttccggctgccggagagtaggggacatgtcagcccccaagtagagctaccaccatacctggagcgtgtgaaacagcaagccaatgaggcttttgcctgccagcagtggacccaagccattcagctttacagcaaggctgtgcagagggcccctcacaatgccatgctttatggaaaccgagcagcagcctacatgaagcgcaagtgggatggtgaccactatgatgccctgagggactgcctcaaggccatctccctaaacccatgccacctgaaggcacactttcgcctggcccgctgcctctttgagctcaagtatgtggctgaagccctggagtgcctggacgacttcaaagggaaatttccggagcaggcccacagcagcgcttgtgatgcattgggccgcgacatcacagctgccctcttctctaaaaatgatggtgaggagaagaagggacctggtggcggcgccccagtccgcctccgcagcacgagccgcaaggactccatctcagaggatgaaatggtgctgcgggagcgaagctacgactatcagttccgctactgcggccactgcaacaccaccacggatatcaaagaggccaatttctttggcagcaacgctcagtatatcgtcagtggctctgacgatggctccttcttcatctgggaaaaggagaccaccaacctggtccgtgtgctccaaggggatgagtccattgtcaactgcctgcagccacaccccagctactgcttcctggccaccagtggcatcgatcctgttgtgcggctctggaacccccgaccagagagtgaagacctcacaggccgagtcgtggaagatatggagggtgcttcacaggccaaccagcggcgcatgaatgcagacccgttggaggtgatgctgctcaacatgggctaccggatcacgggcctgagcagtgggggtgccggggcctctgatgatgaggacagctctgagggccaggtgcagtgccggcccagctagaccctccagccctggtccccagcccctgctactggctggaccctctgccctgggcaggaggtcaggggattctgttttggtttgtcttccccaccacccttttttttcatttcccctgttttgtttgttagtttggcgttaggggtggaggttgctacaacttgctggctttcggactctgggctgattgtcccctgactatccccagccctgaaaaaaagagcaggaggggacacccctccatatgcccccccccatctcctgctttcatgtccctggagggctctggcctgcctcaaaaccccttctgcctcaggtggggaggaacaagctgaactgtcttcagggactgtcctgccctttagctggcagcagcaggaggagtgggattcccaattggtaagggctcgccttggcctgttgccactcttgctccctagcctgcaaggctagctcccctgtggtcttcaggaaaggttttgaaaaaggatgggtcccaccctccctccagagccaccagtgttagagcggagcccaaaggaaggatgggagccctggagtgggcaagaccaggccacctgctgaggtcgctgtggagcaccctcgctcctctcctggctactagctctggccctgcacctactctcactggccacctctggaggctctgcctttcccaagggccctggcagagggtggggcactgcaccttaccccacccatccatgccagcacttctgcactacggccattctcctcttgggcgctcctcagcctcactgtgacctttctgccagagctcccagccaggcctactctgctgaggtggcgcttcctgctaagggcccttctctgccctttctgccctccttcccatcccacatgctgagccgccacaaagaccaaagaagtgatggcttttctctgtcccctgctgctctgaggggagaggggtgggtctcctgagccactcagatgggaaagtcccttactcggcccctccctccccagcagccccaagctttacactggatgcagcgatcaacccaccactcaccaggcctctcctcccctctgcccccggctcttagctccagctgctccaggtagttggttcatccttccccctctctccctccctgcttccccttcagtgcttacttggctccagccctccagctgcagcccctggggaaaagcagcctcccttctcctctccctccactccctcgctccctccctcagcccctgtctctgccaggtgcctcctctcagtcaggcttcagagcagccctggagacaggagggccatgttaaaagctttttcacagttttaagaagacaagtggagggtgaggatagtggtggggggtctggcaccatctcattgctttaatcccagcaacacaggtggcagcttctcccccttccttcccaccccagtccctcttcccacccctctcttctagcttggtaatgaagtatatttattggtgaaggaaacagctgctgctgcttctcctgctgctgggacctgctcccctgtctcttctccgtgacctttctctagccagggagaagggagagcaggagtattggggctgggccctggggcccaaggaccagctgggtcccctttgctttcttgtgttccagccacctgccatttcctccctgcctcccaccctccctccctgcctgcccagcctgggccctgcagtgtggagagacacataagccttactgtcctctgggggcaggagccgagcctttttgttgctccgctcccaggagagtgagggtgacgcaattgattaaaaccattttgttctaggtgtggctggtggcatttgtggggtgcagatgggtcttggaaccaaagtgagggcacctggtccctcacctctgtagctctatgacttagtaaccacacctctactggacagaatgaggcctgccttgaagggtcaccgtgagcagcggccacccagcccagcagggctgagtgcagagcccagctctcatggctgtgatttgtaatcatcagctttcactctctggctgttttctcatcagtaaaataagggacttggaatcttagtggtttttcaaaccattttacattgtgacccaatatacacatgattacttgtagatatgtgtgtgtgtatatatatataaaaaaaatgaacaaaagttttac

SEQ ID NO: 105506 - DNA, 3290 bp, Homo sapiens
tgtgaggcggtgcgcaggggcgggcggaggcgctgtccggccccggccaggcgccgggcggggagcatgggaaggggctagaactgctcgagccccccagccccctccccgggatccgcgccccccttcccgggagaggggccgccccccccggacggacatgggctcctgaagttgcgccgctgccggtcgggggaagagacctgacaggtaattaaatgtgtattttgtggacctgggcttggctggaatgctcaggggtcctgaagatcctattatagcttccttctgttgaaccattaagaaaagatggcgaaagtcaacataactagagacctcatccgtaggcagatcaaggagcggggtgccctgagctttgagcggcgctaccatgtcactgacccctttatccggcggctgggcctggaagcagagctgcagggtcactcaggatgtgtcaactgtctggagtggaatgagaaaggagacttgctggcctctggttccgatgaccagcacacgattgtgtgggacccgctgcaccacaagaagctgctctccatgcacacgggacacaccgcaaatatcttctctgtcaagttcctgcctcacgctggggaccgcatcttgatcacgggggcagccgactctaaggtgcatgtgcacgacctgacagtaaaggagaccatccacatgtttggagaccacacaaaccgggtgaagcgcatcgccacagcgcccatgtggcccaacacattctggagtgctgctgaggatgggcttatccgccagtatgaccttcgagagaacagcaaacactcggaggtgctgattgacctgacagagtactgtggccagctggtggaggccaagtgcctcactgtcaacccccaggacaacaactgcctggcagttggggccagcgggcccttcgtgaggctctatgacatccgcatgatccataaccacagaaagagcatgaagcagagcccttcagcgggtgtgcacaccttcatagcaatggcttccggctgccggagagtaggggacatgtcagcccccaagtagagctaccaccatacctggagcgtgtgaaacagcaagccaatgaggcttttgcctgccagcagtggacccaagccattcagctttacagcaaggctgtgcagagggcccctcacaatgccatgctttatggaaaccgagcagcagcctacatgaagcgcaagtgggatggtgaccactatgatgccctgagggactgcctcaaggccatctccctaaacccatgccacctgaaggcacactttcgcctggcccgctgcctctttgagctcaagtatgtggctgaagccctggagtgcctggacgacttcaaagggaaatttccggagcaggcccacagcagcgcttgtgatgcattgggccgcgacatcacagctgccctcttctctaaaaatgatggtgaggagaagaagggacctggtggcggcgccccagtccgcctccgcagcacgagccgcaaggactccatctcagaggatgaaatggtgctgcgggagcgaagctacgactatcagttccgctactgcggccactgcaacaccaccacggatatcaaagaggccaatttctttggcagcaacgctcagtatatcgtcagtggctctgacgatggctccttcttcatctgggaaaaggagaccaccaacctggtccgtgtgctccaaggggatgagtccattgtcaactgcctgcagccacaccccagctactgcttcctggccaccagtggcatcgatcctgttgtgcggctctggaacccccgaccagagagtgaagacctcacaggccgagtcgtggaagatatggagggtgcttcacaggccaaccagcggcgcatgaatgcagacccgttggaggtgatgctgctcaacatgggctaccggatcacgggcctgagcagtgggggtgccggggcctctgatgatgaggacagctctgagggccaggtgcagtgccggcccagctagaccctccagccctggtccccagcccctgctactggctggaccctctgccctgggcaggaggtcaggggattctgttttggtttgtcttccccaccacccttttttttcatttcccctgttttgtttgttagtttggcgttaggggtggaggttgctacaacttgctggctttcggactctgggctgattgtcccctgactatccccagccctgaaaaaaagagcaggaggggacacccctccatatgcccccccccatctcctgctttcatgtccctggagggctctggcctgcctcaaaaccccttctgcctcaggtggggaggaacaagctgaactgtcttcagggactgtcctgccctttagctggcagcagcaggaggagtgggattcccaattggtaagggctcgccttggcctgttgccactcttgctccctagcctgcaaggctagctcccctgtggtcttcaggaaaggttttgaaaaaggatgggtcccaccctccctccagagccaccagtgttagagcggagcccaaaggaaggatgggagccctggagtgggcaagaccaggccacctgctgaggtcgctgtggagcaccctcgctcctctccctccactccctcgctccctccctcagcccctgtctctgccaggtgcctcctctcagtcaggcttcagagcagccctggagacaggagggccatgttaaaagctttttcacagttttaagaagacaagtggagggtgaggatagtggtggggggtctggcaccatctcattgctttaatcccagcaacacaggtggcagcttctcccccttccttcccaccccagtccctcttcccacccctctcttctagcttggtaatgaagtatatttattggtgaaggaaacagctgctgctgcttctcctgctgctgggacctgctcccctgtctcttctccgtgacctttctctagccagggagaagggagagcaggagtattggggctgggccctggggcccaaggaccagctgggtcccctttgctttcttgtgttccagccacctgccatttcctccctgcctcccaccctccctccctgccccctgtcctgcttcccaccccctgcctgcccagcctgggccctgcagtgtggagagacacataagccttactgtcctctgggggcaggagccgagcctttttgttgctccgctcccaggagagtgagggtgacgcaattgattaaaaccattttgttctagg

SEQ ID NO: 105507 - DNA, 3227 bp, Homo sapiens
tgtgaggcggtgcgcaggggcgggcggaggcgctgtccggccccggccaggcgccgggcggggagcatgggaaggggctagaactgctcgagccccccagccccctccccgggatccgcgccccccttcccgggagaggggccgccccccccggacggacatgggctcctgaagttgcgccgctgccggtcgggggaagagacctgacaggtaattaaatgtgtattttgtggacctgggcttggctggaatgctcaggggtcctgaagatcctattatagcttccttctgttgaaccattaagaaaagatggcgaaagtcaacataactagagacctcatccgtaggcagatcaaggagcggggtgccctgagctttgagcggcgctaccatgtcactgacccctttatccggcggctgggcctggaagcagagctgcagggtcactcaggatgtgtcaactgtctggagtggaatgagaaaggagacttgctggcctctggttccgatgaccagcacacgattgtgtgggacccgctgcaccacaagaagctgctctccatgcacacgggacacaccgcaaatatcttctctgtcaagttcctgcctcacgctggggaccgcatcttgatcacgggggcagccgactctaaggtgcatgtgcacgacctgacagtaaaggagaccatccacatgtttggagaccacacaaaccgggtgaagcgcatcgccacagcgcccatgtggcccaacacattctggagtgctgctgaggatgggcttatccgccagtatgaccttcgagagaacagcaaacactcggaggtgctgattgacctgacagagtactgtggccagctggtggaggccaagtgcctcactgtcaacccccaggacaacaactgcctggcagttggggccagcgggcccttcgtgaggctctatgacatccgcatgatccataaccacagaaagagcatgaagcagagcccttcagcgggtgtgcacaccttcatagcaatggcttccggctgccggagagtaggggacatgtcagcccccaagtagagctaccaccatacctggagcgtgtgaaacagcaagccaatgaggcttttgcctgccagcagtggacccaagccattcagctttacagcaaggctgtgcagagggcccctcacaatgccatgctttatggaaaccgagcagcagcctacatgaagcgcaagtgggatggtgaccactatgatgccctgagggactgcctcaaggccatctccctaaacccatgccacctgaaggcacactttcgcctggcccgctgcctctttgagctcaagtatgtggctgaagccctggagtgcctggacgacttcaaagggaaatttccggagcaggcccacagcagcgcttgtgatgcattgggccgcgacatcacagctgccctcttctctaaaaatgatggtgaggagaagaagggacctggtggcggcgccccagtccgcctccgcagcacgagccgcaaggactccatctcagaggatgaaatggtgctgcgggagcgaagctacgactatcagttccgctactgcggccactgcaacaccaccacggatatcaaagaggccaatttctttggcagcaacgctcagtatatcgtcagtggctctgacgatggctccttcttcatctgggaaaaggagaccaccaacctggtccgtgtgctccaaggggatgagtccattgtcaactgcctgcagccacaccccagctactgcttcctggccaccagtggcatcgatcctgttgtgcggctctggaacccccgaccagagagtgaagacctcacaggccgagtcgtggaagatatggagggtgcttcacaggccaaccagcggcgcatgaatgcagacccgttggaggtgatgctgctcaacatgggctaccggatcacgggcctgagcagtgggggtgccggggcctctgatgatgaggacagctctgagggccaggtgcagtgccggcccagctagaccctccagccctggtccccagcccctgctactggctggaccctctgccctgggcaggaggtcaggggattctgttttggtttgtcttccccaccacccttttttttcatttcccctgttttgtttgttagtttggcgttaggggtggaggttgctacaacttgctggctttcggactctgggctgattgtcccctgactatccccagccctgaaaaaaagagcaggaggggacacccctccatatgcccccccccatctcctgctttcatgtccctggagggctctggcctgcctcaaaaccccttctgcctcaggtggggaggaacaagctgaactgtcttcagggactgtcctgccctttagctggcagcagcaggaggagtgggattcccaattggtaagggctcgccttggcctgttgccactcttgctccctagcctgcaaggctagctcccctgtggtcttcaggaaaggttttgaaaaaggatgggtcccaccctccctccagagccaccagtgttagagcggagcccaaaggaaggatgggagccctggagtgggcaagaccaggccacctgctgaggtcgctgtggagcaccctcgctcctctcctggctactagctctggccctgcacctactctcactggccacctctggaggctctgcctttcccaagggccctggcagagggtggggcactgcaccttaccccacccatccatgccagcacttctgcactacggccattctcctcttgggcgctcctcagcctcactgtgacctttctgccagagctcccagccaggcctactctgctgaggtggcgcttcctgctaagggcccttctctgccctttctgccctccttcccatcccacatgctgagccgccacaaagaccaaagaagtgatggcttttctctgtcccctgctgctctgaggggagaggggtgggtctcctgagccactcagatgggaaagtcccttactcggcccctccctccccagcagccccaagctttacactggatgcagcgatcaacccaccacctgcctgcccagcctgggccctgcagtgtggagagacacataagccttactgtcctctgggggcaggagccgagcctttttgttgctccgctcccaggagagtgagggtgacgcaattgattaaaaccattttgttctagg

SEQ ID NO: 105508 - DNA, 1635 bp, Homo sapiens
tgtgaggcggtgcgcaggggcgggcggaggcgctgtccggccccggccaggcgccgggcggggagcatgggaaggggctagaactgctcgagccccccagccccctccccgggatccgcgccccccttcccgggagaggggccgccccccccggacggacatgggctcctgaagttgcgccgctgccggtcgggggaagagacctgacaggtaattaaatgtgtattttgtggacctgggcttggctggaatgctcaggggtcctgaagatcctattatagcttccttctgttgaaccattaagaaaagatggcgaaagtcaacataactagagacctcatccgtaggcagatcaaggagcggggtgccctgagctttgagcggcgctaccatgtcactgacccctttatccggcggctgggcctggaagcagagctgcagggtcactcaggatgtgtcaactgtctggagtggaatgagaaaggagacttgctggcctctggttccgatgaccagcacacgattgtgtgggacccgctgcaccacaagaagctgctctccatgcacacgggacacaccgcaaatatcttctctgtcaagttcctgcctcacgctggggaccgcatcttgatcacgggggcagccgactctaaggtgcatgtgcacgacctgacagtaaaggagaccatccacatgtttggagaccacacaaaccgggtgaagcgcatcgccacagcgcccatgtggcccaacacattctggagtgctgctgaggatgggcttatccgccagtatgaccttcgagagaacagcaaacactcggaggtgctgattgacctgacagagtactgtggccagctggtggaggccaagtgcctcactgtcaacccccaggacaacaactgcctggcagttggggccagcgggcccttcgtgaggctctatgacatccgcatgatccataaccacagaaagagcatgaagcagagcccttcagcgggtgtgcacaccttctgtgaccggcagaaaccccttccggacggtgcagcccagtattacgtagcaggtcacctgccagtgaagcttcctgactacaacaaccgtttgagagtgctggttgccacctatgtgaccttcagccccaatggcacagagctactagtcaacatggggggggaacaggtctatttgtttgacttgacttacaagcagcggccgtacaccttcctcttgcctagaaaatgccactcctcgggggaagtccagaatggcaagatgtccaccaacggtgtgtccaacggtgtgtccaatggcctgcaccttcatagcaatggcttccggctgccggagagtaggggacatgtcagcccccaagtagagctaccaccatacctggagcgtgtgaaacagcaagccaatgaggcttttgcctgccagcagtggacccaagccattcagctttacagcaaggctgtgcagagggcccctcacaatgccatgctttatggaaaccgagcagcagcctacatgaagcgcaagtgggatggtgaccactatgatgccccgagggactgccatgaccatcactatcactatcaccaccactgccatcaccatcgctatcaccatcaccac

SEQ ID NO: 105509 - DNA, 3413 bp, Homo sapiens
tgtgaggcggtgcgcaggggcgggcggaggcgctgtccggccccggccaggcgccgggcggggagcatgggaaggggctagaactgctcgagccccccagccccctccccgggatccgcgccccccttcccgggagaggggccgccccccccggacggacatgggctcctgaagttgcgccgctgccggtcgggggaagagacctgacaggtaattaaatgtgtattttgtggacctgggcttggctggaatgctcaggggtcctgaagatcctattatagcttccttctgttgaaccattaagaaaagatggcgaaagtcaacataactagagacctcatccgtaggcagatcaaggagcggggtgccctgagctttgagcggcgctaccatgtcactgacccctttatccggcggctgggcctggaagcagagctgcagggtcactcaggatgtgtcaactgtctggagtggaatgagaaaggagacttgctggcctctggttccgatgaccagcacacgattgtgtgggacccgctgcaccacaagaagctgctctccatgcacacgggacacaccgcaaatatcttctctgtcaagttcctgcctcacgctggggaccgcatcttgatcacgggggcagccgactctaaggtgcatgtgcacgacctgacagtaaaggagaccatccacatgtttggagaccacacaaaccgggtgaagcgcatcgccacagcgcccatgtggcccaacacattctggagtgctgctgaggatgggcttatccgccagtatgaccttcgagagaacagcaaacactcggaggtgctgattgacctgacagagtactgtggccagctggtggaggccaagtgcctcactgtcaacccccaggacaacaactgcctggcagttggggccagcgggcccttcgtgaggctctatgacatccgcatgatccataaccacagaaagagcatgaagcagagcccttcagcgggtgtgcacaccttctgtgaccggcagaaaccccttccggacggtgcagcccagtattacgtagcaggtcacctgccagtgaagcttcctgactacaacaaccgtttgagagtgctggttgccacctatgtgaccttcagccccaatggcacagagctactagtcaacatggggggggaacaggtctatttgtttgacttgacttacaagcagcggccgtacaccttcctcttgcctagaaaatgccactcctcgggggaagtccagaatggcaagatgtccaccaacggtgtgtccaacggtgtgtccaatggcctgcaccttcatagcaatggcttccggctgccggagagtaggggacatgtcagcccccaagtagagctaccaccatacctggagcgtgtgaaacagcaagccaatgaggcttttgcctgccagcagtggacccaagccattcagctttacagcaaggctgtgcagagggcccctcacaatgccatgctttatggaaaccgagcagcagcctacatgaagcgcaagtgggatggtgaccactatgatgccctgagggactgcctcaaggccatctccctaaacccatgccacctgaaggcacactttcgcctggcccgctgcctctttgagctcaagtatgtggctgaagccctggagtgcctggacgacttcaaagggaaatttccggagcaggcccacagcagcgcttgtgatgcattgggccgcgacatcacagctgccctcttctctaaaaatgatggtgaggagaagaagggacctggtggcggcgccccagtccgcctccgcagcacgagccgcaaggactccatctcagaggatgaaatggtgctgcgggagcgaagctacgactatcagttccgctactgcggccactgcaacaccaccacggatatcaaagaggccaatttctttggcaggagaccaccaacctggtccgtgtgctccaaggggatgagtccattgtcaactgcctgcagccacaccccagctactgcttcctggccaccagtggcatcgatcctgttgtgcggctctggaacccccgaccagagagtgaagacctcacaggccgagtcgtggaagatatggagggtgcttcacaggccaaccagcggcgcatgaatgcagacccgttggaggtgatgctgctcaacatgggctaccggatcacgggcctgagcagtgggggtgccggggcctctgatgatgaggacagctctgagggccaggtgcagtgccggcccagctagaccctccagccctggtccccagcccctgctactggctggaccctctgccctgggcaggaggtcaggggattctgttttggtttgtcttccccaccacccttttttttcatttcccctgttttgtttgttagtttggcgttaggggtggaggttgctacaacttgctggctttcggactctgggctgattgtcccctgactatccccagccctgaaaaaaagagcaggaggggacacccctccatatgcccccccccatctcctgctttcatgtccctggagggctctggcctgcctcaaaaccccttctgcctcaggtggggaggaacaagctgaactgtcttcagggactgtcctgccctttagctggcagcagcaggaggagtgggattcccaattggtaagggctcgccttggcctgttgccactcttgctccctagcctgcaaggctagctcccctgtggtcttcaggaaaggttttgaaaaaggatgggtcccaccctccctccagagccaccagtgttagagcggagcccaaaggaaggatgggagccctggagtgggcaagaccaggccacctgctgaggtcgctgtggagcaccctcgctcctctcctggctactagctctggccctgcacctactctcactggccacctctggaggctctgcctttcccaagggccctggcagagggtggggcactgcaccttaccccacccatccatgccagcacttctgcactacggccattctcctcttgggcgctcctcagcctcactgtgacctttctgccagagctcccagccaggcctactctgctgaggtggcgcttcctgctaagggcccttctctgccctttctgccctccttcccatcccacatgctgagccgccacaaagaccaaagaagtgatggcttttctctgtcccctgctgctctgaggggagaggggtgggtctcctgagccactcagatgggaaagtcccttactcggcccctccctccccagcagccccaagctttacactggatgcagcgatcaacccaccacgagccgagcctttttgttgctccgctcccaggagagtgagggtgacgcaattgattaaaaccattttgttctagg

SEQ ID NO: 105510 - DNA, 3417 bp, Homo sapiens
tgtgaggcggtgcgcaggggcgggcggaggcgctgtccggccccggccaggcgccgggcggggagcatgggaaggggctagaactgctcgagccccccagccccctccccgggatccgcgccccccttcccgggagaggggccgccccccccggacggacatgggctcctgaagttgcgccgctgccggtcgggggaagagacctgacaggtaattaaatgtgtattttgtggacctgggcttggctggaatgctcaggggtcctgaagatcctattatagcttccttctgttgaaccattaagaaaagatggcgaaagtcaacataactagagacctcatccgtaggcagatcaaggagcggggtgccctgagctttgagcggcgctaccatgtcactgacccctttatccggcggctgggcctggaagcagagctgcagggtcactcaggatgtgtcaactgtctggagtggaatgagaaaggagacttgctggcctctggttccgatgaccagcacacgattgtgtgggacccgctgcaccacaagaagctgctctccatgcacacgggacacaccgcaaatatcttctctgtcaagttcctgcctcacgctggggaccgcatcttgatcacgggggcagccgactctaaggtgcatgtgcacgacctgacagtaaaggagaccatccacatgtttggagaccacacaaaccgggtgaagcgcatcgccacagcgcccatgtggcccaacacattctggagtgctgctgaggatgggcttatccgccagtatgaccttcgagagaacagcaaacactcggaggtgctgattgacctgacagagtactgtggccagctggtggaggccaagtgcctcactgtcaacccccaggacaacaactgcctggcagttggggccagcgggcccttcgtgaggctctatgacatccgcatgatccataaccacagaaagagcatgaagcagagcccttcagcgggtgtgcacaccttcatagcaatggcttccggctgccggagagtaggggacatgtcagcccccaagtagagctaccaccatacctggagcgtgtgaaacagcaagccaatgaggcttttgcctgccagcagtggacccaagccattcagctttacagcaaggctgtgcagagggcccctcacaatgccatgctttatggaaaccgagcagcagcctacatgaagcgcaagtgggatggtgaccactatgatgccctgagggactgcctcaaggccatctccctaaacccatgccacctgaaggcacactttcgcctggcccgctgcctctttgagctcaagtatgtggctgaagccctggagtgcctggacgacttcaaagggaaatttccggagcaggcccacagcagcgcttgtgatgcattgggccgcgacatcacagctgccctcttctctaaaaatgatggtgaggagaagaagggacctggtggcggcgccccagtccgcctccgcagcacgagccgcaaggactccatctcagaggatgaaatggtgctgcgggagcgaagctacgactatcagttccgctactgcggccactgcaacaccaccacggatatcaaagaggccaatttctttggcagcaacgctcagtatatcgtcagtggctctgacgatggctccttcttcatctgggaaaaggagaccaccaacctggtccgtgtgctccaaggggatgagtccattgtcaactgcctgcagccacaccccagctactgcttcctggccaccagtggcatcgatcctgttgtgcggctctggaacccccgaccagagagtgaagacctcacaggccgagtcgtggaagatatggagggtgcttcacaggccaaccagcggcgcatgaatgcagacccgttggaggtgatgctgctcaacatgggctaccggatcacgggcctgagcagtgggggtgccggggcctctgatgatgaggacagctctgagggccaggtgcagtgccggcccagctagaccctccagccctggtccccagcccctgctactggctggaccctctgccctgggcaggaggtcaggggattctgttttggtttgtcttccccaccacccttttttttcatttcccctgttttgtttgttagtttggcgttaggggtggaggttgctacaacttgctggctttcggactctgggctgattgtcccctgactatccccagccctgaaaaaaagagcaggaggggacacccctccatatgcccccccccatctcctgctttcatgtccctggagggctctggcctgcctcaaaaccccttctgcctcaggtggggaggaacaagctgaactgtcttcagggactgtcctgccctttagctggcagcagcaggaggagtgggattcccaattggtaagggctcgccttggcctgttgccactcttgctccctagcctgcaaggctagctcccctgtggtcttcaggaaaggttttgaaaaaggatgggtcccaccctccctccagagccaccagtgttagagcggagcccaaaggaaggatgggagccctggagtgggcaagaccaggccacctgctgaggtcgctgtggagcaccctcgctcctctcctggctactagctctggccctgcacctactctcactggccacctctggaggctctgcctttcccaagggccctggcagagggtggggcactgcaccttaccccacccatccatgccagcacttctgcactacggccattctcctcttgggcgctcctcagcctcactgtgacctttctgccagagctcccagccaggcctactctgctgaggtggcgcttcctgctaagggcccttctctgccctttctgccctccttcccatcccacatgctgagccgccacaaagaccaaagaagtgatggcttttctctgtcccctgctgctctgaggggagaggggtgggtctcctgagccactcagatgggaaagtcccttactcggcccctccctccccagcagccccaagctttacactggatgcagcgatcaacccaccactcaccaggcctctcctcccctctgcccccggctcttagctccagctgctccaggtagttggttcatccttccccctctctccctccctgcttccccttcagtgcttacttggctccagccctccagctgcagcccctggggaaaagcagcctcccttctcctctccctccactccctcgctccctccctcagcccctgtctctgccaggtgcctcctctcagtcaggcttcagagcagccctggagacaggagggccatgttaaaagctttttcacagttttaagaagacaagtggagggtcagaacataaggggatcctcaagagtcacc

SEQ ID NO: 105511 - DNA, 2879 bp, Homo sapiens
tgtgaggcggtgcgcaggggcgggcggaggcgctgtccggccccggccaggcgccgggcggggagcatgggaaggggctagaactgctcgagccccccagccccctccccgggatccgcgccccccttcccgggagaggggccgccccccccggacggacatgggctcctgaagttgcgccgctgccggtcgggggaagagacctgacaggtaattaaatgtgtattttgtggacctgggcttggctggaatgctcaggggtcctgaagatcctattatagcttccttctgttgaaccattaagaaaagatggcgaaagtcaacataactagagacctcatccgtaggcagatcaaggagcggggtgccctgagctttgagcggcgctaccatgtcactgacccctttatccggcggctgggcctggaagcagagctgcagggtcactcaggatgtgtcaactgtctggagtggaatgagaaaggagacttgctggcctctggttccgatgaccagcacacgattgtgtgggacccgctgcaccacaagaagctgctctccatgcacacgggacacaccgcaaatatcttctctgtcaagttcctgcctcacgctggggaccgcatcttgatcacgggggcagccgactctaaggtgcatgtgcacgacctgacagtaaaggagaccatccacatgtttggagaccacacaaaccgggtgaagcgcatcgccacagcgcccatgtggcccaacacattctggagtgctgctgaggatgggcttatccgccagtatgaccttcgagagaacagcaaacactcggaggtgctgattgacctgacagagtactgtggccagctggtggaggccaagtgcctcactgtcaacccccaggacaacaactgcctggcagttggggccagcgggcccttcgtgaggctctatgacatccgcatgatccataaccacagaaagagcatgaagcagagcccttcagcgggtgtgcacaccttcatagcaatggcttccggctgccggagagtaggggacatgtcagcccccaagtagagctaccaccatacctggagcgtgtgaaacagcaagccaatgaggcttttgcctgccagcagtggacccaagccattcagctttacagcaaggctgtgcagagggcccctcacaatgccatgctttatggaaaccgagcagcagcctacatgaagcgcaagtgggatggtgaccactatgatgccctgagggactgcctcaaggccatctccctaaacccatgccacctgaaggcacactttcgcctggcccgctgcctctttgagctcaagtatgtggctgaagccctggagtgcctggacgacttcaaagggaaatttccggagcaggcccacagcagcgcttgtgatgcattgggccgcgacatcacagctgccctcttctctaaaaatgatggtgaggagaagaagggacctggtggcggcgccccagtccgcctccgcagcacgagccgcaaggactccatctcagaggatgaaatggtgctgcgggagcgaagctacgactatcagttccgctactgcggccactgcaacaccaccacggatatcaaagaggccaatttctttggcaggtccgaggccctgaagaggagggtgcagcccagttggcagcgggaggttgagtggggagtgttggggcataatggtttcagagaagaatctcaaatccctgctctgcctctgtacccttgggcaaatggcttcacctttgtcagcctctaaagttttttaatctatgaaatgaccaacctgccatgcccatttatgaggccataacaaggactaataagataacccaagtagagcctccagcgcagtgcctgaactactccttcatcccccacctccttctccctctgtctgcatgtgccagagcttggtttctttatctgcattcaaggaacctccctctgcttgagagtatgaggcagcagccctccaaggctgggaatcttggcacatctgttttgtgctcaaaactgtgccctgtgtactaagggacaaactctgtgtttcagacaccatcatccccacccctcatttgtagatgtactttctttgggtaggtgagacacatgaacatgaatcaagaatctctccataggccaggcacagtggctcatgcccgtaatcccagcacttggggaggctgaagcaggaggatcgcttgagcccaggagtttgagaccagcctggacagcatagacccccatctctacaaaaaatgttttaaattatctgggtgtggtgacgtgcacctgtagtcccagctattcaggaggttgacattggaggaccagttaaggccacagtgagccatgatcatgccactgtactccagcttgggtgacagaatgagaccctgtctctaagaaaaaaaaagaatccatcaagatgccctctaaatgtcagtggtgtgtgaggggcagggggagtctggatgccagaagcctggaactgctcaggggaggcttaaaacagggtattttggagacccgagagatgatgtaagatgatcctggcccaaggaggtaataatgaactataggggagactgtcttggagaaatccaggtagtcgctggccctaggtttaagagaacagtgaccagggctatatacctggaggaattctgggtcaagtgcacaccccagcgtgtgggggactgagtggctgcagacttccttgctccccctttacctaggccatgcagcctctacttgaggctgtagggcagtaccccacctgacctccctgccctttgcccccccgccagccatgctgcgacttcgggggaccgagctcgaa

SEQ ID NO: 105512 - DNA, 403 bp, Homo sapiens
tcctgagacagaatcttgctctgtcacccaggctggagtacagtggcacaatcgcagctcactgcaacctccgcctcccaggctcaagcaattctcttccctcaacctcctgagtagctagaattacaggcgtgtgccaccacgcctggctaatttttgtatttttaatagagagtgggtttcaccatcctggtcaggctggtctctaactcccgacctcatgatccgcctgcctcggcctcccaaactgctgggattacaggtttgagccaccacgcccggcctcaatagtgataatattttatatcttaagctttctgttttatttttacaatttagagtatcagtaggattccacttctcattaaattccatgtaaatatcattctttcccaatctacat

SEQ ID NO: 105513 - DNA, 393 bp, Homo sapiens
ttttttttccgtacagatggggttttgccatgttgcccaggctggtctcaaactcctagactcaaaacagtcgcccacactggcctcccaaagtgctgggattacaggcgtgagctaccacacctggtcaaaagttttgcttccttgttaaataatacgtcataagttctttgaaggcagggactgtgtcctctttcttttgccattccccatagtgcctagaatagttatagatggcaggcaggcaacaaatagctctgtggaattaaattgcatatgtatggcatcttctcaggtcccagactgttacaggtctttcccaaatttctcaacattatgtattcttgaacccaaagttgatatcctgatggtacacatcagtttggctgatac

SEQ ID NO: 105514 - DNA, 304 bp, Homo sapiens
gggagctataattccagatgagatttgggtggggacacagccaagcagtatcagacaatgagtctgtgacaatgccagcgccagccttagaccaaattcatgatactctttttactccccacaaaaacattacagatctgtgtgcattctactttattttttactgttacacccttcattggatgaagtacagaccacatatgaaggttaatcattgtatcatttctctgacccagttgcttgcttttgtcttgaaattataattcttatcccatttctaggcttcagttcccaggctgttttt

SEQ ID NO: 105515 - DNA, 513 bp, Homo sapiens
ttagaacaaatttctagaagtagacttgcaggtcaaaggaatgcacatattttaggcttttgataaatgtcaccaaattatttgtagttgcacagactaaaatgtccccatccattttaactttttatttttaacatgaaaaaggctataatgtagcatatttagcataacaaaataaaaccttgagtttgagtatttcattctgtttttagaatgatgagtttatcgaattcaggctgtaccatggggtcttgagaacatagaatttctcatcctcagggtggtttcagagtatatggaattgtaagtgctggcccctgaatcatgtgctaaagggctaatatggaacgtgttcctccttcctttaagaaatgtttggtccttcctgccaattatttgcatttttgagggacaggacaaaaattggaggcaaaatttcactttttccccatgttaagccttttcctgccctatctaaagccaaatctaaacaaaggacaaatttgttcattg

SEQ ID NO: 105516 - DNA, 322 bp, Homo sapiens
catacagtagaaagtgtatacagaggacttcaaagtcctggattcaagcttgacttcactgagtttgtaagtgacttgaacaaataatgtagcattactgaaacatgcttccttatctgtgaaatgaggctaatatcttctatgactacctgtcttgaagggtttcaatgagggttaaatatgaaagacctttggtaacttcaaatgataaacaaatatataggatattgtgattcttggatgtgttctcgttcaagtccaatttgaactgttctcctggctctgtttagccgaacaggagcactatttattttccactttt

SEQ ID NO: 105517 - DNA, 537 bp, Homo sapiens
tttcaagggtcgacgtctaactaaattcccgttaagaattctctttgaaacattaaatgtcttttcttgtttgaaactagaatgtgatcagttggaatattggcaaagaacaggtcattagtgaaaactccaatgaagacaattggctttgggtttgattttcctgtttttgcagttagcttagcaccagatggtgccctagtgagttctgtataaataatacaatcatagggttgagtgattctctaccagtcacagactgaagcagaaaatagcacttgtctttccacacaagctcatgtagattcttttactgctgaattgttcttatgcagctctaacccttaaattgttattatggttggtgtttttttctgtttctttattgggcaggcaagcagccaaatcctcactctgacctagagggaagggctgctggatttgaggatctttagctgatacatacatcccttgcagaaagaagaggcaaagaagtaaaactccctgaattctctctattgttcctggaaaaaaaaa

SEQ ID NO: 105518 - DNA, 585 bp, Homo sapiens
gaagatattcagggcccttccttcaaagggacctgggcagctggcgtccccgcctctggactcagtggtggagcagggaggtccctgtctcaggacccctgagtctcggggccccaggagcccagggccaccagccgtggaggagccctggccttctgccttccacacccaatcccactccgtgctgctgggtccttctctacgacccaggctgcagtggctccacgggcgcaggccacacctgccatggagacagtgggcacagggcaggggaggtgggcgcacacagcctggctgccactgccatctcctgggcactgggggaactgcccccaccgccacacctgtgctctctgcagggggaaaagtgccaactcagacctggcgagctgagccactggggtctgaggggcccagatgccaccgtgagcagagccatgggggagatgcacagacacgcgtgtgaagcctgggggccctacttaccccttgcctggcctctgtccccgcctactccaggccagccccaggagaggggctcagtggcgtctctggcgcacatgatagggagtgtggccacctgga

SEQ ID NO: 105519 - DNA, 370 bp, Homo sapiens
ctgacctcaagtaatctgcctgccttggccttctaaagtgctgggattacaggcgtgggccaccacgcccagccggaatgagggaagtttgaactccaaagctagagtcccttggtgtcttccgtcctggtctcttttgtcccaaagttgagggaaagggtgggcagggaggagagggaaggaagaagattgggaaggccttgagctcccccttcaggtcgaagcccgtgcaggctttagcaatgacagcaggctaggagagcagacctcagggtgtggctcgtgggcccccaggtctcctagagcctttggggaaaggggggttgggttgagaggttgaaactattttcataacaatgctaagacatga

SEQ ID NO: 105520 - DNA, 677 bp, Homo sapiens
atattatgaaggagcagtgatgacagtgtgggtttatttaatgttacaaacagaattgagaaactggttagttttgtaaaccactaaatttataatttaaaacttccacactctgatatctttagatatatatccccaaacttcctatttgagaccatgaagtcataaatccagcactttatcaagcaaaatttcctgaataccaggcagaactcatgggcatttaaaacaaattactaatttaagaggagtctgttgaaatgtgtatgatttattatgaacattctcagtgtcttaaaaataatatttcttaatggtgccaacatgtatggaaccctgaacttctcacaaagccattcatttatgccataggtcactcaaaaactattaggacagaggatcagaaagactaacttgcataaccattgtgtacaagatactgtgttaagtgtttcacataggttattttatcttgtgactgcctggaagttcaagaatacaacacatttgtttgaacactactatgtactggtttgttgtggctttttttttttttttacatgtttttatttaatccgcagcatcctttatgtcttcacaactaaactaccattttcccactagtttatttactcctttgattattaaaaaaggtattttcggccaggcgcggtggc

SEQ ID NO: 105521 - DNA, 357 bp, Homo sapiens
aaacattttgaaagtgaaattcaagcctccaattagagtgagagaaagaaaacaaagttatcttagtttagaaagaccgagaatcactttctctaccctcatccccactaaaaaccaacaattatgagcagtattttagataagtatagcacagggtggttatatagctctgaatttttttaaactgagttatctttgagatattttccctctttgacctctctttcgaaattaaaacctcgttcttcttaatgatttccaggcttcgtcatccatcttctcaccttctccaatccactctaaggcaaaccttggcttctcttattttggtccatcataaatctacctttatatgac

SEQ ID NO: 105522 - DNA, 351 bp, Homo sapiens
ccccagtacttggaatagtgcctgggacagggaggatagtccgtgaatcgttttttgttttgttttgttcgagacagagttttgcccttgttccccaggccggaatgcagtggtgtgatctcagctcactgcaacctctgtctcctgggttcaagctattctcctgcctcagcctcccaagtagctgggattacaggtgtgcaccaccacgcctggctaattttgtaattttgtattttaagtagagttggggaagatcacttgaggtcaggagttctagaccagcctgaccagcatggcaaaatgtcgtctctacttaaaaatacaaaaattagccgggtgtggtggtgt

SEQ ID NO: 105523 - DNA, 1008 bp, Homo sapiens
tcaagattggcccgggaagcacagggagaccacattgctacaaaaaaaaaaaaaaaaaattagccggccttggtggcctgtgccttgtagttccagctacttgcgaggctgaggcaggagaatcacttgagctcaagagttcgaggctgcaatgacctgtgattgcaccactgtactccagcttggatgacaacaagatcctctctctaaaaaaataaaaaagattaaaagaatcaatacatgttacttagtttgtttacccccaaataatgtcccctcccacccctggggtttgctgcctaatgtaaaggtatttcagatccttacccccattagtcatttagagttttcgctgaagttttattttcagtaggtttgtttgcaaagtgtactaatgaggacatgcaagatagtagaaataatgaaagattattttcttgtttgaatatgtgcagatctggagttactgtagttttttaaagtatatttttgaagttactgtatgctaactcgtaactatggattcagctatataaacgggagtttatctttcactaaacaagtgctgctgaggtgaaagttaggtcttattttgacacttaataaacataacaactgtcagaatttgcatgaggaattacaagagctcatcttttaattctggtggtttttttttcatcaggaaagctttgtgagaagtgtttttacagtacaaatgaatgtctgcttattaaatttaatttgaaaacagaatcagtcttcatttatcggagggtcacttatttttcttgccctagtttaaatccttggaatacttttccaaaaaaatattggttcttcattgatagtaaggagctgaaaaaaaaaattcaaagccagttgcagtggcacatgctggtaatcctagctactcagaaggctgaggcccgaggattgtttgagcccagtagttgaggttgtaatgtgttatgattgtgtctgtgactagccactgcactgtagcctggg

SEQ ID NO: 105524 - DNA, 954 bp, Homo sapiens
tcaagattggcccgggaagcacagggagaccacattgctacaaaaaaaaaaaaaaaaaattagccggccttggtggcctgtgccttgtagttccagctacttgcgaggctgaggcaggagaatcacttgagctcaagagttcgaggctgcaatgacctgtgattgcaccactgtactccagcttggatgacaacaagatcctctctctaaaaaaataaaaaagattaaaagaatcaatacatgttacttagtttgtttacccccaaataatgtcccctcccacccctggggtttgctgcctaatgtaaaggtatttcagatccttacccccattagtcatttagagttttcgctgaagttttattttcagtaggtttgtttgcaaagtgtactaatgaggacatgcaagatagtagaaataatgaaagattattttcttgtttgaatatgtgcagatctggagttactgtagttttttaaagtatatttttgaagttactgtatgctaactcgtaactatggattcagctatataaacgggagtttatctttcactaaacaagtgctgctgaggtgaaagttaggtcttattttgacacttaataaacataacaactgtcagaatttgcatgaggaattacaagagctcatcttttaattctggtggtttttttttcatcaggaaagctttgtgagaagtgtttttacagtacaaatgaatgtctgcttattaaatttaatttgaaaacagaatcagtcttcatttatcggagggtcacttatttttcttgccctagtttaaatccttggaatacttttccaaaaaaatattggttcttcattgatagtaaggagctgaaaaaagctgaggcccgaggattgtttgagcccagtagttgaggttgtaatgtgttatgattgtgtctgtgactagccactgcactgtagcctggg

SEQ ID NO: 105525 - DNA, 348 bp, Homo sapiens
gacgtgagaggatttaaggacagggtgaagtagattcattaaaaagaaattacagtcaaactaattgagggaggagcacccaaaactaggcagcagtagttgacatagaaagaggagggatggactcaagaaatacttaggagactgatgagttgacatttgatgagtcatgcagtgtagataacaaggaaagtaaggaatgaaggatgtcctccaagtttctgcttcaggaactgcgtgggttacggcaccgaagatctagtacaatatacatgaaaagggcaggctgcatgtaggacaggggagcagaaggaggtaagaaatcggttgtggacattgtgcctttga

SEQ ID NO: 105526 - DNA, 778 bp, Homo sapiens
tccctctgtcaccaaggctggaatgcagtaatggatcatagctcactccagccttaacctcctgggttcaagtaatcctgcctcagcctcctaagtagctgggattccaggtgtgggccaccatgtccgtctcctaggaataagtctaataaagagatgcaagtaatctctagatagaaatcaattccaatcaaaatcttggcaaggtttcttgtatgactttgcagttaattctaatatttatatggaaaccaacaacaggcaatgaacatctaaaacctcatgaagtactgaggctgggcgtgggtggctcatgccggtaatcccaacactttgggaggccaaggcgggtggatcacctgaggtcaggagttcgagaccagcctgatcaatatggtgaaatctcgtttctactaaaaatgcaaaaattagtctggcgtggtggtgtcacctgtagtcccagctacttgggagtcaggagaattgcttgaacccacccaggaggcagaggttgcagtgagctgagatcacaccattgcactccagcctgggcgacagagcaagactccgtctgaaaaaaataaataaaacctaatatgaggtactgaaaaaaaacagccccacccgtgtactagtcctgtcagaaatgcttgtcctaaatttactgatgagaaaattatcagacaaatctaaatttagggagaaactctgcaaagcagctgttcaactcattgaaaatactaatatcacaagaaaaaaaacacaaaacatggaggaa

SEQ ID NO: 105527 - DNA, 465 bp, Homo sapiens
agacagagtcttgctctggtcgcccaggctggagtgcaatggtgccgtcatagcacactgtgacctcaaactcctgggctcaagcgatcctccctccttagcctcctgagtagctaggtttacaggagcatgccaccatgcccagcaaatttttaaattttttatagagacagtgtctcactgtgttgcccaggctggagtacggtagtgcaatcatagttcaccgtgaccttgaactcctggcctcaagcgatcctcccatctcagcctccaaaagtgctgagattacaggtgtgagcccccgcgtccagccctgtgctacatactttataacgaccatgtctgatcttcacaaacacctcatgagatgcatgctcttatccttcattttacagatgaggaaaacaggctcaggagtttaagtaacttgccacagttgcaaagccaataaatcgtagagccagg

SEQ ID NO: 105528 - DNA, 278 bp, Homo sapiens
tttttcttttccttctctactagtttggaatttataacctctattttctactattttcaatgattatgttagaaaattttcacatgtatttttaactcatcagagttgaacgttaaacaatatttttattatttttttctgaactaaggaccttaaacactggaattacaattacctgctcttctaattgatatgcaattgttactgtgataactctaatctgtattttccattccacaaaatattattttacagagttcatttacatgcatctacgt

SEQ ID NO: 105529 - DNA, 456 bp, Homo sapiens
gtgttcaccttgtaggaagcagtgagataagcgttggttgcaggtgatattaataaaagtgtgagtattcttactcttaagaattttcagatcttgtggtggagatatgaaaatagaaaaatgctaagtcagaaagttatgagagctaagataggtacatggaagtattaactcttacttgaaaagaaataataagagctaaggaaataaggaagtggtaacagaatgtgtacttgccattccatctccacctacgggtattggcagagaaggaagaagagacatatggtagaaatgagagggtaaatagaggatcaaacacaagattgtgttttcttttttaatgggagagtatgttcacacactttgagaaaataatatgttttaaaaagagatgtaggacttctttaaatgtaaacaattgttaaaattactgaagtaaggtaccagtggaaa

SEQ ID NO: 105530 - DNA, 600 bp, Homo sapiens
caatgacaaagttttatcaaatggacccttgggagtttgacttctcctcactatgaatggtttgcttattgcatgctaatgtagaaaagttctcccacaactgatctgcttagggacagtgtccctggtgccctgggtcagcctttgtaaacagaacaggcttttctgtatgcctttgaatatggtctttccgttttctcaaaattgtagtgtactctgcacatggtgggtagaaacacccttccagattttcttccttggcccaagatcatctaggtcttatgcaattcacaggggaaaggagtagtatgcaggacatgcgtaaattctccttaccatgtggttctttcacattgctgttcctttaagagaactcttaggcaattcggcatatgaaaatgcagcctattgtcaaatttgtgaattataaagcgttccgaccccacaacattgtatattttgtttgcttgtttctgtccgccccaacatttagaagtctggtacttagtagggactgggctgggtagaaaaagaatgcggtcttaattcccacaaccctgcctccttgaagtaggtgaatcctaagcctttagaaacgaa

SEQ ID NO: 105531 - DNA, 267 bp, Homo sapiens
aacccttccctcccaccaaacaaaacattagtgctcagagagtaaagctgtgagcacacatacactttggctatgggcagatgcaggatccaggtagaatgttgacctggggtcattcttaaggagttcctgcccaagatgttagctcatcaggctgagaggactccagcagtaaaggttgtgggatctatactttggtagaaaaggagaaaggaccaagaaaagccagctgaggcactgcctcagctgcccatctaaaggaagttg

SEQ ID NO: 105532 - DNA, 348 bp, Homo sapiens
tatttcagttaatttcagctccctgccagctcagaagaatgatgctgtgctgtgtgctgttcccatgaatactacacgcagggcactgctcagtgactcagccttccagggagccagtcagggttttgaagctgcatcgtccctttcatccttgaagttcttttggatttcatcaatggcatggagggatatttttaaaacaatggagatttttcaggactggcaaaagggctcccctcgtcacagtgccaaaaccatcacaaacataagttatgttaaaaaaaatcctaaactaaaaatatctggtacttagggaactaaaagacatctcatgtttgctatcatttc

SEQ ID NO: 105533 - DNA, 370 bp, Homo sapiens
gaaggtggaaagtgtgcccagttcaaaccctgattctctgccagccggtgttgaccttgagcaagtgcgtcattctgagctcagtctcctgagctgcagaatggagatacttgcttacctcagagggttaatgtgaggactaaaagaggtcagggatagtgagacctggaaagccaaacagcccataatgaagagcagtttccatttagtgttatcagaggctcaaatatttgtccaatgaatatttcaaaggcttaagctctgccttttgtgctctgcgctttgtgtgtctgttggctacaacagaagtgtgcacatccaacctcacgcgatgatgatggatgggaagatactgactggtttgtgttct

SEQ ID NO: 105534 - DNA, 718 bp, Homo sapiens
ccactcattcaaactctgatgtccctcctggtttagggaagattacttggtaccaaaagttggctttgaatcacatgtcttggtaaatagtgataagaaatgaatttgattttccttttcttggaaaccactacttttaaaagggctcggcctttccctttgaagaatttcgggcaccctcagcacttcctgtgcacctgagcgggaggaatggagtgaggtgactctgtttgaaggatgacagagttaaggaaaagcagaagccacagttgattgaagtgattttccagaatttcatctgcaaagtcaccattcctggatgtgcttggaagatggatcttccgtgtgaatttaggctgagcttggaggagtataaatcaagggcttaaggttttattatattctcaaagcacaggatttctgcatgggtgtgcagtgaagttcatccttcccagtgagcaccctcgttcaccttttgtcctctgggccccacttgtgtttacagtacatgtttgtaaaacagagagtgacctctaacaccaagtctagtaagaggcagtgccactgtgtatgttacacagtgtgaggcaaaaggaggagtagcgcgcgcacagaaacgccgtattcaagccttggcagcacaccacggcagtaaagctagcggagcccgtccctggggtgcctttaaacccgcctgcattcacacttgcgtctttat

SEQ ID NO: 105535 - DNA, 796 bp, Homo sapiens
ctgaggcgggctgatcacctgaggtcaggagttagagaccagcctggccaacatggcgaaaccctgtctctactagaagtataaaaatcagccgggtgtgatggcaggtgcctgtaatcccagctactttggagtctgcggcaggagaatctcttgaacccaggaggcagaggttgcagtgagccgagatcacgccactgcattctagcctgggtgacagagcgagacttcgtgtaaaaaaaatttctggttgaaacatttaatggataatattttaaatattaagagtgggcttcttaagcacattagatattgcttagattttcttaagcgcatagtgcaaatctgatgattcccattagattcatatgtttattcatttgatcattcaataaatatttgtttgccttgtactatcttctgtttctttagagtagtggttttcaactgggggccattttgttttccagttggcaatgtgtggagaaatttttggttgttacaactcagatggaggtgctactgacagctagtggatagaggccaggaatgctgctatacatccttcttccaacaaagatgtacctggcctacagtgttggtagtgccacagttgtcacaccctgcttgagagtttagttatttccaagtatgcattgaaagaaatagctttattcaacggaagttcatatggttttacaaaattatcatgtatgttcagttctttaatttaaaaaaattaccataaaagttttgagttgaaaattataactccataattcaggtactatcagtt

SEQ ID NO: 105536 - DNA, 425 bp, Homo sapiens
ccagtgccttagctgctccaggtgtgcctctacctactcctctgattagcctgtccctagtttcctcacatcctgttctcaatgtttactcttcccttctccaaggactctaagtccagcaggcagctcttcacctccatcctcctcctgccatctatggtgtcccaggctgctcctcagaacactggcaccgctcaaccacattcccacccttccttctttcaagaacccttccctgatggtgattcaagggtctctcttcccaggcccctaggaactaattagttgaaggggtaaaaaccggctccagagggctggcccactgccagagttttaaacgaagtcacagaaaaaccacactaaaatggacatttaaaaaacagcaaccatctgacaagcaaagaactggcttttcagtatgagtt

SEQ ID NO: 105537 - DNA, 240 bp, Homo sapiens
ctgggatgaccacatcagttccgtctgacaccagcatccgcacaatacaggcaaagccccttccctctcttcggaggtcggcaccacttttcttccaaacggtatttccaaaaggagcacaacttgaaggaaggagcccgggtgagaaaagtcgagtctttgacggttagtccccctcacggggagcagcgtcaagaaaagacacacatgtcaggcaggtgtacaaaggcagagaaggac

SEQ ID NO: 105538 - DNA, 399 bp, Homo sapiens
tggtgtgaaataggagtccaacgtcattcttttgcatgtggatatccagttgtcccaccactatttgctgaaaagactattctttcccccattgaatgatcttggcacccttgtcaaaaaacaattgaccataaatgtgagagggtttatttctggactccaaattctattacctcactttcttcattattgtagctttgtagtaagttttgaaattggggcatgtgagtcctccaactttgctcttcgggattgttttggctattctgggttccttgaatttccatatgaattataactaacttgtccatcattgcaaagaagccagctgggatttcacattggaaactgctcaatacttcagaatttaataaacagtaagatatacgattcataaga

SEQ ID NO: 105539 - DNA, 362 bp, Homo sapiens
ccgagtagctgggactacaggtacgtgccaccatgcccagctaatttttttgtatttttagtagagacggggtttcatcatgttggccagggtggtctcgaactcctgagctcaagtgatccacccgccttggcctcccaaagtgctgggattacaggcgagagccaccgcgcccagcctaatgatataaatattagtagatttctgcttactcacttcaccaccagcattttctagcaaatgtgagttcagcagacaccaaagatttttataaatcaaagtagacagtctttaacgttgagaagattctgttaactcatctgttctacccacactcttgcccttccctcctcacagaaaag

SEQ ID NO: 105540 - DNA, 330 bp, Homo sapiens
ctcttttcaaatttaccaagatttgcatattaccaagataaagccaccaaagtagccattcactttccaggggtcagttgaaacttgtaacctgataactcctgggaactccttagcagatgttagatcagccatagtcaaataacagtggaaaaagtacttgatgttaggatggggctaaattacagtttaaggattctccgacaggcacttatctgaaattctttttttttttttttttttgagacggaatttcactcttgttgcccaggctggagtgcaatggcttgatctcggctcacttcaacctccgcctcctgggttcaagcg

SEQ ID NO: 105541 - DNA, 334 bp, Homo sapiens
  misc_feature (80)..(80): n is a, c, g, or t
cacaccgtggtatgggatgaactggcccctcacgcctttccataacatcactaatcccatcgtgagggctctgcctcatngacttagtcattccctgaaggccccacctgttaatactgtcacagtggtgattaaacttcaacatgtgaatctggcaggacgttcagatcatggcacttggcctcgtcctgctaacctgtggcaggggggcagatgaggatagaacctatctggggcatcccagatgggtggggtctaggcctcgcttctggcagtcagtaatgcagggtcttgataagcctataagccgcagctgccagtggtcagggctgag

SEQ ID NO: 105542 - DNA, 760 bp, Homo sapiens
gtgtgagcacaggcaggtggagggatgaagagagccaacaagcctgcttatactttcttttccaagtagtttcgccaaccgtaaaaatggatggttccagaaggaagaccttgaaatggtttgatttgagataaatctgggcttgaggcctgtccatatgtgctaggtttgatctgatgggagaacagagccagtgagtgcccaccttggggcccagactcctgtgccagcatgagttccagtgtctttcacttcctcaccatatccactggaaacaggcgagcaagacttcttacctccaactctcctatctcatcttttgtgacctttcatctttcctcttgaggaccttcctttctttccctcccatgacatacaccccacctgtttggctttccctttcccattcctcttgttccccaaccctcaatccgaacagttggtagcaccctctctcatctgcacaggaggacaggtggacagaaaagagtaagaagcatgggttgtttaatagaaattgagttcaagatcagcctgggcaagatggtgagactccgttgctacaaaaataaaaaataaataaatacactagccaggcatagtggcatgtgcctgttttcccagctactcaggaggctgaggtgagagaattgcttgagcccaagagtttgaggctgcagtgagctatgatcatgccactgcactctatccagcctgggctacagagcaagaccctgtctcaagaaaaaaagaaagaaag

SEQ ID NO: 105543 - DNA, 988 bp, Homo sapiens
tgctcacagctggcttctttgtggtgaggacagctataattggtgaggcaaaaccagtgtgccacaaaagcagaatacattctgctgtgcaagcaatgaccagacagactagaatgaaaaggcaagagtttcctaaggttacctggaaccccttgccaggtgttgcattaagtttactggcccttgccaacattcttctaatgcttcctcatttcatctggcttcttggcagtgttcagtttttgtggtcttttatttttactgtttgacttcatttctcttcttagctctgtaaagttccacatgtgtttatctttgtggtgaaaacacaataaacttgcttaatataatgttggaagtattaatccattgtattagtgtgtacaggacctggattgctgataaaaaaataactagcaataacagcctgattgcttaaaaatatttagtaagttttgtcggggtggattggggcagggcagaacttttacattaaatatagatgcaagatttgataagaatcagccagagtgtacagtaagtattcacttaatgttgccaataggttcatggaaactgcgaatttaagcaaagatgatgtataatgaaacacattttactaagggttatcgataaaaacaagaagtaaggtccctatggcatatatctgggcacaagaaaattcacaaactttgaataaagaaccaaggacgtttctaatattaatattggtgtaacgtgagatatgcaacattgagcagaattactaaaatatgatactattggtggacaggggtatctgtaatgcagattggggtggacagggcaaaccgaggaggggtcaaacacggaaaggggaacgggtcataagaaaaaaaaacgggtggggacgaaacagaagaaaataggagtgagaaagagagagtaggaaagaaagaaaaaaaaggagagaaagaaacagaggaggatattatatttatttgtgtta

SEQ ID NO: 105544 - DNA, 106 bp, Homo sapiens
ttataactgtaacttactgagtgcttcctaggtgcattgtgcccagtgttggcattatatttcatttaatgtaatcctcacaataatttaagagaatggtgatatt

SEQ ID NO: 105545 - DNA, 210 bp, Homo sapiens
caaaaacttttcaataaacataaaagtagagacaccagtttaatgagctatcatatacccatcacatagatttaaaaactattaacatttgcaatatttacttcatttgtttttctgaagtatttacaaaatagttgacagtagttatgtaattgcatcctgatattcatccctacgtaatttactttccctctaaaaacatgagggcac

SEQ ID NO: 105546 - DNA, 489 bp, Homo sapiens
tagtgctttgtggaatactgtttgagaccagcgcattaggctagaccatgacaggtccaggttaccaaagagaacagtaaacacacaaatgtgtgaatccatgagtattagatacagaatgatctgtaaggtttccagggtgtggagatattggttgggaaagagagtattagtccaaatctgagaagtcaaatacaaaggccaagaatttaaatggtttatcaagttgaaggataaagcaaggtttggtatcagatggttaggcataaggttacgggtgtatatcagaagaggagttctcaattccaagaatgtggtccatccattgctgtctggtcttaaatactctgctgagctagcaacctggtcttaaagggatcgaataatgtcagacaggtctgtgttccttttcttccttccccgttcacttttattgagtagctacagtaagggaaatggtaggaaacaagggagcagaaagggaaatac

SEQ ID NO: 105547 - DNA, 590 bp, Homo sapiens
ttgaatggctcactcaccaccctgtgacctgaccagggtatgggattgcagcgtgcctcctcatccctccagtagggatgaccctgcacggatgaggccgggggcggtggccttgggttgaatggcccactcaccaccctgtgacctggccagggtgtgggattgtgcccggcttccccatccttccagtggggatgacgacaggcatttgctgagttccatgggactgtggaaagggctgtgtcactgtagacgctccatcggaaatgctgatgtgtattcttaccacgggcgtccgtgggccaccattgtctcctggcatctggctgtccttggaacccagcaacacccagggacttgggctgtgatcagaagtcctgcccagagcgagtagggtcacgccagagtgaggctggggacagcatggtccactgtggcccagatgtaacttttagtcctgccttcttatccggtttggcaggaacaggacagggtggttagcaggccacagtgtggtgggagtgaaagtgtactgtcctgtgtgatatttttgcacagcctgacagtgggggcaagtttagagcctttga

SEQ ID NO: 105548 - DNA, 395 bp, Homo sapiens
tgtgagccaccgtgcccggctgatttttacatatttttatctcactctgttgcccaggctggagtgcagtggcttaatcaaaactccaaactccaaaccaaggattactccgaacaagtgatcctttgcctaagcatccccagtagctgggactataggccacaccaccacacccggctaatttttaaattttttctgtagaaatgaggtctcactatgttgcccaggctggtcttgaactcctgctctgcggtgatcctcttaccttgctctcaaaagtgctgatagatgtgagccagtgcttcaggcctttgtctttatttacacaggcatattttattttatttatttatttatttatttatttatttattttgtgagacgagtcttgctct

SEQ ID NO: 105549 - DNA, 804 bp, Homo sapiens
acactaaacgctgactcacaggctccactactggaattgcaaatgttttgttttttattttgccagcacaagggattgaaaaacaatgttaccaggcggatattaaaacgactacaacatgagctgctgcttttctatcattttatattcagcttgctttttatattttacctttctagcccccgtaggcatttgattttgtaactccctggaacaggtcagaggattacattaaaatataattactaggtagtggcatctattcttgctgttgtaaaagcacaattcttaaagttgttaggacaggccaaacttacattaataatgaagaaactagcaggatgacacggagctggttctaagagcatttgcagagcagcattaatagaatcagttgaaagggactgcaaaataaaattttaaattaagtataagataactttctacagggcaatgggtacttaacctttcggagttacttctctattggactataaattcttaatggctcatcattttctgcaggttaacttctaaactcacagggccataaaatatctgcactgttctgctgtgaattgttagtcagatatactgtggcattccctaaatgtcagactggcttattacaaatactcttacatgatatcaaaaagaatctatcattttaccttattccaagctcagaataaatttatcttgactgtcagtactttcaacaattttattctgtaaatttatttaaggctgaagttttgtgttcatttaaggatgttcttgtgttctccatctgaaggatgatga

SEQ ID NO: 105550 - DNA, 296 bp, Homo sapiens
gtatttggcagatggggccatgactgggtgaggctaagattctggagactgccaaatcattttcagccttatggccttgggaagctggcatacctctcatccctctcagataccacaggattttgtgacccatggtttgctcctggggtgaagccatcctatcttctatctttggcaccactgaccacatcagtgggagtcctcaccccagccccagccctggttcttgttcacttcttatctcctgccctgctgggtcttcctgaagtcacttcagttttcaaagacttatgtgc

SEQ ID NO: 105551 - DNA, 1022 bp, Homo sapiens
attttatgctgacaagttatatagttgactttttaaattcttcaaatagttatgtatgaaccagttacaatatatccttaagatttataaacattaaaagaataattatctcagttttccaatattgtaaaagcaattaacagatacactttttaaagaagtaatccatatgtttgttatggtattgtttataaagcattcaataataaaaggctgatgaaataacatgttcagtaggatactgtgcagctacttaaaatagcaagtgaatatttaatgagctaaaaagctgttcattattgaataagtaaaagattatcaaatagttgaatagattcaccagaataattcatatgctaaactgttttactggtttactctgggtgagagataaatcttataggggtgggaggaatcttcttgattataaataagcatgtatgatttctgtgatgggcaaactttgttttttgaaaaggagagagagaaatccttgaaaaataaaagtgattatttgaagcaaccttacatccatataatgatttacttttggaaacctataaaagggaatcctactgtgttgaggaactttagacatgataatgaattaactgtcatggaagaaaaatttcaaaatcagataagtttaaaatcagcttcagaggaacagcgtgctttaagttctcaaagtaatattgaaaaggaattcaagaattacttcttgagttcgtggttgagagatttcactgtcatttccccactcttcaagcccccccagacctcaaaaaaaggtaagtgtaagaaaagggatatttaaatctcttttaatttgaaactatattagtaaacaaactaaagaaatacaaatctggtttattttatagtgataaagatttgataatgcaatgaaactttcatatacaaaaattaagcatttttctgttaagtttaatttttcgtagcataaaagtactatatagacatagaaacctcaggaagagcaaaaaaaaaaaatttaaaaa

SEQ ID NO: 105552 - DNA, 344 bp, Homo sapiens
ctcgcagcctggctccgggaagagggtgccccccacagcctggggttcctttcctggagcaggcagcactgtactgcgtgcagggcgggtgagaccgccagggacacaactgcagaggtgaaaggccggcactccaaggtcgcggtctgcgcttccgtgaaacacttgtggtcgagcgaggccaggccgtggtcttggtgtgggagtcaccaggctgggttttcttttgttttttgagagagggtctcgctgtgtcacccaggctggtatgcagtgatgtaatcacagctcattgtggcctcaaccttctgggctcaagcaatcctcccggcccagcctcccaa

SEQ ID NO: 105553 - DNA, 631 bp, Homo sapiens
tggggccccagataggaacacagttgctgtctttgctcaatagcgcctcagggtgtgtggagagccagcctctgcctttgaagctgggccggctccctgcccctaactgctgaaaaccccagctctccccaagccatgagcaaggcccaaacttgccacacctctggctctttttgcaagagagatgttttaaaatagtcttaaatgtcagacatattttttttcacaacatgcctcagacatctcataaattattctgcagtaaaactttaataggaatgcttagaaaatgaagagttctagtcaatggagtttttggtaacttatacaaccgttaaccccaaatcaccctactttttctaccccagaactcattgaagaaaataatttaaaaatagagatgatttttctgaacccatgttagaggctgtctttgatgactgaggtcttatgtttcttcataatgccatatgttagtttgaacaacgtgatattccaatatttgactattttttactttaaaaagttaatttgagatggttcagtctgataatatgtaggaagtataggagttggagttcagtgttttctgaccagaatacaccgataaagttgattattttttcttaga

SEQ ID NO: 105554 - DNA, 465 bp, Homo sapiens
taaataagaggtggtccgtcacttcttcagatgagcaactacaggcttttcaaaagataattgctaatcaacccctttgtgcctgggttttcttatttgtaaaaatagatactactacctaactccaaagtgtgtggtgaagacaaacaactggggtgatgtatactaaagtaacgaaagtgttgaccacacactacgggctggttagtgttagattcccttgtttttccctcagtatcaaaaacagatctaatttaggtttacataaagacaaagtatgaagataaggtgacttacagttggtactactaacaaaatgggctaagatttgcattattgcatgaaaacaacaaaacatatcaataaataacaaaaagcttggaattcagacaacagatcaagtctgggcttgatctcaagctagtgttttgatgttgaaaaaatgttatttggtctttctaaccc

SEQ ID NO: 105555 - DNA, 617 bp, Homo sapiens
ctcaggtgatccatctgcctcggcttcccaaagtgcggggattaaaggcgtgagccacttgtgcccggcctctttttttttatataacacttattgatatattttatcatataataatattgtataatgcatccatttaaagtgtgcaattcagtgattttgagtatattcacagaattgtgcaatcattaccgctatagaattctgtaacattttcatcatcccccaaagaaacttcatatgcattaagcagtcattctccattccctgctatcacccccagcccataggcaaccacaaactgacttattctctctctacatttgcctattctcttttctttctggttatttgttcaacaaatgtggagattgcctgctatgtgccagacactatgccaggtgctagaggtagggatatgggggagcagaacagacgatgttcctgcccccatggagcttacattctagttgtagcatcttagaatgatgaaataaggacatttaagcacagatccaaaggataaaaataaaccagtcttttcaagatatggggacagaaagaatagcaagtccagcggcctggaggctgacctgtactttgtggctgggaggaat

SEQ ID NO: 105556 - DNA, 504 bp, Homo sapiens
tgatgtttgccaggctggtcttaaactcctgacctcaagtgatctgcctgccttggcctcccaaattgctgggattacaggcatgagccaccacgcctggcctgttcaagtattttctagcaatcttggcaaagcaattatgtttagcccacttggctatctttttaacatcctggagtttctaatcatttttaatgcctatctggggaaagatatttaatattatgttctctgttttcctatattgattgacaatagccatggatctttctgtttatcttcttttgtagatctaccacagccctataacaaaacagcaagaaagtgagtcacttaagtttttggtctactagcattataaactgccagctgtccgattcatagtaaataccatcattaatgatgtgtactactaacgcaagtctgaatatggatgcctttgtgtgaaataaaattcagccatatattttttaaatgtgtctggtaattgaactaaggtagaca

SEQ ID NO: 105557 - DNA, 398 bp, Homo sapiens
tacaggaaatcccataaataccctgtgactattattggatttttctgtgtcttctatcaaactatagccttcttgagaactaggaagtcatcccttttggctttctattactagtgcctagatcagtgcttgacacatagcaggctccaaaaatttttttcaggaataaatcagcaactaagtaaataaatgaacatatcagatgtaagacctaaaaaggttttcttctatttcagcattatttattatcattacttaaatgcctaaagctaatggcaaaaatttcctcaactaatcttcatatccaagaaactgagatgacatacaggcagtctgtgcatatgtcaaaaggcccaccaaaccacgaccaacataggatctagaataccacaacctac

SEQ ID NO: 105558 - DNA, 871 bp, Homo sapiens
ggtgagcgttacgtgtacaagttgtgtgtgagcccgaggccctcttctctttggcctcccaaagtgctgggattacaagcgtgagccaccgcgcccggccctatttacttattttttaacctgacccctggagccccccgtaggagttgatagcaaacagatagacacaatgaataagtggaagtcatggcttgtttctgcaaaacacgatctctcatcccccaccctaaaggacctgatatgagacaagacttcccatcccttaacacatcttcatcttatggtcagcaggactgctggttttgattagacaatagcaattaggtaacctggggagagatggatcagcacaaggtgaaccaccctccaacctgcagcctcaactgctgtgagttccaatcactgggaaagtctcacgacttcttacttggtttaccttcgagttgtgcagctgaatcaagcctctgtctcatactattgccttgcatctaccccatgctcagtcaaaccacctctggtgtcaagaaattacacattataaacatcatatatgtacacctatgaatcgttttatatgtgtgtgcatacattatgatacagccctgatctttaaaaggagcaaaaatcagagaatcgtatgtcttaaagaactatttccttacttttttatgctaggtaatgcccatgtgacaaacatgtaaatattcatcaaagaccacatgttttttttacagcttttccttccccactgatttagctgaatgctggggaccttctcgtgatgagcttgcggcacggcattgcatggaaccaacattgcctcgttggacacggtcgacgcaacatatgtgcttctaaaggaaatacagca

SEQ ID NO: 105559 - DNA, 949 bp, Homo sapiens
ggtgagcgttacgtgtacaagttgtgtgtgagcccgaggccctcttctctttggcctcccaaagtgctgggattacaagcgtgagccaccgcgcccggccctatttacttattttttaacctgacccctggagccccccgtaggagttgatagcaaacagatagacacaatgaataagtggaagtcatggcttgtttctgcaaaacacgatctctcatcccccaccctaaaggacctgatatgagacaagacttcccatcccttaacacatcttcatcttatggtcagcaggactgctggttttgattagacaatagcaattaggtaacctggggagagatggatcagcacaaggtgaaccaccctccaacctgcagcctcaactgctgtgagttccaatcactgggaaagtctcacgacttcttacttggtttaccttcgagttgtgcagctgaatcaagcctctgtctcatactattgccttgcatctaccccatgctcagtcaaaccacctctggtgtcaagaaattacacattataaacatcatatatgtacacctatgaatcgttttatatgtgtgtgcatacattatgatacagccctgatctttaaaaggagcaaaaatcagagaatcgtatgtcttaaagaactatttccttacttttttatgctaggtaatgcccatgtgacaaacatgtaaatattcatcaaagaccacatgtatatattttaaaggcattttttcttctccccaactgtatgtatagctagaatctgcttgctgtgtaaccttttcttctgcatggagcttttggtgaagcaaggccatttgtccagtgtttcatagccttaagcatgtttgcccttcgttttttgaatgttcaaaaaatgtttaagtgatcaagaaaaagctctaactttcgacttttgttaattttatgacatgac

SEQ ID NO: 105560 - DNA, 201 bp, Homo sapiens
ctcccagctctaccagcccaggtggaccatgctgcccagggtccttggatatcctctgagtctgactggtggggtcactacaatttggtgccatgtccccagatgccctgcagagacaatcaatggaaatcctgtgttctgagtatcaggttgctcatgagtctccagtcctccacactgaaactgacctccaatcacaag

SEQ ID NO: 105561 - DNA, 507 bp, Homo sapiens
gatagtttcctaaggattaattgcaatgaggaacctgataccatatcagtatacttttcatactctgttatagtaaatccatgtgtttattttgtgctttgagtagatctttattcaaacttaattttgtagcttcatgcattggctatcaaaaaatatcaaaaaatatcaatttgctgagttatgcaagaacttaaaaatattaacacatttcattgtaaaacatcactttggttaatattaccaaaaagctcattagaaatctttatgaattgggaagctgtcaaatgcatggtgacagatacaagttttccaaaattctgtgtgttttttttttttttttttgctggaaaatatgaattttatcattggtaacaattactgtcagttgtttcccagcgttggttcatttacaagaaaatatcagccagacacccaaggttaaataactgtagtttgtctgtcagacactgtttcaaataaaacgatgttatattttaaaagtgg

SEQ ID NO: 105562 - DNA, 393 bp, Homo sapiens
ctgtaagtagtccattataatttataatgaataattccattattcataattaatttaaccaacctcccaggcttagacatttaagtagtttctgaattatttctccatcattctgcgacaacgtgcatcacataacatacatcagtatgtacttgttcaattatgtcatgaggaaatatttctaaatgtggaattgctagatcacaagatatccaaacattcagaatttttgatactcactgacaaatttcttttcagaaagtttatggcaatttctactcatcggatcataagatggtgtggcacaatatacccatctgcaaaaagtcagcctcaaataattgttctgataaacagtggggaatcactgcgtattctctttgcataataagc

SEQ ID NO: 105563 - DNA, 361 bp, Homo sapiens
aattcagaatcctatccaacaaatttaacagagattgaataatttttaaaaagcaaattctggagttgaaagatgcaattaatacactgaagaatgcatcagagtctcttacttgcagaattgatcaaaaagaactagtgaccctgaaacaggttatttgaacatacacagtcagagggagacaaaaaaacaataaaaaaaagaatgaagcacacctacaagatctagaaaatagcctccaaaagccaaatctaagagctattggccttaaagaggaggtagacagagagataggaatagaaagtttattcaaagagagaataacagagaacttccaaaacctagagagagatatcaatat

SEQ ID NO: 105564 - DNA, 253 bp, Homo sapiens
cctggaaggcttcctggaagaggaggcatttgagcttgactttgaagaatggagaggcttctagcaagcagagatggaatcatacaggaaggaagatggcctgggggagggaagtacagcaggcaactggagggagggattcttctttctgttcctcctaagtatcaggttcccctgacgcagagtcttggcacatgctgttccctctgcctggaaaggctttcttatcccattcttccttcaggcctcagct

SEQ ID NO: 105565 - DNA, 114 bp, Homo sapiens
tgctcagcattggggagggcggtttctgggagggaaccgtgaaaggccgcacgggctggttcccggccgactgcgtggaggaagtgcagatgaggcagcatgacacacggcctg

SEQ ID NO: 105566 - DNA, 373 bp, Homo sapiens
tctaaagatcaccacccattcttgatgactatggatagacagactgtcaggacagtactcaccaagttttgaatttgtctacatttttgcagattatccctctggatcagagagagagagagagaacaatttaagaccattttttcccattttataactttttaattcattcactccacaaatattcatttaagacccattacatgctgacaatgtgggcaacaagttatcactgtcccataatttctcaaaggagaaataagatcttgtattactttaaaataacaattttttttgagacagagcaagactctgtctcaaaaaaaaaattatgtgaaaccccatctctgttagaaatacaaaaattaactgg

SEQ ID NO: 105567 - DNA, 339 bp, Homo sapiens
tgagacggagtcttgctctgtcatccaggctagagtgcagtggcacgatcttgcctcagtgcaacctccacctccctggttaggtcaagcaattcctctgcctcagcctcccgagtagctgggattacaggtgcatgccactgtgcccggctaatttttttgtgtatttttagtagagacagggtttcactgccgaagagggtggattgcctgggctcaggagttctttcccttcttataaggagatagtcctatcaaattagagtgccacccttatgacctcatttaacattaagtatctcctaaaggctccatctctagctatcatcactttggtag

SEQ ID NO: 105568 - DNA, 416 bp, Homo sapiens
tttagtcttgagtgactttcaggcctgggcgagtcaggcttgctcagtattctccagtgcaatgggagtatagacgatgatgcgccccgccaatagagaccactacatcattatccccaaagtggtaaaatactcttcctggaattttgagtctttttcctgtgtgaatcttctgagcaaaatctcagaaccaaaatagtgatcatcaagtctaatgtagaaaattaaagcctctctcttttttttgggggggaacatcttaagttgatttagaatttttgtacacaatattcgtctgtggttgaaagggggcacgctgaggtcaagtgatgtagtgttttccatttttccatatgagtctcacagtgtgcgataaaagcaaactcctttattttgtaagtctgcaagaatttctg

SEQ ID NO: 105569 - DNA, 517 bp, Homo sapiens
gctcagacctagtgaactccacggcctggggcgggaggctgtgcccaggctggcctggcctctccaggtgagctcctggcggcaggagggggcagggccgccgggagctctgagctaattcggaagagtaggaagccgatgacgtcactgggcacgtgggcgagctacgcctccgccggttgccatggcagcggcagtctctccgcggctccccggggacacctgctggtcggaggcgccaggactttcattcatgagagaggacggacaggcccgcccttgaggcctcccagggggcggggcgggggaataaccggcttcagtgccggacagccctggtttggacttagttctgctgcttcctggccgcgaggacttggccaaattagctaatctctgtcagcccctttcctcctgagacagcgacacgggaacagtccagttcatggggccagaggaatgaatcaaagccccgagctcagtgctgcaggcactgggcgctccacacgtgggccgt

SEQ ID NO: 105570 - DNA, 143 bp, Homo sapiens
taaaattctaaaacattctatcatgccattcagcataaaaacaacgtggcaaacattctcaaagatgaaataaatcagagctaatagcacacctgagcttatctagagcagttatataataatacatcttgccagctacaaaa

SEQ ID NO: 105571 - DNA, 377 bp, Homo sapiens
gaactagctcttcctacaataaaatgtgaggtggtgagcttcctgccactggaggcactgaacaaatgctacggggaaaacaaactgagtatttcctgaagattctgaatagaaggctgtgtttggagtttgatgctttgaaagctcaagaaatgattctcagacacagcggagtttggggacatcaagggctctgagtgcattttaaagcagcccaggagagagacaaagcaagaccataatgaaacaccccacccagtcttagagtttgagctacagcacggtgatcatgagcagactccaaacccaaatcctgatactgtcacctgctagctgtgtaaccctagaaaagttacaaaacctctttgggcctcagt

SEQ ID NO: 105572 - DNA, 414 bp, Homo sapiens
tactactactactactaaattcgcggccgcgtcgactcaaagtggccgttggaaccagtttgtgggttaaggattttagtgtagtggcttgtacccaagacttttaaaaaatggaatcagcggccaggcacagtcgctcaggcctgtaatcccagcactttgggaggccgaggcaggcagatcacgaggtcaagagatcaaaatcatcctggccaacatggtgaaaccccatctctactaaaaatacaaaaattagctgggcatggtggcgcacacctgtagtcccagctacgtgggaggctaaggcaggaaaatcacttgaacccgggaggcagaggttgcagtgagccaagatcacaccactgcactccagcctggtgtgagatggagtctcacgtcgacgcggccgcgaat

SEQ ID NO: 105573 - DNA, 764 bp, Homo sapiens
gtagtcccagctacctgggaagctgaggtgagagaattgcttgaacttgggaggcagaggttacagtgatctgagatcatgccactgctctacatcctgggcaacagaggggagactccatctcaaaaaataaataaatcaaaagtaaaataaaattactttttaattaagagaaacctcccattgttggatggactgtgattattgcagtctatggcttgccatggtagcttacatgctcactctttcctccagtcttttttttctggaggttggtctgtttccctttcaaaaggtcctcagtggtctctggaggccagaggaaatatcctaaaatacattcattacaaattccatactttaaagtttatttagaccagtcattttcaaagtggccgttggaaccagtttgtgggttaaggattttagtgtagtggcttgtacccaagacttttaaaaaatggaatcagcggccaggcacagtcgctcaggcctgtaatcccagcactttgggaggccgaggcaggcagatcacgaggtcaagagatcaaaatcatcctggccaacatggtgaaaccccatctctactaaaaatacaaaaattagctgggcatggtggcgcacacctgtagtcccagctacgtgggaggctaaggcaggaaaatcacttgaacccgggaggcagaggttgcagtgagccaagatcacaccactgcactccagcctggtgtgagatggagtctcacgtcgacgcggccgcgaat

SEQ ID NO: 105574 - DNA, 368 bp, Homo sapiens
tccccctggcccaaatattttattcctttgaatattgccctcctatttgtcagttactgttatgatgaagttaattgaagtatttacaaaacttaaaacatttaatctttattatattcccaaatgttaaattaatcagttttaaaattctatatctggaaatttcatgtgtgtggtgggggaaaatttagcttttggctttaacatagcttgctgatttttttgctgtgtaatgctttcacctctccactgtgaatcctttctgtgaaagccaggggagaaagatttagaattttaaaaaagtacttaatagagccttggtaaaagtgactctaaaaataaagttcagtagatgcataaaaaaaaaa

SEQ ID NO: 105575 - DNA, 363 bp, Homo sapiens
tgtctcccctctgtgtgacggggggagtgggtggacgggggatgccccgagctatcccgtcaccgtggctgtgtggactgccccccacgtcgccgcagcgcctctgcttctgctcgcagccaccgccgctcggaagcttgttcggtttgctccaccagccacttgacaatgacctggatatccaacccccccagcctgaggagtcccccgcgggccatttctgaaggccctgcggagccctaagccacgcacggcagtgactggacatggccaaggccagctctggggcctcccctgctgtcaggcacaccccagaagtcaggggtccttgaagcccctacgaagcccagcccggggtcccct

SEQ ID NO: 105576 - DNA, 202 bp, Homo sapiens
ggcggaggaaagtgctgtgagattggggtctgaagggacctggcggggtggagagaggctgaggggagagggcagaataagtctgacgatggaaaagtccagggatcggggagacattgaagggagtcggggagggggtcccagacccggcaagaagtctgacccggagagttccagggtcagaccagaccccgaggcgagt

SEQ ID NO: 105577 - DNA, 1136 bp, Homo sapiens
atagaagcagagagcctgcaagagtcaaggagccctagggtgagggtaagagttctttggggcctgaagagaacttggcttatggagatccacaaaccctgagacgaaaggcagttgtctgaaggaatgttcctgggtcgaaggtctctctggccttcagggtgcttcaggggaaatgaagagtggggccaggtcttccgtagttctgagactgtgtggattctagcctttgtagatgaggagattctcccagtgatgctcccactgcccccaacagaggactgacagcttgcagactggttctgctgctgaagatgttgcagcaacctgaactcagccctaagggtgaatggagccgtagccagcaaagggaaaattttagttgcacacttcactggacccagcaacagagaggaagcacagggagagtgctcagaacaggttgcccgggcagccagcgttataggcactggcgtgaggcaaagtcagctagttatagcaatacaacttcgatctcagagctggctgacattcagtattaagtaaaaaggacattctgcaactaaaaccatgagtttcaattttaaacaatcaggactgggcacggtggctcacagtcccagcactttgggaggctgagataggaggatcacgtaaggccaggagtttgagaacagcctgggtgacatagtaagaccccatctacaaaaaaaataataaaattatcaaataaataatcaggatgggatactcttgaaaacaaaattagtgacttggaaaggtacttggaggaaatattccaaaacaaaaacccaaaatatacagattaaggctgtgagggaaaagttaaggaactcagaagacagattcagaagattcagcatttggggatgagaacatggaagagttaattaatattcatctgaggaagtgaaaaaaaattgtataaccaaaatgatggtaaaaaatgaaatgattaaagataaaagctagaatgaatgacctagaagataaaatagtcacaaggattaataaatacaaaaactgattatttgaaagatccagtgaaatcagttaactcttttcttgcctaaggaaaaaatatatatatacaaataagaaatgagaaagaacat

SEQ ID NO: 105578 - DNA, 499 bp, Homo sapiens
cgcctcttgataagtataaaaatttgacacctcttttaatttcaaaataaattaagtattctgaccaaaagcaaacccagtatttcacatagtattaaacataaattaaacttggacaagaaatttggattgtgtctctcagaccagtgattttcagatttgagtgagcatgagaatcacctggaaaacttaggaaaacacagattgctgggctctacttccacaatttgtttttcagtaagtctggggtggggcgtgacaatgtgaatttctaacacattcccaagtgatgttgatgctctcctttggggaccactgccctgggagtctcatcctttcctctatcttagttgttgagaaaagtgtgggcacctttggaggtctagattcagaagcccacatcataggtgcccgatctgttctgttattcccggtgttgttatatttgctgttagcaacaggaagtcggtgtctaaagctggactagtaagcaggcctt

SEQ ID NO: 105579 - DNA, 382 bp, Homo sapiens
aggttgtacctcaggttccccaaagcacagtggaacaaatgacttttgtgtcttcttgctgaaaatctagaaggaatttgttcttaagatatcagggcctaggccgggcgcggtggctcacacctgtaatcccaggactttgtgaggctgacgcgggtggatcacgaggtcaggagatcgagaccatcctggctaacacggtgaaaccctgtctctactaaaaatacaaaaaattagccaggcatggcagcacgcacctgtagttccagctactcggaatgctgaggcaggagaatcgcttgaacccgggaagcagaggttgcagtgagctgagatctcaccactgcactccagcctgggtgacagagcaagactctgtctc

SEQ ID NO: 105580 - DNA, 656 bp, Homo sapiens
  misc_feature (16)..(17): n is a, c, g, or t
tcctgttagccgcgtnnacataggaccgcgccccagtcaatggaagggtgcaaattaccagtgtcctatgatgtgctaaaagaaagcagacacacagcacattgtctcctctagccacacagacacttgcccaggtgatcatattttctcggcacagatttctttatcacttataaagaacctacatttaaagactacaaaactctaaaaccatgacacttctctatttcacaaaagaaatttctgtcttaatatctactggtttagccaataaagtagactaatgaaaaatttaaaaatacttatgtatccttaatgatgatgaagtcctttggggcttcagaatattcatctttacaggttatccctgctgtagaatttcaatgataacttgcgtggaatagctgtaatcttttataaatagtgtttttttagtgtttgaatttttactatcatacagtaagaaactctgctgtttcctgtcaaaacctttcatcagactatgaacatgacagtttcctgttttcttattaactatactgcatttttatgctttattctttgtaaattgtataataacttatcgctttccttttctcattactaaatgtttttgggggaccagcattgtttaatacacacagagaaattctaaa

SEQ ID NO: 105581 - DNA, 320 bp, Homo sapiens
ctggacctgtctttccctactctagcccttgtgatgggcacaggcaactggggcacacagcacctgccgtggagcagttcagggtgttgtgaggaatctgaatggaaagtaatgaaacaagtgtctttgcctcctctgtagttatgtgcggtcttacactattttacatggtcactatcagcttagttgtttgtcacttgttggtgactgctgtaaggtagatttgagatgtccagggactgcagagctgcctgggatatgactggcattgacacacttgcttgatctcacagcagttgccatggcaggtcaggttgcat

SEQ ID NO: 105582 - DNA, 334 bp, Homo sapiens
tgcgtaagtatgcatattaactatactcttgctagtttctgcaaacctagagatccttaaacaaatataagacaatgacttgagaaagatcgctgagaatatggtaattcactgctccctgccacttgattctttctgtgtttccaggcaaactgtctataataaaacattctggagccagtcactttatttttgagatgagaaagcagaggctctgataactgaagtgactttcccaatatgagagacggtatactgctaatggttaaatacaaggactctagagcctgggttcaaattcagagtctgccacttattactagctatacatcac

SEQ ID NO: 105583 - DNA, 296 bp, Homo sapiens
tcctgggcatcggggatggggtttggggccgaggaggggatggagaccagggtcttgtggtagtttggtgggatcctcagaaggtgtggctctcccccttctgaggacgcaaaaactcccagagtttttggcgattgatgtgccacgtgtgccttgtgccctgtgctgggcgagtgtaggcacagctgtgcagacgacgcccttggcaaggctggagcctggacccctgcctggcagcagctgggcgaactggtgtcttctgcctgtgggcccagcttcacttcactagcttagcg

SEQ ID NO: 105584 - DNA, 766 bp, Homo sapiens
tttctgttaatcaaaaatgccatgaagaaagtagaagacaagccacagtgcaaaggacatatttgcaacacctttaaccaacaagtaattaatatccaaaatatatagagaataagaaatagaaaaagacaaataaccaaatagaaaatgtaaaagacacggacagggatttcttggaagagaacacaggtgagcatgtgaagaactgctccctcgcagtggtaaccaagacaatgcaaaatgagataccactttaatatccagtgcataagaagcctaactgtctgggtgcagtggctgatgcctgtaaccccagtgctttgggaggctgaggtgcgaggatctctggaggccaggagtttgagaccagcctctccaaaaagaaaaaaattagctgggcatggttgtgtgcttgcggtcccagctactcaggaggctgaggtgggaggatcccttgagcctgggagttcaaggctgcagtgagctatgatcgtgccactgcactcaagcctgggtgatagaacaactccatctccaaaaaatacgataaaaggcaaaatgtaaatttcagatgaacaactgtaaaaatttaaagtccaaagtaattcaataaaaccaaaatattttatgaaaatgagactgaggctgggtgcggtggctcacgcctttaattccagcactttgggaagccaaggcaggtggatcacctgaggtcaggagttcgagaccagcctgaccaacatggtgaaaccctgtctctactaaa

SEQ ID NO: 105585 - DNA, 424 bp, Homo sapiens
atacatgatttggctcttcccttctctatcctcatcttgatgcctcttaacttaggttttagaaatgtcaaactacttgcatttctttgaacaccatgttattttagaccttctgtctgccttgttctcccttcttgtccatctggcagctttccacacatttccaatgacctccctccattttagagtcactgtgccttgtaaacaccaggaattgctctacttctgaaataataaattcagatattttattatgtaaccatgacctcctttcctcttttactcagttattcatagtgtactttgtacccttttttaggttttctagtccatagatctacttttttgcaatcttccctttccaatcttgactgcgttcctgatcagcttagatgccatagtccatcactttaaccacactctt

SEQ ID NO: 105586 - DNA, 401 bp, Homo sapiens
aggctgccccaggactggctgccagccctcaaagagccccctgggtccccctggcacaactctctgcatgaagcccccagcaggagaagggctcactgccctgagcccgacacagtacgagacggaggcctcactgagtccaggccccgcactggccctcccctggatcctgagtccaggccccaagccagcccctcccctggatctccccagaccctctctgtgggaacccaggggctggagccgctcgactacatcttggtagctctcatttgggacctcatctttaatctcagcaactcagggatcaaagagaaaaggctgaggcaggcgaggccagggtttcttgctcaagcattcggatcattaaacaaacgaaaaaaatcaaagagaaggaaagc

SEQ ID NO: 105587 - DNA, 4659 bp, Homo sapiens
ccaggtcttaggcagccagagtcgagactgtcaccccaaagcctgtcgggtatcacccatgaccatgtcaggccctaaaaaataccctgaatcgctttcaagatcaggaaaacctcaccatgtgagactggagaatttcaggaagatggaaggcatggtccacccaatcctgcaccggaaaatgagcccgcagaacattggggcggcgcggccgatcaagcgcagcctggaggatttggaccttgtgattgcagggaaaaaggcccgggcagtgtctcccttagacccatccaaggaggtctctgggaaggagaaggcctctgagcaggagagtgaaggcagcaaagcagcgcacggtgggcattccgggggcggatcagaaggccacaagcttcccctctcctcccctatcttcccaggtctgtattccgggagcctgtgtaactcgggcctcaactccaggctcccggctgggtattctcattctctgcagtacttgaaaaaccagactgtgctttctccactcatgcagcccctggctttccactcgcttgtgatgcaaagaggaatttttacatcaccgacaaattctcagcagctgtacagacacttggctgcggctacacctgtaggaagttcatatggggaccttttgcataacagcatttaccctttagctgctataaatcctcaagctgcctttccatcttcccagctgtcatccgtgcaccccagtacaaaactgtaggctcagctctgcccagcagtccaaagcggcatggccaacagagcttcactccttacccaggagtgctggcttatagagttagaagtcagtatttcttctaatctgaggctatgatcagtcccagctgtaggggcccagaggggaggtgaacatgcctgatttttgtgggacaactctagcccacaaactgactggctggtgagtcttgactcccttccaacacagatgcccaggcacctccagatcattcacttcgcacgtgggccttgtgaagggatttgtgaatatccaggaagaacttagaggaccccatctgagttcggatggtcaggaaacaatctgggcaaaaaagaggcaggcatttcaaaggaaggggcaaggaagactggcaaacagatggcaagggatgcccctctttttcataaaactctccaaggttcaatcaatgcaatgtatagtgaaacttcaatagatctttcattttgacactattaaacaatccagagaagtaaacactgttaaattgactgtatatatttgcttcttaaaactacctgtatcactgtttgctcacctaatttatatacaggtagttccattttctcccagttccttctcgtctttttttttttttttttttttttttttattaaatggtattgcttttgtttgcaggtctttttgtttttgttttgtttttgaggctgactgactgtcctagttgttgtgtgtttgtaatttttccacatcttattttgagcagctttgggtggtaaagttattgtttacaaattgaagcaactgattctagtggaacaaatgaaaaagaaacagtcaagcacacaatagtgcaaagaacgttcctttgtagatccgcaacttaaggattttgttcctcataaatggcatagttgaaagagcttatacactgcttacccagccaaatgctttgctttgaagtattgggttctgtgaaaatattgagcattgtacttaccttatctaggctgtgaaactgtcctacataccagagaatcataaaaacaaaaacctcactggcagcaagctgccgaataacaacagagtctagaggacatatttgtgggctgcacagatattttaggaatttcagaaattagaacaggagccaaaatgatttacattggcgttggcactgattcctttaaatggtctgggaaagggggttgggaagaggatggagctcaactggccagaagaggagcagctgcagtcctgatagcttctctagcctcggtcttttgagtgataagtagtcatgttgttttcatccagttggtttcttgtcattcccaagaagaatctcccaggccacatctttggggataactgacatactggattagccttttcaaaagaaaagtcatcctatttggttttatggggtgtgagttttgtgtgtacacacacagaaacatgtaaggtggtttgggtcatgtttttaaccacctggcaatacagtccactttctggtttcttttattgtgggaagtaaatggtcaagctgctcaggcagtgaaaagatgtggagaatgtccgttgtcattcttgccactgtattccatttgctaccgagatataacattaaggtggacacattttctaactgtattaattaaaagtcaatggatacagagagtggattttctccccaagtcccatccctgctgaagaccgcttggatgaactccccaacccactgtgcccctcccgcaacactaccagtagactttagaaccatagttaactaagtcttttacctctgagatacttaattctgggaaaattggtgacaattttcaacttctaaataggtaactcgactgcaaaataatcaaaactgataacaatgaaactgcggctcttaaacaaagccatgcatgccgtgcatttgtattgaaatgtctccatgatatgaagccaaatattcaatgtaacatacttaatatccaaaggtggaaacaaaagaatgtagagatccagtgttaagagttccatttgcttcaattaattatttaccttcctgtggaataatatatatatatatatttaatagaaccatagatagactagtagaatttagattataaatgtgtgagtgcagattatcctgctattgcacaagctagaggggggaaaaatctcaattccagctggcaagatgctagccaggacacatataagaaagttgcactagattgaatggtcacagaatcggaggacatggaagaaaaaggaaacttcggtggttctgcagcagacatgggctaggtcatatgtggtttctatgagttcgtgtctcaaaaaaaaaaggagggggggcatctgtccccggtggagctcacctatttggaatatggggcatttgttttttccactgcaatgatttcagtctggtttcatcatgttggaattcgatcacaccattttcaaacaatgttaacatagtccagcttttgtttttctcatctcttctgagaggagactcactgtttctgtctgaggaagctcataccctcggcaaaacatcaggacaaataaagagaaatgggggtacgcattcccaacagaagcagtgtgttatttgttttaaaactctgaacagagatcttggaaatctttcaaaaagaccattgaattcttcattggctgagaacgacgttttaaaatgtcttaaataaggctttgtttgcattgtttgagttcaaggggccttattattgaatggaattgcacaagcctttctttgtgcaatcaaaccattgttattggtagttctgtaaaggaaactgtggaatcgaattggcagtggagtcataaatctatttactgagtgtggcttccaagaaatgttgcaattcaaaatgcactaagtctgtgatttattggagatttggagattctaaataatatttttaaaaaacttccatgcaacttctggtttaatgtttggcaactccacatgataaaaaaataaaaacagcccaaccgagtttcggaattaagtattcttctagtaagtgattcaaacttgtaatatttgccacaggactgacttatttatttactagctagaagctcttaagttcacttgtttatcagggcatatacagaagggtttgttaaaactcgatgttaactttacaactttctgacctggtgcatgaattctcaagtactgtatttcactgtgttggtgtgtctgatggaaatttcgaggtggtcccacaaaaatattttatgtagtgtgccttcaaagagaaccatttatttctcttcacttatcgtcccacaaagtcacatttggtggtggtcagccaagtcgcatctggtctagttttactcttgtcccaattttaaagagaaatgggaatgagtttgccctggtgagacccataccattgcaatgattatcttgagcacttaaagtccagtgttggctgttagtgtatttgatattctgcctgtctcctcatggttgaaatatgtctgaagaatagcagcataatctcttggctgtttatacttttttaaactttcctgtgttgtaaatattgtatacttttggtgattccagctatgtaacctctatgctctgtaaggtgattatttgtatatagcaacatggcccagtgatattatatagtttcccaatggagaggttattgagtaacctttgcattagtttaaacactaccagaagaatgctgagccaactataaacactcaattttgtatgttttccaaattgtacttattactgcttttgatactgtattacgtgccaatagtttcccaatcacatagcaggcaagagatattttgtactttttgatccactgtaatatttaataaaaaatgttactatctgt

SEQ ID NO: 105588 - DNA, 296 bp, Homo sapiens
atatacaaataatcaccttacagagcatagaggttacatagctggaatcaccaaaagtgatattatatagtttcccaatggagaggttattgagtaacctttgcattagtttaaacactaccagaagaatgctgagccaactataaacactcaattttgtatgttttccaaattgtacttattactgcttttgatactgtattacgtgccaatagtttcccaatcacatagcaggcaagagatattttgtactttttgatccactgtaatatttaataaaaaatgttactatctgt

SEQ ID NO: 105589 - DNA, 4997 bp, Homo sapiens
ccaggtcttaggcagccagagtcgagactgtcaccccaaagcctgtcgggtatcacccatgaccatgtcaggccctaaaaaataccctgaatcgctttcaagatcaggaaaacctcaccatgtgagactggagaatttcaggaagatggaaggcatggtccacccaatcctgcaccggaaaatgagcccgcagaacattggggcggcgcggccgatcaagcgcagcctggaggatttggaccttgtgattgcagggaaaaaggcccgggcagtgtctcccttagacccatccaaggaggtctctgggaaggagaaggcctctgagcaggagagtgaaggcagcaaagcagcgcacggtgggcattccgggggcggatcagaaggccacaagcttcccctctcctcccctatcttcccaggtctgtattccgggagcctgtgtaactcgggcctcaactccaggctcccggctgggtattctcattctctgcagtacttgaaaaaccagactgtgctttctccactcatgcagcccctggctttccactcgcttgtgatgcaaagaggaatttttacatcaccgacaaattctcagcagctgtacagacacttggctgcggctacacctgtaggaagttcatatggggaccttttgcataacagcatttaccctttagctgctataaatcctcaagctgcctttccatcttcccagctgtcatccgtgcaccccagtacaaaactgtaggctcagctctgcccagcagtccaaagcggcatggccaacagagcttcactccttacccaggagtgctggcttatagagttagaagtcagtatttcttctaatctgaggctatgatcagtcccagctgtaggggcccagaggggaggtgaacatgcctgatttttgtgggacaactctagcccacaaactgactggctggtgagtcttgactcccttccaacacagatgcccaggcacctccagatcattcacttcgcacgtgggccttgtgaagggatttgtgaatatccaggaagaacttagaggaccccatctgagttcggatggtcaggaaacaatctgggcaaaaaagaggcaggcatttcaaaggaaggggcaaggaagactggcaaacagatggcaagggatgcccctctttttcataaaactctccaaggttcaatcaatgcaatgtatagtgaaacttcaatagatctttcattttgacactattaaacaatccagagaagtaaacactgttaaattgactgtatatatttgcttcttaaaactacctgtatcactgtttgctcacctaatttatatacaggtagttccattttctcccagttccttctcgtctttttttttttttttttttttttttttattaaatggtattgcttttgtttgcaggtctttttgtttttgttttgtttttgaggctgactgactgtcctagttgttgtgtgtttgtaatttttccacatcttattttgagcagctttgggtggtaaagttattgtttacaaattgaagcaactgattctagtggaacaaatgaaaaagaaacagtcaagcacacaatagtgcaaagaacgttcctttgtagatccgcaacttaaggattttgttcctcataaatggcatagttgaaagagcttatacactgcttacccagccaaatgctttgctttgaagtattgggttctgtgaaaatattgagcattgtacttaccttatctaggctgtgaaactgtcctacataccagagaatcataaaaacaaaaacctcactggcagcaagctgccgaataacaacagagtctagaggacatatttgtgggctgcacagatattttaggaatttcagaaattagaacaggagccaaaatgatttacattggcgttggcactgattcctttaaatggtctgggaaagggggttgggaagaggatggagctcaactggccagaagaggagcagctgcagtcctgatagcttctctagcctcggtcttttgagtgataagtagtcatgttgttttcatccagttggtttcttgtcattcccaagaagaatctcccaggccacatctttggggataactgacatactggattagccttttcaaaagaaaagtcatcctatttggttttatggggtgtgagttttgtgtgtacacacacagaaacatgtaaggtggtttgggtcatgtttttaaccacctggcaatacagtccactttctggtttcttttattgtgggaagtaaatggtcaagctgctcaggcagtgaaaagatgtggagaatgtccgttgtcattcttgccactgtattccatttgctaccgagatataacattaaggtggacacattttctaactgtattaattaaaagtcaatggatacagagagtggattttctccccaagtcccatccctgctgaagaccgcttggatgaactccccaacccactgtgcccctcccgcaacactaccagtagactttagaaccatagttaactaagtcttttacctctgagatacttaattctgggaaaattggtgacaattttcaacttctaaataggtaactcgactgcaaaataatcaaaactgataacaatgaaactgcggctcttaaacaaagccatgcatgccgtgcatttgtattgaaatgtctccatgatatgaagccaaatattcaatgtaacatacttaatatccaaaggtggaaacaaaagaatgtagagatccagtgttaagagttccatttgcttcaattaattatttaccttcctgtggaataatatatatatatatatttaatagaaccatagatagactagtagaatttagattataaatgtgtgagtgcagattatcctgctattgcacaagctagaggggggaaaaatctcaattccagctggcaagatgctagccaggacacatataagaaagttgcactagattgaatggtcacagaatcggaggacatggaagaaaaaggaaacttcggtggttctgcagcagacatgggctaggtcatatgtggtttctatgagttcgtgtctcaaaaaaaaaaggagggggggcatctgtccccggtggagctcacctatttggaatatggggcatttgttttttccactgcaatgatttcagtctggtttcatcatgttggaattcgatcacaccattttcaaacaatgttaacatagtccagcttttgtttttctcatctcttctgagaggagactcactgtttctgtctgaggaagctcataccctcggcaaaacatcaggacaaataaagagaaatgggggtacgcattcccaacagaagcagtgtgttatttgttttaaaactctgaacagagatcttggaaatctttcaaaaagaccattgaattcttcattggctgagaacgacgttttaaaatgtcttaaataaggctttgtttgcattgtttgagttcaaggggccttattattgaatggaattgcacaagcctttctttgtgcaatcaaaccattgttattggtagttctgtaaaggaaactgtggaatcgaattggcagtggagtcataaatctatttactgagtgtggcttccaagaaatgttgcaattcaaaatgcactaagtctgtgatttattggagatttggagattctaaataatatttttaaaaaacttccatgcaacttctggtttaatgtttggcaactccacatgataaaaaaataaaaacagcccaaccgagtttcggaattaagtattcttctagtaagtgattcaaacttgtaatatttgccacaggactgacttatttatttactagctagaagctcttaagttcacttgtttatcagggcatatacagaagggtttgttaaaactcgatgttaactttacaactttctgacctggtgcatgaattctcaagtactgtatttcactgtgttggtgtgtctgatggaaatttcgaggtggtcccacaaaaatattttatgtagtgtgccttcaaagagaaccatttatttctcttcacttatcgtcccacaaagtcacatttggtggtggtcagccaagtcgcatctggtctagttttactcttgtcccaattttaaagagaaatgggaatgagtttgccctggtgagacccataccattgcaatgattatcttgagcacttaaagtccagtgttggctgttagtgtatttgatattctgcctgtctcctcatggttgaaatatgtctgaagaatagcagcataatctcttggctgtttatacttttttaaactttcctgtgttgtaaatattgtatacttttggtgattccagctatgtaacctctatgctctgtaaggtgattatttgtatatagcaacatggcccagtgatattatatagtttcccaatggagaggttattgagtaacctttgcattagtttaaacactaccagaagaatgctgagccaactataaacactcaattttgtatgttttccaaattgtacttattactgcttttgatactgtattacgtgccaatagtttcccaatcacatagcaggcaagagatattttgtactttttgatccactgtaatatttaataaaaaatgttactatctgtaaaaaaaaaaaaaaaaaaaaaaaaaaaaaaaaaaaaaaaaaaaaaaaaaaaaaaaaaaaaaaaaaagaaaaaaaaaaaaaaaagcagaacaacaactcacttcccgagagacgagcggagaagcagaaacgagggcgggcagagaagggggggagccagcgcgaggaccaggagagaagaaaaacaaacaacggggggaaaacaagggtgggagaacacacctaaaagagaaaaagccacaaaagaaaacaagaaaagagaaaaaaaaaaagcgcaaagaaagaaaacaacacaacaacgagaaagaaaagagcgccacacaaaaaaaggaagaagag

SEQ ID NO: 105590 - DNA, 4709 bp, Homo sapiens
  misc_feature (4578)..(4578): n is a, c, g, or t
  misc_feature (4580)..(4580): n is a, c, g, or t
  misc_feature (4592)..(4592): n is a, c, g, or t
  misc_feature (4595)..(4595): n is a, c, g, or t
  misc_feature (4608)..(4608): n is a, c, g, or t
  misc_feature (4616)..(4616): n is a, c, g, or t
ccaggtcttaggcagccagagtcgagactgtcaccccaaagcctgtcgggtatcacccatgaccatgtcaggccctaaaaaataccctgaatcgctttcaagatcaggaaaacctcaccatgtgagactggagaatttcaggaagatggaaggcatggtccacccaatcctgcaccggaaaatgagcccgcagaacattggggcggcgcggccgatcaagcgcagcctggaggatttggaccttgtgattgcagggaaaaaggcccgggcagtgtctcccttagacccatccaaggaggtctctgggaaggagaaggcctctgagcaggagagtgaaggcagcaaagcagcgcacggtgggcattccgggggcggatcagaaggccacaagcttcccctctcctcccctatcttcccaggtctgtattccgggagcctgtgtaactcgggcctcaactccaggctcccggctgggtattctcattctctgcagtacttgaaaaaccagactgtgctttctccactcatgcagcccctggctttccactcgcttgtgatgcaaagaggaatttttacatcaccgacaaattctcagcagctgtacagacacttggctgcggctacacctgtaggaagttcatatggggaccttttgcataacagcatttaccctttagctgctataaatcctcaagctgcctttccatcttcccagctgtcatccgtgcaccccagtacaaaactgtaggctcagctctgcccagcagtccaaagcggcatggccaacagagcttcactccttacccaggagtgctggcttatagagttagaagtcagtatttcttctaatctgaggctatgatcagtcccagctgtaggggcccagaggggaggtgaacatgcctgatttttgtgggacaactctagcccacaaactgactggctggtgagtcttgactcccttccaacacagatgcccaggcacctccagatcattcacttcgcacgtgggccttgtgaagggatttgtgaatatccaggaagaacttagaggaccccatctgagttcggatggtcaggaaacaatctgggcaaaaaagaggcaggcatttcaaaggaaggggcaaggaagactggcaaacagatggcaagggatgcccctctttttcataaaactctccaaggttcaatcaatgcaatgtatagtgaaacttcaatagatctttcattttgacactattaaacaatccagagaagtaaacactgttaaattgactgtatatatttgcttcttaaaactacctgtatcactgtttgctcacctaatttatatacaggtagttccattttctcccagttccttctcgtctttttttttttttttttttttttttttattaaatggtattgcttttgtttgcaggtctttttgtttttgttttgtttttgaggctgactgactgtcctagttgttgtgtgtttgtaatttttccacatcttattttgagcagctttgggtggtaaagttattgtttacaaattgaagcaactgattctagtggaacaaatgaaaaagaaacagtcaagcacacaatagtgcaaagaacgttcctttgtagatccgcaacttaaggattttgttcctcataaatggcatagttgaaagagcttatacactgcttacccagccaaatgctttgctttgaagtattgggttctgtgaaaatattgagcattgtacttaccttatctaggctgtgaaactgtcctacataccagagaatcataaaaacaaaaacctcactggcagcaagctgccgaataacaacagagtctagaggacatatttgtgggctgcacagatattttaggaatttcagaaattagaacaggagccaaaatgatttacattggcgttggcactgattcctttaaatggtctgggaaagggggttgggaagaggatggagctcaactggccagaagaggagcagctgcagtcctgatagcttctctagcctcggtcttttgagtgataagtagtcatgttgttttcatccagttggtttcttgtcattcccaagaagaatctcccaggccacatctttggggataactgacatactggattagccttttcaaaagaaaagtcatcctatttggttttatggggtgtgagttttgtgtgtacacacacagaaacatgtaaggtggtttgggtcatgtttttaaccacctggcaatacagtccactttctggtttcttttattgtgggaagtaaatggtcaagctgctcaggcagtgaaaagatgtggagaatgtccgttgtcattcttgccactgtattccatttgctaccgagatataacattaaggtggacacattttctaactgtattaattaaaagtcaatggatacagagagtggattttctccccaagtcccatccctgctgaagaccgcttggatgaactccccaacccactgtgcccctcccgcaacactaccagtagactttagaaccatagttaactaagtcttttacctctgagatacttaattctgggaaaattggtgacaattttcaacttctaaataggtaactcgactgcaaaataatcaaaactgataacaatgaaactgcggctcttaaacaaagccatgcatgccgtgcatttgtattgaaatgtctccatgatatgaagccaaatattcaatgtaacatacttaatatccaaaggtggaaacaaaagaatgtagagatccagtgttaagagttccatttgcttcaattaattatttaccttcctgtggaataatatatatatatatatttaatagaaccatagatagactagtagaatttagattataaatgtgtgagtgcagattatcctgctattgcacaagctagaggggggaaaaatctcaattccagctggcaagatgctagccaggacacatataagaaagttgcactagattgaatggtcacagaatcggaggacatggaagaaaaaggaaacttcggtggttctgcagcagacatgggctaggtcatatgtggtttctatgagttcgtgtctcaaaaaaaaaaggagggggggcatctgtccccggtggagctcacctatttggaatatggggcatttgttttttccactgcaatgatttcagtctggtttcatcatgttggaattcgatcacaccattttcaaacaatgttaacatagtccagcttttgtttttctcatctcttctgagaggagactcactgtttctgtctgaggaagctcataccctcggcaaaacatcaggacaaataaagagaaatgggggtacgcattcccaacagaagcagtgtgttatttgttttaaaactctgaacagagatcttggaaatctttcaaaaagaccattgaattcttcattggctgagaacgacgttttaaaatgtcttaaataaggctttgtttgcattgtttgagttcaaggggccttattattgaatggaattgcacaagcctttctttgtgcaatcaaaccattgttattggtagttctgtaaaggaaactgtggaatcgaattggcagtggagtcataaatctatttactgagtgtggcttccaagaaatgttgcaattcaaaatgcactaagtctgtgatttattggagatttggagattctaaataatatttttaaaaaacttccatgcaacttctggtttaatgtttggcaactccacatgataaaaaaataaaaacagcccaaccgagtttcggaattaagtattcttctagtaagtgattcaaacttgtaatatttgccacaggactgacttatttatttactagctagaagctcttaagttcacttgtttatcagggcatatacagaagggtttgttaaaactcgatgttaactttacaactttctgacctggtgcatgaattctcaagtactgtatttcactgtgttggtgtgtctgatggaaatttcgaggtggtcccacaaaaatattttatgtagtgtgccttcaaagagaaccatttatttctcttcacttatcgtcccacaaagtcacatttggtggtggtcagccaagtcgcatctggtctagttttactcttgtcccaattttaaagagaaatgggaatgagtttgccctggtgagacccataccattgcaatgattatcttgagcacttaaagtccagtgttggctgttagtgtatttgatattctgcctgtctcctcatggttgaaatatgtctgaagaatagcagcataatctcttggctgtttatacttttttaaactttcctgtgttgtaaatattgtatacttttggtgattccagctatgtaacctctatgctctgtaaggtgattatttgtatatagcaacatggcccagtgatattatatagtttcccaatggagaggttattgagtaacctttgcattagtttaaacactaccagaagaatgctgagccaactataaacactcaattttgtatgttttccaaattgtacttattactgcttttgatactgtattacgtgccaatanangttccatactgnggnagaattggcttgnccggtttntaaagtctctgttcaaaaaacaaaaaattcggcggcgaagtaaaatgggggaaaaaggaatacagtgagagggtcaacggggaagagtaaaag

SEQ ID NO: 105591 - DNA, 3966 bp, Homo sapiens
ccaggtcttaggcagccagagtcgagactgtcaccccaaagcctgtcgggtatcacccatgaccatgtcaggccctaaaaaataccctgaatcgctttcaagatcaggaaaacctcaccatgtgagactggagaatttcaggaagatggaaggcatggtccacccaatcctgcaccggaaaatgagcccgcagaacattggggcggcgcggccgatcaagcgcagcctggaggatttggaccttgtgattgcagggaaaaaggcccgggcagtgtctcccttagacccatccaaggaggtctctgggaaggagaaggcctctgagcaggagagtgaaggcagcaaagcagcgcacggtgggcattccgggggcggatcagaaggccacaagcttcccctctcctcccctatcttcccaggtctgtattccgggagcctgtgtaactcgggcctcaactccaggctcccggctgggtattctcattctctgcagtacttgaaaaaccagactgtgctttctccactcatgcagcccctggctttccactcgcttgtgatgcaaagaggaatttttacatcaccgacaaattctcagcagctgtacagacacttggctgcggctacacctgtaggaagttcatatggggaccttttgcataacagcatttaccctttagctgctataaatcctcaagctgcctttccatcttcccagctgtcatccgtgcaccccagtacaaaactgtaggctcagctctgcccagcagtccaaagcggcatggccaacagagcttcactccttacccaggagtgctggcttatagagttagaagtcagtatttcttctaatctgaggctatgatcagtcccagctgtaggggcccagaggggaggtgaacatgcctgatttttgtgggacaactctagcccacaaactgactggctggtgagtcttgactcccttccaacacagatgcccaggcacctccagatcattcacttcgcacgtgggccttgtgaagggatttgtgaatatccaggaagaacttagaggaccccatctgagttcggatggtcaggaaacaatctgggcaaaaaagaggcaggcatttcaaaggaaggggcaaggaagactggcaaacagatggcaagggatgcccctctttttcataaaactctccaaggttcaatcaatgcaatgtatagtgaaacttcaatagatctttcattttgacactattaaacaatccagagaagtaaacactgttaaattgactgtatatatttgcttcttaaaactacctgtatcactgtttgctcacctaatttatatacaggtagttccattttctcccagttccttctcgtctttttttttttttttttttttttttttattaaatggtattgcttttgtttgcaggtctttttgtttttgttttgtttttgaggctgactgactgtcctagttgttgtgtgtttgtaatttttccacatcttattttgagcagctttgggtggtaaagttattgtttacaaattgaagcaactgattctagtggaacaaatgaaaaagaaacagtcaagcacacaatagtgcaaagaacgttcctttgtagatccgcaacttaaggattttgttcctcataaatggcatagttgaaagagcttatacactgcttacccagccaaatgctttgctttgaagtattgggttctgtgaaaatattgagcattgtacttaccttatctaggctgtgaaactgtcctacataccagagaatcataaaaacaaaaacctcactggcagcaagctgccgaataacaacagagtctagaggacatatttgtgggctgcacagatattttaggaatttcagaaattagaacaggagccaaaatgatttacattggcgttggcactgattcctttaaatggtctgggaaagggggttgggaagaggatggagctcaactggccagaagaggagcagctgcagtcctgatagcttctctagcctcggtcttttgagtgataagtagtcatgttgttttcatccagttggtttcttgtcattcccaagaagaatctcccaggccacatctttggggataactgacatactggattagccttttcaaaagaaaagtcatcctatttggttttatggggtgtgagttttgtgtgtacacacacagaaacatgtaaggtggtttgggtcatgtttttaaccacctggcaatacagtccactttctggtttcttttattgtgggaagtaaatggtcaagctgctcaggcagtgaaaagatgtggagaatgtccgttgtcattcttgccactgtattccatttgctaccgagatataacattaaggtggacacattttctaactgtattaattaaaagtcaatggatacagagagtggattttctccccaagtcccatccctgctgaagaccgcttggatgaactccccaacccactgtgcccctcccgcaacactaccagtagactttagaaccatagttaactaagtcttttacctctgagatacttaattctgggaaaattggtgacaattttcaacttctaaataggtaactcgactgcaaaataatcaaaactgataacaatgaaactgcggctcttaaacaaagccatgcatgccgtgcatttgtattgaaatgtctccatgatatgaagccaaatattcaatgtaacatacttaatatccaaaggtggaaacaaaagaatgtagagatccagtgttaagagttccatttgcttcaattaattatttaccttcctgtggaataatatatatatatatatttaatagaaccatagatagactagtagaatttagattataaatgtgtgagtgcagattatcctgctattgcacaagctagaggggggaaaaatctcaattccagctggcaagatgctagccaggacacatataagaaagttgcactagattgaatggtcacagaatcggaggacatggaagaaaaaggaaacttcggtggttctgcagcagacatgggctaggataaaaaaataaaaacagcccaaccgagtttcggaattaagtattcttctagtaagtgattcaaacttgtaatatttgccacaggactgacttatttatttactagctagaagctcttaagttcacttgtttatcagggcatatacagaagggtttgttaaaactcgatgttaactttacaactttctgacctggtgcatgaattctcaagtactgtatttcactgtgttggtgtgtctgatggaaatttcgaggtggtcccacaaaaatattttatgtagtgtgccttcaaagagaaccatttatttctcttcacttatcgtcccacaaagtcacatttggtggtggtcagccaagtcgcatctggtctagttttactcttgtcccaattttaaagagaaatgggaatgagtttgccctggtgagacccataccattgcaatgattatcttgagcacttaaagtccagtgttggctgttagtgtatttgatattctgcctgtctcctcatggttgaaatatgtctgaagaatagcagcataatctcttggctgtttatacttttttaaactttcctgtgttgtaaatattgtatacttttggtgattccagctatgtaacctctatgctctgtaaggtgattatttgtatatagcaacatggcccagtgatattatatagtttcccaatggagaggttattgagtaacctttgcattagtttaaacactaccagaagaatgctgagccaactataaacactcaattttgtatgttttccaaattgtacttattactgcttttgatactgtattacgtgccaatagtttcccaatcacatagcaggcaagagatattttgtactttttgatccactgtaatatttaataaaaaatgttactatctgt

SEQ ID NO: 105592 - DNA, 3663 bp, Homo sapiens
ccaggtcttaggcagccagagtcgagactgtcaccccaaagcctgtcgggtatcacccatgaccatgtcaggccctaaaaaataccctgaatcgctttcaagatcaggaaaacctcaccatgtgagactggagaatttcaggaagatggaaggcatggtccacccaatcctgcaccggaaaatgagcccgcagaacattggggcggcgcggccgatcaagcgcagcctggaggatttggaccttgtgattgcagggaaaaaggcccgggcagtgtctcccttagacccatccaaggaggtctctgggaaggagaaggcctctgagcaggagagtgaaggcagcaaagcagcgcacggtgggcattccgggggcggatcagaaggccacaagcttcccctctcctcccctatcttcccaggtctgtattccgggagcctgtgtaactcgggcctcaactccaggctcccggctgggtattctcattctctgcagtacttgaaaaaccagactgtgctttctccactcatgcagcccctggctttccactcgcttgtgatgcaaagaggaatttttacatcaccgacaaattctcagcagctgtacagacacttggctgcggctacacctgtaggaagttcatatggggaccttttgcataacagcatttaccctttagctgctataaatcctcaagctgcctttccatcttcccagctgtcatccgtgcaccccagtacaaaactgtaggctcagctctgcccagcagtccaaagcggcatggccaacagagcttcactccttacccaggagtgctggcttatagagttagaagtcagtatttcttctaatctgaggctatgatcagtcccagctgtaggggcccagaggggaggtgaacatgcctgatttttgtgggacaactctagcccacaaactgactggctggtgagtcttgactcccttccaacacagatgcccaggcacctccagatcattcacttcgcacgtgggccttgtgaagggatttgtgaatatccaggaagaacttagaggaccccatctgagttcggatggtcaggaaacaatctgggcaaaaaagaggcaggcatttcaaaggaaggggcaaggaagactggcaaacagatggcaagggatgcccctctttttcataaaactctccaaggttcaatcaatgcaatgtatagtgaaacttcaatagatctttcattttgacactattaaacaatccagagaagtaaacactgttaaattgactgtatatatttgcttcttaaaactacctgtatcactgtttgctcacctaatttatatacaggtagttccattttctcccagttccttctcgtctttttttttttttttttttttttttttattaaatggtattgcttttgtttgcaggtctttttgtttttgttttgtttttgaggctgactgactgtcctagttgttgtgtgtttgtaatttttccacatcttattttgagcagctttgggtggtaaagttattgtttacaaattgaagcaactgattctagtggaacaaatgaaaaagaaacagtcaagcacacaatagtgcaaagaacgttcctttgtagatccgcaacttaaggattttgttcctcataaatggcatagttgaaagagcttatacactgcttacccagccaaatgctttgctttgaagtattgggttctgtgaaaatattgagcattgtacttaccttatctaggctgtgaaactgtcctacataccagagaatcataaaaacaaaaacctcactggcagcaagctgccgaataacaacagagtctagaggacatatttgtgggctgcacagatattttaggaatttcagaaattagaacaggagccaaaatgatttacattggcgttggcactgattcctttaaatggtctgggaaagggggttgggaagaggatggagctcaactggccagaagaggagcagctgcagtcctgatagcttctctagcctcggtcttttgagtgataagtagtcatgttgttttcatccagttggtttcttgtcattcccaagaagaatctcccaggccacatctttggggataactgacatactggattagccttttcaaaagaaaagtcatcctatttggttttatggggtgtgagttttgtgtgtacacacacagaaacatgtaaggtggtttgggtcatgtttttaaccacctggcaatacagtccactttctggtttcttttattgtgggaagtaaatggtcaagctgctcaggcagtgaaaagatgtggagaatgtccgttgtcattcttgccactgtattccatttgctaccgagatataacattaaggtggacacattttctaactgtattaattaaaagtcaatggatacagagagtggattttctccccaagtcccatccctgctgaagaccgcttggatgaactccccaacccactgtgcccctcccgcaacactaccagtagactttagaaccatagttaactaagtcttttacctctgagatacttaattctgggaaaattggtgacaattttcaacttctaaataggtaactcgactgcaaaataatcaaaactgataacaatgaaactgcggctcttaaacaaagccatgcatgccgtgcatttgtattgaaatgtctccatgatatgaagccaaatattcaatgtaacatacttaatatccaaaggtggaaacaaaagaatgtagagatccagtgttaagagttccatttgcttcaattaattatttaccttcctgtggaataatatatatatatatatttaatagaaccatagatagactagtagaatttagattataaatgtgtgagtgcagattatcctgctattgcacaagctagaggggggaaaaatctcaattccagctggcaagatgctagccaggacacatatactgtatttcactgtgttggtgtgtctgatggaaatttcgaggtggtcccacaaaaatattttatgtagtgtgccttcaaagagaaccatttatttctcttcacttatcgtcccacaaagtcacatttggtggtggtcagccaagtcgcatctggtctagttttactcttgtcccaattttaaagagaaatgggaatgagtttgccctggtgagacccataccattgcaatgattatcttgagcacttaaagtccagtgttggctgttagtgtatttgatattctgcctgtctcctcatggttgaaatatgtctgaagaatagcagcataatctcttggctgtttatacttttttaaactttcctgtgttgtaaatattgtatacttttggtgattccagctatgtaacctctatgctctgtaaggtgattatttgtatatagcaacatggcccagtgatattatatagtttcccaatggagaggttattgagtaacctttgcattagtttaaacactaccagaagaatgctgagccaactataaacactcaattttgtatgttttccaaattgtacttattactgcttttgatactgtattacgtgccaatagtttcccaatcacatagcaggcaagagatattttgtactttttgatccactgtaatatttaataaaaaatgttactatctgt

SEQ ID NO: 105593 - DNA, 4317 bp, Homo sapiens
  misc_feature (4183)..(4183): n is a, c, g, or t
  misc_feature (4191)..(4191): n is a, c, g, or t
  misc_feature (4205)..(4205): n is a, c, g, or t
  misc_feature (4219)..(4219): n is a, c, g, or t
  misc_feature (4224)..(4224): n is a, c, g, or t
  misc_feature (4235)..(4235): n is a, c, g, or t
  misc_feature (4244)..(4244): n is a, c, g, or t
  misc_feature (4247)..(4247): n is a, c, g, or t
  misc_feature (4254)..(4254): n is a, c, g, or t
  misc_feature (4267)..(4267): n is a, c, g, or t
  misc_feature (4272)..(4272): n is a, c, g, or t
  misc_feature (4276)..(4276): n is a, c, g, or t
  misc_feature (4298)..(4298): n is a, c, g, or t
ccaggtcttaggcagccagagtcgagactgtcaccccaaagcctgtcgggtatcacccatgaccatgtcaggccctaaaaaataccctgaatcgctttcaagatcaggaaaacctcaccatgtgagactggagaatttcaggaagatggaaggcatggtccacccaatcctgcaccggaaaatgagcccgcagaacattggggcggcgcggccgatcaagcgcagcctggaggatttggaccttgtgattgcagggaaaaaggcccgggcagtgtctcccttagacccatccaaggaggtctctgggaaggagaaggcctctgagcaggagagtgaaggcagcaaagcagcgcacggtgggcattccgggggcggatcagaaggccacaagcttcccctctcctcccctatcttcccaggtctgtattccgggagcctgtgtaactcgggcctcaactccaggctcccggctgggtattctcattctctgcagtacttgaaaaaccagactgtgctttctccactcatgcagcccctggctttccactcgcttgtgatgcaaagaggaatttttacatcaccgacaaattctcagcagctgtacagacacttggctgcggctacacctgtaggaagttcatatggggaccttttgcataacagcatttaccctttagctgctataaatcctcaagctgcctttccatcttcccagctgtcatccgtgcaccccagtacaaaactgtaggctcagctctgcccagcagtccaaagcggcatggccaacagagcttcactccttacccaggagtgctggcttatagagttagaagtcagtatttcttctaatctgaggctatgatcagtcccagctgtaggggcccagaggggaggtgaacatgcctgatttttgtgggacaactctagcccacaaactgactggctggtgagtcttgactcccttccaacacagatgcccaggcacctccagatcattcacttcgcacgtgggccttgtgaagggatttgtgaatatccaggaagaacttagaggaccccatctgagttcggatggtcaggaaacaatctgggcaaaaaagaggcaggcatttcaaaggaaggggcaaggaagactggcaaacagatggcaagggatgcccctctttttcataaaactctccaaggttcaatcaatgcaatgtatagtgaaacttcaatagatctttcattttgacactattaaacaatccagagaagtaaacactgttaaattgactgtatatatttgcttcttaaaactacctgtatcactgtttgctcacctaatttatatacaggtagttccattttctcccagttccttctcgtctttttttttttttttttttttttttttattaaatggtattgcttttgtttgcaggtctttttgtttttgttttgtttttgaggctgactgactgtcctagttgttgtgtgtttgtaatttttccacatcttattttgagcagctttgggtggtaaagttattgtttacaaattgaagcaactgattctagtggaacaaatgaaaaagaaacagtcaagcacacaatagtgcaaagaacgttcctttgtagatccgcaacttaaggattttgttcctcataaatggcatagttgaaagagcttatacactgcttacccagccaaatgctttgctttgaagtattgggttctgtgaaaatattgagcattgtacttaccttatctaggctgtgaaactgtcctacataccagagaatcataaaaacaaaaacctcactggcagcaagctgccgaataacaacagagtctagaggacatatttgtgggctgcacagatattttaggaatttcagaaattagaacaggagccaaaatgatttacattggcgttggcactgattcctttaaatggtctgggaaagggggttgggaagaggatggagctcaactggccagaagaggagcagctgcagtcctgatagcttctctagcctcggtcttttgagtgataagtagtcatgttgttttcatccagttggtttcttgtcattcccaagaagaatctcccaggccacatctttggggataactgacatactggattagccttttcaaaagaaaagtcatcctatttggttttatggggtgtgagttttgtgtgtacacacacagaaacatgtaaggtggtttgggtcatgtttttaaccacctggcaatacagtccactttctggtttcttttattgtgggaagtaaatggtcaagctgctcaggcagtgaaaagatgtggagaatgtccgttgtcattcttgccactgtattccatttgctaccgagatataacattaaggtggacacattttctaactgtattaattaaaagtcaatggatacagagagtggattttctccccaagtcccatccctgctgaagaccgcttggatgaactccccaacccactgtgcccctcccgcaacactaccagtagactttagaaccatagttaactaagtcttttacctctgagatacttaattctgggaaaattggtgacaattttcaacttctaaataggtaactcgactgcaaaataatcaaaactgataacaatgaaactgcggctcttaaacaaagccatgcatgccgtgcatttgtattgaaatgtctccatgatatgaagccaaatattcaatgtaacatacttaatatccaaaggtggaaacaaaagaatgtagagatccagtgttaagagttccatttgcttcaattaattatttaccttcctgtggaataatatatatatatatatttaatagaaccatagatagactagtagaatttagattataaatgtgtgagtgcagattatcctgctattgcacaagctagaggggggaaaaatctcaattccagctggcaagatgctagccaggacacatataagaaagttgcactagattgaatggtcacagaatcggaggacatggaagaaaaaggaaacttcggtggttctgcagcagacatgggctaggtcatatgtggtttctatgagttcgtgtctcaaaaaaaaaaggagggggggcatctgtccccggtggagctcacctatttggaatatggggcatttgttttttccactgcaatgatttcagtctggtttcatcatgttggaattcgatcacaccattttcaaacaatgttaacatagtccagcttttgtttttctcatctcttctgagaggagactcactgtttctgtctgaggaagctcataccctcggcaaaacatcaggacaaataaagagaaatgggggtacgcattcccaacagaagcagtgtgttatttgttttaaaactctgaacagagatcttggaaatctttcaaaaagaccattgaattcttcattggctgagaacgacgttttaaaatgtcttaaataaggctttgtttgcattgtttgagttcaaggggccttattattgaatggaattgcacaagcctttctttgtgcaatcaaaccattgttattggtagttctgtaaaggaaactgtggaatcgaattggcagtggagtcataaatctatttactgagtgtggcttccaagaaatgttgcaattcaaaatgcactaagtctgtgatttattggagatttggagattctaaataatatttttaaaaaacttccatgcaacttctggtttaatgtttggcaactccacatgataaaaaaataaaaacagcccaaccgagtttcggaattaagtattcttctagtaagtgattcaaacttgtaatatttgccacaggactgacttatttatttactagctagaagctcttaagttcacttgtttatcagggcatatacagaagggtttgttaaaactcgatgttaactttacaactttctgacctggtgcatgaattctcaagtactgtatttcactgtgttggtgtgtctgatggaaatttcgaggtggtcccacaaaaatattttatgtagtgtgccttcaaagagaaccatttatttctcttcacttatcgtcccacaaagtcacatttggtggtggtcagccaagtcgcatctggtctagttttactcttgtcccaattttaaagagaaatgggaatgagtttgcccccggggggaggnccccaaanccattggcaatggntaaaccttggggcnccttnaaaggcccagngttgggccnggnaaggggnatttggaaatccngcccnggcnccccccaagggggtgaaaaaanggcccggaaggaaaacccg

SEQ ID NO: 105594 - DNA, 4138 bp, Homo sapiens
ccaggtcttaggcagccagagtcgagactgtcaccccaaagcctgtcgggtatcacccatgaccatgtcaggccctaaaaaataccctgaatcgctttcaagatcaggaaaacctcaccatgtgagactggagaatttcaggaagatggaaggcatggtccacccaatcctgcaccggaaaatgagcccgcagaacattggggcggcgcggccgatcaagcgcagcctggaggatttggaccttgtgattgcagggaaaaaggcccgggcagtgtctcccttagacccatccaaggaggtctctgggaaggagaaggcctctgagcaggagagtgaaggcagcaaagcagcgcacggtgggcattccgggggcggatcagaaggccacaagcttcccctctcctcccctatcttcccaggtctgtattccgggagcctgtgtaactcgggcctcaactccaggctcccggctgggtattctcattctctgcagtacttgaaaaaccagactgtgctttctccactcatgcagcccctggctttccactcgcttgtgatgcaaagaggaatttttacatcaccgacaaattctcagcagctgtacagacacttggctgcggctacacctgtaggaagttcatatggggaccttttgcataacagcatttaccctttagctgctataaatcctcaagctgcctttccatcttcccagctgtcatccgtgcaccccagtacaaaactgtaggctcagctctgcccagcagtccaaagcggcatggccaacagagcttcactccttacccaggagtgctggcttatagagttagaagtcagtatttcttctaatctgaggctatgatcagtcccagctgtaggggcccagaggggaggtgaacatgcctgatttttgtgggacaactctagcccacaaactgactggctggtgagtcttgactcccttccaacacagatgcccaggcacctccagatcattcacttcgcacgtgggccttgtgaagggatttgtgaatatccaggaagaacttagaggaccccatctgagttcggatggtcaggaaacaatctgggcaaaaaagaggcaggcatttcaaaggaaggggcaaggaagactggcaaacagatggcaagggatgcccctctttttcataaaactctccaaggttcaatcaatgcaatgtatagtgaaacttcaatagatctttcattttgacactattaaacaatccagagaagtaaacactgttaaattgactgtatatatttgcttcttaaaactacctgtatcactgtttgctcacctaatttatatacaggtagttccattttctcccagttccttctcgtctttttttttttttttttttttttttttattaaatggtattgcttttgtttgcaggtctttttgtttttgttttgtttttgaggctgactgactgtcctagttgttgtgtgtttgtaatttttccacatcttattttgagcagctttgggtggtaaagttattgtttacaaattgaagcaactgattctagtggaacaaatgaaaaagaaacagtcaagcacacaatagtgcaaagaacgttcctttgtagatccgcaacttaaggattttgttcctcataaatggcatagttgaaagagcttatacactgcttacccagccaaatgctttgctttgaagtattgggttctgtgaaaatattgagcattgtacttaccttatctaggctgtgaaactgtcctacataccagagaatcataaaaacaaaaacctcactggcagcaagctgccgaataacaacagagtctagaggacatatttgtgggctgcacagatattttaggaatttcagaaattagaacaggagccaaaatgatttacattggcgttggcactgattcctttaaatggtctgggaaagggggttgggaagaggatggagctcaactggccagaagaggagcagctgcagtcctgatagcttctctagcctcggtcttttgagtgataagtagtcatgttgttttcatccagttggtttcttgtcattcccaagaagaatctcccaggccacatctttggggataactgacatactggattagccttttcaaaagaaaagtcatcctatttggttttatggggtgtgagttttgtgtgtacacacacagaaacatgtaaggtggtttgggtcatgtttttaaccacctggcaatacagtccactttctggtttcttttattgtgggaagtaaatggtcaagctgctcaggcagtgaaaagatgtggagaatgtccgttgtcattcttgccactgtattccatttgctaccgagatataacattaaggtggacacattttctaactgtattaattaaaagtcaatggatacagagagtggattttctccccaagtcccatccctgctgaagaccgcttggatgaactccccaacccactgtgcccctcccgcaacactaccagtagactttagaaccatagttaactaagtcttttacctctgagatacttaattctgggaaaattggtgacaattttcaacttctaaataggtaactcgactgcaaaataatcaaaactgataacaatgaaactgcggctcttaaacaaagccatgcatgccgtgcatttgtattgaaatgtctccatgatatgaagccaaatattcaatgtaacatacttaatatccaaaggtggaaacaaaagaatgtagagatccagtgttaagagttccatttgcttcaattaattatttaccttcctgtggaataatatatatatatatatttaatagaaccatagatagactagtagaatttagattataaatgtgtgagtgcagattatcctgctattgcacaagctagaggggggaaaaatctcaattccagctggcaagatgctagccaggacacatataagaaagttgcactagattgaatggtcacagaatcggaggacatggaagaaaaaggaaacttcggtggttctgcagcagacatgggctaggtcatatgtggtttctatgagttcgtgtctcaaaaaaaaaaggagggggggcatctgtccccggtggagctcacctatttggaatatggggcatttgttttttccactgcaatgatttcagtctggtttcatcatgttggaattcgatcacaccattttcaaacaatgttaacatagtccagcttttgtttttctcatctcttctgagaggagactcactgtttctgtctgaggaagctcataccctcggcaaaacatcaggacaaataaagagaaatgggggtacgcattcccaacagaagcagtgtgttatttgttttaaaactctgaacagagatcttggaaatctttcaaaaagaccattgaattcttcattggctgagaacgacgttttaaaatgtcttaaataaggctttgtttgcattgtttgagttcaaggggccttattattgaatggaattgcacaagcctttctttgtgcaatcaaaccattgttattggtagttctgtaaaggaaactgtggaatcgaattggcagtggagtcataaatctatttactgagtgtggcttccaagaaatgttgcaattcaaaatgcactaagtctgtgatttattggagatttggagattctaaataatatttttaaaaaacttccatgcaacttctggtttaatgtttggcaactccacatgataaaaaaataaaaacagcccaaccgagtttcggaattaagtattcttctagtaagtgattcaaacttgtaatatttgccacaggactgacttatttatttactagctagaagctcttaagttcacttgtttatcagggcatatacagaagggtttgttaaaactcgatgttaactttacaactttctgacctggtgcatgaattctcaagtactgtatttcactgtgttggtgtgtctgatggaaatttcgaggtggtcccacaaaaatattttatgtagtgtgccttcaaagagaaccatttatttctcttcacttatcaaatccctccatatcaagcttatcgatccaaacgacctcgagggcggatccggatttcactcagc

SEQ ID NO: 105595 - DNA, 559 bp, Homo sapiens
tgagactgagtctcatttcgttgcccaggctggagtgcagtggcgtgatctcggctcactgcaacctccgccacttgggttcaagcaattctctgcctcagcctcctgaatagctgagattgcaggtgcccgccaccacgcccggctaatttttttgtatttttagtagagatggggtttcaccatcttgtccaggttgatattgaactcctgacctcatgatccacctgccttggcctcccaaagtcctgggattacaggcgtgagccaccgcgcctggcctgaattttgtttttttttagacacaggatcttgctgtgtcacccaggctggtcctggactcttggcctcaggcaatcctcttgactctgcctctcaaagtgctataggattacaggtgtgaaccaccatgcctggccaggcaaaaataattaaattcttcctttctggtgcagaaggtgaagctagtgtgtctgctcagtgggatcctgcaggcatcctctgcagctgttgtggaggtagatacagagcttccaggatgtgtatccaccttacctta

SEQ ID NO: 105596 - DNA, 260 bp, Homo sapiens
tgagaggcaaccacggagttgctgccactagaacaggacagggcacacctgcttaaggggagaaccctgctaacactggaatgagctgctttcgggctacccaccatgagcatctgacatgccacagaaccggttttatagacgagttttcttttgccaccgtcactgatctggctacacaggggctcggcctccactacggcagcttcagaggcggcagacgagcagctgagggcccgtgctacagacggagcagggcg

SEQ ID NO: 105597 - DNA, 1708 bp, Homo sapiens
gaaggaagaacagaaaagccttatggggctttatgagaaggtttttccattgtttagtgtgtttgcaaaaaggaattttatggaagtacctaaccaaagctgtgacagaagggtctccttggtcatgtggcattttccagctttccttggattttatgctacattaatttgccctggctgataaatggtgtttgaagaaatgtgaaattttgttactttgatttttattttaattcaagcttattaaaagcatcaagcattatatgccacactcagcattttcatagacatagtcattaggagaatctggacaaagtaatactcttgtagaaacggaagcatcttgctgtacttgaaagataactggactcagagctacttcactcctcacttgggcaaatgccgatatcactttgcttagctataaagtgccatcagtgggatggatcgtcttcacggtgaaccgtgttacacttctgcaattcctcaagttcatattaattaggaagtggcagagctaggacacaaaattcctaattcctgaagatagttagtctcctaattaagtgcttctcactatatgggatgccttctttaggaataagactttcctttaattttcaagttccacaacttctaaaattatttgctatctcgaagcagcagaatattgatcatttttctcagtttaggctaacacagtccacaccattaccacttaaataaagtaaccgaatgctaaatattatccttatcaaacatccatcactttgttgcttttatgagatgtagattgctaaaaacttttgagctagtagacgttacctttaagcatcaatgaatgcaaacagtgaagacctcaaagaagagttacctcattttctctacatgatctccaatgtagtctcagataaggcccatacatagttaaaagctggtaacagctctgaacagaagtatgtattaaatgtttcaaacttgtatatatttttgaatgcttttgtttttggagtgaatttttaatactctgtgttaaaagaaaaacattccatcttgtaggcagtgttcctcagtaaaaatctttgttgcattttcccatataaatgaatcacccttattaaaacaggaggagggagggatttgtggtgacctaccgctgccctccctttctaagagaagaggaggccatggggtatgataactaaatgaacatctctggaagttcctccgtctgatatgtgtattctgacataacagaatttcccaagacttctttgaggaaggctgtccacgcttcaggcaaagtttacccattattattatgattttgaatattccttgttcattacagtccagaaaatctgcagaagttctccatgttcagtggttgaccagaatctgattgttgcgctcaattaaagtgcttattatttagctaaaacaacttatatggaagttaattatttcaggaaatacataataagaccaaaaaaatcactggataatatgtagatatattttagttccattactattaatagcaattagataactctccctccccccattgaggtgagaatgggctcctagatacttggtggtcaatagaactgatttgattaactttcatttaactgtggttattgttacatctactgattttttcaaataaaaatttctagaaggctcagatttgactaaaaaaaaa

SEQ ID NO: 105598 - DNA, 417 bp, Homo sapiens
tgaggacacaagcactttgtagctgaagtgccaaaccaactagagagcctatggcagggtggcaactggctccctggaggtggcctccccaacccagacctataggagaggaagcaaatgttctagtcttgtggaatggtaaggggaaaaaactattgtactgttgggcttgggagagagtgaggtgcagcatgacacacacaggtataccccactctcccaggcacactcagcggagaccacacactaccctagtcacactgaagaaggcagcagcctgcttggtgagaaagcccagggtcatgtttctctcgactgagatctgcacagcctctcaggcagaccctcagggaatgggacttatgcttgggctgggcttattggtactcctagccccttgctaagccaagaacctaa

SEQ ID NO: 105599 - DNA, 752 bp, Homo sapiens
ccaaaatgttattattaaattataaagggggattaaaaactctaaattgtttttgtaatttatttacccaagaaagctcagctcagatgcagcatctggttgtcagcgaggtcctgctttttaaccaattttccagatggttgactgaggaacaaggaggtcaagtgacttgcccaaggtcacacagtaagtcagtggttagccccgcattggaacccaggatcctcctggctcccagtccttggctctaaccagtggaccacacagcctccctatccctgtacatgccagaatagaaaatataagaaggaatgtttttgtgttggcatttgaaaaaatgctttttagatttccttattttttttgagaaaaggtcctaagaccaaaacattccatcatttcaacttttcctaaacacccctcttttagtatatgtgtatgatcatttgaaaaaagattaagtgaaatgaggaattcagatttaagtatcaagtattataaatgtaaactgatatttcactcacatagaaaaatactacatcattttagaaagctattaaaggttttacaatactaaagtgattattataatctcaatttatactcaaaatactagtctctgaacattactaataattgtttcatataatttttttctaccttgaagtactctattctgtatatattaataattggtaagttgtcttccttgtgtcttaatcacactaacaattttacaaaatctaggacct

SEQ ID NO: 105600 - DNA, 350 bp, Homo sapiens
taagtagaagatgagaaatagcttgtatggaacagagaagtctttgtaccgatacatattcaactaaagatctgaaaatcaataatctcaggttttgaaaatagaatgctattcttataccatatgtttaatgtacatctgtataaggttaacaaaaatctattaccatctcactacttagtctgaaatggaaaacctagtgtttttaagtgatcatagataattcattaaagcgtaaggctcctacataataattattgcttgtcacttttgaatcaacaaatagatattatgatggatcagagaacttttgatatatccgtattaattatgattgtctcattaaatat

SEQ ID NO: 105601 - DNA, 358 bp, Homo sapiens
tcataattgtgtaattatccctaagtatttttctttaagtaatagaactagtaattacatcctaattgaatgtgtaatctcatcattaggataggtaaatatataatagtgtgatgatgataaggtaattaaaattccaaggatgactctgccataaaaacctatgacatgttcctgcctctgtcccaggattcccttctccagcaggctttgaaatcccacctggacagaagagataagctccaaggcctaagaaacgtttaatgagacagcacttttcccagtgaacatacaggccatctggagcagtattgtctgcctctctctccacaacccttcccaaaatacctccttggga

SEQ ID NO: 105602 - DNA, 448 bp, Homo sapiens
tctcaggatagggtcccagtcttatttacttaaaactaggtaaataagtgcctgccaggaagtatgcaccaaataattatttgttcaaatatgatctaattacttaatgcttacaatcatctacatttttaaatttttaaatattttaacccatttcccatttaggaaaaaaaaaaaaaagtacagcttgctgccagcacagtattcttggtgcaaatgggaaatcggttaatacagtccaaatcagtgtgtctggttcatttcagctccttcactgccaaaccaggggtcaaggactgctttagcttttctgccttctccttgtctgtgatgatgaatgtgtaaggtatcctctgcattgaactttaaacttcacgttgtccttattgatctattttttaaattaagaaattatggtacaaggagataaagtatctcattcaaaggc

SEQ ID NO: 105603 - DNA, 277 bp, Homo sapiens
taaaagcctcatgaagagttgattacatgataaacataaattgtctaattagtagagagaaactatgctatgcaataaatggtgttaggttacagctaaccgtttggagaaaaatattaaatctcccttacatacacacacattttatatactgcgcatttaaaatgtatgtacttttcagctgggcgccgtgattgttaattactgctgttattaccgttaagaaaaataaatattttaaattggcatttaataaagagattcaaatatgcaaaaa

SEQ ID NO: 105604 - DNA, 319 bp, Homo sapiens
taggtgtatggacagtgcaacaacattgattctggccagtccatgaacttggaatatctttccattttggagtgtcctcttcaatttcctgcatcagtgttttacagttttcattatagatgtctttcacttctgtggttaattcctagctattttgttttatttgtagcaattgtgctctcagtcacccgcatcagtccttctgtatattttgagttgcattaatttgcaggccacttatttaatatgaaactgtgcctgcttgttacttggtagcagacctgggagccaggtggcctgggttcagattccagctccg

SEQ ID NO: 105605 - DNA, 386 bp, Homo sapiens
ggcagttagtaattgaggccagtgcagtaatacaggtaagaaagaaatgctgatgttgcctctaagtagagatagatttgagaagaaaatatgacggaggtgggagctgatgcatggtccaaataaatgtggagatatgtttatgaatgggaagatttgatattgttaggatgttaattctccccaaattaatttagactcctggcagaggaatcattgggttgaagggttcttgatatacattagcaaatttgttttccagagagtagaatgtatttattcccttaccggcactgtacctacttcactgtgtcttcaccaaaattgaatgtttatcttaaaaagctttgtgagacttctcagtaaagatgacagattaagcatac

SEQ ID NO: 105606 - DNA, 373 bp, Homo sapiens
tctggtgaaaagatacatatatacctttagaattagcaagctggactcagattagatgatcccaattttgttggcaacatccaaagcatggtcatcaggagccagtggacacatgccttcttctctccatcaggtcgactcagtgttggccttggccacaccaatgtcatggagcttgctcccttcttctctccatcaggtcgactcagtgttggccttggccacattgatgtcatggagctccctcccttcttctctccatcaggttgactcagtgttgaccttggccacacagatgtcatggaactccttcatagcctgttccatctggtgcttgttggctttaacatccacagtggacacaagtgtgttg

SEQ ID NO: 105607 - DNA, 501 bp, Homo sapiens
cattatatggaaaagcattgtgaaaatccctgtcctgttctgttccattctgattactggtgcatgcagcccccagtcacgtacccactgtttgctcaatcgatcacgaccctctcacgcggactcccttagagttctaagcccttaaaagggacaggaattgctcactcgggagctcggttgttggagacgtgagtcttgccaaagctcccggccgaataaagcccttccttctttaactcggtgtctgaggggttttgtctgcagcttgcctgctacaacactaaccaaacatcttctggtgtttgctggcagtccttggcactccttggtttgtagatgcctcttccagtcacatggtatcttctccctgtgtgtcctcatgacatcatgacatcttttctctgcacatgtctgtttctgtgtccaaatttcccccttgtacgacatcagtcatacaagattggagtccattctgatgatctcattttaatgtgatta

SEQ ID NO: 105608 - DNA, 316 bp, Homo sapiens
atacacacaattagaaatgatgaaaagaatattactaccatcagaaataaaagcaactgtcagaaactactatgagcacctctatgtaaacaagttagaaaacctaggagagatagataaattcctggacacatacaccctcccaaggctgagccaggaagaaattgattccctgaacagaacaataacaagctccaaaattgaatcagtaataaatagcctaccaaccaaaaaaagcttgggacctaatggattcacagtcaaattctaccagatgtagaaaaaagggaaggtaccatttctacagaaactactc

SEQ ID NO: 105609 - DNA, 544 bp, Homo sapiens
cgtgttacccaatagctgtctctcacatgcgcccacatgcacaaagtgggtcatgctgagatcaggcaggagaggctattatttatcttgtttcaagagttcctcaaagtagggaagattaaaaagaaagaagagtttctcatttaggcattactcttgcgactttccttcatccatgttccccgggggattccttgaactcctttgccactgcttcaggcaaatttaggggagttctgctttattctacagtggatggtcccatgcgaggtttatgtgtggggcagtattaggaagctcaatcttgaggccaagtgggagtggattagagagtagaagggattgattagagacaggaagctgatgctccagagagggtgagaagaaacagagacctggatttccaccatggccatgtcccaggatgaggagaagggtcttgattatgaggacactttggaggtggaattataggccttggtaaatcagatgtagtggggaagggagagagaagaccccaagggacaactagttaatttagaac

SEQ ID NO: 105610 - DNA, 387 bp, Homo sapiens
cccaaaggccaattcagtagttctggttggtgcctgggaatctgaaatcgtaatgtcccccaggtgatggccagacttgcacactaaaatccaacttcttgcaagggtagaacagaaatgcaaagaggttaatgactcccttgtaatcaagaagccatgtagtggcaggatatgagggaactcaactctggagctttcttcttggataggaaaattctaatgtggaaaccagatttgcagtgattggaggtattgtcccttctcacaggtaaggacaagccttctaggtcagtggagactcagaactctttgaggggaaggagagggaggagaagcagtgctgaggcagtcacaaacagcaaaacacattcttgagtttccatgtta

SEQ ID NO: 105611 - DNA, 481 bp, Homo sapiens
agtcatgttctcaactataattttagagttctaagaaacatattaatattactatatatattccactcaaccaagttttaaactgctattatcatcagaatggggaagagtctaccaatacttttttgcgtgtcagcatatttaaatgatcacaattagctttagtcctcacttgacaagaactaaattttcttcagtattttccccatacctcttcaaaggtatttattcagtatttctatttttaaggttttgctgtttttggtaaatgtcttatctaatttgataccatacaaaatcaaataaacgaataccacataaaatgaataaaaatgaaaaagttagaaataccactatgaaatcaatttccctttattagaaaagctcacatgtgcctgtcacccataataaattaccaatcatgacttcataaaaggaaataaggtcaactatttgatgattctcgattactcatctaatc

SEQ ID NO: 105612 - DNA, 406 bp, Homo sapiens
ttttgctggaagctgccagaggccaggtgagaggcgtggaacagattcttccctaaaacatcagagggagcatggccccaccaacacctagatttcagacacctagtctgacttgagtaagttttgggcccggagatgacgtcctgggacaggagttgggcctggagaggccaccgtgaggcataagctgcatgtagagaggccagtgtgaggcaagacctgggcctgtctaggctgctgggagacaggcaggaatctggccagggaaggttgccatgagacaaaagttgggcctggaaaggcccttgtgaagcatgagcttggcctaaagaggccactgggtggcaggagctgggtgtgtggaagctgctgaaaggttgggagcttggcttggcgatgctctaga

SEQ ID NO: 105613 - DNA, 503 bp, Homo sapiens
aaccctccagacctctccttccttctctccctgttagggttggagggaaccagcgtggtcccaggaggggtggctggtggggtgcagaaaacgccctggttgcaaaggggcctcacgtgcccgacacaagggtcctggctgttagctgctactcatgagttcaaactaggaggaggctcacacgtgtcctttgcaaagtagactccttatctcccactccggctggtttcccaaatccatcctgataaagcagaaaaaccaagagccaaattctgcgggtgacctttctgacagctggaaggtcctccccatccccattccttgcgtgctctcctcttgtcctgccccctctgctttgtctccacttcctcatccttttccctctctggaccctgctcctgagtatctcccaccttcttcagacaacttctcctcatgaagtacagagtcccccacctccaggaaaaagagacaaagaccacgagaaggacctgagaaacgcc

SEQ ID NO: 105614 - DNA, 273 bp, Homo sapiens
atctctgctccccccttccccagcagatggttacctttgggctgttgctttcttgtcaccatctgagttctcagacgctggaaagccatgttctcggctctgtgaatgacaatgctgactggagtgctgcccctctgtaaagggctgggtgtggatggtcacaagcccctcacatgcctcagccaagaggaagtagtacaggggtcagcccagaggtccaggggaaaggagtggaaaccgatttccccaccaagggaggggcctgtacctcag

SEQ ID NO: 105615 - DNA, 467 bp, Homo sapiens
ccctctcccaggccctggcaacccccactccacctttttgtctaagagtttggctactccgagtcactcgtgtaagtggaatcaggcagtatttgtccttttgtgactggcttatttcacttcgcataacgtccaaggtttatccacgtttccacgtgggtcaggatttccttcattttatattttcaataggtatgcttttgtttatatgactgtaacagcagtattcacataattttacattctccttttaaaatatatgataaaaggtttccagtgttgttgacacgtagtctgcaaaattcatttctaagggctgcataacgatctgtcagatggatacaatatggtttacttaatcaccggtaggtgcccaagtcccttagagtatttcttgcatctatgatatttacgatatgccaagcttgtgtccttacatttaactaatttagtccttacaataactc

SEQ ID NO: 105616 - DNA, 131 bp, Homo sapiens
tataacatcaactgggaaggggataatagaatgcacttcaaatcttggatgaagatctactttccttagaatgtatataagggaagtggcatacataagattatttagctatcagaataaacatttttttt

SEQ ID NO: 105617 - DNA, 466 bp, Homo sapiens
gcaggaagctgggttcaactaagtagcttagtagagccatccggcttccaggaatgggatagtcactacagagatggagcaggactctgactcagcagtgggagagactggaagagaggcagtggctactgtgaaagaacacaccaaccacagagcagagacaaatcctttaggtagctgtcttttgaaattcactttgtattctacctctatgtaaatgtaaatgttaagtgcctccattataaataacttataaataatactaacgtaacacatccttgatatttacaaataacactgcctagaaatcttaaaaggaaaaccaaacatacatttaatacatctacaagaaatacctttttagaaaataaaatgtatatgtttcaaaatttgatgagcatttacgatgtggaataagcctacttttttcacagtctggcaaatgggagagtcctcatttacagat

SEQ ID NO: 105618 - DNA, 519 bp, Homo sapiens
agacattggattgaggagtttataatcaaatgtacagttaatactaagtttgtttgtacatagtaatttaggaaaatttaattacttagagctgccagaaaggaaaggaaaaaataacatccaccaaaggtaccattttcctctatcccatccttggcatgagaagaagttgagtttcctacctggcagtggatcagcaggttctgggtgaagccatggaagacagttaagtcactcttggctttctaaaaggaacagtgttcatcgtcctccagtgtgcatacctggtgcagattattttttaaagctgtgtatcactgaatgccattctacttgaatttatccctgtttgaatgtatctaagagtaatgatgctatcagaagcatcctaattctacttcttttcacttactatagcatttttcacagcagtacttccaatctttttctacaggaccttctcctcttacccttttaaaaacaccttacctcttacgtcgctggcttgaatgagctccc

SEQ ID NO: 105619 - DNA, 465 bp, Homo sapiens
agacacggagagatttatcttcatcaggttctgggctagaggggggtcactattcctgtgaccctagtctgcaccactctctcaggcatgctcaacaacctcagctcatggtcgcaaaaggaacacgtccccttctcttcaatctgatggtaagtttctgttcttttcggggactctctcctcagagttggagcagctttcatctctcctaatgggagaactttattctcagtcccaaaatcccttttgctgatgcagtgacgaggtgaaactaaggtggaccaatggtgcttgagtggggctggggtgagcacgaagtgatactgacaagagtgccgggtcacaacagacctgggcaggatgggcttctgcccgggctccataagacccaggcatctcagcagctgcctgattctctgtctgactctgacagcatccagaacttagaagtctaccctgtagcat

SEQ ID NO: 105620 - DNA, 387 bp, Homo sapiens
attcacacagtaactctacaaatacatcaaaatgtatagaagattagatactttagaagagggcacataggccaacagaacagaaaagagaactcttaaagtctcataccttcagccatctgatcttcaacaaagttgattcaaataagcagtggggaaaggattccctattcaattaatgatgctgggatagctggctaactgttgcaagaagtcagggaccctgaacggagggagtggctggagccgtggcagaggaacataaattgtgaagatttcatggacatttatcacttcccaaataatactcttataatttcttatgcctgtcttactttaatctcttaatcctattatcttcataagctgaggatgtatgtcacctca

SEQ ID NO: 105621 - DNA, 750 bp, Homo sapiens
agcactttaaaaaacattaatagactttatattttagagcagttttgggttttacagaaaaattgggcagaaagtacagggagtcctcgtatactccccctctgccccacttccttccacagttattataacttcttgcattggtggcccatacattacaatttgatacatcattactaactaaagcatatcgtttacttgagggttcatgcttcctgttatgcagttttaggtcttgagaagtgcataatgtcatggatcatgcagaatagttgcactgccctaaaactcccctgtgtgataaacactttttaaaatcaaaaaggcaatggaacattctgtatgacactgcaatggtagatatgtatatagagcaccaagactgagcctaaacagcagctccaggcaggaccccactcccttcagggcccaccctgcaccatcttcctcaaatgttttatacaaaaaaaaaaaaaaaatagtggtgcctaattggcattgcatcgattttcttaagagccaggactaacacaaagtgatttcaaagcttccattaggacaccatgaacactgggcccacggtggtggcatcaggcagaccttgctcccttctgcacagagcttgcagagaaagcccaggcaagtagggtggagggccttccctaagaggctggctctttcagaagttcaggtttggccgggcgcggtggctcacgcctgtaatcccagcactttgggaggccgaggcgg

SEQ ID NO: 105622 - DNA, 580 bp, Homo sapiens
caggttcaaagagcatgttgtctttgttttgtcaactgtaaagactaatatcaacttcctagaaaatagacaaaaatggatgaagtgatgatgggtttgacaggacaagtatatttcactttacctcagtgatgtatttaatttatcgtgcccatgagaaaaagcaaacctttcaagcacatgtcttacatttgaagccacatgcctgaagatgccttgggaagtggtcctgggcatttgaatcagaattggggaaaagattaggctctctagagatgggacacacatcaggatatgagaattagcagtgattcgtatgctgttgtgatggtgaccgtaagtccatttcccagtgttcccattgccatgtcacagaccctcatacttgtttgcccatgcacccttttttcttatcttttagtcacttaagctactagaacttagaaatattctagtcgacataatcatcttgatactttccaaacttccaaattctttgagacggttaaagcgatacccttaataaaatgcttttgcataggcaggtgatgttcaactttgatcagtctcataatcatgt

SEQ ID NO: 105623 - DNA, 377 bp, Homo sapiens
atgcatgtctttatttttcttcccattaaagaatcagaactgtagcctgcatcaggtagtgtatccatgggaaattttcttcaccagcccttggatagatcagggtaggaggggaatggggcttggagagtaagacaggattgaaaaagtatgtgtacaattaaattcacacagtgaagagtttctcaatcattagaaagcttgacggagaaaagtaacacaacctttggagtatgtgaaccactgttcccctgaccccacctcatagctcttgggaaagttgtgggtaatgtatgtccctgtgaaacatttttgctttaagaaatagaaacatttttcaccagaattaaagcttttcttatttaatgtccttcttt

SEQ ID NO: 105624 - DNA, 742 bp, Homo sapiens
ggcttccgtcctcaggagttcggaactatataaagttcagaaaacatgtctcgaagatatgactccaggaccactatattttctccagaaggtcgcttataccaagttgaatatgccatggaagctattggacatgcaggcacctgtttgggaattttagcaaatgatggtgttttgcttgcagcagagagacgcaacatccacaagcttcttgatgaagtctttttttctgaaaaaatttataaactcaatgaggacatggcttgcagtgtggcaggcataacttctgatgctaatgttctgactaatgaactaaggctcattgctcaaagtggaaattgcaacactaacaagagagaatggaaagacagtaatcagagttctcaaacaaaaagaagtggagcagttgatcaaaaaacacgaggaagaagaagccaaagctgagcgtgagaagaaagaaaaagaacagaaagaaaaggataaatagaatcagagattttattactcatttggggcaccatttcagtgtaaaagcagtcctactcttccacactaggaaggctttactttttttaactggtgcagtgggaaaataggacattacatactgaattgggtccttgtcatttctgtccaattgaatactttattgtaacgatgatggttacccttcatggacgtcttaatcttccacacacatcccctttttttggaataaaatttggaaaatggaaatgaagga

SEQ ID NO: 105625 - DNA, 460 bp, Homo sapiens
tagacaaagaatattcctttgtctagcagaagagggggggcctccttcagtggaaattgcaacactaacaagagagaatggaaagacagtaatcagagttctcaaacaaaaagaagtggagcagttgatcaaaaaacacgaggaagaagaagccaaagctgagcgtgagaagaaagaaaaagaacagaaagaaaaggataaatagaatcagagattttattactcatttggggcaccatttcagtgtaaaagcagtcctactcttccacactaggaaggctttactttttttaactggtgcagtgggaaaataggacattacatactgaattgggtccttgtcatttctgtccaattgaatactttattgtaacgatgatggttacccttcatggacgtcttaatcttccacacacatcccctttttttggaataaaatttggaaaatggaaatgaagga

SEQ ID NO: 105626 - DNA, 463 bp, Homo sapiens
taccctttacaatccccccctcccctcccaacacgattaatgcttcgggggactggaaattgcaacactaacaagagagaatggaaagacagtaatcagagttctcaaacaaaaagaagtggagcagttgatcaaaaaacacgaggaagaagaagccaaagctgagcgtgagaagaaagaaaaagaacagaaagaaaaggataaatagaatcagagattttattactcatttggggcaccatttcagtgtaaaagcagtcctactcttccacactaggaaggctttactttttttaactggtgcagtgggaaaataggacattacatactgaattgggtccttgtcatttctgtccaattgaatactttattgtaacgatgatggttacccttcatggacgtcttaatcttccacacacatcccctttttttggaataaaatttggaaaatggaaatgaagga

SEQ ID NO: 105627 - DNA, 794 bp, Homo sapiens
  misc_feature (765)..(765): n is a, c, g, or t
catcgaggcccgggcggttaactcggcaccgaggctggaactatataaagttcagaaaacatgtctcgaagatatgactccaggaccactatattttctccagaaggtcgcttataccaagttgaatatgccatggaagctattggacatgcaggcacctgtttgggaattttagcaaatgatggtgttttgcttgcagcagagagacgcaacatccacaagcttcttgatgaagtctttttttctgaaaaaatttataaactcaatgaggacatggcttgcagtgtggcaggcataacttctgatgctaatgttctgactaatgaactaaggctcattgctcaaaggtatttattacagtatcaggagccaataccttgtgagcagttggttacagcgctgtgtgatatcaaacaagcttatacacaatttggaggaaaacgtccctttggtgtttcattgctgtacattggctgggataagcactatggctttcagctctatcagagtgaccctagtggaaattacgggggatggaaggccacatgcattggaaataatagcgctgcagctgtgtcaatgttgaaacaagactataaagaaggagaaatgaccttgaagtcagcacttgctttagctatcaaagtactaaataagaccatggatgttagtaaactctctgctgaaaaagtggaattgcacactaccagagagatggaagccgtatcagagttctcaacaaaagatgggcgtgtcaaaaaccgngagagaagcaagtggggtggagaagaaaa

SEQ ID NO: 105628 - DNA, 825 bp, Homo sapiens
  misc_feature (57)..(57): n is a, c, g, or t
  misc_feature (796)..(796): n is a, c, g, or t
taggctagtacgagcccgggggttgattagggctccgggacatctcagtcttcgggntcttccatctggaactatataaagttcagaaaacatgtctcgaagatatgactccaggaccactatattttctccagaaggtcgcttataccaagttgaatatgccatggaagctattggacatgcaggcacctgtttgggaattttagcaaatgatggtgttttgcttgcagcagagagacgcaacatccacaagcttcttgatgaagtctttttttctgaaaaaatttataaactcaatgaggacatggcttgcagtgtggcaggcataacttctgatgctaatgttctgactaatgaactaaggctcattgctcaaaggtatttattacagtatcaggagccaataccttgtgagcagttggttacagcgctgtgtgatatcaaacaagcttatacacaatttggaggaaaacgtccctttggtgtttcattgctgtacattggctgggataagcactatggctttcagctctatcagagtgaccctagtggaaattacgggggatggaaggccacatgcattggaaataatagcgctgcagctgtgtcaatgttgaaacaagactataaagaaggagaaatgaccttgaagtcagcacttgctttagctatcaaagtactaaataagaccatggatgttagtaaactctctgctgaaaaagtggaattgcacactaccagagagatggaagccgtatcagagttctcaacaaaagatgggcgtgtcaaaaaccgngagagaagcaagtggggtggagaagaaaa

SEQ ID NO: 105629 - DNA, 823 bp, Homo sapiens
gcctactactactaaattcgcgggcgcgtcgacgtctttttttctgaaaaaatttataaactcaacgaggacatggcttgcagtgtggcaggcataacttctgatgctaatgttctgactaatgaactaaggctcattgctcaaaggtatttattacagtatcaggagccaataccttgtgagcagttggttacagcgctgtgtgatatcaaacaagcttatacacaatttggaggaaaacgtccctttggtgtttcattgctgtacattggctgggataagcactatggctttcagctctatcagagtgaccctagtggaaattacgggggatggaaggccacatgcattggaaataatagcgctcacagcatgtagtcaatgttcgacaacaaggacttataacacgaacggacgaacactgaccccttgcaagctcccagcacttggctcttacgcctattcagacagtaccttacacattaacgaacccatcggcattgtttcaagttaagacttcttccttggcttgcacacaaacacgtagggcacacatctgggcgagacgaacttcgaaaccaaacggaacggaacgcaaacttcggggcacacacacgagacaaagattaaagaattccgaagcacaggttctaccttccaagataccccaaaaagacagcacggcaacacgcgttgggcgacaacggcccacaggttatcgcggactttcccaacagaacacacaaaacccactgtgcgaaacgcgggcacacgggacacacgggcacaaagggtcggccaagaacaaggagccctctggaca

SEQ ID NO: 105630 - DNA, 494 bp, Homo sapiens
tagacaaagaatattcctttgtctagcagaagagggggggcctccttcagtggaaattgcaacactaacaagagagaatggaaagacagtaatcagagttctcaaacaaaaagaagtggagcagttgatcaaaaaacacgaggaagaagaagccaaagctgagcgtgagaagaaagaaaaagaacagaaagaaaaggataaatagaatcagagattttattactcatttggggcaccatttcagtgtaaaagcagtcctactcttccacactaggaaggctttactttttttaactggtgcagtgggaaaataggacattacatactgaattgggtccttgtcatttctgtccaattgaatactttattgtaacgatgatggttacccttcatggacgtcttaatcttccacacacatcccctttttttggaataaaatttggaaaatggaaatgaaggaaaaacagaaaaatggcctcgttggcctcagaggc

SEQ ID NO: 105631 - DNA, 1262 bp, Homo sapiens
ccccgccccaacccagcggttctgcgcatgcgcgggggccatattagcagcggttattcggtgagcggtggtggtttattcttccgtggagttaagggctccgtggacatctcaggtcttcagggtcttccatctggaactatataaagttcagaaaacatgtctcgaagatatgactccaggaccactatattttctccagaaggtcgcttataccaagttgaatatgccatggaagctattggacatgcaggcacctgtttgggaattttagcaaatgatggtgttttgcttgcagcagagagacgcaacatccacaagcttcttgatgaagtctttttttctgaaaaaatttataaactcaatgaggacatggcttgcagtgtggcaggcataacttctgatgctaatgttctgactaatgaactaaggctcattgctcaaaggtatttattacagtatcaggagccaataccttgtgagcagttggttacagcgctgtgtgatatcaaacaagcttatacacaatttggaggaaaacgtccctttggtgtttcattgctgtacattggctgggataagcactatggctttcagctctatcagagtgaccctagtggaaattacgggggatggaaggccacatgcattggaaataatagcgctgcagctgtgtcaatgttgaaacaagactataaagaaggagaaatgaccttgaagtcagcacttgctttagctatcaaagtactaaataagaccatggatgttagtaaactctctgctgaaaaagtggaaattgcaacactaacaagagagaatggaaagacagtaatcagagttctcaaacaaaaagaagtggagcagttgatcaaaaaacacgaggaagaagaagccaaagctgagcgtgagaagaaagaaaaagaacagaaagaaaaggataaatagaatcagagattttattactcatttggggcaccatttcagtgtaaaagcagtcctactcttccacactaggaaggctttactttttttaactggtgcagtgggaaaataggacattacatactgaattgggtccttgtcatttctgtccaattgaatactttattgtaacgatgatggttacccttcatggacgtcttaatcttccacacacatcccctttttttggaataaaatttggaaaatggaaatgaaggaataaattctctgtagcagtaattgttaaatatacaaaaactgacagggcgattactttttgc

SEQ ID NO: 105632 - DNA, 1302 bp, Homo sapiens
ccccgccccaacccagcggttctgcgcatgcgcgggggccatattagcagcggttattcggtgagcggtggtggtttattcttccgtggagttaagggctccgtggacatctcaggtcttcagggtcttccatctggaactatataaagttcagaaaacatgtctcgaagatatgactccaggaccactatattttctccagaaggtcgcttataccaagttgaatatgccatggaagctattggacatgcaggcacctgtttgggaattttagcaaatgatggtgttttgcttgcagcagagagacgcaacatccacaagcttcttgatgaagtctttttttctgaaaaaatttataaactcaatgaggacatggcttgcagtgtggcaggcataacttctgatgctaatgttctgactaatgaactaaggctcattgctcaaaggtatttattacagtatcaggagccaataccttgtgagcagttggttacagcgctgtgtgatatcaaacaagcttatacacaatttggaggaaaacgtccctttggtgtttcattgctgtacattggctgggataagcactatggctttcagctctatcagagtgaccctagtggaaattacgggggatggaaggccacatgcattggaaataatagcgctgcagctgtgtcaatgttgaaacaagactataaagaaggagaaatgaccttgaagtcagcacttgctttagctatcaaagtactaaataagaccatggatgttagtaaactctctgctgaaaaagtggaaattgcaacactaacaagagagaatggaaagacagtaatcagagttctcaaacaaaaagaagtggagcagttgatcaaaaaacacgaggaagaagaagccaaagctgagcgtgagaagaaagaaaaagaacagaaagaaaaggataaatagaatcagagattttattactcatttggggcaccatttcagtgtaaaagcagtcctactcttccacactaggaaggctttactttttttaactggtgcagtgggaaaataggacattacatactgaattgggtccttgtcatttctgtccaattgaatactttattgtaacgatgatggttacccttcatggacgtcttaatcttccacacacatcccctttttttggaataaaatttggaaaatggaaatgaaggaaaaaacaacacaaaaacaatatacaaacaaattcacaacccaggaaaaccggaacaaatcaaaataaaaaaaacaaaaaagggcctttttggcctaaggggg

SEQ ID NO: 105633 - DNA, 1575 bp, Homo sapiens
ccccgccccaacccagcggttctgcgcatgcgcgggggccatattagcagcggttattcggtgagcggtggtggtttattcttccgtggagttaagggctccgtggacatctcaggtcttcagggtcttccatctggaactatataaagttcagaaaacatgtctcgaagatatgactccaggaccactatattttctccagaaggtcgcttataccaagttgaatatgccatggaagctattggacatgcaggcacctgtttgggaattttagcaaatgatggtgttttgcttgcagcagagagacgcaacatccacaagcttcttgatgaagtctttttttctgaaaaaatttataaactcaatgaggacatggcttgcagtgtggcaggcataacttctgatgctaatgttctgactaatgaactaaggctcattgctcaaaggtatttattacagtatcaggagccaataccttgtgagcagttggttacagcgctgtgtgatatcaaacaagcttatacacaatttggaggaaaacgtccctttggtgtttcattgctgtacattggctgggataagcactatggctttcagctctatcagagtgaccctagtggaaattacgggggatggaaggccacatgcattggaaataatagcgctgcagctgtgtcaatgttgaaacaagactataaagaaggagaaatgaccttgaagtcagcacttgctttagctatcaaagtactaaataagaccatggatgttagtaaactctctgctgaaaaagtggaaattgcaacactaacaagagagaatggaaagacagtaatcagagttctcaaacaaaaagaagtggagcagttgatcaaaaaacacgaggaagaagaagccaaagctgagcgtgagaagaaagaaaaagaacagaaagaaaaggataaatagaatcagagattttattactcatttggggcaccatttcagtgtaaaagcagtcctactcttccacactaggaaggctttactttttttaactggtgcagtgggaaaataggacattacatactgaattgggtccttgtcatttctgtccaattgaatactttattgtaacgatgatggttacccttcatggacgtcttaatcttccacacacatcccctttttttggaataaaatttggaaaatggaaatgaaggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatttaagtgagaacaaaataaaaaaaaaaaaaaaaacttgggggggggccccttccacaatttccccttattagggggctgttaaaaaaaaaaagggcgcgtttttaaaaagtgtgcgttgggaaaaaccttgggttcccacacttaaggccctgtgaaaaaatccccttttgacgggtgggataaaagtaaagaggcccaatcggtgctttcaacaagaggggactctgtatggaaatgtgaatatgtagctaaatatttggaaaaatcccg

SEQ ID NO: 105634 - DNA, 1339 bp, Homo sapiens
  misc_feature (1203)..(1203): n is a, c, g, or t
  misc_feature (1206)..(1206): n is a, c, g, or t
ccccgccccaacccagcggttctgcgcatgcgcgggggccatattagcagcggttattcggtgagcggtggtggtttattcttccgtggagttaagggctccgtggacatctcaggtcttcagggtcttccatctggaactatataaagttcagaaaacatgtctcgaagatatgactccaggaccactatattttctccagaaggtcgcttataccaagttgaatatgccatggaagctattggacatgcaggcacctgtttgggaattttagcaaatgatggtgttttgcttgcagcagagagacgcaacatccacaagcttcttgatgaagtctttttttctgaaaaaatttataaactcaatgaggacatggcttgcagtgtggcaggcataacttctgatgctaatgttctgactaatgaactaaggctcattgctcaaaggtatttattacagtatcaggagccaataccttgtgagcagttggttacagcgctgtgtgatatcaaacaagcttatacacaatttggaggaaaacgtccctttggtgtttcattgctgtacattggctgggataagcactatggctttcagctctatcagagtgaccctagtggaaattacgggggatggaaggccacatgcattggaaataatagcgctgcagctgtgtcaatgttgaaacaagactataaagaaggagaaatgaccttgaagtcagcacttgctttagctatcaaagtactaaataagaccatggatgttagtaaactctctgctgaaaaagtggaaattgcaacactaacaagagagaatggaaagacagtaatcagagttctcaaacaaaaagaagtggagcagttgatcaaaaaacacgaggaagaagaagccaaagctgagcgtgagaagaaagaaaaagaacagaaagaaaaggataaatagaatcagagattttattactcatttggggcaccatttcagtgtaaaagcagtcctactcttccacactaggaaggctttactttttttaactggtgcagtgggaaaataggacattacatactgaattgggtccttgtcatttctgtccaattgaatactttattgtaacgatgatggttacccttcatggacgtcttaatcttccacacacatcccctttttttggaataaaatttggaaaatggaaatgaaggaaanaanaaaaaaatgagatactaaaaaatatttttattataaaaaatacctcttttatccataagggggatatatttttataagattccctcggggggggggggcccggccccaattggcccctttaagggatgtgttt

SEQ ID NO: 105635 - DNA, 1156 bp, Homo sapiens
  misc_feature (1156)..(1156): n is a, c, g, or t
ccccgccccaacccagcggttctgcgcatgcgcgggggccatattagcagcggttattcggtgagcggtggtggtttattcttccgtggagttaagggctccgtggacatctcaggtcttcagggtcttccatctggaactatataaagttcagaaaacatgtctcgaagatatgactccaggaccactatattttctccagaaggtcgcttataccaagttgaatatgccatggaagctattggacatgcaggcacctgtttgggaattttagcaaatgatggtgttttgcttgcagcagagagacgcaacatccacaagcttcttgatgaagtctttttttctgaaaaaatttataaactcaatgaggacatggcttgcagtgtggcaggcataacttctgatgctaatgttctgactaatgaactaaggctcattgctcaaaggtatttattacagtatcaggagccaataccttgtgagcagttggttacagcgctgtgtgatatcaaacaagcttatacacaatttggaggaaaacgtccctttggtgtttcattgctgtacattggctgggataagcactatggctttcagctctatcagagtgaccctagtggaaattacgggggatggaaggccacatgcattggaaataatagcgctgcagctgtgtcaatgttgaaacaagactataaagaaggagaaatgaccttgaagtcagcacttgctttagctatcaaagtactaaataagaccatggatgttagtaaactctctgctgaaaaagtggaaattgcaacactaacaagagagaatggaaagacagtaatcagagttctcaaacaaaaagaagtggagcagttgatcaaaaaacacgaggaagagcaagtgaaggtgagaagaagaaaagacgagaaaggtaattgatcaggattataatcatggggccatttcggttaagatctatctcaatagaggttatttttatggggggggaatgggctcctatgatggtctggcatctgtcaaggtattggagagtggtcctgggttactccaaatcttggtaatgaggggaaaaaacggttgggaaagaagggtttgctgaggtgcttgtaatatgaaaatttttttttgtcgtttttgtttttcn

SEQ ID NO: 105636 - DNA, 893 bp, Homo sapiens
  misc_feature (864)..(864): n is a, c, g, or t
ccccgccccaacccagcggttctgcgcatgcgcgggggccatattagcagcggttattcggtgagcggtggtggtttattcttccgtggagttaagggctccgtggacatctcaggtcttcagggtcttccatctggaactatataaagttcagaaaacatgtctcgaagatatgactccaggaccactatattttctccagaaggtcgcttataccaagttgaatatgccatggaagctattggacatgcaggcacctgtttgggaattttagcaaatgatggtgttttgcttgcagcagagagacgcaacatccacaagcttcttgatgaagtctttttttctgaaaaaatttataaactcaatgaggacatggcttgcagtgtggcaggcataacttctgatgctaatgttctgactaatgaactaaggctcattgctcaaaggtatttattacagtatcaggagccaataccttgtgagcagttggttacagcgctgtgtgatatcaaacaagcttatacacaatttggaggaaaacgtccctttggtgtttcattgctgtacattggctgggataagcactatggctttcagctctatcagagtgaccctagtggaaattacgggggatggaaggccacatgcattggaaataatagcgctgcagctgtgtcaatgttgaaacaagactataaagaaggagaaatgaccttgaagtcagcacttgctttagctatcaaagtactaaataagaccatggatgttagtaaactctctgctgaaaaagtggaattgcacactaccagagagatggaagccgtatcagagttctcaacaaaagatgggcgtgtcaaaaaccgngagagaagcaagtggggtggagaagaaaa

SEQ ID NO: 105637 - DNA, 1181 bp, Homo sapiens
gtatcaacgcagagtgcccattacggccgagcggttattcggtgagcggtggtggtttattcttccgtggagttaagggctccgtggacatctcaggtcttcagggtcttccatctggaactatataaagttcagaaaacatgtctcgaagatatgactccaggaccactatattttctccagaaggtcgcttataccaagttgaatatgccatggaagctattggacatgcaggcacctgtttgggaattttagcaaatgatggtgttttgcttgcagcagagagacgcaacatccacaagcttcttgatgaagtctttttttctgaaaaaatttataaactcaatgaggacatggcttgcagtgtggcaggcataacttctgatgctaatgttctgactaatgaactaaggctcattgctcaaaggtatttattacagtatcaggagccaataccttgtgagcagttggttacagcgctgtgtgatatcaaacaagcttatacacaatttggaggaaaacgtccctttggtgtttcattgctgtacattggctgggataagcactatggctttcagctctatcagagtgaccctagtggaaattacgggggatggaaggccacatgcattggaaataatagcgctgcagctgtgtcaatgttgaaacaagactataaagaaggagaaatgaccttgaagtcagcacttgctttagctatcaaagtactaaataagaccatggatgttagtaaactctctgctgaaaaagtggaaattgcaacactaacaagagagaatggaaagacagtaatcagagttctcaaacaaaaagaagtggagcagttgatcaaaaaacacgaggaagaagaagccaaagctgagcgtgagaagaaagaaaaagaacagaaagaaaaggataaatagaatcagagattttattactcatttggggcaccatttcagtgtaaaagcagtcctactcttccacactaggaaggctttactttttttaactggtgcagtgggaaaataggacattacatactgaattgggtccttgtcatttctgtccaattgaatactttattgtaacgatgatggttacccttcatggacgtcttaatcttccacacacatcccctttttttggaataaaatttggaaaatggaaatgaagga

SEQ ID NO: 105638 - DNA, 1076 bp, Homo sapiens
ccccgccccaacccagcggttctgcgcatgcgcgggggccatattagcagcggttattcggtgagcggtggtggtttattcttccgtggagttaagggctccgtggacatctcaggtcttcagggtcttccatctggaactatataaagttcagaaaacatgtctcgaagatatgactccaggaccactatattttctccagaaggtcgcttataccaagttgaatatgccatggaagctattggacatgcaggcacctgtttgggaattttagcaaatgatggtgttttgcttgcagcagagagacgcaacatccacaagcttcttgatgaagtctttttttctgaaaaaatttataaactcaatgaggacatggcttgcagtgtggcaggcataacttctgatgctaatgttctgactaatgaactaaggctcattgctcaaaggtatttattacagtatcaggagccaataccttgtgagcagttggttacagcgctgtgtgatatcaaacaagcttatacacaatttggaggaaaacgtccctttggtgtttcattgctgtacattggctgggataagcactatggctttcagctctatcagagtgaccctagtggaaattacgggggatggaaggccacatgcattggaaataatagcgcttggaaattgcaacactaacaagagagaatggaaagacagtaatcagagttctcaaacaaaaagaagtggagcagttgatcaaaaaacacgaggaagaagaagccaaagctgagcgtgagaagaaagaaaaagaacagaaagaaaaggataaatagaatcagagattttattactcatttggggcaccatttcagtgtaaaagcagtcctactcttccacactaggaaggctttactttttttaactggtgcagtgggaaaataggacattacatactgaattgggtccttgtcatttctgtccaattgaatactttattgtaacgatgatggttacccttcatggacgtcttaatcttccacacacatcccctttttttggaataaaatttggaaaatggaaatgaagga

SEQ ID NO: 105639 - DNA, 1112 bp, Homo sapiens
ccccgccccaacccagcggttctgcgcatgcgcgggggccatattagcgaactatataaagttcagaaaacatgtctcgaagatatgactccaggaccactatattttctccagaaggtcgcttataccaagttgaatatgccatggaagctattggacatgcaggcacctgtttgggaattttagcaaatgatggtgttttgcttgcagcagagagacgcaacatccacaagcttcttgatgaagtctttttttctgaaaaaatttataaactcaatgaggacatggcttgcagtgtggcaggcataacttctgatgctaatgttctgactaatgaactaaggctcattgctcaaaggtatttattacagtatcaggagccaataccttgtgagcagttggttacagcgctgtgtgatatcaaacaagcttatacacaatttggaggaaaacgtccctttggtgtttcattgctgtacattggctgggataagcactatggctttcagctctatcagagtgaccctagtggaaattacgggggatggaaggccacatgcattggaaataatagcgctgcagctgtgtcaatgttgaaacaagactataaagaaggagaaatgaccttgaagtcagcacttgctttagctatcaaagtactaaataagaccatggatgttagtaaactctctgctgaaaaagtggaaattgcaacactaacaagagagaatggaaagacagtaatcagagttctcaaacaaaaagaagtggagcagttgatcaaaaaacacgaggaagaagaagccaaagctgagcgtgagaagaaagaaaaagaacagaaagaaaaggataaatagaatcagagattttattactcatttggggcaccatttcagtgtaaaagcagtcctactcttccacactaggaaggctttactttttttaactggtgcagtgggaaaataggacattacatactgaattgggtccttgtcatttctgtccaattgaatactttattgtaacgatgatggttacccttcatggacgtcttaatcttccacacacatcccctttttttggaataaaatttggaaaatggaaatgaagga

SEQ ID NO: 105640 - DNA, 1476 bp, Homo sapiens
tgcctgtaccggtccgaggtggttatgaagcggttattcggtgagcggtggtggtttattcttccgtggagttaagggctccgtggacatctcaggtcttcagggtcttccatctggtgagcctttggccccttggggcccgcggaagcttggccgctttcccattgggcgggggtcgtgaacgtcaagacagtcggtcccggcctgcagttgccgccgaggagccgtgggcacgatgactctgcaccgcctcctctgtgacggaccgacagccgggaatggcccccgccggccgccgtcgggggcttcccagtgccaagcctggacgccggggcccgcgagggggcgggctgagggtgggggtctgtgggcaggaccgagagttggggtggcttccgtcctcaggagttcggaactatataaagttcagaaaacatgtctcgaagatatgactccaggaccactatattttctccagaaggtcgcttataccaagttgaatatgccatggaagctattggacatgcaggcacctgtttgggaattttagcaaatgatggtgttttgcttgcagcagagagacgcaacatccacaagcttcttgatgaagtctttttttctgaaaaaatttataaactcaatgaggacatggcttgcagtgtggcaggcataacttctgatgctaatgttctgactaatgaactaaggctcattgctcaaaggtatttattacagtatcaggagccaataccttgtgagcagttggttacagcgctgtgtgatatcaaacaagcttatacacaatttggaggaaaacgtccctttggtgtttcattgctgtacattggctgggataagcactatggctttcagctctatcagagtgaccctagtggaaattacgggggatggaaggccacatgcattggaaataatagcgctgcagctgtgtcaatgttgaaacaagactataaagaaggagaaatgaccttgaagtcagcacttgctttagctatcaaagtactaaataagaccatggatgttagtaaactctctgctgaaaaagtggaaattgcaacactaacaagagagaatggaaagacagtaatcagagttctcaaacaaaaagaagtggagcagttgatcaaaaaacacgaggaagaagaagccaaagctgagcgtgagaagaaagaaaaagaacagaaagaaaaggataaatagaatcagagattttattactcatttggggcaccatttcagtgtaaaagcagtcctactcttccacactaggaaggctttactttttttaactggtgcagtgggaaaataggacattacatactgaattgggtccttgtcatttctgtccaattgaatactttattgtaacgatgatggttacccttcatggacgtcttaatcttccacacacatcccctttttttggaataaaatttggaaaatggaaatgaagga

SEQ ID NO: 105641 - DNA, 1123 bp, Homo sapiens
ccccgccccaacccagcggttctgcgcatgcgcgggggccatattagcagcggttattcggtgagcggtggtggtttattcttccgtggagttaagggctccgtggacatctcaggtcttcagggtcttccatctggaactatataaagttcagaaaacatgtctcgaagatatgactccaggaccactatattttctccagaaggtcgcttataccaagttgaatatgccatggaagctattggacatgcaggcacctgtttgggaattttagcaaatgatggtgttttgcttgcagcagagagacgcaacatccacaagcttcttgatgaagtctttttttctgaaaaaatttataaactcaatgaggacatggcttgcagtgtggcaggcataacttctgatgctaatgttctgactaatgaactaaggctcattgctcaaaggtatttattacagtatcaggagccaataccttgtgagcagttggttacagcgctgtgtgatatcaaacaagcttatacacaatttggaggaaaacgtccctttggtgtttcattgctgtacattggctgggataagcactatggctttcagctctatcagagtgaccctagtggaaattacgggggatggaaggccacatgcattggaaataatagcgctcacagcatgtagtcaatgttcgacaacaaggacttataacacgaacggacgaacactgaccccttgcaagctcccagcacttggctcttacgcctattcagacagtaccttacacattaacgaacccatcggcattgtttcaagttaagacttcttccttggcttgcacacaaacacgtagggcacacatctgggcgagacgaacttcgaaaccaaacggaacggaacgcaaacttcggggcacacacacgagacaaagattaaagaattccgaagcacaggttctaccttccaagataccccaaaaagacagcacggcaacacgcgttgggcgacaacggcccacaggttatcgcggactttcccaacagaacacacaaaacccactgtgcgaaacgcgggcacacgggacacacgggcacaaagggtcggccaagaacaaggagccctctggaca

SEQ ID NO: 105642 - DNA, 2564 bp, Homo sapiens
ccccgccccaacccagcggttctgcgcatgcgcgggggccatattagcagcggttattcggtgagcggtggtggtttattcttccgtggagttaagggctccgtggacatctcaggtcttcagggtcttccatctggtgagcctttggccccttggggcccgcggaagcttggccgctttcccattgggcgggggtcgtgaacgtcaagacagtcggtcccggcctgcagttgccgccgaggagccgtgggcacgatgactctgcaccgcctcctctgtgacggaccgacagccgggaatggcccccgccggccgccgtcgggggcttcccagtgccaagcctggacgccggggcccgcgagggggcgggctgagggtgggggtctgtgggcaggaccgagagttggggtggcttccgtcctcaggagttcggtacgtgaaagttagctctcccggaggtgccggtgaactcaaaatcgtgctgtgcccggcgtcaggcgtggagacaacagaaagttgtgcttaaagctcgaatcagaaatccccggcgagtgtctctgtgtcctccctgcttctctgctctgtgccatccttactttgcaccattcctattgcaattacctcaaccagttcgctgccctcggtctctcaccagccagagtgatcatttaaaatgccaatcagttcctgtgggccttgggaatcattcagaggagccccattggctgagagataaaattctgtttttacctgggcacgcgggctctccaggatttgattccagcttacctttccagtcttgattccctatattccagtatttggaaatgtgggccttggactgaggctttaccaaataacgctgagcacctagtattgcctttgcacgaatggtactgatggtgcccaagataactgcctccacccccaagttcaggacccagatcactctctggagaaggcctcagcctcttgccttggctttcaaggctctgcgtgatttggatactcgcttagctcttatttatatatattttaaaagcatcagcagtttatctcatgcccactaaactatcctgcctccgtaccctttgttcatactttctgctctgtgtggaatgcccttctttcttcccctgttctttctcttagacccaagggttctcagccttatttctgcctctcccatctctgatttactttcattttctgtatcgatttctcaaaaaatactttcttgattctttcatcatcccttttcccaccctacccccggttcctctttccacattataatctatgactgcctctctcacctaactgccagtattagcttttcaggacaggaactggttttacacattttggtattccagcatctagcataatgcctgacacttagctgaataaagggagtaaataaaacagatttgtaaagtcagcaaatgctttttaatttgtgaatcttattttaatgatgatctgattttctttttacaggaactatataaagttcagaaaacatgtctcgaagatatgactccaggaccactatattttctccagaaggtcgcttataccaagttgaatatgccatggaagctattggacatgcaggcacctgtttgggaattttagcaaatgatggtgttttgcttgcagcagagagacgcaacatccacaagcttcttgatgaagtctttttttctgaaaaaatttataaactcaatgaggacatggcttgcagtgtggcaggcataacttctgatgctaatgttctgactaatgaactaaggctcattgctcaaaggtatttattacagtatcaggagccaataccttgtgagcagttggttacagcgctgtgtgatatcaaacaagcttatacacaatttggaggaaaacgtccctttggtgtttcattgctgtacattggctgggataagcactatggctttcagctctatcagagtgaccctagtggaaattacgggggatggaaggccacatgcattggaaataatagcgctgcagctgtgtcaatgttgaaacaagactataaagaaggagaaatgaccttgaagtcagcacttgctttagctatcaaagtactaaataagaccatggatgttagtaaactctctgctgaaaaagtggaaattgcaacactaacaagagagaatggaaagacagtaatcagagttctcaaacaaaaagaagtggagcagttgatcaaaaaacacgaggaagaagaagccaaagctgagcgtgagaagaaagaaaaagaacagaaagaaaaggataaatagaatcagagattttattactcatttggggcaccatttcagtgtaaaagcagtcctactcttccacactaggaaggctttactttttttaactggtgcagtgggaaaataggacattacatactgaattgggtccttgtcatttctgtccaattgaatactttattgtaacgatgatggttacccttcatggacgtcttaatcttccacacacatcccctttttttggaataaaatttggaaaatggaaatgaagga

SEQ ID NO: 105643 - DNA, 3074 bp, Homo sapiens
ccccgccccaacccagcggttctgcgcatgcgcgggggccatattagcagcggttattcggtgagcggtggtggtttattcttccgtggagttaagggctccgtggacatctcaggtcttcagggtcttccatctggtgagcctttggccccttggggcccgcggaagcttggccgctttcccattgggcgggggtcgtgaacgtcaagacagtcggtcccggcctgcagttgccgccgaggagccgtgggcacgatgactctgcaccgcctcctctgtgacggaccgacagccgggaatggcccccgccggccgccgtcgggggcttcccagtgccaagcctggacgccggggcccgcgagggggcgggctgagggtgggggtctgtgggcaggaccgagagttggggtggcttccgtcctcaggagttcggtacgtgaaagttagctctcccggaggtgccggtgaactcaaaatcgtgctgtgcccggcgtcaggcgtggagacaacagaaagttgtgcttaaagctcgaatcagaaatccccggcgagtgtctctgtgtcctccctgcttctctgctctgtgccatccttactttgcaccattcctattgcaattacctcaaccagttcgctgccctcggtctctcaccagccagagtgatcatttaaaatgccaatcagttcctgtgggccttgggaatcattcagaggagccccattggctgagagataaaattctgtttttacctgggcacgcgggctctccaggatttgattccagcttacctttccagtcttgattccctatattccagtatttggaaatgtgggccttggactgaggctttaccaaataacgctgagcacctagtattgcctttgcacgaatggtactgatggtgcccaagataactgcctccacccccaagttcaggacccagatcactctctggagaaggcctcagcctcttgccttggctttcaaggctctgcgtgatttggatactcgcttagctcttatttatatatattttaaaagcatcagcagtttatctcatgcccactaaactatcctgcctccgtaccctttgttcatactttctgctctgtgtggaatgcccttctttcttcccctgttctttctcttagacccaagggttctcagccttatttctgcctctcccatctctgatttactttcattttctgtatcgatttctcaaaaaatactttcttgattctttcatcatcccttttcccaccctacccccggttcctctttccacattataatctatgactgcctctctcacctaactgccagtattagcttttcaggacaggaactggttttacacattttggtattccagcatctagcataatgcctgacacttagctgaataaagggagtaaataaaacagatttgtaaagtcagcaaatgctttttaatttgtgaatcttattttaatgatgatctgattttctttttacaggaactatataaagttcagaaaacatggtgagttaatacacatgccaataaacggttgcctgataaacagtattgcttgtactcagtttacagacttgagtgggaaaattgaaatagaaggaaagcagtgagaaggtgcctttttttcttgtcagtttcctctcacctattgaactttgtataccaggataggttttgtaagatcatttgtaggcttgcaggagttggcctactttcagtgggtaggaatcactcatgtgtttttcctttgcagtctcgaagatatgactccaggaccactatattttctccagaaggtaaaatagaaattgtttaatctgcctcaagtttaaaaataaatgtgttagacttttagaaaaaaaaattacaaactttttttggtagttgcaaagttcatcctttttgtactttgaagcaattatcatcaccaggttgattataccatagaagagtgaaagtggaaatttgtttctagcttgcttcattgctgatttcttttgggccagtggtgcaggagcacagaggagagtcttggcttctcactgcttttgttttgtaggtcgcttataccaagttgaatatgccatggaagctattggacatgcaggcacctgtttgggaattttagcaaatgatggtgttttgcttgcagcagagagacgcaacatccacaagcttcttgatgaagtctttttttctgaaaaaatttataaactcaatgaggacatggcttgcagtgtggcaggcataacttctgatgctaatgttctgactaatgaactaaggctcattgctcaaaggtatttattacagtatcaggagccaataccttgtgagcagttggttacagcgctgtgtgatatcaaacaagcttatacacaatttggaggaaaacgtccctttggtgtttcattgctgtacattggctgggataagcactatggctttcagctctatcagagtgaccctagtggaaattacgggggatggaaggccacatgcattggaaataatagcgctgcagctgtgtcaatgttgaaacaagactataaagaaggagaaatgaccttgaagtcagcacttgctttagctatcaaagtactaaataagaccatggatgttagtaaactctctgctgaaaaagtggaaattgcaacactaacaagagagaatggaaagacagtaatcagagttctcaaacaaaaagaagtggagcagttgatcaaaaaacacgaggaagaagaagccaaagctgagcgtgagaagaaagaaaaagaacagaaagaaaaggataaatagaatcagagattttattactcatttggggcaccatttcagtgtaaaagcagtcctactcttccacactaggaaggctttactttttttaactggtgcagtgggaaaataggacattacatactgaattgggtccttgtcatttctgtccaattgaatactttattgtaacgatgatggttacccttcatggacgtcttaatcttccacacacatcccctttttttggaataaaatttggaaaatggaaatgaagga

SEQ ID NO: 105644 - DNA, 1591 bp, Homo sapiens
tgcctgtaccggtccgaggtggttatgaagcggttattcggtgagcggtggtggtttattcttccgtggagttaagggctccgtggacatctcaggtcttcagggtcttccatctggtgagcctttggccccttggggcccgcggaagcttggccgctttcccattgggcgggggtcgtgaacgtcaagacagtcggtcccggcctgcagttgccgccgaggagccgtgggcacgatgactctgcaccgcctcctctgtgacggaccgacagccgggaatggcccccgccggccgccgtcgggggcttcccagtgccaagcctggacgccggggcccgcgagggggcgggctgagggtgggggtctgtgggcaggaccgagagttggggtggcttccgtcctcaggagttcggtacgtgaaagttagctctcccggaggtgccggtgaactcaaaatcgtgctgtgcccggcgtcaggcgtggagacaacagaaagttgtgcttaaagctcgaatcagaaatccccggaactatataaagttcagaaaacatgtctcgaagatatgactccaggaccactatattttctccagaaggtcgcttataccaagttgaatatgccatggaagctattggacatgcaggcacctgtttgggaattttagcaaatgatggtgttttgcttgcagcagagagacgcaacatccacaagcttcttgatgaagtctttttttctgaaaaaatttataaactcaatgaggacatggcttgcagtgtggcaggcataacttctgatgctaatgttctgactaatgaactaaggctcattgctcaaaggtatttattacagtatcaggagccaataccttgtgagcagttggttacagcgctgtgtgatatcaaacaagcttatacacaatttggaggaaaacgtccctttggtgtttcattgctgtacattggctgggataagcactatggctttcagctctatcagagtgaccctagtggaaattacgggggatggaaggccacatgcattggaaataatagcgctgcagctgtgtcaatgttgaaacaagactataaagaaggagaaatgaccttgaagtcagcacttgctttagctatcaaagtactaaataagaccatggatgttagtaaactctctgctgaaaaagtggaaattgcaacactaacaagagagaatggaaagacagtaatcagagttctcaaacaaaaagaagtggagcagttgatcaaaaaacacgaggaagaagaagccaaagctgagcgtgagaagaaagaaaaagaacagaaagaaaaggataaatagaatcagagattttattactcatttggggcaccatttcagtgtaaaagcagtcctactcttccacactaggaaggctttactttttttaactggtgcagtgggaaaataggacattacatactgaattgggtccttgtcatttctgtccaattgaatactttattgtaacgatgatggttacccttcatggacgtcttaatcttccacacacatcccctttttttggaataaaatttggaaaatggaaatgaagga

SEQ ID NO: 105645 - DNA, 1690 bp, Homo sapiens
tgcctgtaccggtccgaggtggttatgaagcggttattcggtgagcggtggtggtttattcttccgtggagttaagggctccgtggacatctcaggtcttcagggtcttccatctggaactatataaagttcagaaaacatggtgagttaatacacatgccaataaacggttgcctgataaacagtattgcttgtactcagtttacagacttgagtgggaaaattgaaatagaaggaaagcagtgagaaggtgcctttttttcttgtcagtttcctctcacctattgaactttgtataccaggataggttttgtaagatcatttgtaggcttgcaggagttggcctactttcagtgggtaggaatcactcatgtgtttttcctttgcagtctcgaagatatgactccaggaccactatattttctccagaaggtaaaatagaaattgtttaatctgcctcaagtttaaaaataaatgtgttagacttttagaaaaaaaaattacaaactttttttggtagttgcaaagttcatcctttttgtactttgaagcaattatcatcaccaggttgattataccatagaagagtgaaagtggaaatttgtttctagcttgcttcattgctgatttcttttgggccagtggtgcaggagcacagaggagagtcttggcttctcactgcttttgttttgtaggtcgcttataccaagttgaatatgccatggaagctattggacatgcaggcacctgtttgggaattttagcaaatgatggtgttttgcttgcagcagagagacgcaacatccacaagcttcttgatgaagtctttttttctgaaaaaatttataaactcaatgaggacatggcttgcagtgtggcaggcataacttctgatgctaatgttctgactaatgaactaaggctcattgctcaaaggtatttattacagtatcaggagccaataccttgtgagcagttggttacagcgctgtgtgatatcaaacaagcttatacacaatttggaggaaaacgtccctttggtgtttcattgctgtacattggctgggataagcactatggctttcagctctatcagagtgaccctagtggaaattacgggggatggaaggccacatgcattggaaataatagcgctgcagctgtgtcaatgttgaaacaagactataaagaaggagaaatgaccttgaagtcagcacttgctttagctatcaaagtactaaataagaccatggatgttagtaaactctctgctgaaaaagtggaaattgcaacactaacaagagagaatggaaagacagtaatcagagttctcaaacaaaaagaagtggagcagttgatcaaaaaacacgaggaagaagaagccaaagctgagcgtgagaagaaagaaaaagaacagaaagaaaaggataaatagaatcagagattttattactcatttggggcaccatttcagtgtaaaagcagtcctactcttccacactaggaaggctttactttttttaactggtgcagtgggaaaataggacattacatactgaattgggtccttgtcatttctgtccaattgaatactttattgtaacgatgatggttacccttcatggacgtcttaatcttccacacacatcccctttttttggaataaaatttggaaaatggaaatgaagga

SEQ ID NO: 105646 - DNA, 1137 bp, Homo sapiens
tgcctgtaccggtccgaggtggttatgaagcggttattcggtgagcggtggtggtttattcttccgtggagttaagggctccgtggacatctcaggtcttcagggtcttccatctggaactatataaagttcagaaaacatggtcgcttataccaagttgaatatgccatggaagctattggacatgcaggcacctgtttgggaattttagcaaatgatggtgttttgcttgcagcagagagacgcaacatccacaagcttcttgatgaagtctttttttctgaaaaaatttataaactcaatgaggacatggcttgcagtgtggcaggcataacttctgatgctaatgttctgactaatgaactaaggctcattgctcaaaggtatttattacagtatcaggagccaataccttgtgagcagttggttacagcgctgtgtgatatcaaacaagcttatacacaatttggaggaaaacgtccctttggtgtttcattgctgtacattggctgggataagcactatggctttcagctctatcagagtgaccctagtggaaattacgggggatggaaggccacatgcattggaaataatagcgctgcagctgtgtcaatgttgaaacaagactataaagaaggagaaatgaccttgaagtcagcacttgctttagctatcaaagtactaaataagaccatggatgttagtaaactctctgctgaaaaagtggaaattgcaacactaacaagagagaatggaaagacagtaatcagagttctcaaacaaaaagaagtggagcagttgatcaaaaaacacgaggaagaagaagccaaagctgagcgtgagaagaaagaaaaagaacagaaagaaaaggataaatagaatcagagattttattactcatttggggcaccatttcagtgtaaaagcagtcctactcttccacactaggaaggctttactttttttaactggtgcagtgggaaaataggacattacatactgaattgggtccttgtcatttctgtccaattgaatactttattgtaacgatgatggttacccttcatggacgtcttaatcttccacacacatcccctttttttggaataaaatttggaaaatggaaatgaagga

SEQ ID NO: 105647 - DNA, 1107 bp, Homo sapiens
ccccgccccaacccagcggttctgcgcatgcgcgggggccatattagcagcggttattcggtgagcggtggtggtttattcttccgtggagttaagggctccgtggacatctcaggtcttcagggtcttccatctggaactatataaagttcagaaaacatgtctcgaagatatgactccaggaccactatattttctccagaagcagagagacgcaacatccacaagcttcttgatgaagtctttttttctgaaaaaatttataaactcaatgaggacatggcttgcagtgtggcaggcataacttctgatgctaatgttctgactaatgaactaaggctcattgctcaaaggtatttattacagtatcaggagccaataccttgtgagcagttggttacagcgctgtgtgatatcaaacaagcttatacacaatttggaggaaaacgtccctttggtgtttcattgctgtacattggctgggataagcactatggctttcagctctatcagagtgaccctagtggaaattacgggggatggaaggccacatgcattggaaataatagcgctgcagctgtgtcaatgttgaaacaagactataaagaaggagaaatgaccttgaagtcagcacttgctttagctatcaaagtactaaataagaccatggatgttagtaaactctctgctgaaaaagtggaaattgcaacactaacaagagagaatggaaagacagtaatcagagttctcaaacaaaaagaagtggagcagttgatcaaaaaacacgaggaagaagaagccaaagctgagcgtgagaagaaagaaaaagaacagaaagaaaaggataaatagaatcagagattttattactcatttggggcaccatttcagtgtaaaagcagtcctactcttccacactaggaaggctttactttttttaactggtgcagtgggaaaataggacattacatactgaattgggtccttgtcatttctgtccaattgaatactttattgtaacgatgatggttacccttcatggacgtcttaatcttccacacacatcccctttttttggaataaaatttggaaaatggaaatgaagga

SEQ ID NO: 105648 - DNA, 1037 bp, Homo sapiens
ccccgccccaacccagcggttctgcgcatgcgcgggggccatattagcagcggttattcggtgagcggtggtggtttattcttccgtggagttaagggctccgtggacatctcaggtcttcagggtcttccatctggaactatataaagttcagaaaacatgtctcgaagatatgactccaggaccactatattttctccagaagggacatggcttgcagtgtggcaggcataacttctgatgctaatgttctgactaatgaactaaggctcattgctcaaaggtatttattacagtatcaggagccaataccttgtgagcagttggttacagcgctgtgtgatatcaaacaagcttatacacaatttggaggaaaacgtccctttggtgtttcattgctgtacattggctgggataagcactatggctttcagctctatcagagtgaccctagtggaaattacgggggatggaaggccacatgcattggaaataatagcgctgcagctgtgtcaatgttgaaacaagactataaagaaggagaaatgaccttgaagtcagcacttgctttagctatcaaagtactaaataagaccatggatgttagtaaactctctgctgaaaaagtggaaattgcaacactaacaagagagaatggaaagacagtaatcagagttctcaaacaaaaagaagtggagcagttgatcaaaaaacacgaggaagaagaagccaaagctgagcgtgagaagaaagaaaaagaacagaaagaaaaggataaatagaatcagagattttattactcatttggggcaccatttcagtgtaaaagcagtcctactcttccacactaggaaggctttactttttttaactggtgcagtgggaaaataggacattacatactgaattgggtccttgtcatttctgtccaattgaatactttattgtaacgatgatggttacccttcatggacgtcttaatcttccacacacatcccctttttttggaataaaatttggaaaatggaaatgaagga

SEQ ID NO: 105649 - DNA, 1019 bp, Homo sapiens
  misc_feature (17)..(17): n is a, c, g, or t
cggacgcgtgggtcganccacgcgtccgatagcggttattcggtgagcggtggtggtttattcttccgtggagttaagggctccgtggacatctcaggtcttcagggtcttccatctggaactatataaagttcagaaaacatgtctcgaagatatgactccaggaccactatattttctccagaagggacatggcttgcagtgtggcaggcataacttctgatgctaatgttctgactaatgaactaaggctcattgctcaaaggtatttattacagtatcaggagccaataccttgtgagcagttggttacagcgctgtgtgatatcaaacaagcttatacacaatttggaggaaaacgtccctttggtgtttcattgctgtacattggctgggataagcactatggctttcagctctatcagagtgaccctagtggaaattacgggggatggaaggccacatgcattggaaataatagcgctgcagctgtgtcaatgttgaaacaagactataaagaaggagaaatgaccttgaagtcagcacttgctttagctatcaaagtactaaataagaccatggatgttagtaaactctctgctgaaaaagtggaaattgcaacactaacaagagagaatggaaagacagtaatcagagttctcaaacaaaaagaagtggagcagttgatcaaaaaacacgaggaagaagaagccaaagctgagcgtgagaagaaagaaaaagaacagaaagaaaaggataaatagaatcagagattttattactcatttggggcaccatttcagtgtaaaagcagtcctactcttccacactaggaaggctttactttttttaactggtgcagtgggaaaataggacattacatactgaattgggtccttgtcatttctgtccaattgaatactttattgtaacgatgatggttacccttcatggacgtcttaatcttccacacacatcccctttttttggaataaaatttggaaaatggaaatgaagga

SEQ ID NO: 105650 - DNA, 1122 bp, Homo sapiens
ccccgccccaacccagcggttctgcgcatgcgcgggggccatattagcagcggttattcggtgagcggtggtggtttattcttccgtggagttaagggctccgtggacatctcaggtcttcagggtcttccatctggaactatataaagttcagaaaacatgtctcgaagatatgactccaggaccactatattttctccagaaggtcgcttataccaagttgaatatgccatggaagctattggacatgcaggcacctgtttgggaattttagcaaatgatggtgttttgcttgcagcagagagacgcaacatccacaagcttcttgatgaagtctttttttctgaaaaaatttataaactcaatgagtatttattacagtatcaggagccaataccttgtgagcagttggttacagcgctgtgtgatatcaaacaagcttatacacaatttggaggaaaacgtccctttggtgtttcattgctgtacattggctgggataagcactatggctttcagctctatcagagtgaccctagtggaaattacgggggatggaaggccacatgcattggaaataatagcgctgcagctgtgtcaatgttgaaacaagactataaagaaggagaaatgaccttgaagtcagcacttgctttagctatcaaagtactaaataagaccatggatgttagtaaactctctgctgaaaaagtggaaattgcaacactaacaagagagaatggaaagacagtaatcagagttctcaaacaaaaagaagtggagcagttgatcaaaaaacacgaggaagaagaagccaaagctgagcgtgagaagaaagaaaaagaacagaaagaaaaggataaatagaatcagagattttattactcatttggggcaccatttcagtgtaaaagcagtcctactcttccacactaggaaggctttactttttttaactggtgcagtgggaaaataggacattacatactgaattgggtccttgtcatttctgtccaattgaatactttattgtaacgatgatggttacccttcatggacgtcttaatcttccacacacatcccctttttttggaataaaatttggaaaatggaaatgaagga

SEQ ID NO: 105651 - DNA, 887 bp, Homo sapiens
ccccgccccaacccagcggttctgcgcatgcgcgggggccatattagcagcggttattcggtgagcggtggtggtttattcttccgtggagttaagggctccgtggacatctcaggtcttcagggtcttccatctggaactatataaagttcagaaaacatgtctcgaagatatgactccaggaccactatattttctccagaaggtcgcttataccaagttgaatatgccatggaagctattggacatgcaggcacctgtttgggaattttagcaaatgatggtgttttgcttgcagcagagagacgcaacatccacaagcttcttgatgaagtctttttttctgaaaaaatttataaactcaatgaggacatggcttgcagtgtggcaggcataacttctgatgctaatgttctgactaatgaactaaggctcattgctcaaaggtatttattacagtatcaggagccaataccttgtgagcagttggttacagcgctgtgtgatatcaaacaagcttatacacaatttggaggaaaacgtccctttggtgtttcattgctgtacattggctgggataagcactatggctttcagctctatcagagtgaccctagtggaaattacgggggatggaggcaatgttggaatataggggtgggtgtgtcatgtgaacagatttaagaggaatgacttgagtcggctgtttgtttcaagtctatagactgtgttgtaacctcgtgagcagtggatggctacagaagaggagaggatcagtttaaaaaaggggggtcaacaggggaacgtggggaaaaacacaagggaaatttttggggggaaactccagagttggggggaaaagggggtgtgatgacctaaaaagtcta

SEQ ID NO: 105652 - DNA, 465 bp, Homo sapiens
  misc_feature (45)..(45): n is a, c, g, or t
  misc_feature (47)..(47): n is a, c, g, or t
tcgctttcctgaatcacgttgttctactattcgcgacaacaccgnanaggcttgttggaaattgcaacactaacaagagagaatggaaagacagtaatcagagttctcaaacaaaaagaagtggagcagttgatcaaaaaacacgaggaagaagaagccaaagctgagcgtgagaagaaagaaaaagaacagaaagaaaaggataaatagaatcagagattttattactcatttggggcaccatttcagtgtaaaagcagtcctactcttccacactaggaaggctttactttttttaactggtgcagtgggaaaataggacattacatactgaattgggtccttgtcatttctgtccaattgaatactttattgtaacgatgatggttacccttcatggacgtcttaatcttccacacacatcccctttttttggaataaaatttggaaaatggaaatgaagga

SEQ ID NO: 105653 - DNA, 995 bp, Homo sapiens
  misc_feature (859)..(859): n is a, c, g, or t
  misc_feature (862)..(862): n is a, c, g, or t
ccccgccccaacccagcggttctgcgcatgcgcgggggccatattagcagcggttattcggtgagcggtggtggtttattcttccgtggagttaagggctccgtggacatctcaggtcttcagggtcttccatctggaactatataaagttcagaaaacatgtctcgaagatatgactccaggaccactatattttctccagaaggtcgcttataccaagttgaatatgccatggaagctattggacatgcaggcacctgtttgggaattttagcaaatgatggtgttttgcttgcagcagagagacgcaacatccacaagcttcttgatgaagtctttttttctgaaaaaatttataaactcaatgaggacatggcttgcagtgtggcaggcataacttctgatgctaatgttctgactaatgaactaaggctcattgctcaaagtggaaattgcaacactaacaagagagaatggaaagacagtaatcagagttctcaaacaaaaagaagtggagcagttgatcaaaaaacacgaggaagaagaagccaaagctgagcgtgagaagaaagaaaaagaacagaaagaaaaggataaatagaatcagagattttattactcatttggggcaccatttcagtgtaaaagcagtcctactcttccacactaggaaggctttactttttttaactggtgcagtgggaaaataggacattacatactgaattgggtccttgtcatttctgtccaattgaatactttattgtaacgatgatggttacccttcatggacgtcttaatcttccacacacatcccctttttttggaataaaatttggaaaatggaaatgaaggaaanaanaaaaaaatgagatactaaaaaatatttttattataaaaaatacctcttttatccataagggggatatatttttataagattccctcggggggggggggcccggccccaattggcccctttaagggatgtgttt

SEQ ID NO: 105654 - DNA, 368 bp, Homo sapiens
cgactctagaggctccctcattagtggagcagttgatcaaaaaacacgaggaagaagaagccaaagctgagcgtgagaagaaagaaaaagaacagaaagaaaaggataaatagaatcagagattttattactcatttggggcaccatttcagtgtaaaagcagtcctactcttccacactaggaaggctttactttttttaactggtgcagtgggaaaataggacattacatactgaattgggtccttgtcatttctgtccaattgaatactttattgtaacgatgatggttacccttcatggacgtcttaatcttccacacacatcccctttttttggaataaaatttggaaaatggaaatgaagga

SEQ ID NO: 105655 - DNA, 1130 bp, Homo sapiens
  misc_feature (44)..(44): n is a, c, g, or t
agaaaacgctacgccatcaacaatcagaaaaaaccccccccccnctttgtggaaattgcaacactaacaagagagaatggaaagacagtaatcagagttctcaaacaaaaagaagtggagcagttgatcaaaaaacacgaggaagaagaagccaaagctgagcgtgagaagaaagaaaaagaacagaaagaaaaggataaatagaatcagagattttattactcatttggggcaccatttcagtgtaaaagcagtcctactcttccacactaggaaggctttactttttttaactggtgcagtgggaaaataggacattacatactgaattgggtccttgtcatttctgtccaattgaatactttattgtaacgatgatggttacccttcatggacgtcttaatcttccacacacatcccctttttttggaataaaatttggaaaatggaaatgaaggaaaaaaaaaaaaaaaaaaaaaaaaaaaaaaaaaaaaaaaaaaaaaaaaaaaaaaaaaaagataaatagaaatgaacaagacgataataataataaaagcatataataaaagtaaaaaccagataaataaagaaaagaagaacaaccaaaacaagcacaacataaattacccaagatgacaatgaccttttcgatcacctactaccaactcccgcccctcaagcctcaaagcaagcaccatctccctctatgttcggcgtccattatcactcaacatcaccagcgacaccaccatttctcgccgagtcagcgttcccgccagcacctccaccacccctccacacacctccaagcctgcaacgtccctctgatcaccatgatcacgcatccccacgtactacgtgatatacgggacgcgccagcacaacgggcccgtgcctacacacaaagaacactaagcctcggatgcagagaacgagaccctataacacgcaccagctaaaacgccgagacatcaacttccaccatactctgtccccaatcgagcagtagacacaacgtcttatcacctcgtgccgactcacactcaaaccatacgggcatcacgcgccgtcgctaccagcgactacacagagcgacagaagtagacacacaagacaccatctaggcatca

SEQ ID NO: 105656 - DNA, 1234 bp, Homo sapiens
ccccgccccaacccagcggttctgcgcatgcgcgggggccatattagcagcggttattcggtgagcggtggtggtttattcttccgtggagttaagggctccgtggacatctcaggtcttcagggtcttccatctggaactatataaagttcagaaaacatgtctcgaagatatgactccaggaccactatattttctccagaaggtcgcttataccaagttgaatatgccatggaagctattggacatgcaggcacctgtttgggaattttagcaaatgatggtgttttgcttgcagcagagagacgcaacatccacaagcttcttgatgaagtctttttttctgaaaaaatttataaactcaatgaggacatggcttgcagtgtggcaggcataacttctgatgctaatgttctgactaatgaactaaggctcattgctcaaaggtatttattacagtatcaggagccaataccttgtgagcagttggttacagcgctgtgtgatatcaaacaagcttatacacaatttggaggaaaacgtccctttggtgtttcattgctgtacattggctgggataagcactatggctttcagctctatcagagtgaccctagtggaaattacgggggatggaaggccacatgcattggaaataatagcgctgcagctgtgtcaatgttgaaacaagactataaagaaggagaaatgaccttgaagtcagcacttgctttagctatcaaagtactaaataagaccatggatgttagtaaactctctgctgaaaaagtggaaattgcaacactaacaagagagaatggaaagacagtaatcagagttctcaaacaaaaagaagtggagcagttgatcaaaaaacacgaggaagaagaagccaaagctgagcgtgagaagaaagaaaaagaacagaaagaaaaggataaatagaatcagagattttattactcatttggggcaccatttcagtgtaaaagcagtcctactcttccacactaggaaggctttactttttttaactggtgcagtgggaaaataggacattacatactgaattgggtccttgtcatttctgtccaattgaatactttattgtaacgatgatggttacccttcatggacgtcttaatcttccacacacatcccctttttttggaataaaatttggaaaatggaaatgaaggaaaaacagaaaaatggcctcgttggcctcagaggc

SEQ ID NO: 105657 - DNA, 1286 bp, Homo sapiens
ccccgccccaacccagcggttctgcgcatgcgcgggggccatattagcagcggttattcggtgagcggtggtggtttattcttccgtggagttaagggctccgtggacatctcaggtcttcagggtcttccatctggaactatataaagttcagaaaacatgtctcgaagatatgactccaggaccactatattttctccagaaggtcgcttataccaagttgaatatgccatggaagctattggacatgcaggcacctgtttgggaattttagcaaatgatggtgttttgcttgcagcagagagacgcaacatccacaagcttcttgatgaagtctttttttctgaaaaaatttataaactcaatgaggacatggcttgcagtgtggcaggcataacttctgatgctaatgttctgactaatgaactaaggctcattgctcaaaggtatttattacagtatcaggagccaataccttgtgagcagttggttacagcgctgtgtgatatcaaacaagcttatacacaatttggaggaaaacgtccctttggtgtttcattgctgtacattggctgggataagcactatggctttcagctctatcagagtgaccctagtggaaattacgggggatggaaggccacatgcattggaaataatagcgctgcagctgtgtcaatgttgaaacaagactataaagaaggagaaatgaccttgaagtcagcacttgctttagctatcaaagtactaaataagaccatggatgttagtaaactctctgctgaaaaagtggaaattgcaacactaacaagagagaatggaaagacagtaatcagagttctcaaacaaaaagaagtggagcagttgatcaaaaaacacgaggaagaagaagccaaagctgagcgtgagaagaaagaaaaagaacagaaagaaaaggataaatagaatcagagattttattactcatttggggcaccatttcagtgtaaaagcagtcctactcttccacactaggaaggctttactttttttaactggtgcagtgggaaaataggacattacatactgaattgggtccttgtcatttctgtccaattgaatactttattgtaacgatgatggttacccttcatggacgtcttaatcttccacacacatcccctttttttggaataaaatttggaaaatggaaatgaaggaaaaaaccaaacaaaaatactaacaaaaccgaccaactcgccggaaggaacaaaaaacagaaaaatggcctcgttggcctcagaggc

SEQ ID NO: 105658 - DNA, 1871 bp, Homo sapiens
ccccgccccaacccagcggttctgcgcatgcgcgggggccatattagcagcggttattcggtgagcggtggtggtttattcttccgtggagttaagggctccgtggacatctcaggtcttcagggtcttccatctggaactatataaagttcagaaaacatgtctcgaagatatgactccaggaccactatattttctccagaaggtcgcttataccaagttgaatatgccatggaagctattggacatgcaggcacctgtttgggaattttagcaaatgatggtgttttgcttgcagcagagagacgcaacatccacaagcttcttgatgaagtctttttttctgaaaaaatttataaactcaatgaggacatggcttgcagtgtggcaggcataacttctgatgctaatgttctgactaatgaactaaggctcattgctcaaaggtatttattacagtatcaggagccaataccttgtgagcagttggttacagcgctgtgtgatatcaaacaagcttatacacaatttggaggaaaacgtccctttggtgtttcattgctgtacattggctgggataagcactatggctttcagctctatcagagtgaccctagtggaaattacgggggatggaaggccacatgcattggaaataatagcgctgcagctgtgtcaatgttgaaacaagactataaagaaggagaaatgaccttgaagtcagcacttgctttagctatcaaagtactaaataagaccatggatgttagtaaactctctgctgaaaaagtggaaattgcaacactaacaagagagaatggaaagacagtaatcagagttctcaaacaaaaagaagtggagcagttgatcaaaaaacacgaggaagaagaagccaaagctgagcgtgagaagaaagaaaaagaacagaaagaaaaggataaatagaatcagagattttattactcatttggggcaccatttcagtgtaaaagcagtcctactcttccacactaggaaggctttactttttttaactggtgcagtgggaaaataggacattacatactgaattgggtccttgtcatttctgtccaattgaatactttattgtaacgatgatggttacccttcatggacgtcttaatcttccacacacatcccctttttttggaataaaatttggaaaatggaaatgaaggaaaaaaaaaaaaaaaaaaaaaaaaaaaaaaaaaaaaaaaaaaaaaaaaaaaaaaaaaaagataaatagaaatgaacaagacgataataataataaaagcatataataaaagtaaaaaccagataaataaagaaaagaagaacaaccaaaacaagcacaacataaattacccaagatgacaatgaccttttcgatcacctactaccaactcccgcccctcaagcctcaaagcaagcaccatctccctctatgttcggcgtccattatcactcaacatcaccagcgacaccaccatttctcgccgagtcagcgttcccgccagcacctccaccacccctccacacacctccaagcctgcaacgtccctctgatcaccatgatcacgcatccccacgtactacgtgatatacgggacgcgccagcacaacgggcccgtgcctacacacaaagaacactaagcctcggatgcagagaacgagaccctataacacgcaccagctaaaacgccgagacatcaacttccaccatactctgtccccaatcgagcagtagacacaacgtcttatcacctcgtgccgactcacactcaaaccatacgggcatcacgcgccgtcgctaccagcgactacacagagcgacagaagtagacacacaagacaccatctaggcatca

SEQ ID NO: 105659 - DNA, 1200 bp, Homo sapiens
ccccgccccaacccagcggttctgcgcatgcgcgggggccatattagcagcggttattcggtgagcggtggtggtttattcttccgtggagttaagggctccgtggacatctcaggtcttcagggtcttccatctggaactatataaagttcagaaaacatgtctcgaagatatgactccaggaccactatattttctccagaaggtcgcttataccaagttgaatatgccatggaagctattggacatgcaggcacctgtttgggaattttagcaaatgatggtgttttgcttgcagcagagagacgcaacatccacaagcttcttgatgaagtctttttttctgaaaaaatttataaactcaatgaggacatggcttgcagtgtggcaggcataacttctgatgctaatgttctgactaatgaactaaggctcattgctcaaaggtatttattacagtatcaggagccaataccttgtgagcagttggttacagcgctgtgtgatatcaaacaagcttatacacaatttggaggaaaacgtccctttggtgtttcattgctgtacattggctgggataagcactatggctttcagctctatcagagtgaccctagtggaaattacgggggatggaaggccacatgcattggaaataatagcgctgcagctgtgtcaatgttgaaacaagactataaagaaggagaaatgaccttgaagtcagcacttgctttagctatcaaagtactaaataagaccatggatgttagtaaactctctgctgaaaaagtggaaattgcaacactaacaagagagaatggaaagacagtaatcagagttctcaaacaaaaagaagtggagcagttgatcaaaaaacacgaggaagaagaagccaaagctgagcgtgagaagaaagaaaaagaacagaaagaaaaggataaatagaatcagagattttattactcatttggggcaccatttcagtgtaaaagcagtcctactcttccacactaggaaggctttactttttttaactggtgcagtgggaaaataggacattacatactgaattgggtccttgtcatttctgtccaattgaatactttattgtaacgatgatggttacccttcatggacgtcttaatcttccacacacatcccctttttttggaataaaatttggaaaatggaaatgaagga

SEQ ID NO: 105660 - DNA, 302 bp, Homo sapiens
tactttctcttttttcttgaaacagagcctaactctgtcacccagtctggagtggagcaatcctctaatctcagccccctgagtagctgggattacaggcatgcaccaccacacctggctaatttttaaaaatctttggtagagatgggatctcactatgttgcccgggctggtctcaaattcctaggctcaagtgatctcctgcctcagcctctcaaagtgctgggccttctgcttccctgggctttgccaggcctccctatgcattgtgatagccaaagtttgctttctacaaagtcacc

SEQ ID NO: 105661 - DNA, 467 bp, Homo sapiens
gagtcactattttgaagcaaactaagaatttctaaggagcttggagacttgcacatcttctgatattgggaggtcttaggttaaaagacttttttatttggattcattaattgagtgtaggtcattgttaatggaaaatcgttgaacacttaataaatacagctatgtttaaagttcttaaaaatttaaatacagattaggaagcccaaatttcagaggaactggtagaggatttgtgctttgtttttaatgttttaaacagccctgtggttatagtttagaaaggtcatagttttgacggtcctctattaaaagaaagtgatttttccatcagaatacagttgagtgccacagtgtatagagaagccatagctaatactttaaaatgttttacttttaaaatttcaaaacaaactgtaggttttaaaagttttctctctcacagttttaacccaatctgagaaata

SEQ ID NO: 105662 - DNA, 401 bp, Homo sapiens
gcgagcagctactactacggggggcgcggcccgtcgacagaagacacaaagatgtggttataccaacatttgaaattctgcccaaagaagcagaaaaaaggaagaaagaaaggaaggaacgaattgtgtaacgatagcctattgataataaattatagtacattgattcaatggaaccctataccaccacaaagaaaactgttagagatttatatttattaacataaaagattgtcagtgaaatattaaatgaaaaaagcaaataaccagacagtaaatgaatgtattcttctttccaaaaacagtgtatgtctatatacatgcactgtcatgcaaagaaaaggaaatatcacaaaatgtaaacactggttgtcgacgaggggcgggttataggagaagaa

SEQ ID NO: 105663 - DNA, 475 bp, Homo sapiens
aggggagccagaggcaggaagaggaagagcaggtagacagggtatgctcggcagtctgtaaaatccagtataaggctatataataacacattaagtcttctgtagttaaatctaattttcttagcttctataattaagcctaagttatcttcatttttgtagttagggccacagtcttgtcaaaattgtccagtatttatactgtggatcataaaacttaggctggaaaggcctataagatcatagagttcaaccctagcccatcccacatgcaggaccctgccctgggctccttctcaggctttcccagggaaagggcatttttgatgttgttggcagcatggccgtgtggcataactcttgaaattctggctcctttatttttccactctggtcctgggtgtttgcacaaggtcagcctactgccttgtgtacaggatcccttcagacattcgctggcagcaccaggcacttt

SEQ ID NO: 105664 - DNA, 351 bp, Homo sapiens
cattgtccaggctagaatgcagtggcacgatcttagctcaccacaacctgcgcctccctggctcaagcaatcttcccggcttagcctcccaagcagctgggactataggcacacaccaccatgcctggctaatttttgtatgttttgtagagacgggtttcgccatgttgaccaggctggtcttgaactcctgggctcaagtgatctgcccacatcactctcccaaagtgttgggattacaggcgtgagccaccatgcctggcctgaatcttaaatatacatattcatctagcaaataatatatgttaaaaaacagggtatggttgactaaggacgttggcccagatatac

SEQ ID NO: 105665 - DNA, 449 bp, Homo sapiens
taacaacagctgattttcactctacatcttaattgacctctctacagcatttgacaccattgtttccatgggtgccctaccccttcccaacttgcaccaacaaactccctcttttcttggcttatgtaatgctggctgccctggttttcttcctgcttttctgtgtttttgcttataaagcttattctcctctacccagccagtaaagggtagagttcctcaaaaatgccatcttaggctctttcttcttctcactctacactccttaacaggcagggctgagtggctcacacctgtaatctcagcattttgggaggccagggcaagaagaccacttgaggccaggagttcaagaccatcctgggcaacaaagtcagaccctgtttttacaaaaaataaatataaaacatccttgaaaatatattatcagaggaattgtagagtactga

SEQ ID NO: 105666 - DNA, 117 bp, Homo sapiens
gacatccccagtcaacacacacacacgtacgtgtaatgtaatgctgttgcattatcaaagccacacctctcccacagttataaagaacaggattacttaatggttaaaagcttgaca

SEQ ID NO: 105667 - DNA, 408 bp, Homo sapiens
ttatccctatgcggatccagaagggattttactgatgaagaaactaaagctcagagaagcaaagtgactttccaaaaggtcacacagccagtaagtgatggaaggataaatccaggcctgcccgatgttgcagcccaggtcctttccagtatgccatgttgggaagaagagacaaagagagagaaaagggtagagatggacggaagacggtagaggtggagatcagcacacacaaacacacatgaagacagagaaaacagggaggtaagggctccaagagacaggtaccccatgcttgaccagtggtcttcccccgtgacctcgccacttggaccagcctccatttccaaaacccagggaagggccaggcatggtggctcatacctgtaatctcaatactttgggagg

SEQ ID NO: 105668 - DNA, 296 bp, Homo sapiens
ggctggagataccaaaaatgaccaacagggtgaggacaagtgaccttccaacctaaggaatatgaggcaatgtacagggatgaatctggacagagcccaaatccctaccaccagggaacttgagccagtggcaccttctgcggcacttcaatttcctcctctgtaaaatgaggtgaagatgccaacctggtggggtgtctggtaggactgaaggagccctggcactgtgtttggcacacagcaggtgctcagtaagcataacatccaaagatgacctacagcatgtgtccagaccc

SEQ ID NO: 105669 - DNA, 275 bp, Homo sapiens
attccaactccagtgcagaattcccttgacacccccctcactattcacctggggctcagagacacctccttaactcatgcagtgcatatgatctgcatgcccattaggcatttacctattgtgaatctgctggtctggaaaagaatctgttcctgcttctgctgcctgattgtgtgatatgtagagggaaattactcttgataatttgaatctatttgtcatttccccttgtcaaattgtatgtgcgaaaagcctacagaatctaccattcattc

SEQ ID NO: 105670 - DNA, 405 bp, Homo sapiens
  misc_feature (310)..(310): n is a, c, g, or t
gtggtttataatcccacaggtccattctattataaactgcaggtggcaaatcaagtgactatgaactatgctgtgtgtatgtgtgtgtgtgtgtgtgtgtgtagattctattaagaaatgttctaggctgggtgcggtgactcacgcctgtaatcccagcactttgggaggctgaggcaggcggatcacgaggtcaggagatcgagaccatcctggctaacacagtgaaaccccatctctactaaaaatataaaaacttagccaggcgtggtggcaggcgcctgtaatcccagctactggggaggctgangcagaagaatggcgtgaactggggaggcagagcttgcagtgagaggagatggcgccactgtgccactgcactccacctgggcgacagagcgagac

SEQ ID NO: 105671 - DNA, 1520 bp, Homo sapiens
tactgaaaatgtggctttcataattgtcttagcttagaccattcatagcattattacccaccttgggagtgggaatggtaggaggaggataatgaactggggaagcttcctttagctccccagtaccaaaaccacactaaataagttttgatttcctgggcttccttgttttatgttgaaattggtggtgaggctcagtaatagtttcttaaatgttaaggctagaagttgtacaccacctagtggctgtgtacattaaaacaggaagcagaaaccggccaggaagagggagccggatctggatgtgtctattggagtgactgcagcactccatatagaacctgggcattgctctctttatttttaattgaagtaaaatttgtgatagcattttacaaattgaaaatagctgtgtcatttaaaaaattcccattaaatttgttcccagtacccctcatgtttccagtgatttccttctactctgtcagtgtgcggttaagccgtatagactcattttaatactaatgtcagccaaataaaattaataagttaaacttatttcccttatcattatatacatcctaaagccaatgtattttaaaattgcttgtaccattgcctgctctcctttgataaaaattgtagtttcacttagcatatgtttattgattatagtcacaaaatagaccttgggtgtattgcataaaacatgatcctagcatagaggaggagatggacatgtaaatacataattgcaacaggttataacatgtatgactcttacaatagacgtctctatagcagttaatgctggccggatgcggtggctcatgcctgtaatcccagcactttggaaggccaaggcaggcggatcacctgttggtagttcgagaccagcctggccaacatggtgaaaccccgtctttactaaaaatacaaaactagccaggcatggtggtgtgcacgtgtagtcccagctactccggaggctgaggcaggagaattgcttgaacctgggaggtggaggttgcagtgagccaagatcatgccaccacactccatcctgggtgacagagcaagactttgtctcaaacaaacaaacaaaaaaacaacaacaactctatagcagttagggagagaggatacaaaggaaggagtggttgatctgccaagggagatttagaagactatttggaggaatgatacctgagttctgtcctaaaagttgagaaattgttcacaaggttgacagaaagtgagctactccaggcagaaggaacagcttagacaaaagctcagtggtataaaacaacatggtatatttcaggaactacagctgattcagtgagatatatctgactagagaagtgggtaggggccagaaagtaggctttgtatgcagcacttctacttgggaggctgaggcaggagaattgcttgaacccgggaggtggaggttgcagtgagctgagatcgttccactgtactccagcctgggcgacagagtgagactctgtctc

SEQ ID NO: 105672 - DNA, 524 bp, Homo sapiens
tcccaactgccaaatgcaggcctgtagcggtaggagctgagaggagagaaagttccactttttcgactctaccagctgaaaatgcaggcgtcctcacctcctagaaatccaatcatgcttctgttcagtggggccagcctgtgatgtcccagcagctgcctagaacgcaggagtggctggcgcactcccatgtaactctgcatgtgcgccgaccgcctgacggtccttgccagccttgtagtctgtctagtgtcccccaggaacccccttcctcctgtccattcagctaggtctgcaccaataaaatgggcctaaggcgtcgcaggtggtcactagttctggactcgaagtgccttgggcgcagggatgacccaggcttcttgtatcccatcaccgtctaacagtgggcacatgggctcaccacacatgcgtttgcttaccgagccccctgcagggagtgattgcagtcttccctttccattgcctctcagaactcaactgtttctcattctttccgcccagca

SEQ ID NO: 105673 - DNA, 218 bp, Homo sapiens
gtatgaatatgctacagtctgttcactcaccaactgaatgacatttggatttttccaatgccttcctggtatctatttccctccattagtctatgggaagctttctagagaatcattgtgattctaaccaggtatatttggtattttttttgagggcaaaggtttttgggcagcgtcccccaagtcatcctgtataattgtgtactgagtggtccttt

SEQ ID NO: 105674 - DNA, 360 bp, Homo sapiens
agaatgtggggggcacaaaaatgtctgcccttgagctttcaattgaatagacataaatattcctatattaaaagttgtatagtaatataggagaacttggcatatgacttagtggcaaatgagtagtagggataactaatttgagagcttgaacatatgaatgaaaactgaaaaaggtagcacttcatttttacctatacatttctaagtatctgtcatgatatttgaaaatatttgtgtgcaagtatagaatattaccagtactctccatactgtcccatctctgttagtgcttcttgttctgtctcgtatctatgctgttttctcccacaaggttggagtctacttggaacagtttta

SEQ ID NO: 105675 - DNA, 134 bp, Homo sapiens
ctgaatcacagatgagaatgaatgtcactctcttggttccaataatgacctcccatatttaatatggttgaaaatttgggcagtaactaacctctgtttgttggtttatttgttttggagacacggtctcgctc

SEQ ID NO: 105676 - DNA, 399 bp, Homo sapiens
caagcctgatactttatgcttttcagcatattttcatttgaaccttgggagaaaattatgtgtatgtaagatagctattattccattccacagataagaggaaactgaggcatggaagacagccagaataattctagttgcctgacttgtttttttgtttttgttgttttgttttgttttgttttttttgagacagggtctcactctctcactccagcctaggcgacagagcaaaactcccgtctcaaaaacaaaaaacatttattccttttaggcaaggcatcatactcagtatcacgaggaagaataaagatgttggtaacaagttaggcagtggtagctagaaaaaaatctcccagttcttttcttatgtaaaggtgattagtgtttcttgctagt

SEQ ID NO: 105677 - DNA, 508 bp, Homo sapiens
taaatagctgagtctcaatcaatcacagcaaccaagctttaggcagccaacattgaacccatgttctaataaagcaaatgccaagctgtaaccaaaagagctgtctctttacctcgcttctgttttctgtccaaaaatgctgcttgaccacattgcaggtcagagttctctgaacttattctggttctgaaggctgtccgagttgtgaatcgttctttgctcaattaaactctgttaaatttaatgtgtctaaggcctttcctttttaccagtgagtactcaatactttctcaatgacttttgattaattttgattgttaaatagcacatttcaatgaaggtatctcctattcaaaattccctttgcagctatacacactaaaaataacttttaaagtactgtactggctgggcacagtggctcacgcctgaaatcccagcactctgggaggccgagatgggtggatcacttgaggtcaggagctcgagatcagtctggccaacatgg

SEQ ID NO: 105678 - DNA, 364 bp, Homo sapiens
  misc_feature (194)..(194): n is a, c, g, or t
  misc_feature (199)..(199): n is a, c, g, or t
  misc_feature (208)..(208): n is a, c, g, or t
  misc_feature (341)..(341): n is a, c, g, or t
ggcttgaagtttcgggaaaggccatccgctgggctgagactctgtctgactctggacaatgtttaatttttgatcatctattcataattaagaggaagacattgtaaagctgattggaagctccaaatgcagtggcaaagcttcttgaccctgccgccctagcagcccagcttgtccccgcgcccgtccccgcngcggngctccgacnccggcccccggtctacgacgacggccccgcggccgtgtatgtctgaggaggcaggcgacgagacacccgacgtggaccccgagctgttgaggtacttgctgggacggattcttgtcgggaagcgcggtacttncgagggggtgggcagccccgtcg

SEQ ID NO: 105679 - DNA, 317 bp, Homo sapiens
ctggcacagaaaatgtacttaataacttataatcctaattattaattattattatagattgctctcatttactgatccaaatcacatgctatgattttaagtgcctaatatcattagacaaataaatgacaactattaataggattattactatgcttgcagctgaaccaaagagacaggacaaaggactcaaagagcattcacctccacagtagattaaaaagagccacaaagtctttgctgctccccctatcaagagatggagtctattttcacctcctggtgaaaacagcatggccttggcactggcattgacc

SEQ ID NO: 105680 - DNA, 387 bp, Homo sapiens
aaggaagatgtcacctttatcaaggaaacaaaatttccaagcagcgatgatgtcaccatctattgagctcttgagctgtttacaaacatgcactcatttactccttaaagcaaggctgttgttttaatgactagatgtcattatctctattttacaaaaaaggcaatttcaggaagcttaagaaggttaagtttcccaccaaggaagagggaaatagattgaaaatgtcatgcaaaggattcagtccaagactttctgagtagacaacttgagtgccaaaatactggcactaccctttgttattttctgtccagcacacaattcttgggccacttctgtggaatcttggtagtagggacatttatgtaaagtagaggtgctcatttt

SEQ ID NO: 105681 - DNA, 373 bp, Homo sapiens
tgtcgtcaacaatgacctcagatgcacacaaaccctcagtcagtgcaagaatccaagtatccccagagggccagcaagtccagttcaaacaggagctgggaggaaacctggctggtgctcacctgcttgttggggtagggggctgttataaagtgaattatgtcccttgaaattcacaggttgaagtcctacccccaggacctcagaatgtggctgtgtttggagacagagccattaaagaggaaataaaggtaaatgagttccttggggtgggccctactcccataggtctgttgtcctcataagaagggattagggcacagactcacaaggagggatggccctatgaggaccggggaggagactgcatcta

SEQ ID NO: 105682 - DNA, 800 bp, Homo sapiens
aataaatccaaggtgacaaaaacagctgtaaagtttttagctgtcttttcaaaaacgaaagttgtatgctgtacagttgtggtcttggcattcctgtgctgcctatacacaagctatgaagagggagaaaagggggtaaaggtggttgtgctgttacaggttttgtatttaattctagctggcatgtgagggatttcattcatgtgccagagtgggaggtcctggagtggggttgccctgctgtctgaatcttcccaccagctactcctaacgagctctggtggtttaccctaatctagcggcactctttgctttcctgtagctcagtggcttcatctgttttcttgtcttggtcagtcaagggacagatctacgcttgtttagttggtattttggcttcaaactgatttttttttttcttttcagaagcctcagttaaagaatgacttaaatatacttcttccccattataggtgatacaggctcgttgaataaaatttggaaagtaaagttcaaaaatatcttggcatattacctttcatacttctatgcaggtatacacacaaattgaattagatcagagtgaatttttaggctatttgatattaacaaaacttttatagaaattctatgttgctttatactttcccccactaatggacaagacattgtttttccatatcctccccagcatacttcatgctaacataattcaaaatattagccaattttgtctgcaaaaactagcatcgttatttcacttggcatatttgcctatctttgaccaatagtcaaagggg

SEQ ID NO: 105683 - DNA, 288 bp, Homo sapiens
gcgagttgttcctgtgttccagtgaagcagaaggcagggcctgagcttgtgaggaaagatgagctaaagaactgcgtatgctccttagacaaagataatttgtcacatcaccaccattcatctcttagttcccagctcactgttccaacaagtctgttttgtagatttcttatatattaaaaaatgtctctagccgtccactgagcaatcagttcattcattcatccttttcctcccgaaatatttattgagcacttttaaaataccagtattacacctggttctcag

SEQ ID NO: 105684 - DNA, 784 bp, Homo sapiens
aaaagcatgtctagcaaaggcacggtagctcatgcctgtaattcctacactttgtgggggccaacgtgggggactgcatgagcctaggagctcgagaccagcctgggcaatatggtgagaccccgtatttaccccccagccccccaaaaaaatacgaaaattagttggggatgggcacatgcttatgggtcccagctactgagctgaggtggcaaggatcacttgagcccaggaggctgcagtgagctgagatcacatcactgcactccagccaggggacaaggctagatcccattaagaaaaaaaaaaaaaaaaaagcatgcctaaaaaaaatctcttttggattctataatcgggtaaggagtttatggcgggtggcaagtaaggggaccctttttaaggggtttgagggggtcaaggcagacttggacagacctgggcaagggacaaatggatgggacccgttggtacattgagatttgggcccctggaaattttagtggagactctggagtccccagaaaaaggacagaatctccctatttggattgggttatggaaccccaacatggtatacaggtggtcagaaaactcgcatctccgggaaacaggatctaggccttttcttgtaggtgagttatacttcagtaaaagaaatatacaacaaatttactgtagtcaaggagtttcctaaaaattaacttctcataagccagaggtaagtactgtaatcataagattataaacttccaatttagaggcatgaaggtacattttatataat

SEQ ID NO: 105685 - DNA, 82 bp, Homo sapiens
ggcctcctaggtatggagcaaggagcattttacaggatgggatgatgatgctgtgtgagcatgtgaaggaaagaactcactg

SEQ ID NO: 105686 - DNA, 271 bp, Homo sapiens
gccacctcagatccttaaggctgtgtcaggagccacgtggcctcctcgaacccaagcccatgtcccagttactggtaataaaacagccagaactcccatctgccacttgccaagccccaaatgtgcaatttacacaacaatccaggttatcacagccaccttaggataaagctcctgaaactccagaaattaagccaattttctgaggctacagagctaccatcagggagggctgaaagttgaacctaggacccaaaacccaagactctcc

SEQ ID NO: 105687 - DNA, 841 bp, Homo sapiens
acccctcgtggcggtcccgcccgtccccgcgcaggcgcgctcgggctgccgctggctcttcgcacgcggccatggccgactccgagctgcagctggttgagcagcggatccgcagcttccccgacttccccaccccaggcgtggtattcagggacatctcgcccgtcctgaaggaccccgcctccttccgcgccgccatcggcctcctggcgcgacacctgaaggcgacccacgggggccgcatcgactacatcgcaggcctagactcccgaggcttcctctttggcccctccctggcccaggagcttggactgggctgcgtgctcatccgaaagcgggggaagctgccaggccccactctgtgggcctcctattccctggagtacgggaaggctgagctggagattcagaaagacgccctggagccaggacagagggtggtcgtcgtggatgatctgctggccactggtggaaccatgaacgctgcctgtgagctgctgggccgcctgcaggctgaggtcctggagtgcgtgagcctggtggagctgacctcgcttaagggcagggagaagctggcacctgtacccttcttctctctcctgcagtatgagtgaccacagggcctcccagcccaacatctccagctggatcccagggaaatatcagccttgggcaactgcagtgaccaggggcaccggctgcccacagggaacacattcctttgctggggttcagcgcctctcctggggctggaagtgccaaagcctggggcaaagctgtgtttcagccacactgaacccaattacacacagcgggagaacgcagtaaacagctttcccac

SEQ ID NO: 105688 - DNA, 962 bp, Homo sapiens
  misc_feature (852)..(853): n is a, c, g, or t
  misc_feature (855)..(856): n is a, c, g, or t
  misc_feature (865)..(865): n is a, c, g, or t
  misc_feature (870)..(870): n is a, c, g, or t
acccctcgtggcggtcccgcccgtccccgcgcaggcgcgctcgggctgccgctggctcttcgcacgcggccatggccgactccgagctgcagctggttgagcagcggatccgcagcttccccgacttccccaccccaggcgtggtattcagggacatctcgcccgtcctgaaggaccccgcctccttccgcgccgccatcggcctcctggcgcgacacctgaaggcgacccacgggggccgcatcgactacatcgcaggcctagactcccgaggcttcctctttggcccctccctggcccaggagcttggactgggctgcgtgctcatccgaaagcgggggaagctgccaggccccactctgtgggcctcctattccctggagtacgggaaggctgagctggagattcagaaagacgccctggagccaggacagagggtggtcgtcgtggatgatctgctggccactggtggaaccatgaacgctgcctgtgagctgctgggccgcctgcaggctgaggtcctggagtgcgtgagcctggtggagctgacctcgcttaagggcagggagaagctggcacctgtacccttcttctctctcctgcagtatgagtgaccacagggcctcccagcccaacatctccagctggatcccagggaaatatcagccttgggcaactgcagtgaccaggggcaccggctgcccacagggaacacattcctttgctggggttcagcgcctctcctggggctggaagtgccaaagcctggggcaaagctgtgtttcagccacactgaacccaattacacacagcgggagaacgcagtaaacagctttcccaccaccaccaccnncnncaccacccncaccncccacaccacccctatctcttttttttctctaatccccctacacccacacccccacacacaccccacaacctttactaatccccacaccacc

SEQ ID NO: 105689 - DNA, 888 bp, Homo sapiens
taggctaggtagaggccgggtgtgaatcggccgaggctggctggctcttcgcacgcggccatggccgactccgagctgcagctggttgagcagcggatccgcagcttccccgacttccccaccccaggcgtggtattcagggacatctcgcccgtcctgaaggaccccgcctccttccgcgccgccatcggcctcctggcgcgacacctgaaggcgacccacgggggccgcatcgactacatcgcaggcctagactcccgaggcttcctctttggcccctccctggcccaggagcttggactgggctgcgtgctcatccgaaagcgggggaagctgccaggccccactctgtgggcctcctattccctggagtacgggaaggctgagctggagattcagaaagacgccctggagccaggacagagggtggtcgtcgtggatgatctgctggccactggtggaaccatgaacgctgcctgtgagctgctgggccgcctgcaggctgaggtcctggagtgcgtgagcctggtggagctgacctcgcttaagggcagggagaagctggcacctgtacccttcttctctctcctgcagtatgagtgaccacagggcctcccagcccaacatctccagctggatcccagggaaatatcagccttgggcaactgcagtgaccaggggcaccggctgcccacagggaacacattcctttgctggggttcagcgcctctcctggggctggaagtgccaaagcctggggcaaagctgtgtttcagccacactgaacccaattacacacagcgggagaacgcagtaaacagctttcccacaaaaacaacatcgtctccctacaacacacacactactcctcagacacaacacgagcgg

SEQ ID NO: 105690 - DNA, 597 bp, Homo sapiens
gcctattccctggagtacgggaggcccacagagtggggcctggcagcttcccccgctttcggatgagcacgcagcccagtccaagctcctgggccaggagctgccaggccccactctgtgggcctcctattccctggagtacgggaaggctgagctggagattcagaaagacgccctggagccaggacagagggtggtcgtcgtggatgatctgctggccactggtggaaccatgaacgctgcctgtgagctgctgggccgcctgcaggctgaggtcctggagtgcgtgagcctggtggagctgacctcgcttaagggcagggagaagctggcacctgtacccttcttctctctcctgcagtatgagtgaccacagggcctcccagcccaacatctccagctggatcccagggaaatatcagccttgggcaactgcagtgaccaggggcaccggctgcccacagggaacacattcctttgctggggttcagcgcctctcctggggctggaagtgccaaagcctggggcaaagctgtgtttcagccacactgaacccaattacacacagcgggagaacgcagtaaacagctttcccac

SEQ ID NO: 105691 - DNA, 610 bp, Homo sapiens
  misc_feature (16)..(16): n is a, c, g, or t
cccgggtggcggggcngtcaagcaggatcggtgggttgggggagggccaagggtggacatctcgcccgtcctgaaggaccccgcctccttccgcgccgccatcggcctcctggcgcgacacctgaaggcgacccacgggggccgcatcgactacatcgcaggcctagactcccgaggcttcctctttggcccctccctggcccaggagcttggactgggctgcgtgctcatccgaaagcgggggaagctgccaggccccactctgtgggcctcctattccctggagtacgggaaggctgagctggagattcagaaagacgccctggagccaggacagagggtggtcgtcgtggatgatctgctggccactggtgtatgagtgaccacagggcctcccagcccaacatctccagctggatcccagggaaatatcagccttgggcaactgcagtgaccaggggcaccggctgcccacagggaacacattcctttgctggggttcagcgcctctcctggggctggaagtgccaaagcctggggcaaagctgtgtttcagccacactgaacccaattacacacagcgggagaacgcagtaaacagctttcccac

SEQ ID NO: 105692 - DNA, 830 bp, Homo sapiens
taggctaggtagaggccgggtgtgaatcggccgaggctggctggctcttcgcacgcggccatggccgactccgagctgcagctggttgagcagcggatccgcagcttccccgacttccccaccccaggcgtggtattcagggacatctcgcccgtcctgaaggaccccgcctccttccgcgccgccatcggcctcctggcgcgacacctgaaggcgacccacgggggccgcatcgactacatcgcaggcctagactcccgaggcttcctctttggcccctccctggcccaggagcttggactgggctgcgtgctcatccgaaagcgggggaagctgccaggccccactctgtgggcctcctattccctggagtacgggaaggctgagctggagattcagaaagacgccctggagccaggacagagggtggtcgtcgtggatgatctgctggccactggtggaaccatgaacgctgcctgtgagctgctgggccgcctgcaggctgaggtcctggagtgcgtgagcctggtggagctgacctcgcttaagggcagggagaagctggcacctgtacccttcttctctctcctgcagtatgagtgaccacagggcctcccagcccaacatctccagctggatcccagggaaatatcagccttgggcaactgcagtgaccaggggcaccggctgcccacagggaacacattcctttgctggggttcagcgcctctcctggggctggaagtgccaaagcctggggcaaagctgtgtttcagccacactgaacccaattacacacagcgggagaacgcagtaaacagctttcccac

SEQ ID NO: 105693 - DNA, 831 bp, Homo sapiens
ggtcatgggttaccctgggccccccgggaattatgggatcgctggctcttcgcacgcggccatggccgactccgagctgcagctggttgagcagcggatccgcagcttccccgacttccccaccccaggcgtggtattcagggacatctcgcccgtcctgaaggaccccgcctccttccgcgccgccatcggcctcctggcgcgacacctgaaggcgacccacgggggccgcatcgactacatcgcaggcctagactcccgaggcttcctctttggcccctccctggcccaggagcttggactgggctgcgtgctcatccgaaagcgggggaagctgccaggccccactctgtgggcctcctattccctggagtacgggaaggctgagctggagattcagaaagacgccctggagccaggacagagggtggtcgtcgtggatgatctgctggccactggtggaaccatgaacgctgcctgtgagctgctgggccgcctgcaggctgaggtcctggagtgcgtgagcctggtggagctgacctcgcttaagggcagggagaagctggcacctgtacccttcttctctctcctgcagtatgagtgaccacagggcctcccagcccaacatctccagctggatcccagggaaatatcagccttgggcaactgcagtgaccaggggcaccggctgcccacagggaacacattcctttgctggggttcagcgcctctcctggggctggaagtgccaaagcctggggcaaagctgtgtttcagccacactgaacccaattacacacagcgggagaacgcagtaaacagctttcccac

SEQ ID NO: 105694 - DNA, 883 bp, Homo sapiens
acccctcgtggcggtcccgcccgtccccgcgcaggcgcgctcgggctgccgctggctcttcgcacgcggccatggccgactccgagctgcagctggttgagcagcggatccgcagcttccccgacttccccaccccaggcgtggtattcagggacatctcgcccgtcctgaaggaccccgcctccttccgcgccgccatcggcctcctggcgcgacacctgaaggcgacccacgggggccgcatcgactacatcgcaggcctagactcccgaggcttcctctttggcccctccctggcccaggagcttggactgggctgcgtgctcatccgaaagcgggggaagctgccaggccccactctgtgggcctcctattccctggagtacgggaaggctgagctggagattcagaaagacgccctggagccaggacagagggtggtcgtcgtggatgatctgctggccactggtggaaccatgaacgctgcctgtgagctgctgggccgcctgcaggctgaggtcctggagtgcgtgagcctggtggagctgacctcgcttaagggcagggagaagctggcacctgtacccttcttctctctcctgcagtatgagtgaccacagggcctcccagcccaacatctccagctggatcccagggaaatatcagccttgggcaactgcagtgaccaggggcaccggctgcccacagggaacacattcctttgctggggttcagcgcctctcctggggctggaagtgccaaagcctggggcaaagctgtgtttcagccacactgaacccaattacacacagcgggagaacgcagtaaacagctttcccacaagaacacacaaagaccacacacgcacacaccaacgcacggg

SEQ ID NO: 105695 - DNA, 994 bp, Homo sapiens
ggtcatgggttaccctgggccccccgggaattatgggatcgctggctcttcgcacgcggccatggccgactccgagctgcagctggttgagcagcggatccgcagcttccccgacttccccaccccaggcgtggtattcaggtgcacgcacaggccgccctcgtggcgccccgacctgcgggcctacggatgggagcgcgtggcccgcgacctccgggcgggcggggcgggaaccctcgtctttcgcccccggggccctgccctccttcggccccggcgtcaccaggcctgtccttgggtccagggacatctcgcccgtcctgaaggaccccgcctccttccgcgccgccatcggcctcctggcgcgacacctgaaggcgacccacgggggccgcatcgactacatcgcaggcctagactcccgaggcttcctctttggcccctccctggcccaggagcttggactgggctgcgtgctcatccgaaagcgggggaagctgccaggccccactctgtgggcctcctattccctggagtacgggaaggctgagctggagattcagaaagacgccctggagccaggacagagggtggtcgtcgtggatgatctgctggccactggtggaaccatgaacgctgcctgtgagctgctgggccgcctgcaggctgaggtcctggagtgcgtgagcctggtggagctgacctcgcttaagggcagggagaagctggcacctgtacccttcttctctctcctgcagtatgagtgaccacagggcctcccagcccaacatctccagctggatcccagggaaatatcagccttgggcaactgcagtgaccaggggcaccggctgcccacagggaacacattcctttgctggggttcagcgcctctcctggggctggaagtgccaaagcctggggcaaagctgtgtttcagccacactgaacccaattacacacagcgggagaacgcagtaaacagctttcccac

SEQ ID NO: 105696 - DNA, 850 bp, Homo sapiens
ggtcatgggttaccctgggccccccgggaattatgggatcgctggctcttcgcacgcggccatggccgactccgagctgcagctggttgagcagcggatccgcagcttccccgacttccccaccccaggcgtggtattcagggacatctcgcccgtcctgaaggaccccgcctccttccgcgccgccatcggcctcctggcgcgacacctgaaggcgacccacgggggccgcatcgactacatcgcaggcctagactcccgaggcttcctctttggcccctccctggcccaggagcttggactgggctgcgtgctcatccgaaagcgggggaagctgccaggccccactctgtgggcctcctattccctggagtacgggaaggctgagctggagattcagaaagacgccctggagccaggacagagggtggtcgtcgtggatgatctgctggccactggtgtatgagtgaccacagggcctcccagcccaacatctccagctggatcccagggaaatatcagccttgggcaactgcagtgaccaggggcaccggctgcccacagggaacacattcctttgctggggttcagcgcctctcctggggctggaagtgccaaagcctggggcaaagctgtgtttcagccacactgaacccaattacacacagcgggagaacgcagtaaacagctttcccaccaaaaaaaaaagaacaacgctgactgctaacaaaaacccgcggcggcattatctgggggggaaaaggtctcacgggcctccgcccaacgtgcgcggcccttttggaaagggaaacgggggcccccaagggcgctaacaagcgggcgatctcca

SEQ ID NO: 105697 - DNA, 898 bp, Homo sapiens
ggtcatgggttaccctgggccccccgggaattatgggatcgctggctcttcgcacgcggccatggccgactccgagctgcagctggttgagcagcggatccgcagcttccccgacttccccaccccaggcgtggtattcagggacatctcgcccgtcctgaaggaccccgcctccttccgcgccgccatcggcctcctggcgcgacacctgaaggcgacccacgggggccgcatcgactacatcgcaggcctagactcccgaggcttcctctttggcccctccctggcccaggagcttggactgggctgcgtgctcatccgaaagcgggggaagctgccaggccccactctgtgggcctcctattccctggagtacgggaaggctgagctggagattcagaaagacgccctggagccaggacagagggtggtcgtcgtggatgatctgctggccactggtggggctggcctggagcacctgctctctgcagcccaggccaactggggacctcaccctcccatccccaggaaccatgaacgctgcctgtgagctgctgggccgcctgcaggctgaggtcctggagtgcgtgagcctggtggagctgacctcgcttaagggcagggagaagctggcacctgtacccttcttctctctcctgcagtatgagtgaccacagggcctcccagcccaacatctccagctggatcccagggaaatatcagccttgggcaactgcagtgaccaggggcaccggctgcccacagggaacacattcctttgctggggttcagcgcctctcctggggctggaagtgccaaagcctggggcaaagctgtgtttcagccacactgaacccaattacacacagcgggagaacgcagtaaacagctttcccac

SEQ ID NO: 105698 - DNA, 860 bp, Homo sapiens
ggtcatgggttaccctgggccccccgggaattatgggatcgctggctcttcgcacgcggccatggccgactccgagctgcagctggttgagcagcggatccgcagcttccccgacttccccaccccaggcgtggtattcaggtgcacgcacaggccgccctcgtggcgccccgacctgcgggcctacggatgggagcgcgtggcccgcgacctccgggcgggcggggcgggaaccctcgtctttcgcccccggggccctgccctccttcggccccggcgtcaccaggcctgtccttgggtccagggacatctcgcccgtcctgaaggaccccgcctccttccgcgccgccatcggcctcctggcgcgacacctgaaggcgacccacgggggccgcatcgactacatcgcaggctgagctggagattcagaaagacgccctggagccaggacagagggtggtcgtcgtggatgatctgctggccactggtggaaccatgaacgctgcctgtgagctgctgggccgcctgcaggctgaggtcctggagtgcgtgagcctggtggagctgacctcgcttaagggcagggagaagctggcacctgtacccttcttctctctcctgcagtatgagtgaccacagggcctcccagcccaacatctccagctggatcccagggaaatatcagccttgggcaactgcagtgaccaggggcaccggctgcccacagggaacacattcctttgctggggttcagcgcctctcctggggctggaagtgccaaagcctggggcaaagctgtgtttcagccacactgaacccaattacacacagcgggagaacgcagtaaacagctttcccac

SEQ ID NO: 105699 - DNA, 1040 bp, Homo sapiens
ggtcatgggttaccctgggccccccgggaattatgggatcgctggctcttcgcacgcggccatggccgactccgagctgcagctggttgagcagcggatccgcagcttccccgacttccccaccccaggcgtggtattcagggacatctcgcccgtcctgaaggaccccgcctccttccgcgccgccatcggcctcctggcgcgacacctgaaggcgacccacgggggccgcatcgactacatcgcaggcctagactcccgaggcttcctctttggcccctccctggcccaggagcttggactgggctgcgtgctcatccgaaagcgggggaagctgccaggccccactctgtgggcctcctattccctggagtacgggaaggaaccatgaacgctgcctgtgagctgctgggccgcctgcaggctgaggtcctggagtgcgtgagcctggtggagctgacctcgcttaagggcagggagaagctggcacctgtacccttcttctctctcctgcagtatgagtgaccacagggcctcccagcccaacatctccagctggatcccagggaaatatcagccttgggcaactgcagtgaccaggggcaccggctgcccacagggaacacattcctttgctggggttcagcgcctctcctggggctggaagtgccaaagcctggggcaaagctgtgtttcagccacactgaacccaattacacacagcgggagaacgcagtaaacagctttcccactcaaaaaaaaaaacaacaaacaccaaaaaacaaaacaaaaacacaaaaacccgcgccactataggggcggaacaagagacaacaagcacacgggtccaagggcttccaacccgtcttcacagggacaaggggcccaaagaggggggacaaatcagacggacgaaaacaaacaaaacagcacacagagaacgcagggaacagcaaaagaaagagacaaaaagagacaaagagagaaaaacaacgacacaacacaccacgcacaatccacagaccagagcaaacaacaga

SEQ ID NO: 105700 - DNA, 834 bp, Homo sapiens
ggtcatgggttaccctgggccccccgggaattatgggatcgctggctcttcgcacgcggccatggccgactccgagctgcagctggttgagcagcggatccgcagcttccccgacttccccaccccaggcgtggtattcaggtgcacgcacaggccgccctcgtggcgccccgacctgcgggcctacggatgggagcgcgtggcccgcgacctccgggcgggcggggcgggaaccctcgtctttcgcccccggggccctgccctccttcggccccggcgtcaccaggcctgtccttgggtccagggacatctcgcccgtcctgaaggaccccgcctccttccgcgccgccatcggcctcctggcgcgacacctgaaggcgacccacgggggccgcatcgactacatcgcaggcgagtgcccagtggccgcatctagggcgcttccgcctctgcgcgcgccgagggcagcacgtgggctctgcgcgtctgcttgggggagggcctttggggtgcttcagggggcgccgggacgggcgccgtgcttgggtcgcccgggaagggttgtgagattgagcccccgaggccgccgcgctgtgcaggcgtccttcccgcaggttccgggtccccagcccaggacaggcgtgaccgagttgccgggtcagttggtctccctggagtgcccaagctgaatccacagggcccagctgccttgcttcttgttcctctctgcgagctggtattgagcgcctgccacgagccaggccttccctggtgaagatcacggaatgcccacccagggaagggaggcctggaggcctccgggagagcccaaga

SEQ ID NO: 105701 - DNA, 697 bp, Homo sapiens
ggtcatgggttaccctgggccccccgggaattatgggatcgctggctcttcgcacgcggccatggccgactccgagctgcagctggttgagcagcggatccgcagcttccccgacttccccaccccaggcgtggtattcagggacatctcgcccgtcctgaaggaccccgcctccttccgcgccgccatcggcctcctggcgcgacacctgaaggcgacccacgggggccgcatcgactacatcgcaggcctagactcccgaggcttcctctttggcccctccctggcccaggagcttggactgggctgcgtgctcatccgaaagcgggggaagctgccaggccccactctgtgggcctcctattccctggagtacgggaaggctgagctggagattcagaaagacgccctggagccaggacagagggtggtcgtcgtggatgatctgctggccactggtgtatgagtgaccacagggcctcccagcccaacatctccagctggatcccagggaaatatcagccttgggcaactgcagtgaccaggggcaccggctgcccacagggaacacattcctttgctggggttcagcgcctctcctggggctggaagtgccaaagcctggggcaaagctgtgtttcagccacactgaacccaattacacacagcgggagaacgcagtaaacagctttcccac

SEQ ID NO: 105702 - DNA, 1060 bp, Homo sapiens
ggtcatgggttaccctgggccccccgggaattatgggatcgctggctcttcgcacgcggccatggccgactccgagctgcagctggttgagcagcggatccgcagcttccccgacttccccaccccaggcgtggtattcagggacatctcgcccgtcctgaaggaccccgcctccttccgcgccgccatcggcctcctggcgcgacacctgaaggcgacccacgggggccgcatcgactacatcgcaggcctagactcccgaggcttcctctttggcccctccctggcccaggagcttggactgggctgcgtgctcatccgaaagcgggggaagctgccaggccccactctgtgggcctcctattccctggagtacgggaaggctgagctggagattcagaaagacgccctggagccaggacagagggtggtcgtcgtggatgatctgctggccactggtggtaagggtctccccgcagccaactgctgtggctccaagggcctggtgggagtgggacaggacctcgctgtgtgacatgggatgcagcttactgttgtccagagggtgcctggtggccaggccgacaccttcctctccccatgccttcccctccccaacccaggggctggcctggagcacctgctctctgcagcccaggccaactggggacctcaccctcccatccccaggaaccatgaacgctgcctgtgagctgctgggccgcctgcaggctgaggtcctggagtgcgtgagcctggtggagctgacctcgcttaagggcagggagaagctggcacctgtacccttcttctctctcctgcagtatgagtgaccacagggcctcccagcccaacatctccagctggatcccagggaaatatcagccttgggcaactgcagtgaccaggggcaccggctgcccacagggaacacattcctttgctggggttcagcgcctctcctggggctggaagtgccaaagcctggggcaaagctgtgtttcagccacactgaacccaattacacacagcgggagaacgcagtaaacagctttcccac

SEQ ID NO: 105703 - DNA, 1343 bp, Homo sapiens
cgccagctcttgctggagccacaacactgccagagctcccttctcacctcctgcaggaagccctccctgacctcctgccaggccggggcagggtttccctgagcgtcccccaaccatcacagctcaggccacctcgagagactccctttttagacagaagccctggtgcagagctgcctttgagagtaagctgaggcctgtcaggtttctaccagcccagttacagatgggctgctcagctcagagagaggggtggtgactcccctaggaacacacagctaagaagtggtcccttaaaagacagacccaggtctgcactctgacctggaagcagctccgggtaggtgatgggtaacattccttaaatggtgcatgtcactggcctttcagctgggagccaaccaggtaccccttgccaccggccaaccctggcccctggggattcccatgctgccgagtcactcctgtcacttaccctgacaggcctagactcccgaggcttcctctttggcccctccctggcccaggagcttggactgggctgcgtgctcatccgaaagcgggggaagctgccaggccccactctgtgggcctcctattccctggagtacgggaagaaggtaagagggctggggtggccagaggaagggcagggccaggccaccgtggccactctcccccagttctaaaaggccttcccaggcgtgtcaagtggagctgctgtggttacagtggccttgggagctcagagaggttgagacataggctgggctcacacagccaggtaacagcaaggtggggttggagtcagggtctagggtggcagctgccaagctgtgcaacaaagctgttttctgcgggaggctgaggaccacacaccacttcccactccaggctgagctggagattcagaaagacgccctggagccaggacagagggtggtcgtcgtggatgatctgctggccactggtggaaccatgaacgctgcctgtgagctgctgggccgcctgcaggctgaggtcctggagtgcgtgagcctggtggagctgacctcgcttaagggcagggagaagctggcacctgtacccttcttctctctcctgcagtatgagtgaccacagggcctcccagcccaacatctccagctggatcccagggaaatatcagccttgggcaactgcagtgaccaggggcaccggctgcccacagggaacacattcctttgctggggttcagcgcctctcctggggctggaagtgccaaagcctggggcaaagctgtgtttcagccacactgaacccaattacacacagcgggagaacgcagtaaacagctttcccac

SEQ ID NO: 105704 - DNA, 1572 bp, Homo sapiens
cgccagctcttgctggagccacaacactgccagagctcccttctcacctcctgcaggaagccctccctgacctcctgccaggccggggcagggtttccctgagcgtcccccaaccatcacagctcaggccacctcgagagactccctttttagacagaagccctggtgcagagctgcctttgagagtaagctgaggcctgtcaggtttctaccagcccagttacagatgggctgctcagctcagagagaggggtggtgactcccctaggaacacacagctaagaagtggtcccttaaaagacagacccaggtctgcactctgacctggaagcagctccgggtaggtgatgggtaacattccttaaatggtgcatgtcactggcctttcagctgggagccaaccaggtaccccttgccaccggccaaccctggcccctggggattcccatgctgccgagtcactcctgtcacttaccctgacaggcctagactcccgaggcttcctctttggcccctccctggcccaggagcttggactgggctgcgtgctcatccgaaagcgggggaagctgccaggccccactctgtgggcctcctattccctggagtacgggaagaaggtaagagggctggggtggccagaggaagggcagggccaggccaccgtggccactctcccccagttctaaaaggccttcccaggcgtgtcaagtggagctgctgtggttacagtggccttgggagctcagagaggttgagacataggctgggctcacacagccaggtaacagcaaggtggggttggagtcagggtctagggtggcagctgccaagctgtgcaacaaagctgttttctgcgggaggctgaggaccacacaccacttcccactccaggctgagctggagattcagaaagacgccctggagccaggacagagggtggtcgtcgtggatgatctgctggccactggtggtaagggtctccccgcagccaactgctgtggctccaagggcctggtgggagtgggacaggacctcgctgtgtgacatgggatgcagcttactgttgtccagagggtgcctggtggccaggccgacaccttcctctccccatgccttcccctccccaacccaggggctggcctggagcacctgctctctgcagcccaggccaactggggacctcaccctcccatccccaggaaccatgaacgctgcctgtgagctgctgggccgcctgcaggctgaggtcctggagtgcgtgagcctggtggagctgacctcgcttaagggcagggagaagctggcacctgtacccttcttctctctcctgcagtatgagtgaccacagggcctcccagcccaacatctccagctggatcccagggaaatatcagccttgggcaactgcagtgaccaggggcaccggctgcccacagggaacacattcctttgctggggttcagcgcctctcctggggctggaagtgccaaagcctggggcaaagctgtgtttcagccacactgaacccaattacacacagcgggagaacgcagtaaacagctttcccac

SEQ ID NO: 105705 - DNA, 696 bp, Homo sapiens
ggtcatgggttaccctgggccccccgggaattatgggatcgctggctcttcgcacgcggccatggccgactccgagctgcagctggttgagcagcggatccgcagcttccccgacttccccaccccaggcgtggtattcagggacatctcgcccgtcctgaaggaccccgcctccttccgcgccgccatcggcctcctggcgcgacacctgaaggcgacccacgggggccgcatcgactacatcgcaggcctagactcccgaggcttcctctttggcccctccctggcccaggagcttggactgggctgcgtgctcatccgaaagcgggggaagctgccaggccccactctgtgggcctcctattccctggagtacgggaagtgcgtgagcctggtggagctgacctcgcttaagggcagggagaagctggcacctgtacccttcttctctctcctgcagtatgagtgaccacagggcctcccagcccaacatctccagctggatcccagggaaatatcagccttgggcaactgcagtgaccaggggcaccggctgcccacagggaacacattcctttgctggggttcagcgcctctcctggggctggaagtgccaaagcctggggcaaagctgtgtttcagccacactgaacccaattacacacagcgggagaacgcagtaaacagctttcccac

SEQ ID NO: 105706 - DNA, 5783 bp, Homo sapiens
  misc_feature (1554)..(1554): n is a, c, g, or t
ttgacgtgtggaagcagttcttggggatgtgactactgccacggtgacaattctagaccaggaggcagcagggagcctcatattgccagcaccacccattgtggtcacacttgctgactatgaccatgtggaagaagttaccaaggaaggagtcaagaaatccccctccccaggctacccactggtctgtgtcaccccctgcgaccctcatttccccagatacgctgtcatgaaggagcgctgcagtgaggccggcatcaaccagacatctgtgcagttcagctgggaagtggctgcccccactgatggcaatggggcccggtctccctttgaaaccatcactgacaacacaccattcaccagtgtcaaccacatggtcctggacagcatttacttcagccggaggttccatgtgcgttgtgtggccaaggctgtggacaaggtgggccatgtggggacccccttaaggagcaacattgttaccattggaacagacagtgctatctgccacacaccagtggtggctgggacatccagaggcttccaggctcagtccttcatcgcaaccttgaaatacctggatgtcaaacataaggagcatccgaacagaatccacatttcggtgcagatcccacaccaggatggaatgctgccccttatctccaccatgccgttgcacaacttacattttctactgtctgagtccatctacagacaccagcacgtctgctccaatttagttaccacctatgacctgagaggcatctcagaggcagggttcctggatgatgtggtctatgatagcactgccctggggcctggctacgatcgccccttccagtttgaccccagcgtgcgagagccgaagaccatccagctctacaaacacctgaacctgaagagctgcgtgtggacctttgatgcttattatgacatgactgagctgattgacgtctgtgggggctctgtaaccgctgacttccaggtgagggactctgcccagtccttcttgacagtgcacgtgcctctatatgtgtcctacatctatgtgacagcccccaggggctgggcctccttggagcaccacaccgagatggagttttctttcttctatgacactgttctctggagaacaggaatccagacagacagcgtgctctctgcaaggcttcagataataagaatctacattcgagaggatggccgtcttgtcattgaattcaagacccatgccaaattcagaggacagtttgtgatggagcatcacactctcccagaagtgaaatctttcgtattgactccagaccacctaggaggaattgaatttgacttgcagctattatggagcgctcagacttttgattctccacatcaactctggagagccacaagctcttataacaggaaggactactcaggagagtacaccatctacctgatcccttgcacagtgcagcccacacagccatgggttgacccaggagagaagcctttggcctgcactgcacatgccccagaaagattcctgatacccattgcattccagcagaccanccgccctgtgccagttgtgtattcacttaacactgaatttcagctctgcaataatgagaaggtgttcctaatggatcccaatacatctgatatgtcactagcagaaatggattacaaaggagccttttcaaaaggtcaaatcctttatggccgagtactttggaatccagaacaaaatcttaattctgcttacaaactccagctggagaaagtctatctttgtacgggcaaggatggttatgtgcctttctttgatcccacggggacaatctacaatgaagggccccagtatggatgcattcagccaaacaaacacctaaaacacagattcctgctgttggaccgcaatcagccagaggtaactgataagtacttccatgatgtgccttttgaggctcactttgcctctgagttgcctgatttccatgtggtcagtaacatgccaggtgtggatggatttactctaaaagtagatgcactctataaggtggaagcaggacaccagtggtatctccaggtcatctacatcattggccctgacaccatctcagggccccgggtccagcgctctctcacagctccactcagacgcaaccgaagggacctggtagagcccgatggccagctgatccttgatgattccctcatctatgacaatgaaggagaccaagtcaagaatggcaccaatatgaagtccctgaatctggagatgcaagagttggcggtagctgcgtccctgtcacagactggggcgtccattggcagtgccctggctgcaatcatgcttctacttctggtgtttttggtggcttgttttatcaacaggaaatgccagaaacagaggaagaagaagcccgcagaggacattttggaagaatatcctctgaataccaaggtagaagtgcccaagaggcacccggaccgggtggagaagaacgtgaatagacactactgcactgtgcggaacgtcaacatcctgagtgagcctgaggcggcttacacgttcaaaggtgctaaagtcaaaagactgaatctagaagtcagagttcacaacaatttacaagatggaacagaagtttaatggaggagacctatgtgtatttttttctaaaatcatttttataaaatggggggaaatactggtatttttataatctcgcagataaaaaagggaaaactatagctttgagtggcagacagcacacatcacatgcatcaactcacaactgagctacctcattcagcaaagaaccactgagaaccccagagtattacagttatttccgtagatccctttaatagtgtcaacaactgtacacagctccttctgtaaggctggtcttagaaaacaagtactttagtatcaggacaggagttgaacaattaggttagcagatggagatgagaggactgggtagagtaccatggcagatctcagagagaagaagtaggtacgggcctttggttccctcccccagccccagctttctcctacagggcttttcctgagtccccagacagcagagtatgaactgctgacacccagattccattaaaaattctgctaatcgacacaacacatatatttgctcatgatttcacttgacagcgtatgctccttggcctctaattgtactttgcttttccagagccctttttacctggggatttcagtgtgcttaagtaaaatcctctgaaaaccacgggagcctctgcctcctcagccacagagaactccctcctacaaagggggagactgaaacccgagttaaggaggggcctggcaggcgtatcagagcacattagtgatgcccttcaccccagggaggtgtctgttcccaactagtttatgtggcactgagacatccatccctgaccaaggatgctgcgaaacaggatcaatgtactacggccttttaattcaacattgccataaatgctttaaagaaaacccaccacactttcctcctactccggtctttgcccgttcctgtaacagacaatcccatgtcctaggtatggttttttattctgttagtgcttcgggaaagtaagtgattcatttgaataaggcaaattaggagaaagcccaggttggggtgaaatcagacttaacagatacatgctggttctccttgctgtgtgtgacacagcagacagaggcactattcctggtgcagtatttcagggatttctctttgaggggttcttttctggtagctcaggcaattatttttaccatatcagcacatgacaaggccatgaacacatggctctaaaataatttagtgttcaagtatcagcttaactattttgtgtaggctacacacagcttgcttttgtttctcttctgtttctgccttattggcggaaacataagcgtgcatgccatgttgttttgaattggaggcacaatttcattattcgagagtaaaagacatgtcctcttctgatgcatggcacaccatagtcaccaagcaaataacagagccttcacattgtgtaatatttgtatgagaatgactcaagctctttgagaacattccaaactagtaacatttcgctactaaaagctagaaaggatgaactgtgaaaggttctaggcagctctgtgagactccaagctccttgaaagtaggacctttgtgagccacgcctttcattcttcaacagtgccttgcatgtaacaagcactccagaaatgtttgttgaatgaatgaatggtgtcatgggtgaatgatggggagtaaatttaggaaggggaagtgagagagtatggtggcaatatcacaagggaggagagaggaaaacaattatcttctctacttggattatgagataaccttttcttggaggaaagaaacaccgctttacaaaggcatgactctggcggtggtcctaaggaagcatgagcagaaaattcataaaaatgtatcatcagcaggagatgagactatgaattggcatccagaacaggagatttagagcaaaatctaatttagcattctgagatgagtgtcaggttttcaggagagaatgagttggggtgagcccagagtctgaaactcctgactggtcaggtgctacttaagaccagcttgggcaattcagggcagaactcctgtatcagcctcatggacacccagaattggtatctcatggctggagagctgatcagccaggcacagaatctccagaacaacctagagagtgaatgctaatttgtagagcgaacttccatttggcccattatttgtaactgtgtaactgctccaagtgccagaatgcttacacgttaaagcagcacctttccatttgcccacatattcttcttgcacaccccttccattactgctgaataggacattgcatgggaagagtacagaggtggcagaatgaagctagagtgggaaggactaaagactgagccccagagtgctcccagcaaccgccacgtacaaggtctgaaatgacaagggcaagagtgagataggaaactgtgtgtgaaaggaaagcccttgcagtatttctgcctccctttctttctgcctttcaccccactaaatgtacgttattgaatgccagtacttctctagtggatgcacacttgttaaatagtgttaagagatgtggagatgagatatacccctttgatgtagaattattcatttggtttgtttcatacttcattataggaatcaagtaatttgatgactaatgtggattatatttcagtcaaagctctgctttcaatttctctgatttgctcactaatgccttatgtgtgttttactaaccttttatatcttgccttcaagtgagaaggaacaaacaactctcagtggttactacttgcttttatatgctggctgtgaaggttaaaagaaagaatggtctgtaccattttttctgctttgctgcccttttattgtaccccaggcctcctagaggactcctgcagattctattgttgggtgggaaatagtgttggaatgtgtttgcacagtcttatgatattcagtctcagtctgctataggtatttgttattcttggatactacacacctgctcagactgagtaaacatttgtggtgctgtcaacctgatttcttgactctcaaatgatttttgtatttccaatatgaatttgtgtgttatgaatttctgatttctccaatagtatatgccactatataaatttgtattaataaatgacagtcttgttggtt

SEQ ID NO: 105707 - DNA, 456 bp, Homo sapiens
aattacttcctattgggtccctcccatgacacatggggattatgggaactgtaattcaagataagatttggtggggacacagccaaaccatatcaggcagccactgacttatggagagggcttcacagcacatactctctcaactcaacctaaagccaggagtgatgagtacttttctcctcccagtcactgccacctaccaatatagtggaaccatctttctaaatcttgcatttcttttttctgaaatcctaggaccgcaatcagccagaggtaactgataagtacttccatgatgtgccttttgaggctcactttgcctctgagttgcctgatttccatgtggtcagtaacatgccaggtgtggatggatttactctaaaagtagatgcactctataaggtgagtttggtgagaagaacagaagcttaagaccaagtctactttaaagcttga

SEQ ID NO: 105708 - DNA, 6050 bp, Homo sapiens
  misc_feature (1554)..(1554): n is a, c, g, or t
ttgacgtgtggaagcagttcttggggatgtgactactgccacggtgacaattctagaccaggaggcagcagggagcctcatattgccagcaccacccattgtggtcacacttgctgactatgaccatgtggaagaagttaccaaggaaggagtcaagaaatccccctccccaggctacccactggtctgtgtcaccccctgcgaccctcatttccccagatacgctgtcatgaaggagcgctgcagtgaggccggcatcaaccagacatctgtgcagttcagctgggaagtggctgcccccactgatggcaatggggcccggtctccctttgaaaccatcactgacaacacaccattcaccagtgtcaaccacatggtcctggacagcatttacttcagccggaggttccatgtgcgttgtgtggccaaggctgtggacaaggtgggccatgtggggacccccttaaggagcaacattgttaccattggaacagacagtgctatctgccacacaccagtggtggctgggacatccagaggcttccaggctcagtccttcatcgcaaccttgaaatacctggatgtcaaacataaggagcatccgaacagaatccacatttcggtgcagatcccacaccaggatggaatgctgccccttatctccaccatgccgttgcacaacttacattttctactgtctgagtccatctacagacaccagcacgtctgctccaatttagttaccacctatgacctgagaggcatctcagaggcagggttcctggatgatgtggtctatgatagcactgccctggggcctggctacgatcgccccttccagtttgaccccagcgtgcgagagccgaagaccatccagctctacaaacacctgaacctgaagagctgcgtgtggacctttgatgcttattatgacatgactgagctgattgacgtctgtgggggctctgtaaccgctgacttccaggtgagggactctgcccagtccttcttgacagtgcacgtgcctctatatgtgtcctacatctatgtgacagcccccaggggctgggcctccttggagcaccacaccgagatggagttttctttcttctatgacactgttctctggagaacaggaatccagacagacagcgtgctctctgcaaggcttcagataataagaatctacattcgagaggatggccgtcttgtcattgaattcaagacccatgccaaattcagaggacagtttgtgatggagcatcacactctcccagaagtgaaatctttcgtattgactccagaccacctaggaggaattgaatttgacttgcagctattatggagcgctcagacttttgattctccacatcaactctggagagccacaagctcttataacaggaaggactactcaggagagtacaccatctacctgatcccttgcacagtgcagcccacacagccatgggttgacccaggagagaagcctttggcctgcactgcacatgccccagaaagattcctgatacccattgcattccagcagaccanccgccctgtgccagttgtgtattcacttaacactgaatttcagctctgcaataatgagaaggtgttcctaatggatcccaatacatctgatatgtcactagcagaaatggattacaaaggagccttttcaaaaggtcaaatcctttatggccgagtactttggaatccagaacaaaatcttaattctgcttacaaactccagctggagaaagtctatctttgtacgggcaaggatggttatgtgcctttctttgatcccacggggacaatctacaatgaagggccccagtatggatgcattcagccaaacaaacacctaaaacacagattcctgctgttggaccgcaatcagccagaggtaactgataagtacttccatgatgtgccttttgaggctcactttgcctctgagttgcctgatttccatgtggtcagtaacatgccaggtgtggatggatttactctaaaagtagatgcactctataaggtggaagcaggacaccagtggtatctccaggtcatctacatcattggccctgacaccatctcagggccccgggtccagcgctctctcacagctccactcagacgcaaccgaagggacctggtagagcccgatggccagctgatccttgatgattccctcatctatgacaatgaaggagaccaagtcaagaatggcaccaatatgaagtccctgaatctggagatgcaagagttggcggtagctgcgtccctgtcacagactggggcgtccattggcagtgccctggctgcaatcatgcttctacttctggtgtttttggtggcttgttttatcaacaggaaatgccagaaacagaggaagaagaagcccgcagaggacattttggaagaatatcctctgaataccaaggtagaagtgcccaagaggcacccggaccgggtggagaagaacgtgaatagacactactgcactgtgcggaacgtcaacatcctgagtgagcctgaggcggcttacacgttcaaaggtgctaaagtcaaaagactgaatctagaagtcagagttcacaacaatttacaagatggaacagaagtttaatggaggagacctatgtgtatttttttctaaaatcatttttataaaatggggggaaatactggtatttttataatctcgcagataaaaaagggaaaactatagctttgagtggcagacagcacacatcacatgcatcaactcacaactgagctacctcattcagcaaagaaccactgagaaccccagagtattacagttatttccgtagatccctttaatagtgtcaacaactgtacacagctccttctgtaaggctggtcttagaaaacaagtactttagtatcaggacaggagttgaacaattaggttagcagatggagatgagaggactgggtagagtaccatggcagatctcagagagaagaagtaggtacgggcctttggttccctcccccagccccagctttctcctacagggcttttcctgagtccccagacagcagagtatgaactgctgacacccagattccattaaaaattctgctaatcgacacaacacatatatttgctcatgatttcacttgacagcgtatgctccttggcctctaattgtactttgcttttccagagccctttttacctggggatttcagtgtgcttaagtaaaatcctctgaaaaccacgggagcctctgcctcctcagccacagagaactccctcctacaaagggggagactgaaacccgagttaaggaggggcctggcaggcgtatcagagcacattagtgatgcccttcaccccagggaggtgtctgttcccaactagtttatgtggcactgagacatccatccctgaccaaggatgctgcgaaacaggatcaatgtactacggccttttaattcaacattgccataaatgctttaaagaaaacccaccacactttcctcctactccggtctttgcccgttcctgtaacagacaatcccatgtcctaggtatggttttttattctgttagtgcttcgggaaagtaagtgattcatttgaataaggcaaattaggagaaagcccaggttggggtgaaatcagacttaacagatacatgctggttctccttgctgtgtgtgacacagcagacagaggcactattcctggtgcagtatttcagggatttctctttgaggggttcttttctggtagctcaggcaattatttttaccatatcagcacatgacaaggccatgaacacatggctctaaaataatttagtgttcaagtatcagcttaactattttgtgtaggctacacacagcttgcttttgtttctcttctgtttctgccttattggcggaaacataagcgtgcatgccatgttgttttgaattggaggcacaatttcattattcgagagtaaaagacatgtcctcttctgatgcatggcacaccatagtcaccaagcaaataacagagccttcacattgtgtaatatttgtatgagaatgactcaagctctttgagaacattccaaactagtaacatttcgctactaaaagctagaaaggatgaactgtgaaaggttctaggcagctctgtgagactccaagctccttgaaagtaggacctttgtgagccacgcctttcattcttcaacagtgccttgcatgtaacaagcactccagaaatgtttgttgaatgaatgaatggtgtcatgggtgaatgatggggagtaaatttaggaaggggaagtgagagagtatggtggcaatatcacaagggaggagagaggaaaacaattatcttctctacttggattatgagataaccttttcttggaggaaagaaacaccgctttacaaaggcatgactctggcggtggtcctaaggaagcatgagcagaaaattcataaaaatgtatcatcagcaggagatgagactatgaattggcatccagaacaggagatttagagcaaaatctaatttagcattctgagatgagtgtcaggttttcaggagagaatgagttggggtgagcccagagtctgaaactcctgactggtcaggtgctacttaagaccagcttgggcaattcagggcagaactcctgtatcagcctcatggacacccagaattggtatctcatggctggagagctgatcagccaggcacagaatctccagaacaacctagagagtgaatgctaatttgtagagcgaacttccatttggcccattatttgtaactgtgtaactgctccaagtgccagaatgcttacacgttaaagcagcacctttccatttgcccacatattcttcttgcacaccccttccattactgctgaataggacattgcatgggaagagtacagaggtggcagaatgaagctagagtgggaaggactaaagactgagccccagagtgctcccagcaaccgccacgtacaaggtctgaaatgacaagggcaagagtgagataggaaactgtgtgtgaaaggaaagcccttgcagtatttctgcctccctttctttctgcctttcaccccactaaatgtacgttattgaatgccagtacttctctagtggatgcacacttgttaaatagtgttaagagatgtggagatgagatatacccctttgatgtagaattattcatttggtttgtttcatacttcattataggaatcaagtaatttgatgactaatgtggattatatttcagtcaaagctctgctttcaatttctctgatttgctcactaatgccttatgtgtgttttactaaccttttatatcttgccttcaagtgagaaggaacaaacaactctcagtggttactacttgcttttatatgctggctgtgaaggttaaaagaaagaatggtctgtaccattttttctgctttgctgcccttttattgtaccccaggcctcctagaggactcctgcagattctattgttgggtgggaaatagtgttggaatgtgtttgcacagtcttatgatattcagtctcagtctgctataggtatttgttattcttggatactacacacctgctcagactgagtaaacatttgtggtgctgtcaacctgatttcttgactctcaaatgatttttgtatttccaatatgaatttgtgtgttatgaatttctgatttctccaatagtatatgccactatataaatttgtattaataaatgacagtcttgttggttttttgtttgttttcctatgttctttttagattatatctcttatgaatatagacattgccattaagatgccaaaattcattctaaatttgaagcggtcttctggagaaaacccttctaatgagggtgaatctgagacactcattaactgtgttcagagtaagatgctgaataaattatatgtttccagattatcataggtcttctttggcaatcagttgaaattctgagacaaagaggaataattaaaatttccatgtgccatataat

SEQ ID NO: 105709 - DNA, 5333 bp, Homo sapiens
  misc_feature (1554)..(1554): n is a, c, g, or t
ttgacgtgtggaagcagttcttggggatgtgactactgccacggtgacaattctagaccaggaggcagcagggagcctcatattgccagcaccacccattgtggtcacacttgctgactatgaccatgtggaagaagttaccaaggaaggagtcaagaaatccccctccccaggctacccactggtctgtgtcaccccctgcgaccctcatttccccagatacgctgtcatgaaggagcgctgcagtgaggccggcatcaaccagacatctgtgcagttcagctgggaagtggctgcccccactgatggcaatggggcccggtctccctttgaaaccatcactgacaacacaccattcaccagtgtcaaccacatggtcctggacagcatttacttcagccggaggttccatgtgcgttgtgtggccaaggctgtggacaaggtgggccatgtggggacccccttaaggagcaacattgttaccattggaacagacagtgctatctgccacacaccagtggtggctgggacatccagaggcttccaggctcagtccttcatcgcaaccttgaaatacctggatgtcaaacataaggagcatccgaacagaatccacatttcggtgcagatcccacaccaggatggaatgctgccccttatctccaccatgccgttgcacaacttacattttctactgtctgagtccatctacagacaccagcacgtctgctccaatttagttaccacctatgacctgagaggcatctcagaggcagggttcctggatgatgtggtctatgatagcactgccctggggcctggctacgatcgccccttccagtttgaccccagcgtgcgagagccgaagaccatccagctctacaaacacctgaacctgaagagctgcgtgtggacctttgatgcttattatgacatgactgagctgattgacgtctgtgggggctctgtaaccgctgacttccaggtgagggactctgcccagtccttcttgacagtgcacgtgcctctatatgtgtcctacatctatgtgacagcccccaggggctgggcctccttggagcaccacaccgagatggagttttctttcttctatgacactgttctctggagaacaggaatccagacagacagcgtgctctctgcaaggcttcagataataagaatctacattcgagaggatggccgtcttgtcattgaattcaagacccatgccaaattcagaggacagtttgtgatggagcatcacactctcccagaagtgaaatctttcgtattgactccagaccacctaggaggaattgaatttgacttgcagctattatggagcgctcagacttttgattctccacatcaactctggagagccacaagctcttataacaggaaggactactcaggagagtacaccatctacctgatcccttgcacagtgcagcccacacagccatgggttgacccaggagagaagcctttggcctgcactgcacatgccccagaaagattcctgatacccattgcattccagcagaccanccgccctgtgccagttgtgtattcacttaacactgaatttcagctctgcaataatgagaaggtgttcctaatggatcccaatacatctgatatgtcactagcagaaatggattacaaaggagccttttcaaaaggtcaaatcctttatggccgagtactttggaatccagaacaaaatcttaattctgcttacaaactccagctggagaaagtctatctttgtacgggcaaggatggttatgtgcctttctttgatcccacggggacaatctacaatgaagggccccagtatggatgcattcagccaaacaaacacctaaaacacagattcctgctgttggaccgcaatcagccagaggtaactgataagtacttccatgatgtgccttttgaggctcactttgcctctgagttgcctgatttccatgtggtcagtaacatgccaggtgtggatggatttactctaaaagtagatgcactctataaggtggaagcaggacaccagtggtatctccaggtcatctacatcattggccctgacaccatctcagggccccgggtccagcgctctctcacagctccactcagacgcaaccgaagggacctggtagagcccgatggccagctgatccttgatgattccctcatctatgacaatgaaggagaccaagtcaagaatggcaccaatatgaagtccctgaatctggagatgcaagagttggcggtagctgcgtccctgtcacagactggggcgtccattggcagtgccctggctgcaatcatgcttctacttctggtgtttttggtggcttgttttatcaacaggaaatgccagaaacagaggaagaagaagcccgcagaggacattttggaagaatatcctctgaataccaaggtagaagtgcccaagaggcacccggaccgggtggagaagaacgtgaatagacactactgcactgtgcggaacgtcaacatcctgagtgagcctgaggcggcttacacgttcaaaggtgctaaagtcaaaagactgaatctagaagtcagagttcacaacaatttacaagatggaacagaagtttaatggaggagacctatgtgtatttttttctaaaatcatttttataaaatggggggaaatactggtatttttataatctcgcagataaaaaagggaaaactatagctttgagtggcagacagcacacatcacatgcatcaactcacaactgagctacctcattcagcaaagaaccactgagaaccccagagtattacagttatttccgtagatccctttaatagtgtcaacaactgtacacagctccttctgtaaggctggtcttagaaaacaagtactttagtatcaggacaggagttgaacaattaggttagcagatggagatgagaggactgggtagagtaccatggcagatctcagagagaagaagtaggtacgggcctttggttccctcccccagccccagctttctcctacagggcttttcctgagtccccagacagcagagtatgaactgctgacacccagattccattaaaaattctgctaatcgacacaacacatatatttgctcatgatttcacttgacagcgtatgctccttggcctctaattgtactttgcttttccagagccctttttacctggggatttcagtgtgcttaagtaaaatcctctgaaaaccacgggagcctctgcctcctcagccacagagaactccctcctacaaagggggagactgaaacccgagttaaggaggggcctggcaggcgtatcagagcacattagtgatgcccttcaccccagggaggtgtctgttcccaactagtttatgtggcactgagacatccatccctgaccaaggatgctgcgaaacaggatcaatgtactacggccttttaattcaacattgccataaatgctttaaagaaaacccaccacactttcctcctactccggtctttgcccgttcctgtaacagacaatcccatgtcctaggtatggttttttattctgttagtgcttcgggaaagtaagtgattcatttgaataaggcaaattaggagaaagcccaggttggggtgaaatcagacttaacagatacatgctggttctccttgctgtgtgtgacacagcagacagaggcactattcctggtgcagtatttcagggatttctctttgaggggttcttttctggtagctcaggcaattatttttaccatatcagcacatgacaaggccatgaacacatggctctaaaataatttagtgttcaagtatcagcttaactattttgtgtaggctacacacagcttgcttttgtttctcttctgtttctgccttattggcggaaacataagcgtgcatgccatgttgttttgaattggaggcacaatttcattattcgagagtaaaagacatgtcctcttctgatgcatggcacaccatagtcaccaagcaaataacagagccttcacattgtgtaatatttgtatgagaatgactcaagctctttgagaacattccaaactagtaacatttcgctactaaaagctagaaaggatgaactgtgaaaggttctaggcagctctgtgagactccaagctccttgaaagtaggacctttgtgagccacgcctttcattcttcaacagtgccttgcatgtaacaagcactccagaaatgtttgttgaatgaatgaatggtgtcatgggtgaatgatggggagtaaatttaggaaggggaagtgagagagtatggtggcaatatcacaagggaggagagaggaaaacaattatcttctctacttggattatgagataaccttttcttggaggaaagaaacaccgctttacaaaggcatgactctggcggtggtcctaaggaagcatgagcagaaaattcataaaaatgtatcatcagcaggagatgagactatgaattggcatccagaacaggagatttagagcaaaatctaatttagcattctgagatgagtgtcaggttttcaggagagaatgagttggggtgagcccagagtctgaaactcctgactggtcaggtgctacttaagaccagcttgggcaattcagggcagaactcctgtatcagcctcatggacacccagaattggtatctcatggctggagagctgatcagccaggcacagaatctccagaacaacctagagagtgaatgctaatttgtagagcgaacttccatttggcccattatttgtaactgtgtaactgctccaagtgccagaatgcttacacgttaaagcagcacctttccatttgcccacatattcttcttgcacaccccttccattactgctgaataggacattgcatgggaagagtacagaggtggcagaatgaagctagagtgggaaggactaaagactgagccccagagtgctcccagcaaccgccacgtacaaggtctgaaatgacaagggcaagagtgagataggaaactgtgtgtgaaaggaaagcccttgcagtatttctgcctccctttctttctgcctttcaccccactaaatgtacgttattgaatgccagtacttctctagtggatgcacacttgttaaatagtgttaagagatgtggagatgagatatacccctttgatgtagaattattcatttggtttgtttcatacttcattataggaatcaagtaatttgatgactaatgtggattatatttcagtcaaagctctgctttcatgtcccgctgctcagacggtaccggga

SEQ ID NO: 105710 - DNA, 5803 bp, Homo sapiens
  misc_feature (1554)..(1554): n is a, c, g, or t
  misc_feature (5801)..(5801): n is a, c, g, or t
ttgacgtgtggaagcagttcttggggatgtgactactgccacggtgacaattctagaccaggaggcagcagggagcctcatattgccagcaccacccattgtggtcacacttgctgactatgaccatgtggaagaagttaccaaggaaggagtcaagaaatccccctccccaggctacccactggtctgtgtcaccccctgcgaccctcatttccccagatacgctgtcatgaaggagcgctgcagtgaggccggcatcaaccagacatctgtgcagttcagctgggaagtggctgcccccactgatggcaatggggcccggtctccctttgaaaccatcactgacaacacaccattcaccagtgtcaaccacatggtcctggacagcatttacttcagccggaggttccatgtgcgttgtgtggccaaggctgtggacaaggtgggccatgtggggacccccttaaggagcaacattgttaccattggaacagacagtgctatctgccacacaccagtggtggctgggacatccagaggcttccaggctcagtccttcatcgcaaccttgaaatacctggatgtcaaacataaggagcatccgaacagaatccacatttcggtgcagatcccacaccaggatggaatgctgccccttatctccaccatgccgttgcacaacttacattttctactgtctgagtccatctacagacaccagcacgtctgctccaatttagttaccacctatgacctgagaggcatctcagaggcagggttcctggatgatgtggtctatgatagcactgccctggggcctggctacgatcgccccttccagtttgaccccagcgtgcgagagccgaagaccatccagctctacaaacacctgaacctgaagagctgcgtgtggacctttgatgcttattatgacatgactgagctgattgacgtctgtgggggctctgtaaccgctgacttccaggtgagggactctgcccagtccttcttgacagtgcacgtgcctctatatgtgtcctacatctatgtgacagcccccaggggctgggcctccttggagcaccacaccgagatggagttttctttcttctatgacactgttctctggagaacaggaatccagacagacagcgtgctctctgcaaggcttcagataataagaatctacattcgagaggatggccgtcttgtcattgaattcaagacccatgccaaattcagaggacagtttgtgatggagcatcacactctcccagaagtgaaatctttcgtattgactccagaccacctaggaggaattgaatttgacttgcagctattatggagcgctcagacttttgattctccacatcaactctggagagccacaagctcttataacaggaaggactactcaggagagtacaccatctacctgatcccttgcacagtgcagcccacacagccatgggttgacccaggagagaagcctttggcctgcactgcacatgccccagaaagattcctgatacccattgcattccagcagaccanccgccctgtgccagttgtgtattcacttaacactgaatttcagctctgcaataatgagaaggtgttcctaatggatcccaatacatctgatatgtcactagcagaaatggattacaaaggagccttttcaaaaggtcaaatcctttatggccgagtactttggaatccagaacaaaatcttaattctgcttacaaactccagctggagaaagtctatctttgtacgggcaaggatggttatgtgcctttctttgatcccacggggacaatctacaatgaagggccccagtatggatgcattcagccaaacaaacacctaaaacacagattcctgctgttggaccgcaatcagccagaggtaactgataagtacttccatgatgtgccttttgaggctcactttgcctctgagttgcctgatttccatgtggtcagtaacatgccaggtgtggatggatttactctaaaagtagatgcactctataaggtggaagcaggacaccagtggtatctccaggtcatctacatcattggccctgacaccatctcagggccccgggtccagcgctctctcacagctccactcagacgcaaccgaagggacctggtagagcccgatggccagctgatccttgatgattccctcatctatgacaatgaaggagaccaagtcaagaatggcaccaatatgaagtccctgaatctggagatgcaagagttggcggtagctgcgtccctgtcacagactggggcgtccattggcagtgccctggctgcaatcatgcttctacttctggtgtttttggtggcttgttttatcaacaggaaatgccagaaacagaggaagaagaagcccgcagaggacattttggaagaatatcctctgaataccaaggtagaagtgcccaagaggcacccggaccgggtggagaagaacgtgaatagacactactgcactgtgcggaacgtcaacatcctgagtgagcctgaggcggcttacacgttcaaaggtgctaaagtcaaaagactgaatctagaagtcagagttcacaacaatttacaagatggaacagaagtttaatggaggagacctatgtgtatttttttctaaaatcatttttataaaatggggggaaatactggtatttttataatctcgcagataaaaaagggaaaactatagctttgagtggcagacagcacacatcacatgcatcaactcacaactgagctacctcattcagcaaagaaccactgagaaccccagagtattacagttatttccgtagatccctttaatagtgtcaacaactgtacacagctccttctgtaaggctggtcttagaaaacaagtactttagtatcaggacaggagttgaacaattaggttagcagatggagatgagaggactgggtagagtaccatggcagatctcagagagaagaagtaggtacgggcctttggttccctcccccagccccagctttctcctacagggcttttcctgagtccccagacagcagagtatgaactgctgacacccagattccattaaaaattctgctaatcgacacaacacatatatttgctcatgatttcacttgacagcgtatgctccttggcctctaattgtactttgcttttccagagccctttttacctggggatttcagtgtgcttaagtaaaatcctctgaaaaccacgggagcctctgcctcctcagccacagagaactccctcctacaaagggggagactgaaacccgagttaaggaggggcctggcaggcgtatcagagcacattagtgatgcccttcaccccagggaggtgtctgttcccaactagtttatgtggcactgagacatccatccctgaccaaggatgctgcgaaacaggatcaatgtactacggccttttaattcaacattgccataaatgctttaaagaaaacccaccacactttcctcctactccggtctttgcccgttcctgtaacagacaatcccatgtcctaggtatggttttttattctgttagtgcttcgggaaagtaagtgattcatttgaataaggcaaattaggagaaagcccaggttggggtgaaatcagacttaacagatacatgctggttctccttgctgtgtgtgacacagcagacagaggcactattcctggtgcagtatttcagggatttctctttgaggggttcttttctggtagctcaggcaattatttttaccatatcagcacatgacaaggccatgaacacatggctctaaaataatttagtgttcaagtatcagcttaactattttgtgtaggctacacacagcttgcttttgtttctcttctgtttctgccttattggcggaaacataagcgtgcatgccatgttgttttgaattggaggcacaatttcattattcgagagtaaaagacatgtcctcttctgatgcatggcacaccatagtcaccaagcaaataacagagccttcacattgtgtaatatttgtatgagaatgactcaagctctttgagaacattccaaactagtaacatttcgctactaaaagctagaaaggatgaactgtgaaaggttctaggcagctctgtgagactccaagctccttgaaagtaggacctttgtgagccacgcctttcattcttcaacagtgccttgcatgtaacaagcactccagaaatgtttgttgaatgaatgaatggtgtcatgggtgaatgatggggagtaaatttaggaaggggaagtgagagagtatggtggcaatatcacaagggaggagagaggaaaacaattatcttctctacttggattatgagataaccttttcttggaggaaagaaacaccgctttacaaaggcatgactctggcggtggtcctaaggaagcatgagcagaaaattcataaaaatgtatcatcagcaggagatgagactatgaattggcatccagaacaggagatttagagcaaaatctaatttagcattctgagatgagtgtcaggttttcaggagagaatgagttggggtgagcccagagtctgaaactcctgactggtcaggtgctacttaagaccagcttgggcaattcagggcagaactcctgtatcagcctcatggacacccagaattggtatctcatggctggagagctgatcagccaggcacagaatctccagaacaacctagagagtgaatgctaatttgtagagcgaacttccatttggcccattatttgtaactgtgtaactgctccaagtgccagaatgcttacacgttaaagcagcacctttccatttgcccacatattcttcttgcacaccccttccattactgctgaataggacattgcatgggaagagtacagaggtggcagaatgaagctagagtgggaaggactaaagactgagccccagagtgctcccagcaaccgccacgtacaaggtctgaaatgacaagggcaagagtgagataggaaactgtgtgtgaaaggaaagcccttgcagtatttctgcctccctttctttctgcctttcaccccactaaatgtacgttattgaatgccagtacttctctagtggatgcacacttgttaaatagtgttaagagatgtggagatgagatatacccctttgatgtagaattattcatttggtttgtttcatacttcattataggaatcaagtaatttgatgactaatgtggattatatttcagtcaaagctctgctttcaatttctctgatttgctcactaatgccttatgtgtgttttactaaccttttatatcttgccttcaagtgagaaggaacaaacaactctcagtggttactacttgcttttatatgctggctgtgaaggttaaaagaaagaatggtctgtaccattttttctgctttgctgcccttttattgtaccccaggcctcctagaggactcctgcagattctattgttgggtgggaaatagtgttggaatgtgtttgcacagtcttatgatattcagtctcagtctgctataggtatttgttattcttggatactacacacctgctcagactgagtaaacatttgtggtgctgtcaacctgatttcttgactctcaaatgatttttgtatttccaatatgaatttgtgtgttatgaatttctgatttctccaatagtatatgccactatataaatttgtattaataaatgacagtcttgttggttaaaaaaaaaaaatgattnaa

SEQ ID NO: 105711 - DNA, 929 bp, Homo sapiens
ttgacgtgtggaagcagttcttggggatgtgactactgccacggtgacaattctagaccaggaggcagcagggagcctcatattgccagcaccacccattgtggtcacacttgctgactatgaccatgtggaagaagttaccaaggaaggagtcaagaaatccccctccccaggctacccactggtctgtgtcaccccctgcgaccctcatttccccagatacgctgtcatgaaggagcgctgcagtgaggccggcatcaaccagacatctgtgcagttcagctgggaagtggctgcccccactgatggcaatggggcccggtctccctttgaaaccatcactgacaacacaccattcaccagtgtcaaccacatggtcctggacagcatttacttcagccggaggttccatgtgcgttgtgtggccaaggctgtggacaaggtgggccatgtggggacccccttaaggagcaacattgttaccattggaacagacagtgctatctgccacacaccagtggtggctgggacatccagaggcttccaggctcagtccttcatcgcaaccttgaaatacctggatgtcaaacataaggagcatccgaacagaatccacatttcggtgcagatcccacaccaggatggaatgctgccccttatctccaccatgccgttgcacaacttacattttctactgtctgagtccatctacagacaccagcacgtctgctccaatttagttaccacctatgacctgagaggcatctcagaggcagggttcctggatgatgtggtctatgatagcactgccctggggcctggctacgatcgccccttccagtttgaccccagcgtgcttgatgcgttgttcccttctgatcgtggtgattaagaggtgaactcactgacaacgaccgggatcctctgag

SEQ ID NO: 105712 - DNA, 304 bp, Homo sapiens
ggaagtggaaaataggaaaaacaaaaggggatcatgcttccaaaaaaatgtactcccttttaaagaatttctgatgggcagaaagtctttgagaaaagagggcatgagatcaaatggaccctaactatgcagtgacaaattgtgcatttttcagtggaaggatgccattggggaagggggacaccgggaagtttgggttgtaactacttagctacagcatcaggactgaagtgtcatctggactagagaaccaagacaaatctctttgaacccagagtgaagttactttctccctgcctctcca

SEQ ID NO: 105713 - DNA, 271 bp, Homo sapiens
ataagtcaaggccataagctgacccagaaccccaaggatccccgagagggtcaaccatgattaaagaaacggaagaagcaactgctgcaggaagaactgaaaggactagcatggcaagccacgtgcagcgatgattcttcaacacccagagcctacggactcaagtctctctgaggttctctcatgatatgcttttgggaaaacgaagtattcagctatgggtacacttttatagaatgtgctacttcaaaaagccagaaacttttcttac

SEQ ID NO: 105714 - DNA, 496 bp, Homo sapiens
ctgcagtacaactaaatgttcaagggcaaaaactctgttttcttgtaaaatcaactctcttgtggaatcccttatcacttgttctgaattctgaagtgcccacactggggaaaatcccccaggccctacatggctccccatttacagtgtttgctgtgtgtgtcacagatggtgcacaaacacctcaaaatggccttgccaggaaggctctgaggctagaggttaagtagcttggccaatgcctgactgctaggaagtggcagaaactgaactcagatttttcaaaaaatcagtgattcgcaaatgctcctcctgatcatacaagagtcaactcagcagcatattaaaaatacacattttggccaggcacaatggctcacacctgtaatcgcagcactttgagaggccaatgcggcaggattgcttgagcccaggagttcgagaccagcctgggaaacatggatggctccgtctctacaaaaaattaaaaaaaaaa

SEQ ID NO: 105715 - DNA, 779 bp, Homo sapiens
tggagcgcagggctgctggagactaactgtgagctactaacacgggtggaagatagcttttgcaatactcggtttgcatgtgctgaaagtcatctgtcttctgagtcaacactcccgacctggtaaacaacctgctcagggctctggtgaacaagctgtagatcaagtctcgggttctcatgactcccttagccctctcacctccgcggagtaccccagagcccgacctcagctccatccctcaggacgcagccacggtccccagcttggcggccccacaggctctcacagtctgcctctacatcaacaagcaggccaatgcggggccctatctggagaggaagaaggtgcagcagctcccggagcattttgggcccgagcggccatcggcggtgctgcagcaggccgtccaagcctgcatcgactgcgcccaccagcagaagctggtcttctccctggtcaagcagggctatggtggtgagatggtgtcagtctcggcttcctttgatggcaaacagcacctgcggagcctgcctgtggtgaacagcatcggctatgtcctccgcttcctcgccaagctgtgccgaagcctcctgtgcgatgacctcttcagccaccagcccttccccaggggctgcagtgcctctgagaaagtccaggagaaagaggaagggaggatggaatcaggaggatgacagccttccttcctaaaagctgatgtccccatctgaaagctggttttcctcccagtcagctgggaggtttggaagtaatgaccc

SEQ ID NO: 105716 - DNA, 1088 bp, Homo sapiens
tggagcgcagggctgctggagactaactgtgagctactaacacgggtggaagatagcttttgcaatactcggtttgcatgtgctgaaagtcatctgtcttctgagtcaacactcccgacctggtaaacaacctgctcagggctctggtgaacaagctgtagcacctcttctgcctgtgagcgatttgtcacctcattctgtaagactggcaccagcagaaatgcagtctcaaaggatcccggggagaaagcgaggccgaccctcacttcactccacgcctatgaagatggcagttcataacctttattctgcttcagctggctctttaccagcagtgaagatcccaaagaaaagagggcggaaacccgggtacaagaaacctaaggcaacaacaaagacaaatgccctgccagagaacagcttggataggttgcgacaggcagagaacccccccattccactggagagagatcaagtctcgggttctcatgactcccttagccctctcacctccgcggagtaccccagagcccgacctcagctccatccctcaggacgcagccacggtccccagcttggcggccccacaggctctcacagtctgcctctacatcaacaagcaggccaatgcggggccctatctggagaggaagaaggtgcagcagctcccggagcattttgggcccgagcggccatcggcggtgctgcagcaggccgtccaagcctgcatcgactgcgcccaccagcagaagctggtcttctccctggtcaagcagggctatggtggtgagatggtgtcagtctcggcttcctttgatggcaaacagcacctgcggagcctgcctgtggtgaacagcatcggctatgtcctccgcttcctcgccaagctgtgccgaagcctcctgtgcgatgacctcttcagccaccagcccttccccaggggctgcagtgcctctgagaaagtccaggagaaagaggaagggaggatggaatcaggaggatgacagccttccttcctaaaagctgatgtccccatctgaaagctggttttcctcccagtcagctgggaggtttggaagtaatgaccc

SEQ ID NO: 105717 - DNA, 994 bp, Homo sapiens
tggagcgcagggctgctggagactaactgtgagctactaacacgggtggaagatagcttttgcaatactcggtttgcatgtgctgaaagtcatctgtcttctgagtcaacactcccgacctggtaaacaacctgctcagggctctggtgaacaagctgtagcacctcttctgcctgtgagcgatttgtcacctcattctgtaagactggcaccagcagaaatgcagtctcaaaggatcccggggagaaagcgaggccgaccctcacttcactccacgcctatgaagatggcagttcataacctttattctgcttcagctggctctttaccagcagtgaagatcccaaagaaaagagggcggaaacccgggtacaagatcaagtctcgggttctcatgactcccttagccctctcacctccgcggagtaccccagagcccgacctcagctccatccctcaggacgcagccacggtccccagcttggcggccccacaggctctcacagtctgcctctacatcaacaagcaggccaatgcggggccctatctggagaggaagaaggtgcagcagctcccggagcattttgggcccgagcggccatcggcggtgctgcagcaggccgtccaagcctgcatcgactgcgcccaccagcagaagctggtcttctccctggtcaagcagggctatggtggtgagatggtgtcagtctcggcttcctttgatggcaaacagcacctgcggagcctgcctgtggtgaacagcatcggctatgtcctccgcttcctcgccaagctgtgccgaagcctcctgtgcgatgacctcttcagccaccagcccttccccaggggctgcagtgcctctgagaaagtccaggagaaagaggaagggaggatggaatcaggaggatgacagccttccttcctaaaagctgatgtccccatctgaaagctggttttcctcccagtcagctgggaggtttggaagtaatgaccc

SEQ ID NO: 105718 - DNA, 275 bp, Homo sapiens
ccttcctgatgagggacagaggcagaaaaggcagaagctttccacacagtcctttgcctgactgtgacccaaactttctgtcctgaggcagaggtggaaagggcagttttttccccctgaaactcaagtctcttaaccggagggtaaagacagaaaacctccatcgtagaaagggaaggctggaaaggacaactcaagcaaactccaggccttcaaccaaagagtgggaaggtccagatttcaggaggattcaccacttactgcccatctgtttc

SEQ ID NO: 105719 - DNA, 323 bp, Homo sapiens
taggtcttcaggtccatgtgtttggtgacaggggagtgccctccaggtctggtgagaggtcccggccaagcagcagagatgtcagggggcactctggaagtgccatgataaagctgcctttatcatcgtggtttgaaaaagtagccacaaaatgcagagcccaggaagcacgttcagagacttcagacaatcataaactagttgcgccacagaaagatgaaaagtcatgttttcatttcaaaagggctggagacgtgtctgcggcatccaaaccttgactggctgtgcctgcctgggggcgtgcccatgggcagtgggtactg

SEQ ID NO: 105720 - DNA, 4681 bp, Homo sapiens
ctccttccataagggtctggtccttcatccctcccgcttcaccagaccccctcaccctgggagccgccacctccctttccccaagaccagatgtcgcgcggccggacacagccagcacggagagtcgatgccggcgtctgagctgcgcagtggggtcttcccgctgcccagcagcctacaggcgcggtgcactctgggggaacatggccgcttccggtctccctcccgggccggcgctggcctgactgcggccccggtccgtagcactccgccctccgcttctcccgccctgtagccgcgaagactgcttcagcctttccctgtgctgcccctgccgcgcgatggagacgagctcgagctgcgagagtcttggctcccagccggcggcggctcggccgcccagcgtggactccttgtccagtgcctccacttctcattcagagaattcagtgcatacaaaatcagcttctgttgtatcatcagattccatttcaacttctgccgacaacttttctcctgatttgagggtcctgagggagtctaacaagttagcagaaatggaagaaccacccttgcttccaggagaaaatattaaagacatggccaaagatgtaacttatatatgtccattcactggcgctgtacgaggaactctgactgtcacgaattataggttatatttcaaaagcatggaacgggatcccccatttgttttagatgcttcccttggtgtgataaatagagtagaaaaaattggtggtgcttctagtcgaggtgaaaattcttatggactagaaactgtgtgtaaggatattaggaatttacgatttgctcataaacctgaggggcggacaagaagatccatatttgagaatctaatgaaatatgcatttcctgtctctaataacctgcctctttttgcttttgaatacaaagaagtattccctgaaaatgggtggaagctatatgaccctcttttagagtatagaaggcagggaattccaaatgaaagctggagaataacaaagataaatgaacgatatgaactttgtgatacataccctgccctcctggttgtgccagcaaatattcctgatgaagaattaaagagagtggcatccttcagatcaagaggccgtatcccagttttatcatggattcatcctgaaagtcaagccacaatcactcggtgtagccagcccatggttggagtgagtggaaagcgaagcaaagaagatgaaaaataccttcaagctatcatggattccaatgcccagtctcacaaaatctttatatttgatgcccggccaagtgttaatgctgttgccaacaaggcaaagggtggaggttatgaaagtgaagatgcctatcaaaatgctgaactagttttcctggatatccacaatattcatgttatgagagaatcattacgaaaacttaaggagattgtgtaccccaacattgaggaaacccactggttgtctaacttggaatctactcattggctagaacatattaagcttattcttgcaggggctcttaggattgctgacaaggtagagtcagggaagacgtctgtggtagtgcattgcagtgatggttgggatcgcacagctcagctcacttcccttgccatgctcatgttggatggatactatcgaaccatccgaggatttgaagtccttgtggagaaagaatggctaagttttggacatcgatttcaactaagagttggccatggagataagaaccatgcagatgcagacagatcgcctgtttttcttcaatttattgactgtgtctggcagatgacaagacagtttcctaccgcatttgaattcaatgagtattttctcattaccattttggaccacctatacagctgcttattcggaacattcctctgtaatagtgaacaacagagaggaaaagagaatcttcctaaaaggactgtgtcactgtggtcttacataaacagccagctggaagacttcactaatcctctctatgggagctattccaatcatgtcctttatccagtagccagcatgcgccacctagagctctgggtgggatattacataaggtggaatccacggatgaaaccacaggaacctattcacaacagatacaaagaacttcttgctaaacgagcagagcttcagaaaaaagtagaggaactacagagagagatttctaaccgatcaacctcatcctcagagagagccagctctcctgcacagtgtgtcactcctgtccaaactgttgtataaaggactgtaagatcaggggcatcattgctatacactcttgattacactggcagctctatgagtagaaagtcttcggaatttagaacccatctatgagagaaagttcagtcactttatttattttaaatctctctaggatgagtttagaactgtagcagtgcaggtggcttaagtgaagtaactccatatgtaattacatgattatgatactaatcttttaagtatccaaagaatattaaaatacttcaatcctggattcacagtgggaacaagtttctattaaaaggcaaatgctgttacaaatttttggcatctggtaatattaaaaccattttagaaatacactctgtgctcactgtgcagaggaacatcagttttcaaaccaacactgaaattctgtggcatcacatatattgggccttgatgtcatgacagatcaaaatcatttgatatccctttctccattctaggtttttctttttttcagtaactgatttaccttgatcacttttcaacttccatattcttcatatagtaaaaggcaaagtgttgaagatactacggtgtggtagtagttgaaaattattgccgtcattatttacatacttaagacatattagcaagttgatccaaaatgggaggccttatagatgtgcttgggggaaaatgaaggggagaaagtagccatacaggagttcaaagaattccatgcccttcagattagcccaattaccagaaacatcatgaaagatattttaaaaactaattatttactacagtgtatttcacttgtcttgtgtgtctgaacacacagaagctaattagcaagtttttaagaagtatttaaaaatcttactaggattgacattttttctgaattctgtataaatagcttatagtgagaagtactgtgctcaaattttacatttttttcctttgcaaattctgtaatttcactcaacgattaagtctaccaaagaacacactgcatgtaaaagatgtattacaatctcaaagccagtaaaagaaatcttgcttcactgttcacctgctacaagtaagagtttggtgctggtagaaacatttgactctgatgtctattttattctacataagagccatatgtaatgtactgtaacaaaggagcttcttgtccccttggtcttttaattaaaagaaattccaactgacttttaaactttgttcttgtccaaagttgccatttcttttttttccccagaaatatttggaaattattggaggaatatgcaccccagatgaaaatgttcagtttgtacccatttttccttaaccaacacccaaatcaaacaattaaaatatacagtgtttttccactcactaattcactatacagagagtctgaaccttagcctccctcttggtcttgcagtgaggaaatttctattagtatatccaatttagcaaaattggtaccaaaatgatttctttggtaattgtgtgaaatataagctttttaacagggcatttaagtggctagcaaatcagtaattaaaaattaagctttctactccaagtatttcacaaatgcatctgccattttcctcatttaaaccttggttatcttggcctgataccacataaaagaatgtagaatggctgaagagatcaagaatttaaagcttctagtcttaacatacttgcatccacttcaaattcaaatcaaaagccagggaaatctaagtgcaaccctaccacttctctgctgagaaccttccagtggttcccctcaccttctgcagaagtctccaatatggagtacatgcacttgggcatttaatatataccactggtgtgtgtgggagggagggaggaggaatactagccctttttatatatttacacaagcaaaacttttaaatatttgaattgacagttacatgtttcataacttcgtatgtctattggttgtgcaggtgtaattttttccctttttgattagggttacaaaatttagagaccagtatgattaagttgaagctccttagcctccttcgacctagtctctgcatacctcaacttttacgtaccaatgctactctgctgttcacaattgcctcatgtaatctgcagattcctgcctccccactttggttcagtctgtcttgtgcacctggaacaactgttctcccttgtgactaattcctattttctagagtttaggcatcatctcttcctttgggaagttatctgattcacgactgccttctctgacatccccaccttcctctgtgcccccatagcactgtgtataccgctactaccactgcaattcacattatattggaatgaacaattcacatgtctaccacaagtctgtaaacataaccttatttgaaatgaattgcaataaagctctgttacaacgt

SEQ ID NO: 105721 - DNA, 3736 bp, Homo sapiens
ctccttccataagggtctggtccttcatccctcccgcttcaccagaccccctcaccctgggagccgccacctccctttccccaagaccagatgtcgcgcggccggacacagccagcacggagagtcgatgccggcgtctgagctgcgcagtggggtcttcccgctgcccagcagcctacaggcgcggtgcactctgggggaacatggccgcttccggtctccctcccgggccggcgctggcctgactgcggccccggtccgtagcactccgccctccgcttctcccgccctgtagccgcgaagactgcttcagcctttccctgtgctgcccctgccgcgcgatggagacgagctcgagctgcgagagtcttggctcccagccggcggcggctcggccgcccagcgtggactccttgtccagttaatgtgttaagagccattgacatttgaagatcatcagaagtgaagataaaacatctcaaaaattataattgcctccacttctcattcagagaattcagtgcatacaaaatcagcttctgttgtatcatcagattccatttcaacttctgccgacaacttttctcctgatttgaggcccatgcagtccagttcgggagctaagtcacttaaacactgtgtgatagttcctacacatctcattatagtttagggagtctcgctctatcccctaggctggagtgcattggcgccatctcggctcatttgcaacctctgtctcccgggttcaagcgattctcctgcctcagcttcccgaggagctgggattacaggtcctgagggagtctaacaagttagcagaaatggaagaaccacccttgcttccaggagaaaatattaaagacatggccaaagatgtaacttatatatgtccattcactggcgctgtacgaggaactctgactgtcacgaattataggttatatttcaaaagcatggaacgggatcccccatttgttttagatgcttcccttggtgtgataaatagagtagaaaaaattggtggtgcttctagtcgaggtgaaaattcttatggactagaaactgtgtgtaaggatattaggaatttacgatttgctcataaacctgaggggcggacaagaagatccatatttgagaatctaatgaaatatgcatttcctgtctctaataacctgcctctttttgcttttgaatacaaagaagtattccctgaaaatgggtggaagctatatgaccctcttttagagtatagaaggcagggaattccaaatgaaagctggagaataacaaagataaatgaacgatatgaactttgtgatacataccctgccctcctggttgtgccagcaaatattcctgatgaagaattaaagagagtggcatccttcagatcaagaggccgtatcccagttttatcatggattcatcctgaaagtcaagccacaatcactcggtgtagccagcccatggttggagtgagtggaaagcgaagcaaagaagatgaaaaataccttcaagctatcatggattccaatgcccagtctcacaaaatctttatatttgatgcccggccaagtgttaatgctgttgccaacaaggcaaagggtggaggttatgaaagtgaagatgcctatcaaaatgctgaactagttttcctggatatccacaatattcatgttatgagagaatcattacgaaaacttaaggagattgtgtaccccaacattgaggaaacccactggttgtctaacttggaatctactcattggctagaacatattaagcttattcttgcaggggctcttaggattgctgacaaggtagagtcagggaagacgtctgtggtagtgcattgcagtgatggttgggatcgcacagctcagctcacttcccttgccatgctcatgttggatggatactatcgaaccatccgaggatttgaagtccttgtggagaaagaatggctaagttttggacatcgatttcaactaagagttggccatggagataagaaccatgcagatgcagacagatcgcctgtttttcttcaatttattgactgtgtctggcagatgacaagacagtttcctaccgcatttgaattcaatgagtattttctcattaccattttggaccacctatacagctgcttattcggaacattcctctgtaatagtgaacaacagagaggaaaagagaatcttcctaaaaggactgtgtcactgtggtcttacataaacagccagctggaagacttcactaatcctctctatgggagctattccaatcatgtcctttatccagtagccagcatgcgccacctagagctctgggtgggatattacataaggtggaatccacggatgaaaccacaggaacctattcacaacagatacaaagaacttcttgctaaacgagcagagcttcagaaaaaagtagaggaactacagagagagatttctaaccgatcaacctcatcctcagagagagccagctctcctgcacagtgtgtcactcctgtccaaactgttgtataaaggactgtaagatcaggggcatcattgctatacactcttgattacactggcagctctatgagtagaaagtcttcggaatttagaacccatctatgagagaaagttcagtcactttatttattttaaatctctctaggatgagtttagaactgtagcagtgcaggtggcttaagtgaagtaactccatatgtaattacatgattatgatactaatcttttaagtatccaaagaatattaaaatacttcaatcctggattcacagtgggaacaagtttctattaaaaggcaaatgctgttacaaatttttggcatctggtaatattaaaaccattttagaaatacactctgtgctcactgtgcagaggaacatcagttttcaaaccaacactgaaattctgtggcatcacatatattgggccttgatgtcatgacagatcaaaatcatttgatatccctttctccattctaggtttttctttttttcagtaactgatttaccttgatcacttttcaacttccatattcttcatatagtaaaaggcaaagtgttgaagatactacggtgtggtagtagttgaaaattattgccgtcattatttacatacttaagacatattagcaagttgatccaaaatgggaggccttatagatgtgcttgggggaaaatgaaggggagaaagtagccatacaggagttcaaagaattccatgcccttcagattagcccaattaccagaaacatcatgaaagatattttaaaaactaattatttactacagtgtatttcacttgtcttgtgtgtctgaacacacagaagctaattagcaagtttttaagaagtatttaaaaatcttactaggattgacattttttctgaattctgtataaatagcttatagtgagaagtactgtgctcaaattttacatttttttcctttgcaaattctgtaatttcactcaacgattaagtctaccaaagaacacactgcatgtaaaagatgtattacaatctcaaagccagtaaaagaaatcttgcttcactgttcacctgctacaagtaagagtttggtgctggtagaaacatttgactctgatgtctattttattctacataagagccatatgtaatgtactgtaacaaaggagcttcttgtccccttggtcttttaattaaaagaaattccaactgactttta

SEQ ID NO: 105722 - DNA, 3663 bp, Homo sapiens
ctccttccataagggtctggtccttcatccctcccgcttcaccagaccccctcaccctgggagccgccacctccctttccccaagaccagatgtcgcgcggccggacacagccagcacggagagtcgatgccggcgtctgagctgcgcagtggggtcttcccgctgcccagcagcctacaggcgcggtgcactctgggggaacatggccgcttccggtctccctcccgggccggcgctggcctgactgcggccccggtccgtagcactccgccctccgcttctcccgccctgtagccgcgaagactgcttcagcctttccctgtgctgcccctgccgcgcgatggagacgagctcgagctgcgagagtcttggctcccagccggcggcggctcggccgcccagcgtggactccttgtccagttaatgtgttaagagccattgacatttgaagatcatcagaagtgaagataaaacatctcaaaaattataattgcctccacttctcattcagagaattcagtgcatacaaaatcagcttctgttgtatcatcagattccatttcaacttctgccgacaacttttctcctgatttgaggagggagtctcgctctatcccctaggctggagtgcattggcgccatctcggctcatttgcaacctctgtctcccgggttcaagcgattctcctgcctcagcttcccgaggagctgggattacaggtcctgagggagtctaacaagttagcagaaatggaagaaccacccttgcttccaggagaaaatattaaagacatggccaaagatgtaacttatatatgtccattcactggcgctgtacgaggaactctgactgtcacgaattataggttatatttcaaaagcatggaacgggatcccccatttgttttagatgcttcccttggtgtgataaatagagtagaaaaaattggtggtgcttctagtcgaggtgaaaattcttatggactagaaactgtgtgtaaggatattaggaatttacgatttgctcataaacctgaggggcggacaagaagatccatatttgagaatctaatgaaatatgcatttcctgtctctaataacctgcctctttttgcttttgaatacaaagaagtattccctgaaaatgggtggaagctatatgaccctcttttagagtatagaaggcagggaattccaaatgaaagctggagaataacaaagataaatgaacgatatgaactttgtgatacataccctgccctcctggttgtgccagcaaatattcctgatgaagaattaaagagagtggcatccttcagatcaagaggccgtatcccagttttatcatggattcatcctgaaagtcaagccacaatcactcggtgtagccagcccatggttggagtgagtggaaagcgaagcaaagaagatgaaaaataccttcaagctatcatggattccaatgcccagtctcacaaaatctttatatttgatgcccggccaagtgttaatgctgttgccaacaaggcaaagggtggaggttatgaaagtgaagatgcctatcaaaatgctgaactagttttcctggatatccacaatattcatgttatgagagaatcattacgaaaacttaaggagattgtgtaccccaacattgaggaaacccactggttgtctaacttggaatctactcattggctagaacatattaagcttattcttgcaggggctcttaggattgctgacaaggtagagtcagggaagacgtctgtggtagtgcattgcagtgatggttgggatcgcacagctcagctcacttcccttgccatgctcatgttggatggatactatcgaaccatccgaggatttgaagtccttgtggagaaagaatggctaagttttggacatcgatttcaactaagagttggccatggagataagaaccatgcagatgcagacagatcgcctgtttttcttcaatttattgactgtgtctggcagatgacaagacagtttcctaccgcatttgaattcaatgagtattttctcattaccattttggaccacctatacagctgcttattcggaacattcctctgtaatagtgaacaacagagaggaaaagagaatcttcctaaaaggactgtgtcactgtggtcttacataaacagccagctggaagacttcactaatcctctctatgggagctattccaatcatgtcctttatccagtagccagcatgcgccacctagagctctgggtgggatattacataaggtggaatccacggatgaaaccacaggaacctattcacaacagatacaaagaacttcttgctaaacgagcagagcttcagaaaaaagtagaggaactacagagagagatttctaaccgatcaacctcatcctcagagagagccagctctcctgcacagtgtgtcactcctgtccaaactgttgtataaaggactgtaagatcaggggcatcattgctatacactcttgattacactggcagctctatgagtagaaagtcttcggaatttagaacccatctatgagagaaagttcagtcactttatttattttaaatctctctaggatgagtttagaactgtagcagtgcaggtggcttaagtgaagtaactccatatgtaattacatgattatgatactaatcttttaagtatccaaagaatattaaaatacttcaatcctggattcacagtgggaacaagtttctattaaaaggcaaatgctgttacaaatttttggcatctggtaatattaaaaccattttagaaatacactctgtgctcactgtgcagaggaacatcagttttcaaaccaacactgaaattctgtggcatcacatatattgggccttgatgtcatgacagatcaaaatcatttgatatccctttctccattctaggtttttctttttttcagtaactgatttaccttgatcacttttcaacttccatattcttcatatagtaaaaggcaaagtgttgaagatactacggtgtggtagtagttgaaaattattgccgtcattatttacatacttaagacatattagcaagttgatccaaaatgggaggccttatagatgtgcttgggggaaaatgaaggggagaaagtagccatacaggagttcaaagaattccatgcccttcagattagcccaattaccagaaacatcatgaaagatattttaaaaactaattatttactacagtgtatttcacttgtcttgtgtgtctgaacacacagaagctaattagcaagtttttaagaagtatttaaaaatcttactaggattgacattttttctgaattctgtataaatagcttatagtgagaagtactgtgctcaaattttacatttttttcctttgcaaattctgtaatttcactcaacgattaagtctaccaaagaacacactgcatgtaaaagatgtattacaatctcaaagccagtaaaagaaatcttgcttcactgttcacctgctacaagtaagagtttggtgctggtagaaacatttgactctgatgtctattttattctacataagagccatatgtaatgtactgtaacaaaggagcttcttgtccccttggtcttttaattaaaagaaattccaactgactttta
